United States Patent 8,067,671 (METHODS FOR GENETIC CONTROL OF PLANT PEST INFESTATION AND COMPOSITIONS THEREOF) - sequence listing, part 49

SEQ ID NO: 119650 - protein, 214 aa, Heterodera glycines
  Coding regions on vcDNA: vcDNA=SeqID_46073; Strand=+; Position=1 -111,154-332,381-491,536-617,846-1006
  Homolog annotation: Hit_ID=NP_741529.1; Match level="QueryCoverage =75%, HitCoverage=35%, E-value=2e-45, Identity=53%"; Hit description =adenylosuccinate synthetase, possibly N-myristoylated (50.2 kD) (5F298) [Caenorhabditis elegans] gb|AAM29
  Essential gene: C elegans homolog=C37H5.6a; Phenotype =Emb,Gro,Pvl,Stp,Unc
IDIVARCQGGNNAGHTVLANGREYHFHLLPSGLASEKVLNIVGNGVVVNLDALFEELESNKIEDSADRLFVSDSAHLVLPVHIATDIMRENALGQNSKLGTTKRGIGPAYSSKCFRNGIRLGELLNQPEKFEQNYRSLVAHFKTLFPDIELDTESDVKQLKVPIRSSLRPIPPSAVASPALAFRRQPSVASSAWSKPTKRVSAPVHSRLNCLTP

SEQ ID NO: 119651 - protein, 294 aa, Heterodera glycines
  Coding regions on vcDNA: vcDNA=SeqID_46074; Strand=-; Position=1 -242,292-458,528-556,611-741,828-1031
  Homolog annotation: Hit_ID=CAE73448.1; Match level="QueryCoverage =92%, HitCoverage=80%, E-value=4e-56, Identity=48%"; Hit description =Hypothetical protein CBG20897 [Caenorhabditis briggsae]
  Essential gene: C elegans homolog=D2024.3; Phenotype=Gro
FWCSFISPVRNQLIACSLISFAGIHYLKWWMRDRKPFELRNFLVFWNAGLAIFSTFGALRFSEEFLYVMKNRSFQDSVCLSISPTQPAALWAFLFSFQDSVCLSISPTQPAALWAFLFSLSKVAEFGDTVLLVLRKRPLIFLHWFHHSVVLIYSWHWHSATELTAAGRWFIQLNYSVHAIGRWFIQLNYSVHAIMYTYYTFASLGIRFPKWVSMTVTTLQTTQMLIMLIGVFISLYVARLKLFSSRPTVCQQSVENMCICFSIYTAFAFLFIRFFVNSYLLGKKPTAAKAVAKK

SEQ ID NO: 119652 - protein, 252 aa, Heterodera glycines
  Coding regions on vcDNA: vcDNA=SeqID_46075; Strand=+; Position=1 -231,278-425,482-776,821-903
  Homolog annotation: Hit_ID=H89152; Match level="QueryCoverage=99%, HitCoverage=48%, E-value=5e-73, Identity=53%"; Hit description =protein C24B5.2 [imported] - Caenorhabditis elegans
  Essential gene: C elegans homolog=T01G9.5a; Phenotype=Emb
MSLLKSVDSKLGDEILTTIVETTDIRLDDIEGNAMAKLALEESVVLPALNPKLFTGLRAPCTGILLFGPPGNGKTMLAKAVANECNSTFFSISAATIMSKWVGDGERLVKALFQVARNAQPSIIFIDEVDSMLCQRFEQEDGAARRVKTEFLVQLDGCSSEKKANGHVLVLAATNRPQELDEGILRRFPQRIFIDLPDKKARFQMIRRTFELNSTNLQIEDAELEKIATMTDNYSYSDLKALCRAAAKFPVQ

SEQ ID NO: 119653 - protein, 371 aa, Heterodera glycines
  Coding regions on vcDNA: vcDNA=SeqID_46076; Strand=-; Position=1 -198,501-632,937-1217,1652-1794,2033-2190,2587-2790
  Homolog annotation: Hit_ID=CAE57200.1; Match level="QueryCoverage =99%, HitCoverage=89%, E-value=1e-139, Identity=62%"; Hit description= Hypothetical protein CBG00050 [Caenorhabditis briggsae]
  Essential gene: C elegans homolog=K02A4.1; Phenotype=Emb,Lvl
FKHKDLSIVRATAGQMQPKPLGTVDLKFGHHFSDHMMEVDWSDTAGWNQPEISPLHSVQLHPGAKVLHYAIELFEGMKAYRGIDDRIRLFRPEMNIARMKRTAARAALPDFDAEEMLKVIAELVRLDREWVPYSASSSLYIRPTLIGTDPTLGVAHSRTAKMFILTGPVGTFFPTGFKSISLFADPSYARAFPGGVGAYKMGCNYAPTLLIGKHAHDLGYQQVLWLTGPDEKITEVGAMNIFIYWRNECGELELVTPPLNDGLILPGVVRDSVLSIAREWGEFRVTERYPTMAELRRALHERRLLQMFGCGTACVISPIGRIAYVERGTGRIDELHIPTMASKATVMQRMYDTINDIQYGRMDRPDWVRIV

SEQ ID NO: 119654 - protein, 209 aa, Heterodera glycines
  Coding regions on vcDNA: vcDNA=SeqID_46077; Strand=+; Position=1 -43,91-225,301-386,475-580,891-1147
  Homolog annotation: Hit_ID=NP_497893.1; Match level="QueryCoverage =99%, HitCoverage=30%, E-value=1e-39, Identity=39%"; Hit description =evolutionarily conserved G-patch domain containing (92.6 kD) (3F501) [Caenorhabditis elegans] emb|CAA8362
  Essential gene: C elegans homolog=R07E5.1; Phenotype=Unclassified
MVYGTPFEKLEDEGRNAISKRPKGIQEEIVTDERGKRRFHGAFTGGFSAGYFNTAGSKHGWVPQTFKSSREDRADKVQNTAEDFMDEEDLGEFGIAARKLRPKMDFIDSLMATPGEKCLLAWELIDSREAGRHGQFDEEAVLEVEEQLRSHFPIEFSPDDVSMVELSAKENVHGLGYKPLAEGAVLSQKYGVMESALKITKKSKGIRGQ

SEQ ID NO: 119655 - protein, 150 aa, Heterodera glycines
  Coding regions on vcDNA: vcDNA=SeqID_46078; Strand=+; Position=1 -55,100-230,276-327,374-588
  Homolog annotation: Hit_ID=AAH20086.1; Match level="QueryCoverage =90%, HitCoverage=79%, E-value=2e-38, Identity=53%"; Hit description =RNA binding motif protein 8a [Mus musculus] gb|AAH58376.1| RNA binding motif protein 8a [Mus musculus] gb|
  Essential gene: C elegans homolog=R07E5.14; Phenotype=Emb
MEGVVLEETMEENVMDTELDDLKKGAAVKRGRGFEGSQKSAVQVYETLDEEGSVGGPQRSVEGWIVFVTNVHEEAQEDEVKDLFKEFGNVMNMHLNLDRRTGYFKGYTIVQYESQEEAAEAIAGLNGYDFLGQELRVDWCFVKGGRERKR

SEQ ID NO: 119656 - protein, 90 aa, Heterodera glycines
  Coding regions on vcDNA: vcDNA=SeqID_46079; Strand=+; Position=1 -201,246-317
  Homolog annotation: Hit_ID=CAE71150.1; Match level="QueryCoverage =91%, HitCoverage=36%, E-value=3e-19, Identity=53%"; Hit description =Hypothetical protein CBG18006 [Caenorhabditis briggsae]
  Essential gene: C elegans homolog=T04A8.11; Phenotype=Lva
QEVNEKLVDKQFAIWRVDAPWLPRVRRPPSTKKGGGKGPIHHYETPVRTGRVILELGGYITEQEVMAARSILMHLYLHMPFPEEICQPRT

SEQ ID NO: 119657 - protein, 232 aa, Heterodera glycines
  Coding regions on vcDNA: vcDNA=SeqID_46080; Strand=-; Position=1 -165,212-591,1122-1274
  Homolog annotation: Hit_ID=NP_502088.1; Match level="QueryCoverage =92%, HitCoverage=27%, E-value=1e-70, Identity=59%"; Hit description =suppressor of var1 3-like 1 (81.2 kD) (4L917) [Caenorhabditis elegans] emb|CAA97429.1| Hypothetical prote
  Essential gene: C elegans homolog=C08F8.2; Phenotype=Gro,Stp
QSVDSLYPFFVKHARCVFPHLECLKELQVISDLTQPHNWYPLAREINRKIIFHAGPTNSGKTYEALEHFKKAKSALYCGPLRLLAYEVYMKMNEAGKTNVVKGIEKRCLYFIGIPCDMITGENRLFAVDSDNPSAHTSATIEIMSPEHRIELCVIDEIQMLRDPQRGAAWTRALMGAPADEIHLCGEESAYDIVCRLLDPIGEHVDLRRYERKGKLVVIVTHGLRDLSLTKV

SEQ ID NO: 119658 - protein, 257 aa, Heterodera glycines
  Coding regions on vcDNA: vcDNA=SeqID_46081; Strand=-; Position=1 -84,137-256,339-368,501-675,785-1017,1079-1207
  Homolog annotation: Hit_ID=EAL28735.1; Match level="QueryCoverage =94%, HitCoverage=10%, E-value=1e-37, Identity=37%"; Hit description =GA15452-PA [Drosophila pseudoobscura]
  Essential gene: C elegans homolog=C13F10.4; Phenotype=Lva
MYEKLGRMVGRSYEETFQSLAKWMKSAESSARVEIWHTMAKMVKGLGAGAFPIYKEIYKSLAKSLADRVLSVRAAAAKCLVSLVAEPDSPLFAQFDLESMCTLCIKSLNCANFEVRQAIAQVFAKMAARVAAQTKQIGSKSLGQLATSVSSPAGGPSLGPCGSKQTAGTLEDILRCLANGMQRGGVGGFLKTAAKTATGYNPRGQRETRIGIAEAYVAMAHELGPRWLKKNIPFWSKHLLELVAKCATDPPNAKQSV

SEQ ID NO: 119659 - protein, 207 aa, Heterodera glycines
  misc_feature (188)..(188): Xaa can be any naturally occurring amino acid
  Coding regions on vcDNA: vcDNA=SeqID_46082; Strand=+; Position=1 -130,346-398,458-503,547-695,937-972,1023-1123
  Homolog annotation: Hit_ID=NP_499603.1; Match level="QueryCoverage =96%, HitCoverage=49%, E-value=7e-73, Identity=69%"; Hit description =Ser/Thr protein phosphatase, protein phosphatase (37.4 kD) (pph-4.1) [Caenorhabditis elegans] emb|CAA2209
  Essential gene: C elegans homolog=Y75B8A.30; Phenotype =Reproductive,defect
MIFSVLQVPDTNYLFLGDFVDRGFYSVETFLLLLALKVRYPDRMMLIRGNHESRQITQVYGFYDECFRKYGSAVVWFYDECFRKYGSAVVWRCCTEVFDCLRCCTEVFDCLSLSAVINGRIFCVHGGLSPSIETIDQIRTIDRKQEVPHDGPMCDLLWSDPEEESVGYGVSPRGESVGYGVSPRGAGXLFGSDVVKTFCEKNGIDMI

SEQ ID NO: 119660 - protein, 101 aa, Heterodera glycines
  Coding regions on vcDNA: vcDNA=SeqID_46083; Strand=+; Position=1 -125,173-354
  Homolog annotation: Hit_ID=CAE68064.1; Match level="QueryCoverage =100%, HitCoverage=18%, E-value=1e-31, Identity=65%"; Hit description= Hypothetical protein CBG13686 [Caenorhabditis briggsae]
  Essential gene: C elegans homolog=Y116A8A.9; Phenotype=Emb
LTRSKKLLATINKNFGTLAFCRRWLDRLGETKYLMSLRDLCEKDIVAPYPPLCDQVQSPWQINAFFTCFTFLQKGCYTAQWEHTILLRPTCKEVVSRGEDY

SEQ ID NO: 119661 - protein, 101 aa, Heterodera glycines
  Coding regions on vcDNA: vcDNA=SeqID_46084; Strand=-; Position=1-528
  Homolog annotation: Hit_ID=CAE68064.1; Match level="QueryCoverage =100%, HitCoverage=22%, E-value=2e-43, Identity=78%"; Hit description= Hypothetical protein CBG13686 [Caenorhabditis briggsae]
  Essential gene: C elegans homolog=Y116A8A.9; Phenotype=Emb
TSHYMKNYDLHEEHIPLRLTRSKKLLATINKNFGTLAFCRRWLDRLGETKYLMSLRDLCEKDIVAPYPPLCDQKGCYTAQWEHTILLRPTCKEVVSRGEDY

SEQ ID NO: 119662 - protein, 575 aa, Heterodera glycines
  misc_feature (538)..(538): Xaa can be any naturally occurring amino acid
  misc_feature (545)..(545): Xaa can be any naturally occurring amino acid
  Coding regions on vcDNA: vcDNA=SeqID_46085; Strand=+; Position=1 -1711,2437-2462
  Homolog annotation: Hit_ID=NP_500227.1; Match level="QueryCoverage =97%, HitCoverage=54%, E-value=2e-83, Identity=33%"; Hit description =predicted CDS, reverse transcriptase like family member (4D351) [Caenorhabditis elegans] gb|AAK68554.1| H
  Essential gene: C elegans homolog=ZK250.3; Phenotype=Clr,Lvl,Sck
KRENNIISSGQKALTNYVKKIKSKKLNSLLIDNSGNICFDEKEKCKLLAETFQKVFIKNNQIFDYSENNSPREKLSDIEINVGIVWNLLRKLPGCSTSPDNLPYILLKNCSETLAVILCDIFRLTLDSGQIPKIWRTSIIVPIYKKGEKSNPENYRPISLTSTVCRVFERILAKKITEFLNKNNFFANEQFGSLKNRSTTTQLLQTLNVFYEAIQNQKEVDVIYIDFSKAFDSVPIDLLLAKIKNAGIVGKILMFLRNFLLQRSFRVKIEDYYSESYILIHGVPQGSVLGPLLFLIFINDLPANIPKNVKIKMYADDVKLYIFHQNDSNTNDLSEAIKILEKWAKSNGLEISVEKSQTLHIGKNNSKKEYFLNGKIIPSVEKVKDLGVIIDSKLSFAEHINKIVKNAYLKAYHILRIMKTRELKTIIRMYKTYVRPQLEYAVEIWNPNLKKDIERIEKVQKFFTRKAFKNADFYIDHIQKDLKFVSIELDERRNIDDLTTAFKIMKGFTNLDASNFTYSIDLLVGHYFESAAHNRKKXEIFLTVXPRIGIIYQLFQFSQIRQINSGLGKFRKHSA

SEQ ID NO: 119663 - protein, 276 aa, Heterodera glycines
  Coding regions on vcDNA: vcDNA=SeqID_46086; Strand=+; Position=1-828
  Homolog annotation: Hit_ID=NP_510671.1; Match level="QueryCoverage =100%, HitCoverage=28%, E-value=1e-54, Identity=40%"; Hit description= predicted CDS, endonuclease/exonuclease/phosphatase family and RNA -directed DNA polymerase (XR69) [Caeno
  Essential gene: C elegans homolog=ZK250.3; Phenotype=Clr,Lvl,Sck
MERILSQNIYNFLLKNNKISEYQFGFVRNRSTTSQLITVVEDWYEAIINGKNVDCIYIDFQKAFDSVPHNLLLYKLEKIGIKGKLLMWIKGFLSNRTFRVKIGDSLSSSKKVTSGVPQGSVLGPLLFLIYINDLPDALPSGVKIKLYADDVKLYICYKARADTEIMHKALHNLFEWANKWQIKVSVQKTFVLYLGSKNPKETYKFDGNTINAVDTIRNLGVNIDNKLQFSDHVNKITRNAYLRMRSLFRIIKSKSSKIWITLYKTYIRPLLEYAPE

SEQ ID NO: 119664 - protein, 59 aa, Heterodera glycines
  Coding regions on vcDNA: vcDNA=SeqID_46087; Strand=-; Position=1-179
  Homolog annotation: Hit_ID=AAH17450.1; Match level="QueryCoverage =96%, HitCoverage=15%, E-value=2e-24, Identity=96%"; Hit description =Unknown (protein for IMAGE:3538275) [Homo sapiens]
  Essential gene: C elegans homolog=T25C8.2; Phenotype=Unclassified
LIARIQAGFAGDDAPRAVFPSIVGRPRHQGVMVGMGQKDSYVGDEAQSKRGILTLKYPI

SEQ ID NO: 119665 - protein, 78 aa, Heterodera glycines
  Coding regions on vcDNA: vcDNA=SeqID_46088; Strand=-; Position=1 -127,187-294
  Homolog annotation: Hit_ID=AAH74615.1; Match level="QueryCoverage =100%, HitCoverage=24%, E-value=2e-24, Identity=67%"; Hit description= Eukaryotic translation initiation factor 2, subunit 1 alpha, 35kDa [Xenopus tropicalis] ref|NP_001005630.
  Essential gene: C elegans homolog=Y37E3.10; Phenotype=Lva
MATLSCRFYADEFPEIDDPVMVKIDKIEEVGAYVTLSEYDNKEGMLQLSELSRRRIRSVNKLIKVGRSECVVVVRVEK

SEQ ID NO: 119666 - protein, 174 aa, Heterodera glycines
  Coding regions on vcDNA: vcDNA=SeqID_46089; Strand=-; Position=1 -175,248-313,355-464,610-780
  Homolog annotation: Hit_ID=CAE69521.1; Match level="QueryCoverage =63%, HitCoverage=21%, E-value=2e-21, Identity=50%"; Hit description =Hypothetical protein CBG15730 [Caenorhabditis briggsae]
  Essential gene: C elegans homolog=H10E21.3a; Phenotype=Emb
MVSPDFECRVCHAYATGHHFGAQSCQACCAFFRRSVVLKRNYLCQKLSKIGANCPIVYTEKVLCRSCRMVKCLTIGMNKNAVQLPEKRGGDHAKKGRAYFTKSGLLRNKRFANNAFGLCCDGLPTAPRRSADSPLSSAASAHSADCPSSSSASSSSASLTIHPSSTFDHSFSTS

SEQ ID NO: 119667 - protein, 71 aa, Heterodera glycines
  Coding regions on vcDNA: vcDNA=SeqID_46090; Strand=+; Position=1 -110,243-346
  Homolog annotation: Hit_ID=XP_312939.1; Match level="QueryCoverage =97%, HitCoverage=37%, E-value=1e-33, Identity=89%"; Hit description =ENSANGP00000014787 [Anopheles gambiae]
  Essential gene: C elegans homolog=W10D5.2; Phenotype=Emb,Lva
FVRWVISMGSCANGGGYYHYSYSVLRGCDRVIPVDIYVPGCPPSAEALLYGVLQLQKKIKRLKKVQMWYRK

SEQ ID NO: 119668 - protein, 122 aa, Heterodera glycines
  Coding regions on vcDNA: vcDNA=SeqID_46091; Strand=-; Position=1 -78,1115-1213,1499-1690
  Homolog annotation: Hit_ID=NP_508844.1; Match level="QueryCoverage =95%, HitCoverage=37%, E-value=1e-44, Identity=69%"; Hit description =calumenin-like protein precursor (36.1 kD) (XF588) [Caenorhabditis elegans] gb|AAB04578.1| Hypothetical p
  Essential gene: C elegans homolog=M03F4.7a; Phenotype=Lva,Lvl,Unc
MDLNSDGQVDELELREHINFMQKRYVVADYNSDGKMDRTEYGCFMHPEDCDHMRDIVVQETVEDIDKDKDGFVDMAEYFGDMYRPDDYPGLKGKEPEWVESEREMFREHRDKDKDGKLNKAR

SEQ ID NO: 119669 - protein, 1122 aa, Heterodera glycines
  misc_feature (841)..(841): Xaa can be any naturally occurring amino acid
  misc_feature (850)..(850): Xaa can be any naturally occurring amino acid
  misc_feature (1117)..(1117): Xaa can be any naturally occurring amino acid
  Coding regions on vcDNA: vcDNA=SeqID_46092; Strand=-; Position=1 -126,170-331,381-455,539-761,805-929,979-1083,1130-1278,1334 -1532,1649-1901,2024-2137,2337-2411,2460-2567,2615-3130,3186 -3385,3438-3648,3702-3840
  Homolog annotation: Hit_ID=A35075; Match level="QueryCoverage=96%, HitCoverage=96%, E-value=0.0, Identity=45%"; Hit description=kinesin heavy chain - longfin squid sp|P21613|KINH_LOLPE KINESIN HEAVY CHAIN gb|AAA29990.1| kinesin heavy chain
  Essential gene: C elegans homolog=R05D3.7; Phenotype=Dpy,Gro,Rup,Unc
MFFSNLFQFKVFCRVRPLNESEKKNSSTNIVKFQSKDTIVVGGKPYAYDHVFEPSGKPYAYDHVFEPSSNQEAVYSTAARHIVQDVLTGYNGTIFAYGQTSSGKTHTMEGVIGDSEKQGIIPRIVNDIFTHEGVIGDSEKQGIIPRIVNDIFTHIYNVDTEMEFLIKVDTEMEFLIKVSYFEIYNERIRDLLDITKTNLAIHEDKNRIPFVKNITEMFVTNPDEVLAYIEEGKTNRQVAVTNMNEHSSRSHSVFQIQVQQDNVAVTNMNEHSSRSHSVFQIQVQQDNKTTLKKLTGKLYLVDLAGSEKVSKTGAEGAVLEEAKNINKSLSAKVSKTGAEGAVLEEAKNINKSLSALGNVISALAEGTKSHVPYRDSKLTRKSHVPYRDSKLTRILQESLGGNSRTTIVICCSPASYNEGETKSTLLFGQRAKTIAKTIKNVVVVNEELTAEEWKRRYERDEKVTRLRQQAQQMEQELRRWRAGDRVSESDWADLSANMQSEPPSTTQQPLLSSREGPIVDEERRKYEEERSKLYAQLDEKDDEIQVQSQMAESLKQQLMEQEKEIKQQRQDKDTLMAELQKAQEQVNKTHEEGEELFSAIQELALNLDQKKAECTQLVTDNERLADDISKKNLESTLINTKKRVYDSIQSMVKEMADLGETNFAFSMQTDLADKNMQTDLADKNKPIDDETLTHARISISKLASDFRANRQKLSLLETGTDDTMKKLDDKLSLLETGTDDTMKKLDDVTKELADCRLQIQQMDAKNKSLRETIDGQEKQKRQLENELDGLNAKLANAKNSLGRRQQRTAAAASEAGDAAQGPDRTEEQSDQTVDGEFWHKXRRHFIGLIXESLQELELSREQLQQDFERLKNDETEKEKRLKSLSALSDKREQAKQDLKGLEETVNKELQTLHNLRKVFVGLEETVNKELQTLHNLRKVFVQDLAQRMKKTPTGPEDEEFLSSPIQKQKIIFLENNLEQLTSVHKQLVRDNAELRCELPKLELVRDNAELRCELPKLEKRYRASSERIKSLEVALRETKENAMKDRKKYQYEVERIKEAVRQRNLARRGQIAKPIRPKPIRPGQHYGTSPCERSVLFPFAFGFLCLPPFAANPSSDXLFTDS

SEQ ID NO: 119670 - protein, 318 aa, Heterodera glycines
  Coding regions on vcDNA: vcDNA=SeqID_46093; Strand=-; Position=1 -208,249-576,761-862,912-1069,1281-1440
  Homolog annotation: Hit_ID=NP_495256.1; Match level="QueryCoverage =98%, HitCoverage=29%, E-value=4e-54, Identity=37%"; Hit description =transducin protein (103.2 kD) (2G563) [Caenorhabditis elegans] gb|AAK31492.1| Hypothetical protein F13H8.
  Essential gene: C elegans homolog=F13H8.2; Phenotype=Gro
IRSSFAGHRTGVNCIAFSADSLTLASGGKDSSIVVWDLVNESGICRLGGHKSTITHLQFAQRDRFLVSSSKDSQLKFWCLTTKSCFYTLASSSSEVYTFALIDDDRLLLVGNAEIELLVFELCWQGQDGWEDERTERNEENEDEGEKRPRTTLVGHDQLLLLDSVEKGDAFDTEQQANRILRCIKRGALIRQAKGRALQLAVSSDEAIVCCVGSDSMLDIYRSIGSICYSFTFLLRHFTVEESKKRYQKKLRKLRLRADSQPMESEKETNEAMESEVSRDVTTLITRIGDFRADSKLKWVDLCEGFAELNNKNVREYR

SEQ ID NO: 119671 - protein, 257 aa, Heterodera glycines
  Coding regions on vcDNA: vcDNA=SeqID_46094; Strand=-; Position=1-771
  Homolog annotation: Hit_ID=NP_508269.1; Match level="QueryCoverage =92%, HitCoverage=36%, E-value=6e-25, Identity=32%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MAFHKIDNDSVNSITNALDFFRIPPTNVSVSSSKVFELLPSNPLTDTPYHFKLHSSQNYIDLSKCYLLSEFRIRKENANGQLVDLAADEVAPIQLVGHTFIRNIKMSINGREVFNANSLMAYKSYFSHELSYSTAAKDSHLNAAGYYRDTGGVLEVGDGCTARRNLFVGSRTAQFIAKIDADLFNQPLYLINFCELDIEILPNDNDFVLITPPGVAAATRYHFEVVGLKMYVKKVSLMDGLALDIARKLELKPARYA

SEQ ID NO: 119672 - protein, 113 aa, Heterodera glycines
  Coding regions on vcDNA: vcDNA=SeqID_46095; Strand=+; Position=1 -126,211-426
  Homolog annotation: Hit_ID=AAO14563.2; Match level="QueryCoverage =77%, HitCoverage=15%, E-value=9e-31, Identity=71%"; Hit description =Hsp90 [Heterodera glycines]
  Essential gene: C elegans homolog=C47E8.5; Phenotype=Emb,Ste
MTFSHAAPVLFIMFAILSGQSGETFAFQAEMPLIINTFYSNKEIFLRELISNSSDALDKIHYQALTDPSQMESGKELFIKIVPNKADLVNNHKPGTEAFIEALQVLFFRLVNP

SEQ ID NO: 119673 - protein, 441 aa, Heterodera glycines
  Coding regions on vcDNA: vcDNA=SeqID_46096; Strand=+; Position=1-1326
  Homolog annotation: Hit_ID=NP_508269.1; Match level="QueryCoverage =98%, HitCoverage=66%, E-value=1e-43, Identity=26%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTCLQKISDSSPLAINSGLNIFSVPPTNVSVVRSFFRQVLPLATITQESPYLFRLYSDNLWTDLSRVYLYLEVSIEKPGANDKWVAIEDGDTHVSAIQGIGQTFVQQLKVTVGNTEVYDSGNLYPFKAYITNELSFPINAKKNFLGSTGYYHTVNQDDSTDEGFKERCKIFKGGKNAQFLSRLDFDLGNQELYLLNNLDLLFTIYKAKDVFLLQTLKANDSTKYRLTVHDVKIYAKMVEVQPSLNMSLYKTLEKQPATYAVRKTEIKSSFISVGRYEFEYNVFSATIPRRVTIALVGNSAFHGDYKLSPFMFEPFDLREISVHAGGVVYPAVPYKLNFSNDHFVSAFVDMYEALGMANSERSFDISMAQFKKGWTFFVIPLTSTLDDSCGFELLRSGTTNVRATFNSPIPLGGVEMIVLGEFDQMIMVDYNRHIVTDSKLG

SEQ ID NO: 119674 - protein, 224 aa, Heterodera glycines
  Coding regions on vcDNA: vcDNA=SeqID_46097; Strand=-; Position=1 -326,405-550,602-698,1099-1177
  Homolog annotation: Hit_ID=CAE69963.1; Match level="QueryCoverage =67%, HitCoverage=28%, E-value=5e-45, Identity=61%"; Hit description =Hypothetical protein CBG16356 [Caenorhabditis briggsae]
  Essential gene: C elegans homolog=T27B1.2; Phenotype =Bmd,Emb,Lva,Lvl,Unc
RTSSTPSAMGRPLPRPAKVRPISPKRGRPLLLVKGRPLPLASSASSIPTFCSTRLSSSSAKTSAASTSSSAAAKSQDRKRPYLCPTCDSRFGSKMELEEHQNSHTRIRPPRLKVCQSPPRLKVCQSRFNRRSTLWNHKRIHSDAKPFKCTVCQMQFKWKNSLKCHKEMHEMHLRKNELSQGTMPDTDSQLLTYATAAKKTMAQQTEEIAALPGTSTTPTSAATL

SEQ ID NO: 119675 - protein, 312 aa, Heterodera glycines
  misc_feature (3)..(3): Xaa can be any naturally occurring amino acid
  misc_feature (19)..(19): Xaa can be any naturally occurring amino acid
  misc_feature (310)..(310): Xaa can be any naturally occurring amino acid
  Coding regions on vcDNA: vcDNA=SeqID_46098; Strand=+; Position=1 -349,473-836,1341-1587
  Homolog annotation: Hit_ID=NP_495954.1; Match level="QueryCoverage =91%, HitCoverage=56%, E-value=1e-60, Identity=41%"; Hit description =acyltransferase 3 family (56.1 kD) (2J453) [Caenorhabditis elegans] emb|CAA92706.1| Hypothetical protein
  Essential gene: C elegans homolog=W07A12.6; Phenotype=Egl
CAXIALSIGIFYVVHKNEXFLSFHQQIAANCTGAQFFSFALLLNNWSRPNCFGYLWHFGLDWQCHLIAPFLLHLLFRRQSVGLIVVAVLIIGSMCLRAFKCVSNGICNKSDVDIPVVPLPMRQFVSVRPEHVSLVQMYMRPMTKCGPFLVGLLLGVFSVSHRFIAVKTQQKKLFCAGFCLAVGCVYGILPEYWYPNDGVTLYNTLYTASFRTLFACGIGLMMLSCLLSIKSRLIHRIFAVFARLTFSVALTHMPIVFLFTRITAFQETESPFSLIIALPPAILMSFTVATIFYCFIHWPISQIISRIIKXII

SEQ ID NO: 119676 - protein, 346 aa, Heterodera glycines
  Coding regions on vcDNA: vcDNA=SeqID_46099; Strand=-; Position=1 -45,541-666,1107-1360,1407-1569,1726-2028,2413-2562
  Homolog annotation: Hit_ID=AAK94490.1; Match level="QueryCoverage =67%, HitCoverage=27%, E-value=4e-26, Identity=32%"; Hit description =PAZ/Piwi domain protein [Heterodera glycines]
  Essential gene: C elegans homolog=F55A12.1; Phenotype=Emb
MRIVLSSRRSWRCLAKCAIPPLVFKRQVHNTAKSIHLWDSEYLDEAGIKLTTEPIALDISALFQEASQSGIAFMLCIHADGDDLAHHFIKKCERDYQIISQCVRAGTVRNVAAKQQRLTVDNILNKTNVKLGGINYNLPRSPFVTSTDMLIIGISTNHPGGGIGERPMAEAETLRSETLSVSSEESIVAGPPSVVGRARREEKVNIIESIVGKCVGYFKEVRGSLPRRVVIYRNGCSEGQFKMVLDINSFWCIIYFKILKFEVPLIQCALRSAGCDNVGLTLIVSNKLQNVRFFSKQVYIANEYAKRGRNLFNYYDAPRDMETFADLNQKLCLEHAGWIAPHRVNA

SEQ ID NO: 119677 - protein, 147 aa, Heterodera glycines
  Coding regions on vcDNA: vcDNA=SeqID_46100; Strand=-; Position=1 -195,475-567,843-889,937-1045
  Homolog annotation: Hit_ID=CAE72593.1; Match level="QueryCoverage =99%, HitCoverage=97%, E-value=3e-25, Identity=36%"; Hit description =Hypothetical protein CBG19782 [Caenorhabditis briggsae]
  Essential gene: C elegans homolog=Y87G2A.10; Phenotype=Gro
MNTYFSIFAQVRLYDNNAERDRIDNMAELYAMVNALECLEKVFSRDYIHAKEYTAECSKLLVQIKVALRLVPRMTIDEFFRSYYIQCPAALERIRESTLPDDFDAKLRVKSWHDKLQGMAAHEEITDEVARQVILEGNKNSYDDSLT

SEQ ID NO: 119678 - protein, 674 aa, Heterodera glycines
  Coding regions on vcDNA: vcDNA=SeqID_46101; Strand=+; Position=1 -263,310-345,392-577,620-701,748-838,892-1229,1285-1391,1966 -2200,2263-2418,2468-2499,2553-2721,2804-2965,3019-3186
  Homolog annotation: Hit_ID=CAE56141.1; Match level="QueryCoverage =97%, HitCoverage=56%, E-value=0.0, Identity=63%"; Hit description =Hypothetical protein CBG23754 [Caenorhabditis briggsae]
  Essential gene: C elegans homolog=R11A8.6; Phenotype=Emb,Gro,Stp
MICPVDNSGCFTDLVPDFKGLFVKDADKQIIKMLKEKGLLVKQEQHKHSYPFCYRSQTPLIYRAVPSWFIRVESLVDRLMTNNEETYWVPSFVRDKRFANWLRDARDWCVSRNRFWGTPINLWVSDDFQEMECPGSIDELERLTGTKVTDLHREKYNFGMSTIDHLQIPSKTGHGMLKRVTEVFDCWFESGSMPYAQQHYPFENSEVFEHNFPADFIAEGIDQTRGWFYTLLVISTALFDRPPFKNLVCNGLVLASDGSKMSKSKKNFPNPLDVVRKYGADALRLYLINSPVVRGENLRFQEEGVAEVSKQVLNPWFNAYKFLSTAMSIYESNDKQFELRSAGFSNVMDLWILSFTNSLIAFVRKEMKLYHLYAVVTPLVSYFETLTNTYIRLNRSRIKGTVAGASADDQMLALSTLSHVLLQITRLMAPFTPFFSEFMWQRLKPLIGDAAEKSVHFTMLPLAEAQFIDKVVERRVAAMRIVVEIVRTLRERKGISVKYPLKEMVVINRNQQFLDDLSSLREYILSECNVEEMTVSQDKQKYGVQLKAEPNFKVLGAKLKTNLKANQVTEVELEALLADGSLTVLGHELTTEEVTVSFTVNPGNATKSNDKWETATANSCVVMVNTTEDDSLLSRGFAREIINRVQKLRKQVLTVGQLQFSKIIFVMAGQIGRD

SEQ ID NO: 119679 - protein, 554 aa, Heterodera glycines
  Coding regions on vcDNA: vcDNA=SeqID_46102; Strand=-; Position=1 -197,243-390,483-629,696-777,828-949,1005-1198,1293-1404,1450 -1736,1872-1989,2040-2297
  Homolog annotation: Hit_ID=NP_491014.1; Match level="QueryCoverage =91%, HitCoverage=56%, E-value=1e-166, Identity=57%"; Hit description= cysteinyl tRNA Synthetase (crs-1) [Caenorhabditis elegans] gb|AAK68426.1| Cysteinyl trna synthetase prot
  Essential gene: C elegans homolog=Y23H5A.7a; Phenotype=Lva
IAKFETDLVQFKTRISQPDNGQSADVRTVLVRKLVESAKEVLSDWLDVTRGNTVTKHDIFAKLARKYENEFLCDMNALNVLEPDVLTRVSEYIPEIIDYVQQIIRNGYAYVSDGSVYFNTAQFASKPNHSYAKLLPEAYADAESAEKHLREGEGELSVAVDNLKEKRSPSDFALWKASKDGEPFWESPWGKGRPGWHIECSAMSGAICGDKLDIHAGGFDLKFPHHDNEIAQCEAYNDNDHWVNFFLHCGTLRIEGLKMSKSLKNFVTIREALNKYTARQLRLLFLMHNWTDNLDYSESTMEHAIHFEKCFCEFFLNVKDIIRKQIKEVDELSQCFKKYGEEEMEVLNKFNAIKVSVHLAMCDSIDTRAVLDKIRTIISLLNTYIMVRKQEEAVLNCQLLTKCANFVRELLCIFGVQPDVGKYEFFTKDCCATSDDREAIIMPYLEILAQFREVVRSEARAQKNIGILKECDRLRDEILPELGVRLEDHSKDTCVKLVDRETLIKEREQKEAAQREKEQRKIQLQKEKEMKRQAKEEQKRKTRETQQKNERENQ

SEQ ID NO: 119680 - protein, 248 aa, Heterodera glycines
  misc_feature (1)..(1): Xaa can be any naturally occurring amino acid
  misc_feature (233)..(233): Xaa can be any naturally occurring amino acid
  misc_feature (243)..(243): Xaa can be any naturally occurring amino acid
  misc_feature (245)..(245): Xaa can be any naturally occurring amino acid
  Coding regions on vcDNA: vcDNA=SeqID_46103; Strand=+; Position=1 -33,677-847,892-952,1044-1193,1274-1500
  Homolog annotation: Hit_ID=NP_500824.1; Match level="QueryCoverage =89%, HitCoverage=28%, E-value=2e-41, Identity=42%"; Hit description =feminization 1 homolog a, FEMinization of XX and XO animals FEM-1 (fem-1) [Caenorhabditis elegans] gb|AAA
  Essential gene: C elegans homolog=F35D6.1a; Phenotype=Stp
XTNNKYNTKTIVFKLAENGDSERLHTLNTLNTEQYLLNVKEPRENGRNMLIIAARNGHIKVVELLLKLGADPHETGTVTFDGEQITVVELLLKLGADPHETGTVTFDGEQITRVPPLWAAAAAGHLEVCKQLVARGVNVNQTTSTNSTPLRGACYDGNLDIVKFLVESGADIEIKFLVESGADIEIPNRHGHTALMIASYREKVEVVRYLLSVGAQTDRTSTKGFFCVLLFMXNLKIVIIIIXYXFHF

SEQ ID NO: 119681 - protein, 211 aa, Heterodera glycines
  Coding regions on vcDNA: vcDNA=SeqID_46104; Strand=+; Position=1 -104,402-546,977-1108,1234-1320,1367-1531
  Homolog annotation: Hit_ID=NP_491069.1; Match level="QueryCoverage =100%, HitCoverage=21%, E-value=2e-60, Identity=50%"; Hit description= coatomer (137.7 kD) (1D464) [Caenorhabditis elegans] gb|AAF36010.2| Hypothetical protein Y71F9AL.17 [Cae
  Essential gene: C elegans homolog=Y71F9AL.17; Phenotype=Gro,Ste
MVFKTERERPPHCVHDNLAFYVKERQLRRLDMNTSKDVALAQVKLNKLTQPYYSLHYNPAENCFLLVTRPAANIENSTYDLYKVEYTGAVDDIFYAGTGLLLLKNADSVQMYDLQQKRVLASVKATKVKYVIWSKNMECAALLSKHTVTLVTKRLEVLGTVQESTRVKSGAWDAGNEAFLYTTSNHIKYALTTGGDHGIIRTMDIPRYILA

SEQ ID NO: 119682 - protein, 408 aa, Heterodera glycines
  Coding regions on vcDNA: vcDNA=SeqID_46105; Strand=+; Position=1 -172,217-346,395-722,906-1070,2381-2417,2468-2862
  Homolog annotation: Hit_ID=CAE59203.1; Match level="QueryCoverage =99%, HitCoverage=90%, E-value=1e-56, Identity=42%"; Hit description =Hypothetical protein CBG02514 [Caenorhabditis briggsae]
  Essential gene: C elegans homolog=ZK1248.14; Phenotype=Emb,Gro
MAATINHISASNGNDQKRRHLASGNEPLQRFGEAKKWMTDIYGQLDGHVGELLEFYLGLVKNGQKFVPPAQIDEIGHFRDSVRAIREVIGRDKMKVVFFGRTSNGKSSVINAMLSCRVLPQGMGHTTCCFLQVEGGSEQDKYFMMEDGAKHFPIAELDSVGHALGSEGMGSLGRDSLIHIFYPKSASKLLQNDVLIVDRYKIMANLTISLEKNFFIRVSKKLSRPNIFILCNRWDASATETDESRAQIRAQHEQRFEDFLANELKRMNVLSRQGHNDGARIGHGQQRPDKREVDAFLSNIVVQSATYLMNGSVGVTIAGLVIYKNVDWRWVVGGVGLVAGLYAFERLRWNNGAKEERLKTQFRQHLEQRHSIRFHLFENKLKFSLHQTESIHTSSCEQQVTRELDQVN

SEQ ID NO: 119683 - protein, 146 aa, Heterodera glycines
  Coding regions on vcDNA: vcDNA=SeqID_46106; Strand=+; Position=1 -57,535-735,783-930
  Homolog annotation: Hit_ID=XP_316229.1; Match level="QueryCoverage =92%, HitCoverage=33%, E-value=3e-34, Identity=53%"; Hit description =ENSANGP00000017049 [Anopheles gambiae]
  Essential gene: C elegans homolog=F40H3.5; Phenotype=Unclassified
VQCRPNSVSPSAFNSNWHFSVAERRLPDCLIIGVRKGGTRALLDALALHPRIRVARHEVHFFDRTELFRHGIEWYRKQMPLAKTDEVVVEKTPAYFVVVEKTPAYFTSPAVPKRVHSLNPGMKMILIVREPVTRTISDFTQAKNDF

SEQ ID NO: 119684 - protein, 308 aa, Heterodera glycines
  Coding regions on vcDNA: vcDNA=SeqID_46107; Strand=-; Position=1 -115,167-223,324-413,456-529,739-892,951-1119,1189-1271,1358-1403
  Homolog annotation: Hit_ID=NP_509594.2; Match level="QueryCoverage =98%, HitCoverage=22%, E-value=2e-59, Identity=43%"; Hit description =GTPase Activating Protein (127.8 kD) (gap-2) [Caenorhabditis elegans] emb|CAA86036.1| Hypothetical protei
  Essential gene: C elegans homolog=ZK899.8a; Phenotype=Ste
FRRRMNPQIDRVHRVDNFLSIWVLEAKGVPAKRRFFCELSLDGQLKARTSLSLDGQLKARTSTKVREKRCFWGESFEFGSLPPSRLLCIDLFRELDAKKDRQTLIGLVHIPLAELDRQTLIGLVHIPLAELAGRQPVEKWYSVSSNELNGNGSSGASTNANCADSLPSIRIKARYQSVHIFPLRAYAPLREYLRLHFLPLYLRLHFLPLCATFEPILGVKAKEDFASALVRVLQHERRAAEALADLAMVEVDGQENDHLLFRGNSLHLLFRGNSLATKAVEAYMKLVANDYLQSVLGDFIRHLLATNL

SEQ ID NO: 119685 - protein, 173 aa, Heterodera glycines
  Coding regions on vcDNA: vcDNA=SeqID_46108; Strand=-; Position=1 -107,159-310,460-722
  Homolog annotation: Hit_ID=CAE57948.1; Match level="QueryCoverage =90%, HitCoverage=98%, E-value=2e-33, Identity=42%"; Hit description =Hypothetical protein CBG01005 [Caenorhabditis briggsae]
  Essential gene: C elegans homolog=R53.4; Phenotype=Emb,Lva
MIVKPVKNFFQKNVTKVWLKPPPHDTFIEPWFPYALILKPIGRAFQRLGVYTYNNFIARTTFGLYPREWNPRVHGPYVHYRYYGTNNDIPLMEVKVNDLAAYIARRDKSPRAIWREFMRNFYKLQYFYFSGPEFGNPLTMIWRYLVIFIVGFFLTLRVVTGADTRFRHALYHW

SEQ ID NO: 119686 - protein, 360 aa, Heterodera glycines
  Coding regions on vcDNA: vcDNA=SeqID_46109; Strand=+; Position=1 -311,372-639,696-939,993-1158,1208-1301
  Homolog annotation: Hit_ID=CAE67252.1; Match level="QueryCoverage =85%, HitCoverage=78%, E-value=7e-43, Identity=36%"; Hit description =Hypothetical protein CBG12692 [Caenorhabditis briggsae]
  Essential gene: C elegans homolog=C55B7.3; Phenotype=Emb
MSGAGSGRQKRGKTEAPRRPTRRSTQQTRQADTQQQQRRAPATQEQSVLAPQPTLRRWEDTAEFFFALERFVNDTTPRSVQDLVSEFTELNAAPRPEPSPEFTRNLECNRDRDVICTEINRVRLHSGRYIHANWISTFGENRFICTQGPLETTCDDFWTMIVQENIEGIVMLCDTIEQNRIKCHQYWPTADNKLMRFANNQIIVKFGREYHVEGALYRTDLIVGAPQMRQGHLRVQHFHWRQWPDRGVPHSDLAPLRLLYHVIGVPRAVVHCSAGIGRTGTLVAVYLANQTLHLGQPLNIFALIRDLRRQRSQSIQTLDQYLYIYFVILRYAQNKASKLNINVNALNALVQALNSTMRRG

SEQ ID NO: 119687 - protein, 218 aa, Heterodera glycines
  Coding regions on vcDNA: vcDNA=SeqID_46110; Strand=-; Position=1 -161,208-416,504-657,703-832
  Homolog annotation: Hit_ID=CAE72426.1; Match level="QueryCoverage =87%, HitCoverage=29%, E-value=2e-32, Identity=38%"; Hit description =Hypothetical protein CBG19592 [Caenorhabditis briggsae]
  Essential gene: C elegans homolog=F08D12.1; Phenotype =Dpy,Emb,Lva,Lvl,Unc
MSFEKAYAFYRKKNDTAALGVIRKLDGSVPRVMELKAQILYRMEQYQEALELFKKLIRTHSDEFDDIRRANLIAVKARLQSQGDSQELDLANLESFETMYNTSCHMIACQKFDDALRLLEKTAVECERSLNADGLGKEEIQQEMAPILAQKAFTLQKLDQKKEALKLYQNVLKTKALNWKLKAAIVENLEADYVKFGKKWRPMKSAHGDEEEPMEEDG

SEQ ID NO: 119688 - protein, 118 aa, Heterodera glycines
  Coding regions on vcDNA: vcDNA=SeqID_46111; Strand=+; Position=1 -180,230-329,706-781
  Homolog annotation: Hit_ID=NP_492601.1; Match level="QueryCoverage =93%, HitCoverage=83%, E-value=2e-31, Identity=54%"; Hit description =cytochrome C Oxidase, subunit Vb, LiPid Depleted LPD-4 (lpd-4) [Caenorhabditis elegans] emb|CAB03002.1| H
  Essential gene: C elegans homolog=F26E4.9; Phenotype=Lpd
MNRLLSGRSLLPKIMRNFSHSNRLAASEADPEHYGYFPDPTEQTWGLEREMLAARLKGEDRYSPKIYYRAEHSTKDVPNVVHVHLEDKVVGCLCEHDGDHVNYWHIRKGDTKRCECGH

SEQ ID NO: 119689 - protein, 408 aa, Heterodera glycines
  Coding regions on vcDNA: vcDNA=SeqID_46112; Strand=-; Position=1 -103,173-289,347-1353
  Homolog annotation: Hit_ID=NP_508269.1; Match level="QueryCoverage =91%, HitCoverage=58%, E-value=8e-38, Identity=27%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTTLKKIDTASEDGLEGGLSLFDIPPTNVAINKSNNQFCDLNKTFLYLSTSIERKDKSNWIPITKDSEADQHVGVESYDSGIYYAFRAYMMNELGFSEDVKKGLCEASCYYVDDVDQDDYTNSGFKNRASRFADGAKCETMVKLNFDLGRQPNLLLNNSDVIFSIHRNTDDFLIMAPPYVSGNAVIANPHTYRINIHDIRIYVKTVDITQSLNNVISNQLQTTSAKYPMRKIEIRSLFIPRGTSDLSHNVFTSIVPRRLIVGFVSTGAYTGNPKESPFVFEHAKIRSIGVEANGNIFPGSPYSLNFDRNKYIRAFVDMYTGLGMDDGERTMSINIQKFVNGWCFFVIPMTSTLEDTPGFELIRNGTTSIKVQFNEPIKDGGYEMIVLGEFDSILSINANRVLSSDGSI

SEQ ID NO: 119690 - protein, 273 aa, Heterodera glycines
  misc_feature (230)..(230): Xaa can be any naturally occurring amino acid
  misc_feature (270)..(270): Xaa can be any naturally occurring amino acid
  Coding regions on vcDNA: vcDNA=SeqID_46113; Strand=+; Position=1-838
  Homolog annotation: Hit_ID=NP_508294.1; Match level="QueryCoverage =97%, HitCoverage=23%, E-value=6e-35, Identity=29%"; Hit description =predicted CDS, endonuclease/exonuclease/phosphatase family and RNA -directed DNA polymerase (XC178) [Caeno
  Essential gene: C elegans homolog=ZK250.3; Phenotype=Clr,Lvl,Sck
DVIPSGVNIKLYADDVKISRTETEIMHKALHNLFEWANKWQIKVSIQKTFVLYLGSKNPKETYKFDGNTINAVDTIRDLGVNIDNKLQFSNHVNHITRNAYLRMRSLFRIIKSKSSKIWITLYKTYIRPLLEYAPEVWNPSLQKNIKKIEKCQKYFTKRVFFKCSLPPIPYQNRLEYLQLPTLEKRRKLFDLFMAHKIVYGRTDLDILKIFKPSERFNVPFYRLTQNINXAKNLFPAGRATKLWNQLDKEIIKINSLNQFKTKIKLLNVXNDR

SEQ ID NO: 119691 - protein, 89 aa, Heterodera glycines
  Coding regions on vcDNA: vcDNA=SeqID_46114; Strand=+; Position=1 -68,123-223,368-468
  Homolog annotation: Hit_ID=NP_490837.1; Match level="QueryCoverage =85%, HitCoverage=13%, E-value=2e-18, Identity=52%"; Hit description =predicted CDS, protein grainy-head (1B734) [Caenorhabditis elegans]
  Essential gene: C elegans homolog=Y48G8AR.1; Phenotype=Lva,Lvl
MIYVRKQGEEIFTPLHLVPPSLGGLARAVSEKYNLDESKIEAFYKQCQKGLTVKIDDDMLRHYTNQDTFQIELKQSELDRSVDNETGPR

SEQ ID NO: 119692 - protein, 147 aa, Heterodera glycines
  Coding regions on vcDNA: vcDNA=SeqID_46115; Strand=-; Position=1 -242,310-450,727-753
  Homolog annotation: Hit_ID=NP_510133.1; Match level="QueryCoverage =98%, HitCoverage=16%, E-value=5e-58, Identity=84%"; Hit description =synthetase (86.5 kD) (XN405) [Caenorhabditis elegans] emb|CAA90672.1| Hypothetical protein T22H6.2a [Caen
  Essential gene: C elegans homolog=T22H6.2a; Phenotype=Gro
SQVSELQQTGRQMLMVSSGAVAFGRQKLRQELVMSMSMRQTLRGPAGMQTDKRACAASGMPGLMSLYEQLFQQYGITVAQVLLTKPDIDDPVLLTKPDIDDPQRRKNLQATIESLLRLNIIPIVNANDAVAPDPKLNMKIWTFDFLF

SEQ ID NO: 119693 - protein, 163 aa, Heterodera glycines
  Coding regions on vcDNA: vcDNA=SeqID_46116; Strand=-; Position=1 -188,281-397,445-630
  Homolog annotation: Hit_ID=CAE60322.1; Match level="QueryCoverage =95%, HitCoverage=72%, E-value=2e-39, Identity=51%"; Hit description =Hypothetical protein CBG03913 [Caenorhabditis briggsae]
  Essential gene: C elegans homolog=F15H10.3; Phenotype=Emb,Ste
MSVGLSSIVDDSHQRQSHFWAEILPPGVGHPNDISGDAIWTLSSCKEGLGVHQLLNDREDTYWQSDGLQPHSITIEFQRKTEVDFLLMFLDYKLDESYTPSKIQVQTGASVLDLDEPKSLSFTEPSGWQMIDLRHAGTKRPANVFVIVVQIIQNHQNGRDTHI

SEQ ID NO: 119694 - protein, 124 aa, Heterodera glycines
  Coding regions on vcDNA: vcDNA=SeqID_46117; Strand=-; Position=1 -273,396-499
  Homolog annotation: Hit_ID=NP_001003411.1; Match level="QueryCoverage= 98%, HitCoverage=18%, E-value=8e-40, Identity=66%"; Hit description =DEAD (Asp-Glu-Ala-Asp) box polypeptide 18 [Danio rerio] gb|AAT68066.1| myc-regulated DEAD/H box 18 RNA
  Essential gene: C elegans homolog=B0511.6; Phenotype=Lva
LQNTSNFVVRNLKCLIVDEADRIFDIGFEQEMHQIVKLLPKKRQSMLFSATCSPKVDELVKTALKTDPLKIGVMEQQRDPNDMATVEGLEQGYVVCPSEKRFLLLFTFLKKKREQKVFMFFSFN

SEQ ID NO: 119695 - protein, 51 aa, Heterodera glycines
  Coding regions on vcDNA: vcDNA=SeqID_46118; Strand=-; Position=1 -44,104-340
  Homolog annotation: Hit_ID=BAB68543.1; Match level="QueryCoverage =90%, HitCoverage=13%, E-value=5e-18, Identity=84%"; Hit description =glyceraldehyde-3-phosphate dehydrogenase [Ascaris suum]
  Essential gene: C elegans homolog=K10B3.7; Phenotype=Unclassified
DFLGDSHSSIFDVGACISLNPHFVKLVSWYDNEFGYSCRLVDLITHCASKA

SEQ ID NO: 119696 - protein, 88 aa, Heterodera glycines
  Coding regions on vcDNA: vcDNA=SeqID_46119; Strand=-; Position=1 -54,254-334,381-512
  Homolog annotation: Hit_ID=NP_496838.1; Match level="QueryCoverage =71%, HitCoverage=71%, E-value=8e-10, Identity=48%"; Hit description =ubiquinone-binding protein like (10.6 kD) (2N782) [Caenorhabditis elegans] emb|CAB04384.1| Hypothetical p
  Essential gene: C elegans homolog=F45H10.2; Phenotype=Clr,Gro,Stp
MRLSLLRASEKHFGNLSKAYGWYYVRIAPVEQKVWKGFFFDAFVKPVKEQLPHWWMFFFPVVTYFLVTDWAKKEYRRLGRIKEFTDEE

SEQ ID NO: 119697 - protein, 159 aa, Heterodera glycines
  Coding regions on vcDNA: vcDNA=SeqID_46120; Strand=-; Position=1 -81,168-341,472-534,801-961
  Homolog annotation: Hit_ID=CAE67815.1; Match level="QueryCoverage =100%, HitCoverage=31%, E-value=4e-16, Identity=31%"; Hit description= Hypothetical protein CBG13395 [Caenorhabditis briggsae]
  Essential gene: C elegans homolog=M176.2; Phenotype=Emb,Lva
MAQFVPFTLYPSPFPRELFDQAMDVNKTLLLMYFRASLPSNFEFLKELHKSVLAVSPSLRYTADLIERKHKEGIRQPLMLICIRADYMASEEIDEKSNEKKYALKQIELNGGSIGGYGTPQPLTALHRRMLSNVGIDNSISVMPENLTSEMLATAMYRA

SEQ ID NO: 119698 - protein, 97 aa, Heterodera glycines
  Coding regions on vcDNA: vcDNA=SeqID_46121; Strand=+; Position=1 -63,562-682,922-1031
  Homolog annotation: Hit_ID=NP_495655.1; Match level="QueryCoverage =41%, HitCoverage=8%, E-value=8e-13, Identity=85%"; Hit description =dolichyl-diphosphooligosaccharide-protein glycosyltransferase (48.8 kD) (2I155) [Caenorhabditis elegans] e
  Essential gene: C elegans homolog=T09A5.11; Phenotype=Emb,Lva
MILMTASSTAYSHNPNKTVEERYEIGIEELQNGKWVPFQGKDVQLEFVRIDPFVRVTLKNNSLCPTIETHAIRTVQSLRLPLLCVRIFNDGWGEQIC

SEQ ID NO: 119699 - protein, 218 aa, Heterodera glycines
  Coding regions on vcDNA: vcDNA=SeqID_46122; Strand=-; Position=1 -352,657-756,868-953,1003-1120
  Homolog annotation: Hit_ID=NP_011780.1; Match level="QueryCoverage =54%, HitCoverage=16%, E-value=1e-31, Identity=54%"; Hit description =Mes1p [Saccharomyces cerevisiae] emb|CAA97293.1| MES1 [Saccharomyces cerevisiae] emb|CAA69086.1| methioni
  Essential gene: C elegans homolog=F58B3.5; Phenotype=Lva
MRYIECLERVGFVDIQVKDERTAGIGSDSDKLLQVVYEKIDKKGNPNGESNAREIQLIFARKPMLPLLEENWSNWAQFERQMAEETELRKLAEEDQDEVRQIAAGKTLRELEKELMEHFLWTDEEMVLIASALPYVNNVPHLGNIIWGPCNYCRMREYQSLFICGTDEYGTATEMKALSEGLTPRQLCDKFYELHKKTYDWFSIDFDFFGRTSNPNQT

SEQ ID NO: 119700 - protein, 101 aa, Heterodera glycines
  Coding regions on vcDNA: vcDNA=SeqID_46123; Strand=-; Position=1 -99,147-215,339-428
  Homolog annotation: Hit_ID=CAA04549.1; Match level="QueryCoverage =98%, HitCoverage=100%, E-value=6e-35, Identity=70%"; Hit description= Sr-mps-1 protein [Strongyloides ratti]
  Essential gene: C elegans homolog=F56E10.4; Phenotype=Lva
NEMPLAEDLLYPDPQKERQKHKLKRLVQHPNSFFMDVKCPGCYKITTVFMDVKCPGCYKITTVFSHAQTVVVCVGCSTVLCQPTGGKARLVEGCSFRKKGH

SEQ ID NO: 119701 - protein, 197 aa, Heterodera glycines
  Coding regions on vcDNA: vcDNA=SeqID_46124; Strand=+; Position=1 -42,175-298,372-418,511-552,593-649,693-827
  Homolog annotation: Hit_ID=NP_498280.1; Match level="QueryCoverage =100%, HitCoverage=57%, E-value=6e-44, Identity=45%"; Hit description= paxillin (3G980) [Caenorhabditis elegans] gb|AAA62294.1| Hypothetical protein C28H8.6a [Caenorhabditis e
  Essential gene: C elegans homolog=C28H8.6a; Phenotype=Lva
GDCASCNQAVIGPVVIALGKMWHPEHFCCAHCGDSIENRNFFERQGKAYCESDYHDLFSPRCSLFSPRCSYCNGPIKERRCVTALGGKNFHVEHFVCAECGKSFGDGHFVCAECGKSFGDGRFHEKSNSAYCRDCFYRTYAPKCQSCRFHEKSNSAYCRDCFYRTYAPKCQSCKQPITHKFITALNTHWHPECFCCQ

SEQ ID NO: 119702 - protein, 144 aa, Heterodera glycines
  misc_feature (117)..(117): Xaa can be any naturally occurring amino acid
  misc_feature (130)..(130): Xaa can be any naturally occurring amino acid
  Coding regions on vcDNA: vcDNA=SeqID_46125; Strand=+; Position=1 -226,397-531,1110-1184
  Homolog annotation: Hit_ID=XP_511009.1; Match level="QueryCoverage =100%, HitCoverage=54%, E-value=5e-25, Identity=46%"; Hit description= PREDICTED: hypothetical protein XP_511009 [Pan troglodytes]
  Essential gene: C elegans homolog=ZK1010.1; Phenotype=Emb
MIEIIILYVLFYSIIMRLCHRITAKKTTFIQIFVKTLGGMTLTIFAHSLDTIENVKAKIQDKEGIPPDQHRLIFCGKTLKDGQTIADYNIQESTLYLRLSLIGGARTRRQQAQEVAXGHSHLTAGALLAXRRALCSPDGGRIAR

SEQ ID NO: 119703 - protein, 210 aa, Heterodera glycines
  misc_feature (14)..(14): Xaa can be any naturally occurring amino acid
  Coding regions on vcDNA: vcDNA=SeqID_46126; Strand=+; Position=1 -111,505-649,703-804,1464-1571,1670-1779
  Homolog annotation: Hit_ID=NP_498417.1; Match level="QueryCoverage =90%, HitCoverage=71%, E-value=2e-39, Identity=43%"; Hit description =SET (trithorax/polycomb) domain containing (27.6 kD) (set-1) [Caenorhabditis elegans] gb|AAC77512.1| Set
  Essential gene: C elegans homolog=T26A5.7a; Phenotype=Emb
LKMPKKKNGTTDQXGCLLITNYFPIRRSKRITTKELEDIKLKELKELIDTGFNEDHLEVFRCSVKGRSVRASKCFQRGEFVVEYKGDLISVKTAQLREQRYAKDEDLISVKTAQLREQRYAKDENVGSFMYYFRHRDNVFCIDATDETPYKGRLINHSYLNNLKTRVFIIGRTFHLVLVAMRDIDNGEELLYDYGERRPSVLAVNPWILG

SEQ ID NO: 119704 - protein, 470 aa, Heterodera glycines
  Coding regions on vcDNA: vcDNA=SeqID_46127; Strand=+; Position=1 -169,212-486,558-660,703-814,872-950,1009-1184,1350-1621,1675-1715
  Homolog annotation: Hit_ID=NP_497837.1; Match level="QueryCoverage =97%, HitCoverage=33%, E-value=1e-148, Identity=58%"; Hit description= leucyl tRNA Synthetase (134.5 kD) (lrs-1) [Caenorhabditis elegans] emb|CAA86751.1| Hypothetical protein
  Essential gene: C elegans homolog=R74.1; Phenotype=Lva
PIKACADKLVREIEQFGNPPVFGYQSSEEIAKQEEEVDQIIKDKSKGKKSKALAKTVAAKFQWQIMQSKALAKTVAAKFQWQIMQSLGLNDAEIAEFSKSEHWLTYFPPKCMADLRKMGLAVDWRRAFITTEANAYFDSFVQWQFRKLRSENLIQFGKRYTYTIYSPKDGQPCMDHDRSTGEGVGPQEYTLIKMQILEPKPKVLSNVSEILEPKPKVLSNVSEPMFLVAATLRPETMYGQTNCFIHPDITYSVFFVGTNDFIHPDITYSVFFVGTNDQEIFIATERAARNMAYQGMTAAARNMAYQGMTAENGKIRFVPGVERVKGAELIGCALKAPLTSFERIYALPMLTIKDDKGTGIVTSVPSDAPDDFAALMDLKKKKPLREKYGILDEMVMPFEPIPILEIPEYGRLAAVHMCEKLGINSQNDRLKLEEAKKELYLKGFYQGVMLVENYHGSVMLVENYHGSEDG

SEQ ID NO: 119705 - protein, 203 aa, Heterodera glycines
  Coding regions on vcDNA: vcDNA=SeqID_46128; Strand=-; Position=1 -104,163-256,340-459,544-642,930-1032,1242-1332
  Homolog annotation: Hit_ID=AAQ84880.1; Match level="QueryCoverage =91%, HitCoverage=29%, E-value=2e-38, Identity=37%"; Hit description =flamingo-like protein FMI-1 [Caenorhabditis elegans]
  Essential gene: C elegans homolog=F15B9.7; Phenotype=Ste,Stp
MPENAPVRSVVVQVQAHNEADQSLFYAFGVSEDSRSTNLFSLDTVSGEIRLAKALDRETQPKHVLKRLDPSQLATVSVIVEVIDIQDNAPSFEKSTYIAEIREDAPIGTTVLSVFARDFDDGANGEVKYSLDNVKEAAEQSNGTACAVNVTEDAPVPSVILRPRARDADAGANADQSKGRRPTISFFDFAMLRHNNRRQRPFT

SEQ ID NO: 119706 - protein, 121 aa, Heterodera glycines
  Coding regions on vcDNA: vcDNA=SeqID_46129; Strand=+; Position=1 -134,272-392,434-542
  Homolog annotation: Hit_ID=XP_392645.1; Match level="QueryCoverage =98%, HitCoverage=80%, E-value=2e-17, Identity=40%"; Hit description =similar to ENSANGP00000023074 [Apis mellifera]
  Essential gene: C elegans homolog=R05D11.7; Phenotype=Egl,Gro
MAYSRSPSPNRERSHRSTRKRSRDRSNERRHKAPRSSHKERHRDRDRRGDRDRDRDRERERHSSGGDKNREHRSKKKDNVAHATKSNPINEIVDVDEDMMRMMGFSNFDTTKNKHVEGNAS

SEQ ID NO: 119707 - protein, 43 aa, Heterodera glycines
  Coding regions on vcDNA: vcDNA=SeqID_46130; Strand=-; Position=1-144
  Homolog annotation: Hit_ID=NP_503397.1; Match level="QueryCoverage =100%, HitCoverage=20%, E-value=1e-09, Identity=72%"; Hit description= RAB family member (22.5 kD) (rab-1) [Caenorhabditis elegans] gb|AAC69218.1| Rab family protein 1 [Caenor
  Essential gene: C elegans homolog=C39F7.4; Phenotype=Ste
AFITMATEIKNRMGPLQQAGGNASAVRIGPSQPVRDKKTGGCC

SEQ ID NO: 119708 - protein, 128 aa, Heterodera glycines
  Coding regions on vcDNA: vcDNA=SeqID_46131; Strand=-; Position=1 -116,256-279,330-441,823-954
  Homolog annotation: Hit_ID=NP_503397.1; Match level="QueryCoverage =69%, HitCoverage=68%, E-value=1e-33, Identity=57%"; Hit description =RAB family member (22.5 kD) (rab-1) [Caenorhabditis elegans] gb|AAC69218.1| Rab family protein 1 [Caenorh
  Essential gene: C elegans homolog=C39F7.4; Phenotype=Ste
MTERQRHGQMNKCEQNIVLCVMCSIMRMRRKRSKRIDELMAAMNPEYDYLFKLLLIGDSGVGKSCLLLRFADDTYTESYISTIGDSFNNVKQWLQEIDRYASESVNKLLVGNKCDLTTKRAIETNVAK

SEQ ID NO: 119709 - protein, 166 aa, Heterodera glycines
  Coding regions on vcDNA: vcDNA=SeqID_46132; Strand=+; Position=1 -280,716-826,903-1010
  Homolog annotation: Hit_ID=CAE61654.1; Match level="QueryCoverage =100%, HitCoverage=63%, E-value=1e-75, Identity=76%"; Hit description= Hypothetical protein CBG05588 [Caenorhabditis briggsae]
  Essential gene: C elegans homolog=B0250.1; Phenotype=Emb,Lva,Unc
MGRRIRAQRKGRGGIFKSHSKHRKGPAKLRPVDYSERHGFIRGIVKDIIHDPGRGAPLAIVQFRDPYKYRVKKETMIAAEGLHTGQFIYCGKKAQVQIGNVMPIGELPEGTTVCNLEEKAGDRGRLARTSGNYAIIVAHNPDTKRTRIRLPSGAKKVVPSANRAMI

SEQ ID NO: 119710 - protein, 426 aa, Heterodera glycines
  Coding regions on vcDNA: vcDNA=SeqID_46133; Strand=-; Position=1 -98,389-585,1773-1929,2482-2639,2699-2784,3056-3265,3563-3649,3972 -4161,4260-4355
  Homolog annotation: Hit_ID=NP_509786.2; Match level="QueryCoverage =84%, HitCoverage=45%, E-value=4e-66, Identity=40%"; Hit description =adenylate kinase (80.6 kD) (XL288) [Caenorhabditis elegans] emb|CAA92123.2| Hypothetical protein F13E6.2
  Essential gene: C elegans homolog=F13E6.2; Phenotype=Gro
MAGLIYNKPEDPIQFLENAIQKIRTNPGMAFKWDSFVTPPQPNKMSEEKTATNSSEKGDIGTTTASSAVDENMGKKKRGEESVAVKRHQSTDNETADGARPPVASAVVAPHATALSPKSSKRASRDASHPSRKRHCFKFETFFKLKKELFRLNSFQCVYSSTQQQNGTRSRVNSWSNSSRPSSLVQAAKDACIAPDAPIILFMGGPGGGKTRYAAKLQEELRDEGLAHICMPDLIRTSIARYKDRSSEWRVAAERYQRGELIPNELAQQLVKAEMGRQPYAKAYFIEGFPREARQVEDFERNVRPVDMALILDYDEDVLRRHMQSRGLFPERLLHLIPGEKDDALIIERMRKLIVRAMRAGVGAGAVTGAASSAGSAHSSTGGTAGKTEHQQKNGFGQSPAANEAENSTKEAEKVAATKCSAAESN

SEQ ID NO: 119711 - protein, 141 aa, Heterodera glycines
  Coding regions on vcDNA: vcDNA=SeqID_46134; Strand=+; Position=1 -90,135-344,410-533
  Homolog annotation: Hit_ID=AAR85527.1; Match level="QueryCoverage =100%, HitCoverage=56%, E-value=8e-72, Identity=95%"; Hit description= 14-3-3b protein [Meloidogyne incognita]
  Essential gene: C elegans homolog=M117.2; Phenotype=Emb
MSDNKEELVQRAKLAEQAERYDDMAQSMKKVTELGAELSNEERNLLSVAYKNVVGARRSSWRVISSIEQKTEGSEKKQQMAKEYREKVEQELREICHDVLDLLDKFLIPKAGNPESKVFYLKMKGDYYRYLAEVATGDDRN

SEQ ID NO: 119712 - protein, 235 aa, Heterodera glycines
  misc_feature (14)..(14): Xaa can be any naturally occurring amino acid
  misc_feature (224)..(224): Xaa can be any naturally occurring amino acid
  Coding regions on vcDNA: vcDNA=SeqID_46135; Strand=-; Position=1 -174,297-396,461-629,691-781,1416-1496
  Homolog annotation: Hit_ID=CAE60471.1; Match level="QueryCoverage =99%, HitCoverage=15%, E-value=2e-45, Identity=46%"; Hit description =Hypothetical protein CBG04082 [Caenorhabditis briggsae]
  Essential gene: C elegans homolog=F52B5.3; Phenotype=Emb
LQVPQFLLDNASLXWRPTRIFCTQPRRLPAIAIARRVASERGERFGATVGYHIRLESNCSAETLLTYCTSGVLLRKLTNDELATEATHVILDEVHERETNTDYLLIADEVHERETNTDYLLIALREALKKRKDLKVVLMSATMGDNRNKFMRYFRETGIKCVDVPTQLFSVEVYHLAEMLAMTPTQLFSVEVYHLAEMLAMTGYMPSSHYGGISTAKWKEEFWXTILKIISRKIK

SEQ ID NO: 119713 - protein, 342 aa, Heterodera glycines
  Coding regions on vcDNA: vcDNA=SeqID_46136; Strand=+; Position=1 -233,1908-2034,2507-2592,2635-2740,2828-3037,3167-3384
  Homolog annotation: Hit_ID=NP_494861.1; Match level="QueryCoverage =96%, HitCoverage=25%, E-value=1e-51, Identity=34%"; Hit description =contactin (2F90) [Caenorhabditis elegans] gb|AAK31482.1| Hypothetical protein C33F10.5b [Caenorhabditis e
  Essential gene: C elegans homolog=C33F10.5a; Phenotype=Sma,Ste,Stp
TASNPHLILINSHLHLPSTFLLLRLFFHFLLLFLMRLPSVHFIVLLPPLPHPFFHLSFLCFSISGSSSSAFPHHSPQSFAFSWVRGGNYGKFVEVSTRIFISMDGTLFFSYNVREDEDSFACTLSLPATQSAQLGPFFRLLLPLGHINPHAFAPRIDEFQPQIFPEPHAFAPRIDEFQPQIFPEMPTRGDTVFLECFAYGFPVPTYHWSRVDGYPLPRFRHRLLSFGRVLRLDRAEIGDSGRYRCSVQNRLGMDSAEIRLTIHCWFTSASSINDYLICSGHSITFKCLADGVGMVSQVEWFLNGVPLVPLLMDQSDRQRFKMASDGHEYVHSNVTKRGPSPF

SEQ ID NO: 119714 - protein, 488 aa, Heterodera glycines
  Coding regions on vcDNA: vcDNA=SeqID_46137; Strand=-; Position=1 -255,296-1181,1235-1460,1508-1605
  Homolog annotation: Hit_ID=CAE61469.1; Match level="QueryCoverage =98%, HitCoverage=32%, E-value=1e-136, Identity=46%"; Hit description= Hypothetical protein CBG05362 [Caenorhabditis briggsae]
  Essential gene: C elegans homolog=R107.8; Phenotype=Egl,Pvl
MGFSGKRCQIKVLQLDDIGVAKACQCQIRTICVTRTPCLNAGQCVDTLFDRHCVCRQGWTGAFCEQELNECEQNPCKNGATCRDLENGFECECAPGFHGFQCQYMVDHCAVSPCRNNGTCVNHGPTYECQCRLGFDGMHCEHNLNECETMSPCDATGTERCEDIVNGYRCHCRPGYAGTLCERHVNQCESAPCANNGTCVDLGAGFQCDCSPGWKGQRCEQMESVCEERKPCQNAGRCVPLVDDYFCVCPEGVSGKNCELAPNRCLGEPCRNGGVCGDFGSHSECACPQGFGGPGCQYRLDVCRAGTCRNGGTCVEVEDHQQQTTALPEGGPRGFKCICPPGFTGNECETDIDECRPSPCPMVAQCVDLVNGFHCKCPFNMTGANCEKRIDPDFDLRFVESAQQPSRAALSIPFRFTSASLTLSIWVRFEHGAWRGGRSLQPQRAPALFFGLFNSENPNQPSNLTELIRISADALLVRLFPDKEMAPS

SEQ ID NO: 119715 - protein, 198 aa, Heterodera glycines
  Coding regions on vcDNA: vcDNA=SeqID_46138; Strand=-; Position=1 -140,203-295,630-711,814-942,1258-1386,1459-1482
  Homolog annotation: Hit_ID=NP_496077.1; Match level="QueryCoverage =97%, HitCoverage=52%, E-value=1e-80, Identity=69%"; Hit description =putative nuclear protein of eukaryotic origin (2J941) [Caenorhabditis elegans] emb|CAA87435.1| Hypothetic
  Essential gene: C elegans homolog=ZK1307.9; Phenotype=Emb
MGERKGQNHYYPPDFNYQTHKTLNRYHGVHALRERGKRANEGILTIRFEMPFNVWCLGCNNHVGMSVRYNAEKRKVGMYYTTPIYEFRMKCHLCDNYFTIRTDPKNFDYELVEGVRRQEIRFDPSTIDNLAPVDRTMSLKLGADAMFKAEHTVDDKKKLASADDQIHRLEAIQTRLYDDYTANSVLRGSFRKKQLENH

SEQ ID NO: 119716 - protein, 69 aa, Heterodera glycines
  Coding regions on vcDNA: vcDNA=SeqID_46139; Strand=-; Position=1-208
  Homolog annotation: Hit_ID=NP_491889.1; Match level="QueryCoverage =97%, HitCoverage=59%, E-value=3e-22, Identity=73%"; Hit description =defender against Apoptotic Death homolog (12.7 kD) (dad-1) [Caenorhabditis elegans] gb|AAB96727.1| Dad (d
  Essential gene: C elegans homolog=F57B10.10; Phenotype=Emb,Lva
MVEVFDSLSKLYADYQRTTAKKLKIIDAYMVYIFLTGVFQFVYCLLVGTFPFNAFLAGFISTVACFVLA

SEQ ID NO: 119717 - protein, 263 aa, Heterodera glycines
  misc_feature (66)..(66): Xaa can be any naturally occurring amino acid
  misc_feature (71)..(71): Xaa can be any naturally occurring amino acid
  misc_feature (76)..(76): Xaa can be any naturally occurring amino acid
  Coding regions on vcDNA: vcDNA=SeqID_46140; Strand=+; Position=1 -21,393-625,1336-1433,1601-1725,2105-2218,2792-2973,3186-3209
  Homolog annotation: Hit_ID=NP_509531.1; Match level="QueryCoverage =97%, HitCoverage=34%, E-value=1e-73, Identity=52%"; Hit description =organic anion transporter K2 (82.5 kD) (XJ679) [Caenorhabditis elegans] gb|AAK72059.1| Hypothetical prote
  Essential gene: C elegans homolog=F47E1.4; Phenotype=Emb
SGIFDKFLIRLRPPGLTPQDPTWIGAWWMGFLLIGLMMIVPSITLFFFPESSKKCKFIKIKITNLXKIKIXKKNKXIKCKLNTFLRSYSAVLSSKVYVGASIARVLDVFAFKGYFVFLPKFLENHYGIPQYLVHLYIALFGVTGFALGTGSGGVIMRKLRLNGRKAAYYVLIASTINTALVMAKSMLGCHSVVNNIGRDGIVTAFNFTRECNMACGCAPDTAKLYPVCDVQGNAFYSPCHAGCRHAEAPDDELVRDFFSCLTN

SEQ ID NO: 119718 - protein, 68 aa, Heterodera glycines
  Coding regions on vcDNA: vcDNA=SeqID_46141; Strand=-; Position=1 -162,326-369
  Homolog annotation: Hit_ID=AAC79129.1; Match level="QueryCoverage =100%, HitCoverage=20%, E-value=1e-26, Identity=91%"; Hit description= glyceraldehyde-3-phosphate-dehydrogenase [Globodera rostochiensis] sp|O16027|G3P1_GLORO Glyceraldehyde-3-
  Essential gene: C elegans homolog=T09F3.3; Phenotype=Emb,Gon,Sma
MAFRVPTPNVSVVDLTARLEKPAPLDAIKEAVKKAANGKLKGILAYTEDQVVSTDFLGDSHSSIFDAG

SEQ ID NO: 119719 - protein, 123 aa, Heterodera glycines
  Coding regions on vcDNA: vcDNA=SeqID_46142; Strand=-; Position=1 -138,186-416
  Homolog annotation: Hit_ID=AAA68771.1; Match level="QueryCoverage =100%, HitCoverage=56%, E-value=6e-32, Identity=58%"; Hit description= Hypothetical protein C56C10.3 [Caenorhabditis elegans] ref|NP _495337.1| protein hspc134 (24.7 kD) (2G881)
  Essential gene: C elegans homolog=C56C10.3; Phenotype=Emb,Lva
MSLFGKIFGGKKQEAAPSTQEVLQKLQEREDMFQKKQEFLEKKIETEIATARAQAANKRVALQALRRKKGYGKQLEHIAGVLNTIHHAKTALENASMNSDVLGVIGESAKAVKKAHNEMDADK

SEQ ID NO: 119720 - protein, 401 aa, Heterodera glycines
  Coding regions on vcDNA: vcDNA=SeqID_46143; Strand=-; Position=1 -144,374-560,613-656,765-898,994-1144,1190-1219,1275-1424,1497-1700
  Homolog annotation: Hit_ID=CAA50802.1; Match level="QueryCoverage =99%, HitCoverage=77%, E-value=1e-155, Identity=71%"; Hit description= alpha-tubulin [Torpedo marmorata] pir||JC4133 tubulin alpha chain, neuron-specific isoform - marbled elec
  Essential gene: C elegans homolog=C47B2.3; Phenotype=Emb
QRECVSIHIGQAGVQIGNACWELYNLEHGIGNDGHLLKKDDGTCSGESNTFYTESSNGKYVPRAIFVDLEPTVIDEVRAGPYRHLFHPEQLITGKEDAANNYARGHYTIGKEQIDRVLERVRKQIGKEQIDRVLERVRKQAENCAGLQGFLVFHSFGGGTGSGFSSLLMERLSVEYGKKSKLEFSIYPAPQVATAVVEPYNSILTTHTTLNHSDCSFMVDNEAIYDICRKSLDVEMPSYANLNRMPSYANLNRLIAQIVSSITASLRFDGALNVIAQIVSSITASLRFDGALNVDLTEFQTNLVPYPRIHFPLATYAPVISADKAYHEALAYHEALSVSEITHMCFEPANQMVKCDSRKGKYMAVCLLYRGDVVPKDVNAAIASVKAKRGIHFVDWSVTGM

SEQ ID NO: 119721 - protein, 361 aa, Heterodera glycines
  Coding regions on vcDNA: vcDNA=SeqID_46144; Strand=+; Position=1 -61,190-512,562-686,741-1125,1327-1463
  Homolog annotation: Hit_ID=NP_956920.1; Match level="QueryCoverage =96%, HitCoverage=35%, E-value=2e-69, Identity=44%"; Hit description =hypothetical protein MGC63840 [Danio rerio] gb|AAH56837.1| Hypothetical protein MGC63840 [Danio rerio]
  Essential gene: C elegans homolog=M18.5; Phenotype=Gro,Stp,Unc
MSPHCLMIDSEDLEDTQISGFDLTKRTLWAGNLSLPGTRLLQITSERVQMLSGDGFTSKWCPDPPCRISLASVNHAQLLLSSGPRLFYLRVDSDQIMLLHRLECADEVACLDISPLGVLFSGVCIFSIGFWSEHSVAVYALKPGTVLCIFSIGFWSEHSVAVYALKPGTVLAEERLSSEFVPRSMLMVTMVTMEGSHFLFVALGDGTVIHFRVDSLTGALSAQKKFTLGTQPTSLCLFQSPKTLNVFACSDRPTVIYSSNHKLSFSNVNLRSVTQICPLNSEFYRDCLALSDGENLVIGTIDDIQKLHIRTVPLGETVHRLAYQPESNLVAILTTRCMTFSLPIASAVRPSISVDWAKSYG

SEQ ID NO: 119722 - protein, 107 aa, Heterodera glycines
  Coding regions on vcDNA: vcDNA=SeqID_46145; Strand=+; Position=1 -198,240-308,350-403
  Homolog annotation: Hit_ID=AAH81136.1; Match level="QueryCoverage =100%, HitCoverage=19%, E-value=4e-37, Identity=66%"; Hit description= AB21 protein [Xenopus laevis] emb|CAA55211.1| yeast RPD3 homologue [Xenopus laevis] sp|Q91695|HD11_XENLA
  Essential gene: C elegans homolog=C53A5.3; Phenotype=Emb,Gon
MTIHSRKVVAYYYDGPFFNQIGLINSVTGDVGNYYYGQGHPMKPHRIRMTHNLLLNYGLYRKMEVFRPKAASLEEMTKYHSDDYMCFLKSIKPDNIADFGRQMQRFN

SEQ ID NO: 119723 - protein, 323 aa, Heterodera glycines
  misc_feature (71)..(71): Xaa can be any naturally occurring amino acid
  misc_feature (100)..(100): Xaa can be any naturally occurring amino acid
  misc_feature (281)..(281): Xaa can be any naturally occurring amino acid
  misc_feature (319)..(319): Xaa can be any naturally occurring amino acid
  Coding regions on vcDNA: vcDNA=SeqID_46146; Strand=+; Position=1-1023
  Homolog annotation: Hit_ID=NP_510671.1; Match level="QueryCoverage =97%, HitCoverage=34%, E-value=7e-44, Identity=32%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
HNLLLYKLEKIGPPGKLLMWIKGFLSRTFRVKIGDLSKKVSPLLFLIYINDLPDALPSGVKIKLYADDLLXSKSDTEIMHKALHNLFEWANKWQIRISIXKTFVLYLGSKNPKETYKFDGNTINAVDTIRDLGVNIDNKLQFSGHVNQITRNAYLRMRSLFRIIKSKSSKIWITLYKTYIRPLLEYAPEVWNPSLQKNIKQIERCQKYFTKRVFFKCSLPPIPYQNRLEYLQLPTLENRRKLFDLFMAHKIAYGRTDLKLFSIFKRALTSPFTDLTQNTNXAKNSFPLLGGTKLWNQLDKGKTNSLNQFKTKLRSSLGXYVRP

SEQ ID NO: 119724 - protein, 126 aa, Heterodera glycines
  misc_feature (22)..(22): Xaa can be any naturally occurring amino acid
  misc_feature (49)..(49): Xaa can be any naturally occurring amino acid
  Coding regions on vcDNA: vcDNA=SeqID_46147; Strand=-; Position=1-383
  Homolog annotation: Hit_ID=P53022; Match level="QueryCoverage=89%, HitCoverage=89%, E-value=2e-33, Identity=63%"; Hit description=Major sperm protein 2 gb|AAA29147.1| major sperm protein
  Essential gene: C elegans homolog=C04G2.4; Phenotype=Unclassified
HESFNYFDQFRFPNLNLNKKSXFENKISIFIRVRVRDRNDIGYIFKTRXPKCINMNPPNGGLGPKESGKVDGSCDAFDPGSEDTKGDRVTVEWTNAPNPAATAVKVEGFQGDGMVSRKNLSIEYSG

SEQ ID NO: 119725 - protein, 130 aa, Heterodera glycines
  Coding regions on vcDNA: vcDNA=SeqID_46148; Strand=-; Position=1 -133,177-433
  Homolog annotation: Hit_ID=NP_506079.1; Match level="QueryCoverage =72%, HitCoverage=28%, E-value=5e-15, Identity=42%"; Hit description =putative mitochondrial translation elongation factor Ts, with ubiquitin associated domain (34.1 kD) (5M75
  Essential gene: C elegans homolog=F55C5.5; Phenotype=Lva
MDGRTADEAIVATVSKVGENIQLARASVISSSPANKLFGQTHPKEEFNGVQLGRFISLVSLGHKSDESVSDFPTAQLGQVICQHIIGMAPESLGEPRKKGAKRATQMEIVDESDTGEEEDLNASQVDQSE

SEQ ID NO: 119726 - protein, 1151 aa, Heterodera glycines
  Coding regions on vcDNA: vcDNA=SeqID_46149; Strand=+; Position=1 -488,534-1389,1455-1782,2185-3134,3470-3680,3783-3952,3973-4425
  Homolog annotation: Hit_ID=Q94637; Match level="QueryCoverage=95%, HitCoverage=59%, E-value=4e-79, Identity=25%"; Hit description =Vitellogenin 6 precursor gb|AAB49749.1| vitellogenin pir||T18561 vitellogenin vit-6 [similarity] - Oscheius sp
  Essential gene: C elegans homolog=C04F6.1; Phenotype=Emb,Gro
MTNWGHFQQIDASVAHVQTLFAMYKQQQNEQQQTQCIYDKAVALGALGNAGLDIALADLERIIKDTREARVVRMMAIDATRRMRTQMPHSVRAMLLPVFLNTGEQPQVRITAFANILGAQPTAEVVDQLVYAIGKEPNREVQAYCYRTMKTMANSQKPDETQIAKHVKSSLKQLANAVDEQQLRTSGKWQFEQLYNNAQREGVFMSFVNAVSSRSALPAYAHVQLDSHFNDHYTYNKLNIYMVQQEAEQWYERAMNSFGNSKRKQKQQQHGSKQLSSIYEQLGIKSHRSDFGTVPTAADNDNEAYQQHQQQQQQNNMRPFAMLGLRSNNVDKAFIALDEHTIGEQTRRMLNGEEMKPNWAAILFGHGAQQQHLDMAIVQNMGEKEAKIATSAGVPLRILSTTPMMANVEGRVGAKAAPKMGPSAAGHGLSAQFEFSAMSARMAQIQKMELITPFAASGVESIRSLHINLPLQGELSLVNSEQQQGISIKVKLPQRGTQLASAHSLPFTFIAKAEPSAQFVREPRQIIAVHDPKLDQQQREVNSVLGQKALALPLQIRGHYHVPAEPSNLLQFAQLLMATENAVHVQYQPNEESPRELTIRASGEHFRKAAQMQLPDTPQLHNFYAQQFHSSSSCDSDDSVNAANCEENDATEQQQGENGGEQYISNDNQQQQLNSFISAYKPRQQYAHALRLSAQTSGGARDATAHANIQAQCDERMRYCTVQADANKNQQWTLSAQAQVVMPDTVPSVEQLQQPTMLKQFIALAKAQWGDQQDKQHMNVRIRGTQAHTEQTRAVMAQIQQQHEGKRHGFSAQQQRKMLQRSAFLNQFHVEATYALKAYAQNMMNRGIELLKSVYFWNTKSQLLGGPNAPKNGKPSNANVTIRTPAQQLHMQQIQMPAAVGRPFPLIRQQSAQQTHSLAQLFYKQFSLKSRAQCIVDGRNVDTFDGFAFTAPLSSNCFSVLAKHCSSPMEEQHQQQPQFVVMLKKVPGKQNANKSAQKADKEREEFKNDDNFQKKVLKVITAEQQIECQPKTAQGKKGQMICKVNGQPISGDEQCQDELQHQQCVQFNDPRQTDVTIRTGPIAVRFNGRKAWLKVSQAYKNAQCGLCGHYDDADEQEQELRMANGQIGGFGGLNLAKLVDEVDQWTKQKAA

SEQ ID NO: 119727 - protein, 346 aa, Heterodera glycines
  Coding regions on vcDNA: vcDNA=SeqID_46150; Strand=+; Position=1 -189,232-483,529-642,689-936,983-1217
  Homolog annotation: Hit_ID=CAE64972.1; Match level="QueryCoverage =99%, HitCoverage=20%, E-value=1e-161, Identity=81%"; Hit description= Hypothetical protein CBG09806 [Caenorhabditis briggsae]
  Essential gene: C elegans homolog=T20G5.1; Phenotype=Emb
MNLMSNPQVADAILGNRMFNHYDRASIGQLCEKAGLPQRALEHFTDLYDIKRTVVHTQHFNSEWLVSYFGRLNVQDSLECLKAMLQANLRQNLQIVVQIASKYCEQLGTQSLIDIFESFKSYEGLFYFLGSIVNFSQDSEVHFKYIQAATRTGQIKEVERICRESNCYDPERVKNYLKEAKLADQLPLIIVCDRHDMVQDLVLYLYRSNLMKSIEVFVSKVNPKRLPIVVGALLNVDCSEDQIKQLIQITRGKFDIDELVEEVEKRNRLKLLNSWLESRVHEGNQDQATHNALAKIYIDSNNNPERFLRENQFYDSRVIGKYCEKRDPHYALLAYERGRCDSELIA

SEQ ID NO: 119728 - protein, 353 aa, Heterodera glycines
  Coding regions on vcDNA: vcDNA=SeqID_46151; Strand=-; Position=1 -84,181-244,361-481,586-649,746-844,899-922,994-1069,1177-1241,1290 -1346,1397-1496,1547-1608,3072-3130
  Homolog annotation: Hit_ID=NP_491914.1; Match level="QueryCoverage =96%, HitCoverage=85%, E-value=6e-59, Identity=37%"; Hit description=- related expressed kinase (1H241) [Caenorhabditis elegans] gb|AAB54139.1| Hypothetical protein ZC581.1 [C
  Essential gene: C elegans homolog=ZC581.1; Phenotype=Lva,Unc
LKNFKKLKDLGRGAFGICALYKVKRIFLKVVIKVVIKRVSLECQSENDKRAISYEASLLKKLSHPNVIRFYDSFVELEQLCILMEYLDGGTMERMIQERKGIKMGQDVLYYFTQIVLALDHMHALKILHRDIKTANIFLNRKMTIVKVGDFGISKVGDFGISKELNSKCAQELNSKCAQASTFVGTMNYVSPEICEGRAYGPKSDVWAVGCVLYELVELHKAFDGDSLHKAFDGDSIQLLLLRIARGQHGPISSTVTSGGQHGPISSTVTSGMRELIENVMEIDENRRPNTTEILLKPMVLQKWMEIHTNLGREILLKPMVLQKWMEIHTNLGRLENYTTKKDSEKQKIRRQG

SEQ ID NO: 119729 - protein, 194 aa, Heterodera glycines
  Coding regions on vcDNA: vcDNA=SeqID_46152; Strand=+; Position=1 -49,3671-3725,4028-4093,4149-4249,4296-4422,4506-4627
  Homolog annotation: Hit_ID=NP_871701.1; Match level="QueryCoverage =92%, HitCoverage=73%, E-value=1e-34, Identity=41%"; Hit description =RanBP1 domain containing protein, Nuclear Pore complex Protein NPP-9 (95.6 kD) (npp-9) [Caenorhabditis el
  Essential gene: C elegans homolog=F59A2.1a; Phenotype=Emb
AYNFVNTRSNKTILCSGDEGSDKEDAAEEFVPDVHYEPVVPLPPEVEVSTGEEEEEVIFSVIFSARCKLYRFDKDARENKERGLGDIKVIYPNFSRYRCVMRREQVFKLSRYRCVMRREQVFKLCANFPIYPDLKIHPREHMPTVYTWACRDFSDEDFSDEPSQGDDVTFSARFKDKVCEKGFKWFLGFRQSPG

SEQ ID NO: 119730 - protein, 126 aa, Heterodera glycines
  Coding regions on vcDNA: vcDNA=SeqID_46153; Strand=-; Position=1 -216,281-442
  Homolog annotation: Hit_ID=CAA65506.1; Match level="QueryCoverage =90%, HitCoverage=39%, E-value=5e-34, Identity=60%"; Hit description =cuticular collagen [Teladorsagia circumcincta]
  Essential gene: C elegans homolog=T07H6.3a; Phenotype=Bmd,Gro,Unc
MDSSSDFDKHAAQREAESLRTLAFFGVCLSTVATVIAVISVPFAYQHFQQLGTQMQNEVDFCKMRSGNMWREVTRTQAYSKVSHDRRHKRQAGSCCVCGVSPPGPPGPPGPSGQPGGDGQPRRLTT

SEQ ID NO: 119731 - protein, 325 aa, Heterodera glycines
  Coding regions on vcDNA: vcDNA=SeqID_46154; Strand=-; Position=1 -206,279-386,1543-1736,2147-2225,2660-2843,3148-3392
  Homolog annotation: Hit_ID=CAE74891.1; Match level="QueryCoverage =90%, HitCoverage=37%, E-value=7e-70, Identity=43%"; Hit description =Hypothetical protein CBG22756 [Caenorhabditis briggsae]
  Essential gene: C elegans homolog=F41D9.1; Phenotype=Unclassified
AANLVKADHDDDVDEVVESLDKFDSFGKSGAKEDALEIIQSIFPLGGRPFTALHPQLVPQYFEEPLELFDEFGFRLAQETENDPAADGGPNAGEPLESSSHRMRWLALIESAHSQVEDELCWAKVDMQRLRHTPKFMPMVNDGGIPHSLRPFLWPRLCSAAEKRKKSPCDYAKIVRKCTKDRACINVQIEKDLLRTLPAHFCFGRPHSVGIAPLRRVLRALAFLFPEIGYCQGMAFVVASLLLVCCEENTFWMCSLIEGILTPSLYAPSLLGVRADERVMRHLMRTDFPGSGIKPDDFKLSECVENFNWTPCGSLLIPLLLITVY

SEQ ID NO: 119732 - protein, 172 aa, Heterodera glycines
  Coding regions on vcDNA: vcDNA=SeqID_46155; Strand=-; Position=1 -173,226-361,422-629
  Homolog annotation: Hit_ID=NP_497831.1; Match level="QueryCoverage =95%, HitCoverage=41%, E-value=2e-28, Identity=41%"; Hit description =putative nuclear protein, with a coiled coil domain, of bilaterial origin (45.1 kD) (3F258) [Caenorhabdit
  Essential gene: C elegans homolog=C16C10.6; Phenotype=Emb
MSANGKFRMGLNVRKSVETAVGPKKTANIFGDESDDDEQQNAAEKFERKYAASAGTKAREQRIVEKELAKNPDIFDYDTHYEEIQQQRDQKVAAQKEADKEKKPKYAHLLAKAHKQRELSKLLVEENTYKKEREKEAGQFEDEEVFVTGAYRQQIEERERHKTEMEREEALE

SEQ ID NO: 119733 - protein, 166 aa, Heterodera glycines
  Coding regions on vcDNA: vcDNA=SeqID_46156; Strand=+; Position=1 -149,204-337,976-1104,1151-1237
  Homolog annotation: Hit_ID=XP_393238.1; Match level="QueryCoverage =96%, HitCoverage=81%, E-value=2e-30, Identity=42%"; Hit description =similar to ENSANGP00000014057 [Apis mellifera]
  Essential gene: C elegans homolog=F46H6.1; Phenotype=Unc
MTTEKESSSGSDDVINASEFASEETFYSPPAQKSVKEIIEADHNDESLKKYKEQLLGENASGPVLVEPDNPKNVLVRRISLVSDDQVKHSMDLPAKGDFVFCVKESCTYRIRFEFVVQREIICGLKYAHKVSRLGVGVPKELYMLGSYGPRHEPYTYETSPEEAPS

SEQ ID NO: 119734 - protein, 249 aa, Heterodera glycines
  Coding regions on vcDNA: vcDNA=SeqID_46157; Strand=+; Position=1 -73,134-345,1324-1644,1894-2037
  Homolog annotation: Hit_ID=NP_035318.1; Match level="QueryCoverage =92%, HitCoverage=72%, E-value=2e-66, Identity=73%"; Hit description =proteasome (prosome, macropain) 26S subunit, ATPase 2 [Mus musculus] dbj|BAC36516.1| unnamed protein prod
  Essential gene: C elegans homolog=C52E4.4; Phenotype=Emb
MSSDIVEKKETNPNETDDKTKEIKSLDEDEIAALSNYNMGPYADQLKQAEKDIDEIQKRINTLCGVKESDTGLAPPILWDIAADKMAMSHEQPLQKGVLFFGPPGTGKTLCARAVANRTDACFIRVIGSELVKKYVGEGARMVRELFSLAKTKKACILFFDEVDAIGGARFDDGKGGDNEVQRTMLELVNQLDGFDSRGAIKVLMATNRPDTLDPALIRPGRIDRRIEFSLVTNENKCRSDNEYTHCSL

SEQ ID NO: 119735 - protein, 101 aa, Heterodera glycines
  Coding regions on vcDNA: vcDNA=SeqID_46158; Strand=+; Position=1 -30,82-159,202-306
  Homolog annotation: Hit_ID=XP_511659.1; Match level="QueryCoverage =87%, HitCoverage=8%, E-value=7e-22, Identity=63%"; Hit description =PREDICTED: similar to ribosomal protein L38 [Pan troglodytes]
  Essential gene: C elegans homolog=C06B8.8; Phenotype=Gro,Stp
TMPRQITDIKQFLLTARRKDAKSVKQFLLTARRKDAKSVKIKKNKENTKFKVRCTRFLYTLVVDDKVRCTRFLYTLVVDDKEKAEKLKQSLPPGLQVKELK

SEQ ID NO: 119736 - protein, 296 aa, Heterodera glycines
  Coding regions on vcDNA: vcDNA=SeqID_46159; Strand=+; Position=1 -95,977-1066,1113-1194,1255-1409,1454-1591,1635-1739
  Homolog annotation: Hit_ID=NP_496402.1; Match level="QueryCoverage =97%, HitCoverage=54%, E-value=2e-50, Identity=42%"; Hit description =cytochrome oxidase assembly (45.0 kD) (2L522) [Caenorhabditis elegans] emb|CAA88968.1| Hypothetical prote
  Essential gene: C elegans homolog=T06D8.5; Phenotype =Gro,Stp,Unclassified
GLQPRRRGWKIRGSGLEVSGFGVGVFQFLPYRLATHLSLAFILYGIFLWNGLSHLFTPNNVHSKSPAIKKFRGMVHGHSKSPAIKKFRGMVHGNKLMIFMTIIIGAFVAGLDAAFVAGLDAGLVYNSWPKYADRWIPEGVLSHTPNWKNFIENPATVQFLHRNMAYLTLILATLTWIKGIRTPLGFRRNMAYLTLILATLTWIKGIRTPLGFRSRLALHSLLVTAWLQLALGISTLLHHVPVSLASMHQNGALLLYSSSTLLHHVPVSLASMHQNGALLLYSSVIWLSNELRKIPK

SEQ ID NO: 119737 - protein, 80 aa, Heterodera glycines
  Coding regions on vcDNA: vcDNA=SeqID_46160; Strand=+; Position=1 -61,135-316
  Homolog annotation: Hit_ID=NP_502079.1; Match level="QueryCoverage =95%, HitCoverage=16%, E-value=1e-11, Identity=40%"; Hit description =histocompatibility 13 (52.8 kD) (4L882) [Caenorhabditis elegans] emb|CAA92975.1| Hypothetical protein T05
  Essential gene: C elegans homolog=T05E11.5; Phenotype=Emb,Gro,Unc
MPEISKTNLLYFLLLLLCWEGCIALATILKPFLSFFLSRLPIGDRWPRRNVPWLLVMKRGKREMKEGQLERAAKKDAVRL

SEQ ID NO: 119738 - protein, 240 aa, Heterodera glycines
  Coding regions on vcDNA: vcDNA=SeqID_46161; Strand=-; Position=1 -22,955-1143,1188-1319,1870-2156,2353-2435
  Homolog annotation: Hit_ID=CAE57200.1; Match level="QueryCoverage =96%, HitCoverage=54%, E-value=3e-66, Identity=51%"; Hit description =Hypothetical protein CBG00050 [Caenorhabditis briggsae]
  Essential gene: C elegans homolog=K02A4.1; Phenotype=Emb,Lvl
EFVLVFYHDELSIVQATGQELKPKPFVNGQLKFGQNFSDHMMEVDWSDAKGWGKPLISPLHPLQLHPGAKALHYAIEALHYAIELFEGMKAYRGQDNHIRLFRPEKNIARMRRTAARLMLPDFDGNELLKIIDELVRTDQDWVPSSDEASLYIRPTMIGTDPTLIEGWSTGSKLFIVTGPTGNIGEAGPKPIALLADPNLARTSPGGVGQYKMGCEKSAVNWIGKSRKKRCCNGLQWWNS

SEQ ID NO: 119739 - protein, 34 aa, Heterodera glycines
  Coding regions on vcDNA: vcDNA=SeqID_46162; Strand=+; Position=1 -22,655-737
  Essential gene: C elegans homolog=F55H2.2; Phenotype=Emb
MKRENVVVIIPKIENTLTYIVTELDEMEREEFFR

SEQ ID NO: 119740 - protein, 189 aa, Heterodera glycines
  Coding regions on vcDNA: vcDNA=SeqID_46163; Strand=-; Position=1 -142,184-284,327-452,504-584,941-1057
  Homolog annotation: Hit_ID=CAE67197.1; Match level="QueryCoverage =76%, HitCoverage=34%, E-value=3e-36, Identity=56%"; Hit description =Hypothetical protein CBG12633 [Caenorhabditis briggsae]
  Essential gene: C elegans homolog=K06A5.6; Phenotype=Emb
MHISFVSRQATAFLGVASRNGLPRVAAEAPPAPLTYLSEDEVALKHSVKQFSESVIRPLVKEMDVKSEMDRRVIEGVFANGLMGIEIAEKFGGSESSFFNVALTVEELAKVDPSVAVLVDVQNTLVAPLIIENGTEEQKHKYLTRIVKDWELLLQNMRTNSALEQVRHVLSISTRSESRKVPFLANMAK

SEQ ID NO: 119741 - protein, 181 aa, Heterodera glycines
  Coding regions on vcDNA: vcDNA=SeqID_46164; Strand=+; Position=1 -126,195-383,488-718
  Homolog annotation: Hit_ID=XP_310552.1; Match level="QueryCoverage =95%, HitCoverage=29%, E-value=9e-17, Identity=31%"; Hit description =ENSANGP00000017318 [Anopheles gambiae]
  Essential gene: C elegans homolog=M176.2; Phenotype=Emb,Lva
MVERFFPNPEEAPLIKAIRDTYANIWRIEENENNEPFSEIIERVKKQPNNFVMKLTEYALWDAWIKKDVEKVYFGKEILEALANFDADKRLAYILMEKLRPMSVKNHIIWAEDGEESSGEDFLEDVTPELGIFGTLLGNIVNGEVLYNAQFGHQLKTKLASENEGGIASGNSAYDSAYLVD

SEQ ID NO: 119742 - protein, 211 aa, Heterodera glycines
  Coding regions on vcDNA: vcDNA=SeqID_46165; Strand=+; Position=1 -230,677-850,1277-1507
  Homolog annotation: Hit_ID=NP_490962.1; Match level="QueryCoverage =100%, HitCoverage=24%, E-value=3e-82, Identity=72%"; Hit description= DNA replication licensing factor Mini Chromosome Maintenance, abnormal cell LINeage LIN-6, LEThal LET-35
  Essential gene: C elegans homolog=Y39G10AR.14; Phenotype=Emb
PNIFGHDEIKRGLLCLLFGGTRKAVDPTDDASRVRLRSDVNILLCGDPGTAKSQLLQYVFQLVPRSQYTSGKVAIVGSSAVGLSASITRDSDSKSVVLQTGALVLADNGVCCIDEFDKMSDGTRSILHEVTKKWVMEQQTLSIAKAGIICQLNARTSVLAAANPIDSKWNKRKNIVKNVNLPHTLLSRFDLIFLVLDPQDEAYDRRLARHL

SEQ ID NO: 119743 - protein, 128 aa, Heterodera glycines
  Coding regions on vcDNA: vcDNA=SeqID_46166; Strand=-; Position=1 -153,200-259,461-516,566-683
  Homolog annotation: Hit_ID=EAA05377.2; Match level="QueryCoverage =82%, HitCoverage=13%, E-value=3e-37, Identity=62%"; Hit description =ENSANGP00000011118 [Anopheles gambiae str. PEST]
  Essential gene: C elegans homolog=M01E5.5a; Phenotype=Lva,Unc
MLSYNRKATGSEAFHLYCLNSGANRQVAILCNHQRAVPKTHEKSMENLENKIKEKKQEYKELKDQLKKSKSDENKQIALGTSKLNYLDPRISVAWCKKNDVPVEKIFSKTQRDKFRWALDMAKEDFIF

SEQ ID NO: 119744 - protein, 389 aa, Heterodera glycines
  misc_feature (375)..(375): Xaa can be any naturally occurring amino acid
  Coding regions on vcDNA: vcDNA=SeqID_46167; Strand=+; Position=1 -143,195-278,326-347,393-441,494-559,617-723,1348-1384,1431-1534,1584- 1624,1672-1739,1810-1985
  Homolog annotation: Hit_ID=NP_501615.1; Match level="QueryCoverage =89%, HitCoverage=86%, E-value=3e-71, Identity=45%"; Hit description =putative endoplasmic reticulum protein, with at least 4 transmembrane domains, of bilaterial origin (4K18
  Essential gene: C elegans homolog=Y11D7A.9; Phenotype=Unclassified
LPSMASFMPNAVSGHYPGWRGRFPSSHKRRSEPEWSVKELIRMNPLHLFFLGFVPPFLGAIGSIVFFLGFVPPFLGAIGSIVTALLLHNDEISNYNWQCGNYNWQCGRARLPSLSRIIRARLPSLSRIINLPMERIFWQITFLFHIPLRAVEIFWQITFLFHIPLRAVEIAVGFFRYGRLRSVHCNWPRLFRYGRLRSVHCNWPRLYSLCRHFYLWLGSLELIFLVALSVVGEREFISYHVIYHVIFFYAFGAFAIGFFLTNVICHSQSLYYLNPYGRISYHFKIVVTILGRISYHFKIVVTILYVISYVISVPVLFGAFVLYWRKCITIMYDVFAVAEYIDVFLTIAYHCCAFFDIRYKVIFSVREVRERKMQXEKEKKRTEERTNES

SEQ ID NO: 119745 - protein, 122 aa, Heterodera glycines
  Coding regions on vcDNA: vcDNA=SeqID_46168; Strand=+; Position=1 -54,315-629
  Homolog annotation: Hit_ID=AAS55946.1; Match level="QueryCoverage =66%, HitCoverage=50%, E-value=3e-33, Identity=80%"; Hit description =ribosomal protein L21 [Ornithodoros moubata]
  Essential gene: C elegans homolog=C14B9.7; Phenotype=Emb
MLLSFIILLFLPNAFPLIQDKKSEAKMVNPKGYRRGTRYMFARPFRKHGVEPLSTFYRVYKRGDIVTVKGNGAFQKGMPFKAYHGKTGRVFNVTKHALGVVVNKRVRLVFLDMLVGVQFGIV

SEQ ID NO: 119746 - protein, 286 aa, Heterodera glycines
  Coding regions on vcDNA: vcDNA=SeqID_46169; Strand=-; Position=1 -64,347-431,527-583,826-935,1005-1179,1252-1317,1381-1548,1854-1902
  Homolog annotation: Hit_ID=XP_316297.1; Match level="QueryCoverage =92%, HitCoverage=97%, E-value=4e-33, Identity=32%"; Hit description =ENSANGP00000020614 [Anopheles gambiae]
  Essential gene: C elegans homolog=Y65B4A.3; Phenotype=Lva,Unc
KLGNEAKTAAQGNSLFAEVHFYSNIFYTHLMFFRYLRKIFCIPISNGNCFGQKRGQKRTDLRQVTDHDRTTLSLKMQRDKLRQACQRYERNIAKDAERARALLRDGRKDRALLRALLLLKRKRFQETMINRIGGFMEQVERTITDMEMAQINREVFDNLRLGTEALKALNETITISLDEVERLMEESKEAQEFQEELSTILGQQMSEEDNDMVEELSTILGQQMSEEDNDMVEEEFERMLSEQMPQCQRSNRRTQKRDGKQRTKRGQRVREEKEPKRRREAVAQEA

SEQ ID NO: 119747 - protein, 168 aa, Heterodera glycines
  Coding regions on vcDNA: vcDNA=SeqID_46170; Strand=+; Position=1 -24,76-261,561-684,1088-1260
  Homolog annotation: Hit_ID=CAE67941.1; Match level="QueryCoverage =86%, HitCoverage=99%, E-value=7e-44, Identity=56%"; Hit description =Hypothetical protein CBG13541 [Caenorhabditis briggsae]
  Essential gene: C elegans homolog=Y66H1A.4; Phenotype=Gro,Stp
MGLPKKLLLPIRKSTNYFHLELGHFTHSCENDIVCLTTCGKIPYFNAPVYFQNKEQIGKIDEIFGGPKDNGFSVKLNEGLKSSSFKKEQKLFIDPAKLLPLERFLGGNQSGGGGGFRGGGRGGGGFRGASGGQGGNFRGQRGGGGGFKRPFEGTPAAGGLSKRKKFNE

SEQ ID NO: 119748 - protein, 201 aa, Heterodera glycines
  Coding regions on vcDNA: vcDNA=SeqID_46171; Strand=+; Position=1 -154,382-465,511-528,603-836,992-1105
  Homolog annotation: Hit_ID=NP_741323.1; Match level="QueryCoverage =75%, HitCoverage=95%, E-value=5e-34, Identity=45%"; Hit description =CCHC type  zinc finger containing protein (15.6 kD) (4C475) [Caenorhabditis elegans] gb|AAK84542.1| Hypot
  Essential gene: C elegans homolog=K08D12.3a; Phenotype=Unc
IILCVKAGRRSIFIVCVRRGREEAGRVEDEREYGMLSLPRIRLDGEGVGGVGHISRDCPNAGRSGGGGGGGGGSRGGGGETKCYNCGRSGHFARECRDAGDRDRGRGGGGGGGGRGGDDRGSKCYNCGGYGHFARECRDERSASGGGRGGRDDRDDRGNKCYNCGKSGHFSRECPEGSDRRGGGGGGRDRDDRRCYNCNEP

SEQ ID NO: 119749 - protein, 140 aa, Heterodera glycines
  Coding regions on vcDNA: vcDNA=SeqID_46172; Strand=+; Position=1 -164,223-482
  Homolog annotation: Hit_ID=CAG58813.1; Match level="QueryCoverage =66%, HitCoverage=61%, E-value=1e-22, Identity=54%"; Hit description =unnamed protein product [Candida glabrata CBS138] ref|XP_445894.1| unnamed protein product [Candida glabra
  Essential gene: C elegans homolog=M7.1; Phenotype=Emb
QNYLRLSSSSSLHCAITTTLQKRPHRRFSSFIRPSVLHINSLAVFAMARRRIQKEMAELHQELVTTGYTAAPMDDGRDLYHWKASIKGPPESPYEGGTFHLDIVFRRDYPFTPPNVKFDTIIYHPNVGERGDICLDILKQ

SEQ ID NO: 119750 - protein, 132 aa, Heterodera glycines
  Coding regions on vcDNA: vcDNA=SeqID_46173; Strand=-; Position=1 -87,141-317,370-432,489-557
  Homolog annotation: Hit_ID=NP_491282.1; Match level="QueryCoverage =100%, HitCoverage=80%, E-value=8e-40, Identity=62%"; Hit description= CalPoNin (cpn-3) [Caenorhabditis elegans] gb|AAB52338.1| Calponin protein 3 [Caenorhabditis elegans] pir
  Essential gene: C elegans homolog=F28H1.2; Phenotype=Emb,Lva
QASKFNDQEGKLILDWVKKLSGENFSTDGSRENFYKLLKDGTLLCKLVTFRGILLMRKPAYLIRLANGIQPGSVKKIQQPTGNFACMENINAFVSFAKAQGVPTEETFQSVDLFEARDLYSVCVTVLSLGRI

SEQ ID NO: 119751 - protein, 163 aa, Heterodera glycines
  Coding regions on vcDNA: vcDNA=SeqID_46174; Strand=-; Position=1 -153,203-448,504-568,622-647
  Homolog annotation: Hit_ID=AAO85519.1; Match level="QueryCoverage =79%, HitCoverage=42%, E-value=2e-36, Identity=52%"; Hit description =putative serine/threonine phosphatase [Oesophagostomum dentatum] gb|AAO85518.1| putative serine/threonine
  Essential gene: C elegans homolog=W09C3.6; Phenotype=Ste
MNEEYCFSASTAVAQSWAQTNFRPVDEQPNSLVDTLIAKLSRTTFEQFTSEVSAQDIHKLCDITVSVLQQQSMLIRLQPPVVLCGDIHGQFRDLLRIFTTMGFPPDKKHLFLGDYVDRGTQSLETMVLLFCYKVKYPDSVILLRGNHECSNMNRAYGFFEEVE

SEQ ID NO: 119752 - protein, 123 aa, Heterodera glycines
  Coding regions on vcDNA: vcDNA=SeqID_46175; Strand=-; Position=1 -136,213-334,376-488
  Homolog annotation: Hit_ID=NP_505859.1; Match level="QueryCoverage =99%, HitCoverage=27%, E-value=9e-22, Identity=47%"; Hit description =human neuronal Ceroid LipofusciNosis related (47.1 kD) (cln-3.1) [Caenorhabditis elegans] gb|AAK38269.1|
  Essential gene: C elegans homolog=C01G8.2; Phenotype=Emb
IFGLANNFAFVVMLSAAKDIIKGPTKESANLNNATTNLSSENLCRHVLPKPSCNSISTGAILLAIIIPALVIKLMCPFVFDRVPFGFRHFLVCIMQALSFIIVAFSNSFTQSLIGVIFTSLGG

SEQ ID NO: 119753 - protein, 441 aa, Heterodera glycines
  Coding regions on vcDNA: vcDNA=SeqID_46176; Strand=+; Position=1-1326
  Homolog annotation: Hit_ID=NP_508269.1; Match level="QueryCoverage =95%, HitCoverage=63%, E-value=6e-44, Identity=26%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTCPQKISDSSPLAINSGLNIFSVPPTNVSVVRSFFRQVLPLATITQESPYLFRLYSDNLWTDLSRVYLYLELSIEKPGANDKWVAIDDADTSVSAIQGIGQTFVQQLKVTVGNTEVYDSGNLYTFKAYITNELSFPINAKKNFLGSTGYYHTVNQDDSTDDGFKERCKIFKGGKNAQFLSRLDFDLGNQELYLLNNLDLLFTIYKAKDVFLLQTLKANDSTKYRLTVHDVKIYAKMVEVQPSLNMSLYKTLEKQPATYAVRKTEIKSSFISVGRYEFEYNVFSATIPRRVTIALVGNSAFHGDYKLSPFMFEPFDLREISVHAGGVVYPAVPYKLNFSNDHFVSAFVDMYEALGMANSERSFDISMAQFKKGWTFFVIPLTSTLDDSCGFELLRNGTTNVRATFNSPIPHGGVEMIVLGEFDQMIMVDYNRHIVTDSKLG

SEQ ID NO: 119754 - protein, 537 aa, Heterodera glycines
  Coding regions on vcDNA: vcDNA=SeqID_46177; Strand=+; Position=1 -156,198-383,1036-1242,1354-1576,1623-1834,1882-1994,2038-2136,2182 -2278,2331-2417,2467-2567,2612-2742
  Homolog annotation: Hit_ID=NP_499596.1; Match level="QueryCoverage =78%, HitCoverage=20%, E-value=4e-74, Identity=37%"; Hit description =type 3 phosphatidylinositol (3N342) [Caenorhabditis elegans] emb|CAA22108.1| Hypothetical protein Y75B8A.
  Essential gene: C elegans homolog=Y75B8A.24; Phenotype=Stp
MAAHFPHIRSRIISEQISLIEEIIDKLFDYLNNSYNGHLGPVKNGKENQEIEITNSLSVELMRTTSILIGLLRAFGRYCNDISFPLISLIYPLPYNLPRKPTDESIHRKSNACHVKKLLSLDLLSKLDSIAGQVFLSSELRKFPYKTVSETLILVSVTLLRDILSPLSIGSGGNEVLECFAGELNEFVLSLFKHGQDSIAQKSQIDERNASSVDRDRSLPLKQQINDKEIAVNRVKMLVIANSICLELIVWSAVDESDGDMICGTISEKMWLPHRHVLAHMPVNVMALEALGSMAEKFPTLSSTLIIRLLSKFLTDPCPILLKIASELKPKDQQHQQLNAREELLSTRRKIGLASLRSAAINSLSRALKSALLIDQSSLQACLASLSSRLYTVASENDSKALLVSENLIQTLGKLGVSFVNDASSSELVLQIFLQRFSNPPSQQDNLIISSLADMWIAGANSIHDKTMKLFTRVTIESSSRVYSSDALPDSRYLHVSLAVDNALAKIANSLDSEEQQTLFLFRLLELFIQLGLEGQR

SEQ ID NO: 119755 - protein, 498 aa, Heterodera glycines
  misc_feature (489)..(489): Xaa can be any naturally occurring amino acid
  Coding regions on vcDNA: vcDNA=SeqID_46178; Strand=-; Position=1 -186,246-332,412-541,588-789,883-991,1092-1148,1191-1310,1541 -1680,1728-2018
  Homolog annotation: Hit_ID=CAE64300.1; Match level="QueryCoverage =86%, HitCoverage=78%, E-value=4e-76, Identity=39%"; Hit description =Hypothetical protein CBG08976 [Caenorhabditis briggsae]
  Essential gene: C elegans homolog=F56D2.1; Phenotype=Emb
CSIRSLVRTQTRVIQNLSPFQTQLPNSYEVLRDRGDTAELSQLKNGFRVASYANGRPTVTVGVWLNAGSRIVGVWLNAGSRIETNENNGIASLFEGLLHKGSGKRNSVQLQTELAKLGARLRSFTTREHSAFFVECLKSDTDKVVELLADALLNQNFDASKVELLADALLNQNFDASKIEEQRAVALDRLQGREGRHSRLMLDNLHATAFQGTPLRLSPLGTTKALNSLTKESVSEFADDILKASGMVLTAVGGVDHEKMSDLAEKHFGHLGNSYNRKVPPHKGYRFTAGEFLYRDDNKGYRFTAGEFLYRDDNYPLMHGAIAVEGIGRNHLDYIAMLVANAYVGTWDRSFAASLNAPKSTVQKMCANDDLIGYENFNISYDITGLFGFYIVMKGHSDEVTGLFGFYIVMKGHSDEVTGEATRAVLHAWKHLAMGITDEEVDAAKNALKARLFLGLENNSQIATHIASEVGHLTKWEEGGGRGKYDDLXEIISFFCRP

SEQ ID NO: 119756 - protein, 57 aa, Heterodera glycines
  Coding regions on vcDNA: vcDNA=SeqID_46179; Strand=+; Position=1 -40,168-298
  Homolog annotation: Hit_ID=NP_490675.1; Match level="QueryCoverage =82%, HitCoverage=22%, E-value=1e-15, Identity=85%"; Hit description =RAB family member (23.4 kD) (rab-11.1) [Caenorhabditis elegans] gb|AAB54158.1| Rab family protein 11.1 [C
  Essential gene: C elegans homolog=F53G12.1; Phenotype=Emb,Ste
MSSQEDEYDYLFKVVLIGDPGVGKSNLLSRFTRNEFNLESKSAAGVDLFFEFSPSIK

SEQ ID NO: 119757 - protein, 46 aa, Heterodera glycines
  Coding regions on vcDNA: vcDNA=SeqID_46180; Strand=-; Position=1 -115,163-353
  Homolog annotation: Hit_ID=XP_214640.1; Match level="QueryCoverage =93%, HitCoverage=18%, E-value=3e-15, Identity=83%"; Hit description =similar to cleavage and polyadenylation specific factor 5; cleavage and polyadenylation specific factor 5
  Essential gene: C elegans homolog=F43G9.5; Phenotype=Emb,Sck,Stp
FFAVPKNFKLVAAPLFELYDNSAGYGPLIASLPQILSRFNFLYNYA

SEQ ID NO: 119758 - protein, 127 aa, Heterodera glycines
  Coding regions on vcDNA: vcDNA=SeqID_46181; Strand=-; Position=1 -83,137-437
  Homolog annotation: Hit_ID=AAA62548.1; Match level="QueryCoverage =77%, HitCoverage=25%, E-value=2e-13, Identity=36%"; Hit description =Hypothetical protein C45G9.5 [Caenorhabditis elegans] ref|NP _498072.1| putative cytoskeletal protein (36.0
  Essential gene: C elegans homolog=C45G9.5; Phenotype=Lva
MGCYKRLSNHWVIFRCRQRQWANIFPAMHGDSLLILDKTGRIQKFTREGHFVEISAKIDDYIGNGFTIREDEAVIACSGIVKDEVTVGETKDEFMCCTMRNVQEGKTMCDDWVENIRLDGSRWTEEA

SEQ ID NO: 119759 - protein, 115 aa, Heterodera glycines
  Coding regions on vcDNA: vcDNA=SeqID_46182; Strand=+; Position=1 -20,236-346,430-646
  Homolog annotation: Hit_ID=NP_506653.1; Match level="QueryCoverage =90%, HitCoverage=57%, E-value=5e-20, Identity=46%"; Hit description =putative endoplasmic reticulum protein, with a transmembrane domain (5P303) [Caenorhabditis elegans] emb|
  Essential gene: C elegans homolog=W06A7.2; Phenotype=Unc
MAQYVPCAGALLPFALVLIIAGLLLLHCGWAAHLLDVGEGMPYGEYSTTKTVSTSTRTKRTAPKGEEEPVFEEIEGKQPPPEIKQGFWQFDEREAWQTVANPYPIKWTNLHGPSL

SEQ ID NO: 119760 - protein, 107 aa, Heterodera glycines
  Coding regions on vcDNA: vcDNA=SeqID_46183; Strand=+; Position=1 -159,310-474
  Homolog annotation: Hit_ID=NP_594438.1; Match level="QueryCoverage =88%, HitCoverage=84%, E-value=6e-30, Identity=62%"; Hit description =60S ribosomal protein L34 [Schizosaccharomyces pombe] emb|CAA16982.1| SPAC23A1.08c [Schizosaccharomyces p
  Essential gene: C elegans homolog=C42C1.14; Phenotype=Lva
MPERLTYRRRLCYNTKSNKTKVVKTPGGRNVFHYRNKLGSIPKCGDTGVPLKGIKAARPRQLAKMTKRKKTVTRAYGGCLSAAAVRQRIIRAFLVRTYHWTQRIVLC

SEQ ID NO: 119761 - protein, 154 aa, Heterodera glycines
  misc_feature (4)..(4): Xaa can be any naturally occurring amino acid
  Coding regions on vcDNA: vcDNA=SeqID_46184; Strand=-; Position=1 -241,308-459,825-903
  Homolog annotation: Hit_ID=AAL26582.1; Match level="QueryCoverage =85%, HitCoverage=51%, E-value=3e-56, Identity=80%"; Hit description =ribosomal protein S6 [Spodoptera frugiperda] sp|Q95V32|RS6_SPOFR 40S ribosomal protein S6
  Essential gene: C elegans homolog=Y71A12B.1; Phenotype=Ste
IDIXASFKGYVLRISGGNDKQGFPMKQGVITNSRVRLLLSKGHSCYRQRKKGERKRKSVRGCIVDSNMSVLALVVVKKGEQEIEGLTDRVVPRRLGPKRATKIRRLFNLNKEDDVRKYVIRRTLPAKEGKPSLKTDYVFGIKDFLRIPLRPRRH

SEQ ID NO: 119762 - protein, 84 aa, Heterodera glycines
  Coding regions on vcDNA: vcDNA=SeqID_46185; Strand=-; Position=1 -48,94-297
  Homolog annotation: Hit_ID=CAE64108.1; Match level="QueryCoverage =100%, HitCoverage=16%, E-value=5e-21, Identity=64%"; Hit description= Hypothetical protein CBG08717 [Caenorhabditis briggsae]
  Essential gene: C elegans homolog=H28O16.1a; Phenotype=Emb,Lva
MLSKKLFQSILNKSPKTAFSTSARLSASSAEVSRILEEKILGQASQINLEETGRVLSIGDGIARVYGLKNIQAEEMVEFDSGMK

SEQ ID NO: 119763 - protein, 95 aa, Heterodera glycines
  Coding regions on vcDNA: vcDNA=SeqID_46186; Strand=+; Position=1 -45,157-396
  Homolog annotation: Hit_ID=XP_395392.1; Match level="QueryCoverage =89%, HitCoverage=7%, E-value=4e-39, Identity=87%"; Hit description =similar to CG13391-PA [Apis mellifera]
  Essential gene: C elegans homolog=F28H1.3; Phenotype=Emb,Lva,Unc
MEQEQQQNVHHSGREIPHEDPTLLFTNAGMNQFKPIFQETVDPNSDMAKLKRAVNTQKCIRAGGKHNDLDDVGKDVYHHTFFEMLGNWSFGDNFK

SEQ ID NO: 119764 - protein, 415 aa, Heterodera glycines
  Coding regions on vcDNA: vcDNA=SeqID_46187; Strand=+; Position=1 -183,250-380,440-683,750-929,998-1114,1165-1557
  Homolog annotation: Hit_ID=AAL78213.1; Match level="QueryCoverage =51%, HitCoverage=85%, E-value=9e-69, Identity=62%"; Hit description =probable protein kinase Hgg-20 [Heterodera glycines]
  Essential gene: C elegans homolog=R90.1; Phenotype=Lva,Unc
MTDSLVELSPGALVSGRWTVIKKLGAGAFGAVYLCQDQDGITKGALKTEPINAPFPLLALEAIVLRSFDTLRASSGKHFCRCMDLGRDQQLDAASGRTLEFNFIVMSLVGRPFDKLLQESGDCFSPGTAIGAALQLLKALQALHEVGYLHRDIKPANFAIGLPETNEQRLLYLLDFGMSRKYLKDDGTIRRQRASANFRGTPIYAPISAHIKRDYSRGDDIESWFYVLIKFYKGAVPWKFIKDINEIGQYKCRRLKDEPAKVRKEALEELTGGCPPEFNKILAHIDGLEPEDRPDYEMIEKTLRGCLKKLDVREHPYDWEVGRQNVPLQQRQASSDQEKKKKGGSSHKKSGSSDKKSASSHKKKKSNSAEDKKKSQAPQKKRKSNSEEEKKKKSQAPQKKRKSNSEERKKPSKKK

SEQ ID NO: 119765 - protein, 173 aa, Heterodera glycines
  Coding regions on vcDNA: vcDNA=SeqID_46188; Strand=+; Position=1 -126,203-356,410-510,742-782
  Homolog annotation: Hit_ID=CAE59959.1; Match level="QueryCoverage =98%, HitCoverage=6%, E-value=5e-51, Identity=54%"; Hit description =Hypothetical protein CBG03449 [Caenorhabditis briggsae]
  Essential gene: C elegans homolog=F25H8.3; Phenotype=Pvl,Rup,Stp,Unc
SVSQQCKFVFGAAAEIGPYMPTCRRLWCSVSFGYQMGCRTQHMPWADGTPCGDHMPWADGTPCGDNMWCHRGQCVGMSPMQRQPVDGGWGEWKPWRECSRTCGGGVQKSFRECDSPPPENSGKYCIGGVQKSFRECDSPPPENSGKYCIGQRERYRPCNIQNGPWETPFRELQ

SEQ ID NO: 119766 - protein, 852 aa, Heterodera glycines
  Coding regions on vcDNA: vcDNA=SeqID_46189; Strand=+; Position=1 -169,222-532,578-809,852-1042,1181-1408,1691-1990,2035-2112,2163 -2228,2275-2604,2651-2809,2856-3025,3075-3183,3241-3456
  Homolog annotation: Hit_ID=NP_510140.1; Match level="QueryCoverage =98%, HitCoverage=45%, E-value=0.0, Identity=46%"; Hit description =CHromoDomain protein, DNA binding helicase Mi-2 like, required for vulval cell fate determination (205.3 kD
  Essential gene: C elegans homolog=F26F12.7; Phenotype=Lva
MSDSELMDTLEGGLNPDDELNDTVGDPDSMEEDEEQEEREQDGADEDPMLESTSGQADDLSKKSRKFAGGKKKGRKGKRSARSGGSREQLPDAYTHSSTELCTMLSMTNAEFEYSEDDFKNITSGKTVNSRFHQTLQELNPKASWARLQCVMTAKYNEYQKMLADQGRQMPKKVPSRSSAVGNAGGATPKESMASSSPSFVKHLPSGSSATIAEKVAPLKIRLSARKKRRNDDSEEDMNSDQEFESLLKEHERQLDEQDKEKEEKKQARVAAKKARDTTKQQQKVKRRKEEGGEEAEGELQQEHQDYCEVCQQGGEIILCDTCPRAYHLVCFDPDLEEPPEGFWSCPHCEQNGVPKTADGGDANAAPGNMEKCRVCNTKEPKNRPEKILSWRWIEYKYPEQVSEEDALKEGEQPANIEDEARRVRLFLHPQKEMKPRREREFFIKWKYMSYWHCEWVPELVLELYFTQTLRMYWRKMDPEVPPEVDDGSNEDMKTGKIDDREKEDDPHNLEQKFYRYGIKPEWMQVHRVISHVYYEKNLFDYLVKWRELVYDQATWERDDFDIPGLEEAIFKYWMHRCQLQFMQQKTMFRERMSGEAMPKYILKKLNKKRAEQGFVTFEEDEKKRKKREGKATIDIKKKYDVQPDFVSETGGTLHPYQLEGINWLRHCWANGIDAILADEMGLGKTIQSLEFIYSLVKEGHSKGPFLIAAPLSTLINWEREAEFWAPDLYVVTYIGDKESRSVVREHEFSFIEGATRGGPKASRLRTDQGIKFHVMLTSYELVSIDKAILSSIDWAVLVVDEAHRLKNNQSLFFRTLREFNIGYRLLLTGTPLQNNLEELFHLLNFLSPDRF

SEQ ID NO: 119767 - protein, 159 aa, Heterodera glycines
  Coding regions on vcDNA: vcDNA=SeqID_46190; Strand=+; Position=1 -165,230-325,489-611,805-900
  Homolog annotation: Hit_ID=XP_309104.1; Match level="QueryCoverage =99%, HitCoverage=32%, E-value=2e-40, Identity=48%"; Hit description =ENSANGP00000020546 [Anopheles gambiae]
  Essential gene: C elegans homolog=ZK1128.5; Phenotype=Pvl,Stp,Unc
MRFMEVPQRLQTLLQQPDPLIIHHVIRWDGSGSSVGAAAAADGSPTENKNTACYDVDVELDDPIKQQQSAFLQSNANVQELMALDHKIYNTVEEINELKVRRDFFASFVENPQAFVEKWLISQSRDLKNLSEISADYEMERRADNYYQPVVQEGVFRYM

SEQ ID NO: 119768 - protein, 83 aa, Heterodera glycines
  Coding regions on vcDNA: vcDNA=SeqID_46191; Strand=-; Position=1 -75,132-222,748-830
  Homolog annotation: Hit_ID=NP_502547.1; Match level="QueryCoverage =100%, HitCoverage=42%, E-value=2e-28, Identity=69%"; Hit description= cytochrome-c oxidase assembly protein (4O11) [Caenorhabditis elegans] emb|CAB05232.1| Hypothetical prote
  Essential gene: C elegans homolog=JC8.5; Phenotype=Gro,Stp
VAKALEHIEQMNTVPERLIRVRFNADVNSSMQWKFKPVQNEIYVNPGETALAFFTAENPSDRPIVGISTYNLTPFQAAYYFNK

SEQ ID NO: 119769 - protein, 94 aa, Heterodera glycines
  Coding regions on vcDNA: vcDNA=SeqID_46192; Strand=+; Position=1 -104,327-504
  Homolog annotation: Hit_ID=NP_493247.1; Match level="QueryCoverage =97%, HitCoverage=29%, E-value=4e-30, Identity=66%"; Hit description =transducin WD-40 repeat protein family like (1N446) [Caenorhabditis elegans] pir||T26531 hypothetical pro
  Essential gene: C elegans homolog=Y18D10A.9; Phenotype=Emb,Stp
GLEGHENEVKCVAFSASGEHLATCSRDKSVWVWQMDDAGDFQVISILQHHTADVKFVLWHPREELLVSGGYDGSVRFYASDGEDWCTGHSVNGD

SEQ ID NO: 119770 - protein, 241 aa, Heterodera glycines
  Coding regions on vcDNA: vcDNA=SeqID_46193; Strand=-; Position=1 -63,203-420,482-602,928-1083,1136-1235
  Homolog annotation: Hit_ID=NP_508870.2; Match level="QueryCoverage =100%, HitCoverage=32%, E-value=4e-64, Identity=52%"; Hit description= amyloid Precursor-Like, Unidentified Vitellogenin-linked Transcript (79.2 kD) (apl-1) [Caenorhabditis el
  Essential gene: C elegans homolog=C42D8.8a; Phenotype=Unc
QEEEEDEDDEEYGDDDEEEEPETTADAKAEQDPYFKDDPQGNEHERFRDAEERLEKRHRKKVTKVITEWSELFERYSTMKEKDPKGAEQYKRNMTAKFRKTVAATAKFRKTVAALEAENKEQRKQIEELHDERVQTALNEKKRQATHEYRAALAVQVGQTNRQNVLRTLKNYIRAEEKDRQHMLNRYRHLLRSDPEAALSFEPILLHRAALSFEPILLHRLRYIDLRINGTLAMLRDFSSL

SEQ ID NO: 119771 - protein, 438 aa, Heterodera glycines
  Coding regions on vcDNA: vcDNA=SeqID_46194; Strand=+; Position=1-1317
  Homolog annotation: Hit_ID=NP_508269.1; Match level="QueryCoverage =99%, HitCoverage=66%, E-value=3e-51, Identity=31%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MAFHKIDNDSVNSITNALDFFRIPPTNVSVSSSKVFELLPSNPLTDTPYHFKLHSSQNYIDLSKCYLLSEFRIRKENANGQLVDLAADEVAPIQLIGHTFIRNIKMSINGREVFNANSLMAYKSYFSHELSYSTAAKDSHLNAAGYYRDTGGVLEVGDGCTARRNLFVGSRTAQFIAKIDADLFNQPLYLINFCELDIEILPNDNDFVLITPPGVAAATRYHFEVVGLKMYVKKVSLMDGLALDIARKLELKPARYAVRKTLMKSLFISHGRFEFTSNLFMDQIPRRITMGLVANADYVGTVSRSPFNFQPFNVREISIIANGRSYPQAAYDLDYPNGKYVRPFNDMNEAVGFANSSESNGITLAQFGTTHCIYMFNLTSSGDDQAALFDLIRNGTTAVSIKFNQAVPAGGIMLVVMGECDSLVMLDKNRSISTDITI

SEQ ID NO: 119772 - protein, 131 aa, Heterodera glycines
  misc_feature (6)..(6): Xaa can be any naturally occurring amino acid
  Coding regions on vcDNA: vcDNA=SeqID_46195; Strand=-; Position=1 -41,1121-1476
  Homolog annotation: Hit_ID=AAP78680.1; Match level="QueryCoverage =95%, HitCoverage=77%, E-value=7e-30, Identity=54%"; Hit description =MBCTL1 [Monosiga brevicollis]
  Essential gene: C elegans homolog=ZK945.9; Phenotype=Gro
FLSIFXLSSSISTTMTTSTSSTSTSSTSTTTLSTSTATTPTSTTSSSSTSSTPSSSTSSTSSTSSTLSSSTSSASSTSSTPSCSSTSTDSTPSSSTTSTPSSSSISTSSTASTSTSSTPSSSTTSTSTPST

SEQ ID NO: 119773 - protein, 220 aa, Heterodera glycines
  Coding regions on vcDNA: vcDNA=SeqID_46196; Strand=-; Position=1 -123,424-752,960-1020,1164-1313
  Homolog annotation: Hit_ID=CAE62583.1; Match level="QueryCoverage =80%, HitCoverage=67%, E-value=6e-49, Identity=54%"; Hit description =Hypothetical protein CBG06697 [Caenorhabditis briggsae]
  Essential gene: C elegans homolog=F25H9.6; Phenotype=Gro,Stp
MATLSNTDSEEIPQKRPRENDKKDLTTSAEKNNSANGGSSEVVATQSALNFFDAADTQEIVYDDRDEWNMWKKRGDPVLHIGKVNFMIESQQIQLYKELRKWADSMLVAPLDANSLAKIANGICDNLVTSVVRAWDQRKPLYFAPAMNTAMWENPLTYQHLKTLKELLLYREIPPIEKEMMCGDKGYGAMASVQMIASIISSDIKNKYAVYSYSSENASS

SEQ ID NO: 119774 - protein, 100 aa, Heterodera glycines
  Coding regions on vcDNA: vcDNA=SeqID_46197; Strand=-; Position=1 -147,1889-2044
  Homolog annotation: Hit_ID=NP_500650.1; Match level="QueryCoverage =46%, HitCoverage=20%, E-value=2e-09, Identity=67%"; Hit description =translation initiation factor eIF-1A (24.4 kD) (4F575) [Caenorhabditis elegans] gb|AAK29845.1| Hypothetic
  Essential gene: C elegans homolog=H06H21.3; Phenotype=Emb,Gro,Sma,Unc
MREMKANGQNGKEEAFDWRIYNQWNRISHVVNCNAQLGDGSANAYSNIQADVILKYTPDEARILKNSGQLPESTKLNEVGEEQNEGEVEFSEFNSKQQFT

SEQ ID NO: 119775 - protein, 73 aa, Heterodera glycines
  Coding regions on vcDNA: vcDNA=SeqID_46198; Strand=+; Position=1 -151,476-545
  Homolog annotation: Hit_ID=AAP30833.1; Match level="QueryCoverage =95%, HitCoverage=28%, E-value=1e-33, Identity=95%"; Hit description =putative gland protein G8A07; Hg-G8A07 [Heterodera glycines]
  Essential gene: C elegans homolog=T26C5.3a; Phenotype=Emb
CLSTHSVLGVCTSKHDEELCKAGGDACEFVIDGYYISVAICVVVGLLWYRIFYRRIKYFQKIPRQDWRVIKTK

SEQ ID NO: 119776 - protein, 159 aa, Heterodera glycines
  Coding regions on vcDNA: vcDNA=SeqID_46199; Strand=-; Position=1 -115,154-329,372-461
  Homolog annotation: Hit_ID=NP_507032.1; Match level="QueryCoverage =81%, HitCoverage=92%, E-value=1e-53, Identity=85%"; Hit description =histone (13.4 kD) (his-3) [Caenorhabditis elegans] ref|NP_505296.1| histone (13.4 kD) (his-19) [Caenorhab
  Essential gene: C elegans homolog=T23D8.6; Phenotype=Emb
MSGRGKGGKAKSGGKAKSRSSRAGLQFPVGRLHRLLRKGHYAERVGAGAPVHYAERVGAGAPVYLAAVLEYLAAEVLELAGNASRDNKKTRINPRHLQLAVRNDEELNKLLSGVTIAQGGVLPNIQAVLLLSGVTIAQGGVLPNIQAVLLPKKTHGESQ

SEQ ID NO: 119777 - protein, 176 aa, Heterodera glycines
  Coding regions on vcDNA: vcDNA=SeqID_46200; Strand=+; Position=1 -101,146-239,384-674
  Homolog annotation: Hit_ID=CAA45761.1; Match level="QueryCoverage =98%, HitCoverage=21%, E-value=2e-39, Identity=50%"; Hit description =unc-93 [Caenorhabditis elegans]
  Essential gene: C elegans homolog=C46F11.1; Phenotype=Unclassified
SSLVFGPLIKLFGRMPLLMFGAVINLLMIITLMIWVVNPGDRTLFNAVIWVVNPGDRTLFNAVAGVWGMADGVWNTQLNGFWVALLGPGRDQLEVAFANYRFWMSFGLALGFFLIRATSIDTFLLISFAFLLMGILGYFLVELFEIIAVKSKFELGLKETFLQMKLELERRTTEVI

SEQ ID NO: 119778 - protein, 175 aa, Heterodera glycines
  Coding regions on vcDNA: vcDNA=SeqID_46201; Strand=-; Position=1 -33,229-723
  Homolog annotation: Hit_ID=BAA88337.1; Match level="QueryCoverage =81%, HitCoverage=14%, E-value=3e-15, Identity=37%"; Hit description =ORF2 [Platemys spixii]
  Essential gene: C elegans homolog=ZK250.3; Phenotype=Clr,Lvl,Sck
MKLGKMVKNKWILKVLKTREIKTLTTAYKTFVRPQLEYATEVWNPNLKKDIDKIERVQKFFTRKAFRKCGFLYRKYKERLKITDLHKLEERRKINDLTTAFKIIKGFTSLDAEKSFFFSERPRRPLLLRVKRHTAKTQNNFFNRIVKSWNNLPVVAVQINKAKEFRGLLKAMSSE

SEQ ID NO: 119779 - protein, 64 aa, Heterodera glycines
  Coding regions on vcDNA: vcDNA=SeqID_46202; Strand=+; Position=1-193
  Essential gene: C elegans homolog=Y54G11A.10; Phenotype=Gro
AVSPSFNFLRRPLPLLVFRRSLFKPPLDSPFCGIYRTNGEICRTDDILVCQHKMNYHPGANVPR

SEQ ID NO: 119780 - protein, 172 aa, Heterodera glycines
  Coding regions on vcDNA: vcDNA=SeqID_46203; Strand=-; Position=1 -178,250-377,426-522,565-681
  Homolog annotation: Hit_ID=CAE60905.1; Match level="QueryCoverage =76%, HitCoverage=34%, E-value=1e-19, Identity=40%"; Hit description =Hypothetical protein CBG04621 [Caenorhabditis briggsae]
  Essential gene: C elegans homolog=C15H11.6; Phenotype=Emb
ELIGLYIRSSHNIIQQHKWQSYRDKIIYRGPMDIAVALSKLPPTEHIKQSFLLDFNFTSDNLIVLSLQGIFRDGKEVSDGSTNFLNMKFFTRQFAIVPKTEGIAIISDILQITPISNARMERYNNLLKNATVAQVQQSALVPGGVLASAVQQQIDGMAPPPPSPQTQPVLMI

SEQ ID NO: 119781 - protein, 146 aa, Heterodera glycines
  Coding regions on vcDNA: vcDNA=SeqID_46204; Strand=-; Position=1 -178,502-763
  Homolog annotation: Hit_ID=NP_508494.1; Match level="QueryCoverage =39%, HitCoverage=10%, E-value=2e-13, Identity=57%"; Hit description =C2H2 type zinc finger containing protein (XD472) [Caenorhabditis elegans] gb|AAA81404.2| Hypothetical pro
  Essential gene: C elegans homolog=F53B3.1; Phenotype=Egl
VLNASGTPINGAFTFWSAPSTAAPAATASVSNLSATTTVISSEPDLTPLTPSTSDVTVNGHSSNVKVLKPVPLVIRTQSADEIAGAVAHPTKPSEIRKLIRSKMVRCRICRNRFLDKHIYERHLRDRHPKEHAAYLSQQEDEVRQQ

SEQ ID NO: 119782 - protein, 181 aa, Heterodera glycines
  Coding regions on vcDNA: vcDNA=SeqID_46205; Strand=+; Position=1 -121,191-468,522-668
  Homolog annotation: Hit_ID=NP_499587.1; Match level="QueryCoverage =96%, HitCoverage=63%, E-value=1e-56, Identity=56%"; Hit description =atp-binding protein like (31.0 kD) (3N306) [Caenorhabditis elegans] emb|CAA22102.1| Hypothetical protein
  Essential gene: C elegans homolog=Y75B8A.14; Phenotype=Emb
MAMGPNGALVYCMEYLADNLDWLHSHLNEGEDDYFLFDCPGQIELYSHLPVMCQIVQALREWNFNVCSTFVMDTTFCLDSTKFMSATLTALSTTVSLQTPAVNVLSKMDLLRPEDRRTVEEIVDGELQNAMEKQGKSQWEEKHRQLTDALSTVINDYSMVRFIPLELQDEQSIEGGRMNEE

SEQ ID NO: 119783 - protein, 156 aa, Heterodera glycines
  Coding regions on vcDNA: vcDNA=SeqID_46206; Strand=-; Position=1 -93,147-320,373-489,648-734
  Homolog annotation: Hit_ID=NP_492352.1; Match level="QueryCoverage =88%, HitCoverage=94%, E-value=7e-23, Identity=45%"; Hit description =ATP Synthase G homolog (14.9 kD) (asg-1) [Caenorhabditis elegans] emb|CAB03179.1| Hypothetical protein K0
  Essential gene: C elegans homolog=K07A12.3; Phenotype=Emb,Gro,Stp
MATRKLSFPEKIANILGVIYRYHEPRLPRYKDILKKVCVRELAPPTPKDWPQVYTFFNIYIFSYIKIKADYAKLDTVMRTQAYRQFKLKEFLVYSAVFVEVLCWFFVGEIIGRGSLTGYIVRSSFVDPKAAKKMAHFKWDDHHELKVENDEEQSGH

SEQ ID NO: 119784 - protein, 304 aa, Heterodera glycines
  misc_feature (217)..(217): Xaa can be any naturally occurring amino acid
  Coding regions on vcDNA: vcDNA=SeqID_46207; Strand=+; Position=1 -117,194-254,323-427,474-554,628-890,974-1109
  Homolog annotation: Hit_ID=CAE66646.1; Match level="QueryCoverage =98%, HitCoverage=38%, E-value=1e-56, Identity=39%"; Hit description =Hypothetical protein CBG11983 [Caenorhabditis briggsae]
  Essential gene: C elegans homolog=F02D10.5; Phenotype=Gro,Unclassified
FDSGFRYFVHEKFSMPYLSTEGISVSPGIKVFSAISPTHYILLPHEMWGNCSDQWPEDLRSPLRYSSLKCKTLCSPLRYSSLKCKTLCRAKYFNELCGCSPFSYNIDEFFSVCTPYEIYKCLGSTVLNDTKLFFSVCTPYEIYKCLGSTVLNDTKLSQNEQILPNCPQCKIEQILPNCPQCKIECQRWVYHTYNSYTEAFVRKPKDKWRRKAEQWQXMFKMKTIDSLKVDHRLLNIFYRDMAYTEYKQVQSLSMTEILSDIGGNMGLFLGMSLISLIEFVTYICKISWLFVSKRRRDHMARNEI

SEQ ID NO: 119785 - protein, 392 aa, Heterodera glycines
  Coding regions on vcDNA: vcDNA=SeqID_46208; Strand=-; Position=1 -182,260-347,418-548,621-726,786-893,949-1068,1138-1214,1276 -1345,1403-1546,1609-1707,1967-2020
  Homolog annotation: Hit_ID=NP_507514.1; Match level="QueryCoverage =80%, HitCoverage=87%, E-value=2e-70, Identity=44%"; Hit description =ubiquitin specific protease 8 (5S413) [Caenorhabditis elegans] emb|CAC14405.1| Hypothetical protein Y59A8
  Essential gene: C elegans homolog=Y59A8B.2; Phenotype=Gro,Sma
MTASSQGRPLPDGNFGNHAGPPHPRRRKALPTSDDVTEQPTTHPTMSPAPFVPTRQPAQPLTDDGTGNFFMSAYAMSAQRIASDSEWKKTPLGQTGLFNMGNTCFMNATLQPLFHTPGFSQLFQEKSAQRFVNGNNSFGTNGMISGSFSALIDLIWSGKFNALRPTTFLEFFARRVNTEMADRQQHDAQEFQLYLLDALHEDTNRVNKRQSFEQNYDDTDLGASASDFNERSKLFSSSPVNDLFNLTNISMVQCSTCNTTSVRFEVVNQLSLELPTNTDDLTLKDCLEAHFSSASLEDKWDCPKCKSKQPATRSTKIWEIPKVLIVHLKRFSLNDGHYVKNNVEVTFDVAELDLAPFLHEKSPHHNTALSLYGITSKHAFLLYYKRMNSKAT

SEQ ID NO: 119786 - protein, 260 aa, Heterodera glycines
  Coding regions on vcDNA: vcDNA=SeqID_46209; Strand=+; Position=1 -67,110-183,223-329,370-392,492-765,858-935
  Homolog annotation: Hit_ID=CAE68442.1; Match level="QueryCoverage =97%, HitCoverage=47%, E-value=1e-56, Identity=49%"; Hit description =Hypothetical protein CBG14230 [Caenorhabditis briggsae]
  Essential gene: C elegans homolog=F56B6.5; Phenotype=Unclassified
THSSVLHMRLALTVTHLLLVSLGSVNLLVIFVILIRPYMRSVNLLVIFVILIRPYMRSITNVYMISLCLADFIYLTNLTLVAVTISLCLADFIYLTNLTLVAVTQLNDKSWPFSSFLCTLYHGTETTGYHGTETTGKYASVMFVVLLAVDRYCAMCKSNWCARYRTYRGAVLVSLAAWLFAALAASPLYFFAEVALLTLRSPVSPANRRELHKLCIAKWPNSDVARWYITISSVLYITISSVLIFALPLAVIFFCYYHIL

SEQ ID NO: 119787 - protein, 166 aa, Heterodera glycines
  Coding regions on vcDNA: vcDNA=SeqID_46210; Strand=+; Position=1 -248,302-554
  Homolog annotation: Hit_ID=CAE72614.1; Match level="QueryCoverage =77%, HitCoverage=56%, E-value=6e-35, Identity=55%"; Hit description =Hypothetical protein CBG19806 [Caenorhabditis briggsae]
  Essential gene: C elegans homolog=ZK909.3; Phenotype=Unclassified
MSHDNGNNAFPAASSIYPSLPSALCDEKPSPAAVLSHCDDMEGISLLVKAADFAARRHRFQKRKDERTPYINHPIGVAFLLISVAKVYDPATLAAAYLHDLVEDTKTTFEELEQLFGREVAEIVRECTDDKNLPKDVQRKKQVEKAAGSSYKVKRKSERRKKHCAD

SEQ ID NO: 119788 - protein, 106 aa, Heterodera glycines
  Coding regions on vcDNA: vcDNA=SeqID_46211; Strand=+; Position=1 -126,189-272,520-630
  Homolog annotation: Hit_ID=NP_499734.1; Match level="QueryCoverage =92%, HitCoverage=27%, E-value=9e-09, Identity=37%"; Hit description =cleavage and Polyadenylation Factor (cpf-2) [Caenorhabditis elegans] emb|CAB05746.1| Hypothetical protein
  Essential gene: C elegans homolog=F56A8.6; Phenotype=Emb
MGMAPPSLLQQQQQQTPFTQQKPTPIAPLAVPPAATAPQQQQAVSPPPLSQQAQQSNSDNLDEEQQAQMLIRVLQLTDEQIRMLPPTERAQVIELRNQLRSADANA

SEQ ID NO: 119789 - protein, 302 aa, Heterodera glycines
  Coding regions on vcDNA: vcDNA=SeqID_46212; Strand=-; Position=1 -78,178-255,373-427,474-615,719-811,855-925,970-1000,1156-1239,1285 -1362
  Homolog annotation: Hit_ID=XP_319061.1; Match level="QueryCoverage =99%, HitCoverage=52%, E-value=1e-88, Identity=59%"; Hit description =ENSANGP00000013182 [Anopheles gambiae]
  Essential gene: C elegans homolog=F39H11.3; Phenotype=Dpy
IDTNFREELSRIREKVEDIYTYEGNKVGRGTYGHVYKTYGHVYKAILRNSPSGMDGKAYALKLIEGQGFSMSACREVALLRELNHPNLIKHPNLIKLLRVFLTTEKRVWLLFDYAEHDLWHIIKYHRSAKQRRQPVMVPKVPKGMVKSLLYQILDGIHYLHNNWIMHRDLKPANILVMGEGTGIERGRVPANILVMGEGTGIERGRVKIADMGFARVFHNPLKFARVFHNPLKPLSELDPVVVTFWYRAPELLLCSKHYTTAIDIWAIGCIFAELLAIDIWAIGCIFAELLTSEPIFVCTEV

SEQ ID NO: 119790 - protein, 225 aa, Heterodera glycines
  Coding regions on vcDNA: vcDNA=SeqID_46213; Strand=-; Position=1 -180,242-439,497-643,705-842,886-898
  Homolog annotation: Hit_ID=NP_495784.1; Match level="QueryCoverage =99%, HitCoverage=36%, E-value=7e-48, Identity=43%"; Hit description =component of the meiotic and mitotic spindle poles, ZYGote defective : embryonic lethal ZYG-9 (156.2 kD)
  Essential gene: C elegans homolog=F22B5.7; Phenotype=Emb
MDPYDLIEPVDISSKLNINFESQKWQERKEALDALQQLLLQSPRLADSPNYREVIEHLTKAMANDANIIVAASATKCVMFFAKGLRSKFTPYVSLVVPVIFTKFKEKKQLLRDALVECIDGIATYTSFDHLCKAVLEALSSKQNPSQKSQTDLFIYRVFRTLPANEIPKGLLKDLHGFDADSEVRDSSFAALGAIMKCTGEKALGCFISPELAKDTNKMPKIAEN

SEQ ID NO: 119791 - protein, 237 aa, Heterodera glycines
  Coding regions on vcDNA: vcDNA=SeqID_46214; Strand=+; Position=1 -239,300-439,482-563,770-910,948-981
  Homolog annotation: Hit_ID=CAE60841.1; Match level="QueryCoverage =93%, HitCoverage=46%, E-value=1e-60, Identity=54%"; Hit description =Hypothetical protein CBG04550 [Caenorhabditis briggsae]
  Essential gene: C elegans homolog=W09C5.2; Phenotype=Lon,Pvl,Stp,Unc
TPQELWHNKCPSPKVAHSALTVATNPFPTSDESQRKLKPPQNGNVHSSQNKAIPEIKLTGFVGFDSLPYQLVRKCQESGFQFNLLCVFQFNLLCVGETGMGKTTLLESLFNMKMEFEQCNRELKTVELREKTFDVQEGAVKVQEGAVKVKLRVVETAGFGDQLDKEKSAQIIVNYINDQFEAYLKEELKVKRNLSSYEDRRIHACIYFISPTGHGIKALDLITLREIKALDLITLRE

SEQ ID NO: 119792 - protein, 239 aa, Heterodera glycines
  Coding regions on vcDNA: vcDNA=SeqID_46215; Strand=+; Position=1 -98,205-302,543-724,775-837,883-1050,1241-1350
  Homolog annotation: Hit_ID=NP_495994.1; Match level="QueryCoverage =85%, HitCoverage=23%, E-value=3e-35, Identity=36%"; Hit description =smooth muscle myosin phosphatase regulatory subunit homolog family member, Maternal Effect Lethal MEL-11
  Essential gene: C elegans homolog=C06C3.1a; Phenotype=Emb,Stp
MRAFLAFEMRRKNVDEQKAREKEFAVLLEDCNKWLQTGLYLDKPHPRTGATALHVAASKGYNKLIGMLIRAGADVNAQDFEGWTPLHAAAHWGERDACRILMENGANLDALTHTVRKWQILNGWGGGHTVFSLADKSISDYLVNLQENFNQLRSEALQHQQQQQQNGATHNQPSNGSAVLQDMANLTLGKDKESSVDSERASKRSSSVYSSSEQDPSCDGQGGKCLANQEKKGFINEKR

SEQ ID NO: 119793 - protein, 194 aa, Heterodera glycines
  Coding regions on vcDNA: vcDNA=SeqID_46216; Strand=-; Position=1 -165,215-442,492-681
  Homolog annotation: Hit_ID=NP_777285.1; Match level="QueryCoverage =96%, HitCoverage=40%, E-value=1e-67, Identity=66%"; Hit description =RuvB-like protein 2 [Danio rerio] gb|AAH58871.1| RuvB-like protein 2 [Danio rerio] gb|AAL18005.1| RuvB-li
  Essential gene: C elegans homolog=T22D1.10; Phenotype=Emb,Lva
MSGIGNFEIRNVSKVERIGAHSHITGLGLKANFEPIFISDGMVGQCAARKAAGLIRLLKDGQIAGRALLIVGEPGTGKTAVAMGISKSIGGDTPFISISASEVFSMDLSKPEALTQSFRKAIGVRIKEETEVLCGEVVQLEIDRPQSGAGPRVGKLTLKTTDMEAIYDIGNKMTESVIKERITAGDVIQIDKAT

SEQ ID NO: 119794 - protein, 248 aa, Heterodera glycines
  misc_feature (65)..(65): Xaa can be any naturally occurring amino acid
  Coding regions on vcDNA: vcDNA=SeqID_46217; Strand=+; Position=1 -55,1644-1976,2024-2119,2288-2521
  Homolog annotation: Hit_ID=NP_509770.2; Match level="QueryCoverage =84%, HitCoverage=16%, E-value=5e-37, Identity=41%"; Hit description =bromodomain containing (XL193) [Caenorhabditis elegans] emb|CAA93473.3| Hypothetical protein F57C7.1a [Ca
  Essential gene: C elegans homolog=H20J04.2; Phenotype=Unc
SASKSLPGKRPPNRNLTDASHSSHDAHSDTMDVGEGLPIESMIDKDSPIKGWETPPQASISEFFXNTFFESVNGMVQPRVVPPVGKPTRWTNQLDFIMKDLLKQAKNHKHAWPFVRPVDAIKLSIPDYHKVIKRPMDLGTIEDYHKVIKRPMDLGTIERRLKNMYYYSASECLKDIMTVFNDCYLFNPPHFVYNMAKELEQFMLTLTKIPPNVSSFCDFEQIFNCYKFNQCEDDVTLMCKNVENLYRD

SEQ ID NO: 119795 - protein, 179 aa, Heterodera glycines
  Coding regions on vcDNA: vcDNA=SeqID_46218; Strand=-; Position=1 -244,631-701,759-887,1417-1511
  Homolog annotation: Hit_ID=EAK84730.1; Match level="QueryCoverage =83%, HitCoverage=41%, E-value=7e-45, Identity=61%"; Hit description =hypothetical protein UM03804.1 [Ustilago maydis 521] ref|XP _401419.1| hypothetical protein UM03804.1 [Usti
  Essential gene: C elegans homolog=T01C3.7; Phenotype=Emb,Lva
MVPGESVYGEKRISSQQTENAPIAAITPKTEETTNGSNGVSAPTAAAAGPAPPVEYRVWNPFRSKLAAAVMAGIEDTHIYPGARVLYLGAASGTSVSHVSDIVGPEGMVYAVEFSHRSGRDLLGMAKKRPNVVPIVDDARHPHKYSMMVTLEPYERDHAVVVAEYRAAKKKVKKEKMEE

SEQ ID NO: 119796 - protein, 507 aa, Heterodera glycines
  Coding regions on vcDNA: vcDNA=SeqID_46219; Strand=-; Position=1 -36,383-517,568-609,665-816,860-1105,1160-1399,1440-1551,1615 -1700,1807-2082
  Homolog annotation: Hit_ID=XP_342680.1; Match level="QueryCoverage =100%, HitCoverage=55%, E-value=4e-95, Identity=39%"; Hit description= similar to SCF complex protein cul-1 [Rattus norvegicus]
  Essential gene: C elegans homolog=D2045.6; Phenotype=Emb
LRANSSASYIIQVEERLGEERDRCQIYLDNTTMDSLMEACDTALIKQHLELFHDKFESLLTRQQNDHLGRMSLLTRQQNDHLGRMYTLCSRVPYTLCSRVPNGLAKLKEILEEYIEREGKASIQQIAREAFNDPKQYISCILKMHELYNRLVVDSFKTDHGFVQAMDLKMHELYNRLVVDSFKTDHGFVQAMDCAFRKFINNNEITAMARNASKSPQLLVLYCDQLLRKSARNMEDEKMDENLEQVGFVWTCQMCQMTVFKYIDDKDMFQAFFHKFLCKRLVYDTSASEEQERCMIAKLKHMCGFEYTSKLERLLTDVALSRDHSEQFKQVANEPRTSNVDFSPRTSNVDFSVIVVMSNVWPLQQPVKFEIPRPLLDCIDSYTQYYTNRFNYTQYYTNRFNGRKLTWALQMCRGELVSTLFKNCFFLQCNTQQIAVLMQYNERNTYTLGELHVALGTDFPGDQLCAVVQSLVKTNLLKLTSADGNLTETKLKQRAEIQRNPGFQNSK

SEQ ID NO: 119797 - protein, 254 aa, Heterodera glycines
  Coding regions on vcDNA: vcDNA=SeqID_46220; Strand=-; Position=1 -116,333-510,590-760,826-967,1102-1256
  Homolog annotation: Hit_ID=NP_955953.2; Match level="QueryCoverage =82%, HitCoverage=26%, E-value=3e-48, Identity=45%"; Hit description =cullin 1 [Danio rerio] gb|AAH66480.1| Cullin 1 [Danio rerio]
  Essential gene: C elegans homolog=D2045.6; Phenotype=Emb
MNNHPVRFETIWKDLLPGLESIFKTQERMAPQRYMEYYTLVFNYCTNQQNDFTHETTNNRARRGNRTTAGTAGAEFVGEELYTRLRHFVEEYTRKLLQECQRLSGDQLLDYYTEQWTKFQFSSTVVNGIFSYLNRHWIRRNIDEAVRPGILEVYNLAVSIWKSVIFDELHHNITSAALALVEKDRNGERITTRLISGVVASYIELGINEHDPAADVGGPATAAVAQQQQQNSVVHRPSVKYQVDRNYFEQRFLE

SEQ ID NO: 119798 - protein, 301 aa, Heterodera glycines
  Coding regions on vcDNA: vcDNA=SeqID_46221; Strand=-; Position=125 -259,316-577,633-870,926-1196
  Homolog annotation: Hit_ID=CAB88203.1; Match level="QueryCoverage =99%, HitCoverage=99%, E-value=1e-156, Identity=83%"; Hit description= putative cuticular collagen [Globodera pallida]
  Essential gene: C elegans homolog=C15A11.6; Phenotype=Emb
MQETHIVLGIASVCSLLAIIATVVTLPSLYSEMSQMNSKVRNGVEAFRVNTDSAWTDLMDVQVVVTPPSKPRANPFNSIFRAKRQLPGHCQCAGLQQPSCPPGPPGPAGPPGQPGQPGSAGQPGQAGQPGQPAAPCPPQNIPCPRCPAGPPGRPGGQGPPGQQGAPGQPGTPAQGGGPGTPGAPGPQGQPGQPGRPGASGQPGQPGANGVVSRPIPGPKGPPGAPGQNGNPGGQGQPGQPGGQGPPGPPGAPGQPGQPGNGGQPGQPGAPGQPGKDSGYCPCPPRSSVLAVKKKMAAAKKA

SEQ ID NO: 119799 - protein, 252 aa, Heterodera glycines
  Coding regions on vcDNA: vcDNA=SeqID_46222; Strand=+; Position=1 -57,505-613,661-788,834-941,1000-1116,1172-1268
  Homolog annotation: Hit_ID=NP_507514.1; Match level="QueryCoverage =90%, HitCoverage=54%, E-value=2e-33, Identity=38%"; Hit description =ubiquitin specific protease 8 (5S413) [Caenorhabditis elegans] emb|CAC14405.1| Hypothetical protein Y59A8
  Essential gene: C elegans homolog=Y59A8B.2; Phenotype=Gro,Sma
NDVTEKEAEFDGTKRVGQGPLGQTGLINLGNTCFINAILQPLFHTPGFSQLFRQKIIIESFGFIIESFGFFRNYGTKGVIAGSFSALIDQILSGNFNAIRPQVFLKEFFANVNAEKEFFANVNAELANGQQHDAHEFLIYLLNALHEDTNREKQQPFDQNYDNTDEKQQPFDQNYDNTDLRANAFDFFEKSKLFFSSPVNDLFNLTTISETKCITCNASSVLTTISETKCITCNASSVRFESVNQLRWVLFA

SEQ ID NO: 119800 - protein, 147 aa, Heterodera glycines
  Coding regions on vcDNA: vcDNA=SeqID_46223; Strand=-; Position=1 -140,336-456,543-725
  Homolog annotation: Hit_ID=NP_493687.1; Match level="QueryCoverage =99%, HitCoverage=6%, E-value=2e-25, Identity=40%"; Hit description =prion-like Q/N-rich domain protein, Prion-like Q/N-rich domain protein PQN-85 (pqn-85) [Caenorhabditis ele
  Essential gene: C elegans homolog=Y43H11AL.3; Phenotype =Bmd,Clr,Emb,Unc
MKTFITALMDKQHLKRRIQVLAKSGNVMVDSDALWVVKYLASKKELSQSFDLYLKKILEGFNPDLYPVAIRAKAMKCLAQIVEADYQVLMIAEVNKIVQDRLIDANASVREATFDLIGKCLVTRPDLLDTYYSILVNRTKVGGICIP

SEQ ID NO: 119801 - protein, 127 aa, Heterodera glycines
  Coding regions on vcDNA: vcDNA=SeqID_46224; Strand=-; Position=1 -35,99-447
  Essential gene: C elegans homolog=R08F11.2; Phenotype=Unclassified
MKIKLIFNDNECFVGVRVTAEVLLAINRCVQIISNRLANFLFQTWRTYVWLLLASVYGLYMLIFTKPILFTGLYVSWFNNPHVGYVDEADEMTVSCFFWVEAGMASQCLIGCDYILYSKPLKYCKTQ

SEQ ID NO: 119802 - protein, 149 aa, Heterodera glycines
  Coding regions on vcDNA: vcDNA=SeqID_46225; Strand=-; Position=1-450
  Homolog annotation: Hit_ID=NP_498735.1; Match level="QueryCoverage =100%, HitCoverage=35%, E-value=2e-15, Identity=30%"; Hit description= predicted CDS, putative cytoplasmic protein family member (3J53) [Caenorhabditis elegans] gb|AAK84536.1|
  Essential gene: C elegans homolog=F19G12.2; Phenotype=Unclassified
MGLVANTDYAGTILRSPFNFQPFNVREISISVNGRPYPQAPYDLDYRNGKYVRPFNDMNEAVGFANSTESNGITFAQYGKTHCIYVFNLTNSGDDQAALFDLIKNGTTAVSIKFNQPVPVGGIMLVVMGECDSLVMLDKNRSISTDTTI

SEQ ID NO: 119803 - protein, 198 aa, Heterodera glycines
  Coding regions on vcDNA: vcDNA=SeqID_46226; Strand=+; Position=1 -230,454-590,857-924,975-1064,1132-1203
  Homolog annotation: Hit_ID=NP_505099.1; Match level="QueryCoverage =99%, HitCoverage=38%, E-value=5e-35, Identity=42%"; Hit description =attachment protein (5I613) [Caenorhabditis elegans] gb|AAA96287.2| Hypothetical protein D1014.3 [Caenorha
  Essential gene: C elegans homolog=D1014.3; Phenotype=Emb,Ste
MYKGEEQRSSAAKCLLKVAHYAAELDQYQKAQLTFEEVAIYEADNPMLKYAAKTHFFQVQFFNNIFLGSPPSRKILLPIDSVVWVLFGRNRDGINCCCPIQALLCSLCIDLLDSQRALKRYEELSNYFADARECQLGKQIIEAMENGDPDGFTEAVQQFDKISRLDQWHVAMLVKVKRRCGDGGDVKNEAGEEEDDLR

SEQ ID NO: 119804 - protein, 205 aa, Heterodera glycines
  Coding regions on vcDNA: vcDNA=SeqID_46227; Strand=+; Position=1 -251,446-596,639-854
  Homolog annotation: Hit_ID=NP_495707.1; Match level="QueryCoverage =100%, HitCoverage=100%, E-value=7e-80, Identity=68%"; Hit description=ribosomal Protein, Large subunit (24.7 kD) (rpl-10) [Caenorhabditis elegans] emb|CAA88308.1| Hypothetic
  Essential gene: C elegans homolog=F10B5.1; Phenotype=Lva,Ste
MGRRPARCYRYIKNKPYPKSRFCRGVPDPKIRIFDLGRKRATVDEFPCCVHMISNEREHLSSEVNVNICCNFKKRMIFYFASKRFHVIRINKMLSCAGADRLQTGMRGAFGKPQGLVARVGIGDMLMSVRVRDQHQAHALEAFRRAKFKFPGRQYIVISRKWGFTPFDREVYEKHRKEGRVIPDGVNCRFLKQHGPLTEWLKNPI

SEQ ID NO: 119805 - protein, 134 aa, Heterodera glycines
  Coding regions on vcDNA: vcDNA=SeqID_46228; Strand=+; Position=1 -85,158-300,680-854
  Homolog annotation: Hit_ID=CAE62748.1; Match level="QueryCoverage =100%, HitCoverage=41%, E-value=2e-22, Identity=46%"; Hit description= Hypothetical protein CBG06912 [Caenorhabditis briggsae]
  Essential gene: C elegans homolog=K02D10.5; Phenotype=Ste
ELLEQREKLERAEQNLDTIHHTTQHTQRSLNSLKSWFGGLVRNKLSRAPKGLGTANANANNQQQQQEQTVQQQHQQRPLHAHLVQSSADEFAGAIGGGGGGVQPPQQHSLNSSSRAYIQGTRWEAMDDEIDNNL

SEQ ID NO: 119806 - protein, 274 aa, Heterodera glycines
  misc_feature (1)..(1): Xaa can be any naturally occurring amino acid
  Coding regions on vcDNA: vcDNA=SeqID_46229; Strand=-; Position=1 -111,161-291,348-405,450-529,570-615,659-776
  Homolog annotation: Hit_ID=NP_502255.1; Match level="QueryCoverage =90%, HitCoverage=48%, E-value=2e-57, Identity=48%"; Hit description =fatty acid desaturase, stearoyl-CoA desaturase (39.1 kD) (fat-6) [Caenorhabditis elegans] emb|CAB08356.1|
  Essential gene: C elegans homolog=VZK822L.1; Phenotype =Gro,Ste,Unc,Unclassified
XKPSQSIAHCSDVGIFLWFAGGVGITAGAHRLWSHKSYKARFPLRVLLVVLNCVAFQNHKSYKARFPLRVLLVVLNCVAFQNDVIEWSRDHRCHHKWTDTDADPHNINRGFFFSHMGWLLVKKHNINRGFFFSHMGWLLVKKHPQVKAHPQVKAKGSTLDLSDLTSDPLLAFQRKFYLPLVLLFCFLLPTKFYLPLVLLFCFLLPTLIPVLLWNESSSVAFYLIPVLLWNESSSVAFYTAAVFRYTFTLHATWLINSVAHMWGGSVTDEGNPSI

SEQ ID NO: 119807 - protein, 122 aa, Heterodera glycines
  Coding regions on vcDNA: vcDNA=SeqID_46230; Strand=-; Position=1 -17,802-909,1280-1520
  Homolog annotation: Hit_ID=NP_499212.1; Match level="QueryCoverage =96%, HitCoverage=10%, E-value=3e-51, Identity=83%"; Hit description =sex determination DEAH box protein, similar to pre-mRNA splicing factor ATP-dependent RNA helicase., Masc
  Essential gene: C elegans homolog=K03H1.2; Phenotype=Emb
MPFFLHDPDLDSYAAIIMDEAHERSLNTDVLFGLLRDVVARRSDLKLIVTSATMDADKFANFFGGHTPIFQIPGRTFPVEIYHARVPVEDHVDAAVKQAVKIHLGGMEGDILIFMPGQEDIE

SEQ ID NO: 119808 - protein, 362 aa, Heterodera glycines
  misc_feature (39)..(39): Xaa can be any naturally occurring amino acid
  Coding regions on vcDNA: vcDNA=SeqID_46231; Strand=+; Position=1 -221,266-490,677-877,933-1114,1190-1259,1322-1398
  Homolog annotation: Hit_ID=CAE74421.1; Match level="QueryCoverage =97%, HitCoverage=32%, E-value=5e-62, Identity=43%"; Hit description =Hypothetical protein CBG22153 [Caenorhabditis briggsae]
  Essential gene: C elegans homolog=Y71G12B.11a; Phenotype=Bmd,Lva,Lvl
PAKATSSPTAISRRLTPAPEGYLPHGAFRPTAETPAGGXAITDTLQLPIHLVGSAPQYGGVSGMIIAQEIPKGERIRYLDARERSQKALVGTGERIRYLDARERSQKALVGTIEATIRAVEEAEEEIQKPPQIELPQFGTQRHWRVEVEKEAVSDRLAAMGAATAEVVQLTAIPEETLDTRVGHAIATIGSNIPEMGRGVRQLAAIMPDESRAGDLMDAARKLCNAFGDFLEKVHPEKQEKRATIVHPEKQEKRATILSAASRVGELSHDMISTMHEQTEEERTFHEELNRRARAVATSTAQLVLQAKTVSAAKTVSAECEEPALKDQVIHSAMKTAFTAFATSELVACTRVTPTMNMACKE

SEQ ID NO: 119809 - protein, 441 aa, Heterodera glycines
  Coding regions on vcDNA: vcDNA=SeqID_46232; Strand=+; Position=1-1326
  Homolog annotation: Hit_ID=NP_508269.1; Match level="QueryCoverage =95%, HitCoverage=63%, E-value=2e-45, Identity=28%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTCPQKISENSPLAINSGLNIFSIPPTNVAVVRSFFRQVLPLATITQESPYLFRLYSDNLWTDLSRIYLYLELSIEKPGAIDKWIAIEDTDVSVSAIQGIGQTFVQQLKVTVGNTEVYDSGNLYPYKAYITNELSFPVNAKKNFLGSTGYYHTERHDDPTDDGFKERCKVFKGGNNAQFLSRLDFDLGNQELYLLNNLDLLFTIYKAKDAFLLQTLKANDDTKYRLTVHDVKIYAKMIEVQPSLNMNLYKTLEKQPATYAVRKTEIKSSYISSGRYEFEYNVFSSTIPRRVTIALVSNSAFNGDYKLTPFKFDPFDLREISVHAGGMVYPVVPHKLNFSKNYYVRAFVEMYEALGMANSERSFDVSMNQFKNGWAFFVISLNSTLDDSCGFELLRSGTTSIRATFDSPIPKGGVEMIVLGEFDQMIMIDYNRHIVSDSKLG

SEQ ID NO: 119810 - protein, 1224 aa, Heterodera glycines
  Coding regions on vcDNA: vcDNA=SeqID_46233; Strand=+; Position=1 -628,802-1485,1863-2969,4064-5319
  Homolog annotation: Hit_ID=NP_508269.1; Match level="QueryCoverage =34%, HitCoverage=63%, E-value=9e-49, Identity=28%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MQHTRRYLLVPEEIYESLISSPQDGSPIGLVRSRIKQIKNDNEINEEQRAFKYEQEFKRFNKLKNDEEERPVDVKIQNLQEVAETFPKPFNLIRKSAIPRRHNLKLGKRRKDYVDDDEEVFDDVKIPNKDDILNFIYKNSQALGISEQGQILKADGRPFITSNVEDIVDHLTKKDRSANKKDPTALKEFVARAKQNAVLSRRLFSDGQTDILKFLLTQRTYTLHRQAKRRFRRLPTLAPGLHIEWQADLAIFDRLSKYNRGLKYLLVCIDSLSRQIFVEPIKSKTSKNMIKAFDQIFKRTKYIPWKILTDQGKEFTARPIQEYYRSKDVEHFCMLTSPQFHAGMAERANRSIKERLYRYFTERNTYKWIDVIQDIVKGINHSMNSTIGMRPVDVTFANAEELRKKLYNEAAKNPRGNPKFHVGDRVRIEKHKHVFQKGNRTNSFRTRIPRKLQFNTEWEVGLAVIVYPHSWPSIGTAQQQFVEIEWQTGKALRIEVPPSNVTNPYELSKNLYKLLGEGSDHLAKQLRTTQNAFLLVINKARRWAREEYIKRKVKENRSIHDEEKLLHALLIDSESFIELKDVDRGLIAEEKHAETSKVPLRISTDDKDSYQKKLNEYFSGLSERDLNLIDDFIKAKVKSEIKKMTEDERMILEASKEVGMGAWLQAYRRIWLACQFTYDNNRNRFDLNFDTRYVKKVKITAQLAYILGFDNTEFLEPENEARFMPDMNGGVSSFNVYAPNLIEPMMIGDVTAPVLRIVTIRGKPDEVIEEQFLAIQYHKILLKEISEIFIEIRTNSGSLMPFQYGTFPPTNVSVIRSFFREILPLASITQESPYLFRLYSDNLWTDLSRIYLYLEISIEKHDANGKWTSIEDTDTNIAPIQGIGQTFVQQLKVTVGNTEVYDSGNLFPFKSYITNELSYPTSVKEHFLGSMGYYHTEAHDDSTDKGFKERCNVLKGGKHAQFLSRLDFDLGNQELYLLNNLDLLFTIYKAKDSFLLQTLKANDNNKYRLAVHDVKIYAKMIEVQPSLNMSLYKTLEKQPATYSVRKTEIKSSFISVGRYEFEYNVFSSTIPRRVTIALVGNSAFNGDYKLSPFKFEPFDLREISVHTGGMVYPAVPYKLDFPKNYFVRAFVDMYEALSMANSERTFDIKMSQFQNGWAFFVIPLNSTLDDSCGFELLRSGTTSIRATFNSPIPKGGVEMIVMGEFDQMIMIDYNRHIVSDSKLG

SEQ ID NO: 119811 - protein, 226 aa, Heterodera glycines
  misc_feature (32)..(32): Xaa can be any naturally occurring amino acid
  Coding regions on vcDNA: vcDNA=SeqID_46234; Strand=-; Position=1 -255,303-428,556-805
  Homolog annotation: Hit_ID=NP_491897.1; Match level="QueryCoverage =76%, HitCoverage=22%, E-value=1e-33, Identity=44%"; Hit description =transcription factor (75.7 kD) (1H161) [Caenorhabditis elegans] pir||T32750 hypothetical protein F57B10.1
  Essential gene: C elegans homolog=F57B10.1; Phenotype=Dpy,Emb,Lva,Lvl
STRLYRMVYNTYPFSELQLGMFACEFFMKRIXPIRLTSNNAPIEGVTLPDFYPLTKSEERELKRIRRKIRNKMSAQTSRRKKQDYIEALQERIFMSDSENREDYIEALQERIFMSDSENRELKKQIEVMAAENRQLAAQLRNMQASIGQSSKRNAQTGTCLAVLLLSVCLIVTPNSRHLGERTSEWTLSAATGASQNNSSKKRWANLSGIGGLNFDHPAYQQGIVF

SEQ ID NO: 119812 - protein, 78 aa, Heterodera glycines
  Coding regions on vcDNA: vcDNA=SeqID_46235; Strand=-; Position=1 -72,252-283,440-547,1061-1085
  Homolog annotation: Hit_ID=AAL30831.2; Match level="QueryCoverage =100%, HitCoverage=84%, E-value=1e-33, Identity=86%"; Hit description= cytoplasmic light-chain dynein [Sus scrofa] ref|NP_998963.1| cytoplasmic light-chain dynein [Sus scrofa]
  Essential gene: C elegans homolog=T26A5.9; Phenotype=Emb
MGDRKAVIKNADMTEEMQQEVGPSAIECATQALEKYNIEKDIAAYIKKEFDKKFNPTWHCIVGRNFGSYVTHEKHFIY

SEQ ID NO: 119813 - protein, 190 aa, Heterodera glycines
  Coding regions on vcDNA: vcDNA=SeqID_46236; Strand=+; Position=1 -151,389-504,1245-1343,1458-1565,1759-1857
  Homolog annotation: Hit_ID=AAH85844.1; Match level="QueryCoverage =69%, HitCoverage=24%, E-value=6e-19, Identity=34%"; Hit description =Unc-84 homolog A [Rattus norvegicus] ref|NP_001007148.1| unc-84 homolog A [Rattus norvegicus]
  Essential gene: C elegans homolog=F54B11.3a; Phenotype=Unc
MAQKQQQQAQIGHQFDEGALLEKVQRMIREELRRFDADRTGIVDYALESSGGSVLSTRCTVQYNERSRVQKLFGFPLWYTGYSPRTVIQSYQDLDELDTRLLLGNFTYDAERGEPLQMFPVQQWDPHGTQIVELETLANWGSQVTCLYRFRVHGDKMREIPEVASADDLAAFDSAKRWPDSSKHKEIGGG

SEQ ID NO: 119814 - protein, 134 aa, Heterodera glycines
  Coding regions on vcDNA: vcDNA=SeqID_46237; Strand=+; Position=1 -80,127-169,391-447,491-679,731-766
  Homolog annotation: Hit_ID=NP_494974.2; Match level="QueryCoverage =76%, HitCoverage=15%, E-value=3e-23, Identity=46%"; Hit description =Adenosine/AMP deaminase (85.4 kD) (2F499) [Caenorhabditis elegans] gb|AAO21474.1| Hypothetical protein C3
  Essential gene: C elegans homolog=C34F11.3a; Phenotype=Lva
MAQLFDKLGVGPHDLSVDRLEVRADDTFHRFDLARWAIGHDKILKTFDDFLDNLFTPLFEVTNDPNTHPELHRFLKVIEMQKYHKTLKFQHVSGIDSVDDESKPENVAFTKDSPEPADYDNDQNPSYSYYLYYM

SEQ ID NO: 119815 - protein, 256 aa, Heterodera glycines
  Coding regions on vcDNA: vcDNA=SeqID_46238; Strand=-; Position=1 -162,230-319,375-651,775-951,998-1059
  Homolog annotation: Hit_ID=CAE60116.1; Match level="QueryCoverage =96%, HitCoverage=39%, E-value=5e-56, Identity=44%"; Hit description =Hypothetical protein CBG03656 [Caenorhabditis briggsae]
  Essential gene: C elegans homolog=C01F1.3; Phenotype=Lva,Lvl,Unc
IDTIVHFAADCTSKRCYEQPMEALENNSVAFVQMLECVREYGKVKKFVHISTDEVYGDSNLGPTEKAKSEECPILPGNPYAATKAICEFYAHLFQQKFALPIVTLRINNIYGPNQWDVKVTDKSKNYNKHFQMLANASLHRNGTAAEAIPRPRQRGPIALVAVRGRRVGGNHTGGRMKEVAECVQSEVRTQMGLPLVAPQFDHIADRPYNDQRYLISFSKATKELGWTPKTPFEEGLKRVVSSHLEHKTEPSQRLS

SEQ ID NO: 119816 - protein, 416 aa, Heterodera glycines
  Coding regions on vcDNA: vcDNA=SeqID_46239; Strand=-; Position=1 -135,458-616,699-805,881-967,1127-1230,2343-2435,2496-2677,2801 -2861,2915-3103
  Homolog annotation: Hit_ID=NP_497046.1; Match level="QueryCoverage =100%, HitCoverage=37%, E-value=1e-127, Identity=42%"; Hit description=basement membrane proteoglycan (2O938) [Caenorhabditis elegans] emb|CAB07706.1| Hypothetical protein ZC
  Essential gene: C elegans homolog=ZC101.2a; Phenotype=Emb,Gro,Unc
DCAPGYSRTGGGPYLGMCEKCECHNHASQCDAEYGACIDCQHNTEGDRCERCKPGFVGDARRGTPYDCRPAPEIAVVRPRCDCHNHSPRGCDSYGRCILCEHNTEGFHCELCKKGFYGDATKGTPWDCTQCPCPGTAECFLDARGQVQGTAECFLDARGQVQCRNCPPGFAGRLCDECAPGYTPGQTADGRKCEPIGKHKPSEVEFVPGPDVPFRVEILQPKQLTIQEGSRAKWTCKIVSADTDLVEIQWSKIGEPELDLVEIQWSKIGEPELPERAQQFGHQLVIDQVQQQDTGHYRCTGRLKGDISTDDATLTIGRAAPAHMPKPSVTPPHQLVDEGQQAVFTCLTPGYADCQQAVFTCLTPGYADCEVQWHFQRLGGPLPHGWQQRGNQIIVQSAQQIHAGDYICSVTHQFGT

SEQ ID NO: 119817 - protein, 208 aa, Heterodera glycines
  Coding regions on vcDNA: vcDNA=SeqID_46240; Strand=-; Position=1 -154,380-471,609-704,783-899,1068-1235
  Homolog annotation: Hit_ID=NP_502818.1; Match level="QueryCoverage =94%, HitCoverage=27%, E-value=3e-27, Identity=31%"; Hit description =heterogeneous nuclear ribonucleoprotein U B (4P813) [Caenorhabditis elegans] emb|CAB63361.1| Hypothetical
  Essential gene: C elegans homolog=Y41E3.11; Phenotype=Unclassified
MSKFTQVPEDMDDDLFELAAGLPPRSKNNEQEPKPVEDEPLPDAEHVELDFYNSDFNMKACPSNKWLVDPDNSDGFALMWGGITEFLSLKHLPFDEADPHQIRVGWSRADSSNLLGEQQNSFAFSSMGNKATNNIFTDFVDPFFVDEVITSVLYRTGDIYFPHVATKNCKVMVNFGTEIPESIEAAKDESGLCLWRFIWELSRKTRIF

SEQ ID NO: 119818 - protein, 241 aa, Heterodera glycines
  misc_feature (222)..(222): Xaa can be any naturally occurring amino acid
  Coding regions on vcDNA: vcDNA=SeqID_46241; Strand=+; Position=1 -75,123-233,296-360,403-529,577-754
  Homolog annotation: Hit_ID=NP_495800.1; Match level="QueryCoverage =100%, HitCoverage=74%, E-value=4e-46, Identity=43%"; Hit description= mitochondrial ribosomal protein S18b like (2I817) [Caenorhabditis elegans] emb|CAA91421.1| Hypothetical
  Essential gene: C elegans homolog=T13H5.5; Phenotype=Lva
VEKKRGFIKPIHTLEEQIEYMNSEVFAETYKGRPIFAETYKGRPICFMWKRNMKGQWKLQPPPRLFCIDRNGRFNVGNACTVCRRFNVGNACTVCRDEYLFFDYRNPKLLEHFLYPGTDQPLNPKLLEHFLYPGTDQPLPIIQTGLCQEQYVNLQAQLLKAKEHGTFIFNVPFRHFNYGQWYPKTFIFNVPFRHFNYGQWYPKDANALISSDGRRINRAETXNVEDIYPNPSIAFETHNRD

SEQ ID NO: 119819 - protein, 279 aa, Heterodera glycines
  Coding regions on vcDNA: vcDNA=SeqID_46242; Strand=+; Position=1 -126,305-476,1050-1442,1739-1887
  Homolog annotation: Hit_ID=XP_425268.1; Match level="QueryCoverage =88%, HitCoverage=18%, E-value=4e-58, Identity=43%"; Hit description =PREDICTED: similar to sno, strawberry notch homolog 1; MOP-3 [Gallus gallus]
  Essential gene: C elegans homolog=F20H11.2; Phenotype=Unclassified
MNPVYSIGTPVDQQQQQQGKNNEAADNSENVPANQMPPDLDEADTAHRVQTDTFVNYAPLRLRSGFPHPDEVVETLSLSSVSSPEIRYTMAIPDEVVDGGDGAGVGKGRTIAAIIFENFLRGRRKAIWLSVSSDLKYDAERDLRDIGADKIAVCALNKLRYGRIGSSESGGGIGRGVIFATYSSLIGESRRGSTAKGGKSADAMEMMKSPTTQRQQRQPLVTRGFASWSNEPRNMAYMSRLGLWGLGLTFKTFGEFIHAVENRGVGAMEMVAMDMKVYV

SEQ ID NO: 119820 - protein, 225 aa, Heterodera glycines
  Coding regions on vcDNA: vcDNA=SeqID_46243; Strand=-; Position=1 -40,101-120,173-199,247-320,810-950,1025-1228,1353-1421
  Homolog annotation: Hit_ID=NP_503036.1; Match level="QueryCoverage =98%, HitCoverage=67%, E-value=1e-51, Identity=52%"; Hit description =auxiliary factor (30.9 kD) (4S62) [Caenorhabditis elegans] emb|CAB55137.1| Hypothetical protein Y116A8C.3
  Essential gene: C elegans homolog=Y116A8C.35; Phenotype=Ste
FYEEVFTELQRTYGPVEELNPVEELNVCENIGEHMVCENIGEHMIGNVYVKFVIGNVYVKFVYEEDAEKAVQGLENRWFNGQPIYAELSPVSDFREARCRQHEISTCSKGGFCNFMHLKDVSDEVYERCYANRGAYERCYANRGARYRSTRRHDRFYADDGYDRREGATGGWTTDEKGPPREIGGWGYVGQKLRARLLMGGGGDRGGGGGGGGRDRRRRDDRGDD

SEQ ID NO: 119821 - protein, 393 aa, Heterodera glycines
  Coding regions on vcDNA: vcDNA=SeqID_46244; Strand=+; Position=1 -75,778-1062,1114-1363,1406-1767,2018-2224
  Homolog annotation: Hit_ID=CAE68638.1; Match level="QueryCoverage =82%, HitCoverage=43%, E-value=2e-84, Identity=45%"; Hit description =Hypothetical protein CBG14528 [Caenorhabditis briggsae]
  Essential gene: C elegans homolog=F55D10.3; Phenotype=Gro
MALLWVQQHITSFGGDPRAVTIGHSVDGHELTAHPLWLLNNVRNGIVNVFSVPFLVGMNAQDGTEAILEDRTLGGTALSQFGTLFICTGEFTDFLQITRQYMRSFIIEYAFKHNYTMNREAVIDAIESFYTYWPDASDVWQIRRWFIDLITDAYYTQPITQSAHLHSDTGSRTFLYVNNYNFSMQRENTVAHNGEVPNFPAWAGSCHDCDLFLLFGFPFMPPELLPKAIRSVNWTDTDRNASQLFSSFVRQFTKYSFVLPFFHLIPKFSDPNLPNDGTWLAHQPRAHWYINFNYSRGQSLTVPGTLSRDFRFEQVAFWENYIPAGLFGVSLLVLIALLVLTLSLGYNVCTRPLRERCGRYSEWEEVQAEERGANVEMARKSTRERGGGEGAGR

SEQ ID NO: 119822 - protein, 241 aa, Heterodera glycines
  Coding regions on vcDNA: vcDNA=SeqID_46245; Strand=+; Position=1 -346,1298-1678
  Homolog annotation: Hit_ID=BAA88337.1; Match level="QueryCoverage =41%, HitCoverage=10%, E-value=8e-13, Identity=41%"; Hit description =ORF2 [Platemys spixii]
  Essential gene: C elegans homolog=ZK250.3; Phenotype=Clr,Lvl,Sck
VLKSREIKTLTAAYKTFVRPQLEYATEVWNPNLKKDIDKIERVQKIFTRKALRKCGFVYKKYGERLKITGLHKLEERRKINDLTTAFKIIKGFTSLDAGKSFFFSERLRRPLLLRTFFENLDEHSLKILDRPLRQVTEFIKQRESDEGRPMRQIWINTYKNRRSAADIIVITRDRYFEKSLDLDLDSMLDLDFLGKNPGPGKIQAPRDLDPGLDLDFLKFVLKSKQMLEKINYLLEASKNI

SEQ ID NO: 119823 - protein, 136 aa, Heterodera glycines
  Coding regions on vcDNA: vcDNA=SeqID_46246; Strand=+; Position=1 -165,265-510
  Homolog annotation: Hit_ID=XP_216748.2; Match level="QueryCoverage =85%, HitCoverage=22%, E-value=6e-16, Identity=41%"; Hit description =similar to Coq6 protein [Rattus norvegicus]
  Essential gene: C elegans homolog=K07B1.2; Phenotype=Age,Unclassified
MNPSLGNAFVPSGPVALLPLGRDLCSLVWTVSTADAARLLQLSPEHFVEELNGTLQFDNSSANSLVNNSLDCLGKALNFLPSKESPAKCTIPRVLSLPYDDRAVFPLSLGYAYDYIRPRVALIGYEKLNQCGGTDP

SEQ ID NO: 119824 - protein, 188 aa, Heterodera glycines
  Coding regions on vcDNA: vcDNA=SeqID_46247; Strand=+; Position=1 -187,916-1047,1498-1617,1689-1815
  Homolog annotation: Hit_ID=CAE65681.1; Match level="QueryCoverage =54%, HitCoverage=31%, E-value=3e-14, Identity=37%"; Hit description =Hypothetical protein CBG10748 [Caenorhabditis briggsae]
  Essential gene: C elegans homolog=C43F9.8; Phenotype=Unclassified
MRIMMMMMYVCGTSRRPQKSIHIHFGVPILQMVATTAAGSPKGFRHHRGIIAAQKGNLFLRLGIGTKQLGVCSSPERQSSITLVFRDVSPLPSAFTFRPGQSYFVITTSNGTLMGLNNTEGGLCATRNMRLKFDVLSLADEADANNDTMLQIPQPHHAHAHHHHHHHQHHHQQRYHHKALVHKQQETH

SEQ ID NO: 119825 - protein, 159 aa, Heterodera glycines
  misc_feature (96)..(96): Xaa can be any naturally occurring amino acid
  Coding regions on vcDNA: vcDNA=SeqID_46248; Strand=+; Position=1 -131,399-565,1056-1141,1660-1752
  Homolog annotation: Hit_ID=CAE58518.1; Match level="QueryCoverage =89%, HitCoverage=32%, E-value=1e-39, Identity=53%"; Hit description =Hypothetical protein CBG01669 [Caenorhabditis briggsae]
  Essential gene: C elegans homolog=W03B1.4; Phenotype=Gro
IYHHSSLSQIELFAVCTERQSDAELDRIVRLQQSLYASLQLRFRVMDMPSEELGAPAARKFDLEAWMPGRKSWGELCSASNCTDFQARRLHLKYRXGEGALRFVHTCNGTGLASTRAMIALLETHQTGRQKGVKLPDVINERMHTERSVGIYCIHQKNA

SEQ ID NO: 119826 - protein, 190 aa, Heterodera glycines
  misc_feature (5)..(5): Xaa can be any naturally occurring amino acid
  misc_feature (181)..(181): Xaa can be any naturally occurring amino acid
  Coding regions on vcDNA: vcDNA=SeqID_46249; Strand=+; Position=1 -287,337-513,1006-1084
  Homolog annotation: Hit_ID=NP_505763.1; Match level="QueryCoverage =90%, HitCoverage=32%, E-value=2e-56, Identity=61%"; Hit description =pleiotropic regulator 1 Arabidopsis like (54.7 kD) (5L288) [Caenorhabditis elegans] emb|CAA98247.1| Hypot
  Essential gene: C elegans homolog=D1054.15; Phenotype=Emb
KKVIXIQKDRHIKVIKGRLKANQRRRKLFIAFLLKSPRHPYLFSAGEDKQVKCWDLEYNKVIRHYHGHLSAVQDLALHPTLDILVTCARDSTARVWDMRTKAQIFVWDMRTKAQIFCLSGHSDTVASVICQGVNPQVVTGSHDSTIRLWDLATGRSMCTLTNHKQTVSGREIHMSYNTFRXSRVDFYYEF

SEQ ID NO: 119827 - protein, 285 aa, Heterodera glycines
  Coding regions on vcDNA: vcDNA=SeqID_46250; Strand=-; Position=1 -213,258-505,549-878
  Homolog annotation: Hit_ID=NP_491777.3; Match level="QueryCoverage =99%, HitCoverage=57%, E-value=7e-74, Identity=50%"; Hit description =aminotransferase class-III (48.6 kD) (1G742) [Caenorhabditis elegans] gb|AAB53010.3| Hypothetical protein
  Essential gene: C elegans homolog=T09B4.8; Phenotype=Unclassified
QNRICENAPMLGKCCALDYHLDELTDCLRHDFPSTTGPAAMIAEPIQGIGGTVQFPEGYLKRAFDEIHARGGLRICDEVQGLRICDEVQTGFGRLGTHFWGFQSQNAVPDIVAMAKGMANGFPMGAVITTKEIGARLMEGGRYFNTFGGNPLACTVAKAVLEVIDEEGLQQNCFKVIDEEGLQQNCFKIGNFLLSELCRIDSRLLGDIRGKGLMIGIELVEEDGQRVLGTERVERIFECIRREGVLVGKGGNEGNVLRIKPPMCVGEEDAWRCAEAVAKALKEEE

SEQ ID NO: 119828 - protein, 559 aa, Heterodera glycines
  Coding regions on vcDNA: vcDNA=SeqID_46251; Strand=-; Position=1 -186,239-532,584-829,883-1186,1238-1391,1441-1702,1779-1922,1987-2076
  Homolog annotation: Hit_ID=CAG32257.1; Match level="QueryCoverage =96%, HitCoverage=83%, E-value=1e-168, Identity=55%"; Hit description= hypothetical protein [Gallus gallus]
  Essential gene: C elegans homolog=C14B9.4a; Phenotype=Emb
MAQEIQIHQALAHPHVVKMEGFFEDDDNVYILLELCSRRSLMELHKRRKAVTEPEARYFTFQIVEACKYLHGKKIIHRDLKLGNLFLNSEMQLKIGDFGLATVVDYDGERKKTLCGTPNYIAPEMLDKKGHSYEVDIWAIGCILYTLLVGKPPFETETLKDTYNRIKANQYTIPPKIGKDAASLITRLLAPDPARRPRVTEILNFQFFTDGFLPKVLPSSCLTMAPKFNMQAVSGGLIRRPELDHVPSPRAAKGPAFTGHAPLASVPETKVPPQAVAVKQDVASVLITEMAAGLPHLRMFNCSDCFRLGENNDVPADFYLSDLYAQLCSLLNTNPERFSEADKDEIEDPRAQPFFWVSRWVDYSDKYGLGYQLCDNSVGVLFNDNTKVILDAAGNQLQYTERNNTEHFYGANKYPQALEKKITLLKFFRSYMNEHLMKAGANIKMRDGDELARLPCLNTWFRTKSAIVLHLSNGTLQINFFQDHSKLIVCPLMSAATYIDQQKNVFTCKFQYLEKYGCPKDLCQRLKYTKVMVERLIARHENPNAMTAKSGRRAEVVPQ

SEQ ID NO: 119829 - protein, 254 aa, Heterodera glycines
  Coding regions on vcDNA: vcDNA=SeqID_46252; Strand=-; Position=1-765
  Homolog annotation: Hit_ID=NP_498506.1; Match level="QueryCoverage =97%, HitCoverage=41%, E-value=5e-40, Identity=36%"; Hit description =RNA-directed DNA polymerase family member (3I9) [Caenorhabditis elegans] gb|AAA21080.1| Hypothetical prot
  Essential gene: C elegans homolog=ZK250.3; Phenotype=Clr,Lvl,Sck
MCSGVPQGSVLGPILFLIYINDLPKKIPKGIFIKLYADDVKLYSIHRTKTDRVIMHEALRQLSNWSNEWCIDISINKTFVLYLGKNNPREQYKINNNTICEVDTIRDLGILIDNKLKLTEHINTVTRNAYGRMRFLFRIIKSKRISIWKIIFMSYIRPLLEYAPEAWNPQLKIHINKIEKCQKYFTRIALRKCNLPYIPYGQRLELFKLPTLEKRRKIFDILTTYKIIHGLTHLDPNSMFKRTNLNTRNKSFFD

SEQ ID NO: 119830 - protein, 271 aa, Heterodera glycines
  Coding regions on vcDNA: vcDNA=SeqID_46253; Strand=+; Position=1 -159,220-360,832-1016,1683-1849,1896-1984,2392-2464
  Homolog annotation: Hit_ID=NP_498064.2; Match level="QueryCoverage =81%, HitCoverage=24%, E-value=8e-24, Identity=31%"; Hit description =la related protein (3G102) [Caenorhabditis elegans] gb|AAK93859.2| Hypothetical protein R144.7 [Caenorhab
  Essential gene: C elegans homolog=R144.7; Phenotype=Emb
KDARGGQCQANEMAKGRCSSADEGKQNAQREEGGAYNVWTKKALERAAASASIPKSPVAKREENDKPVKRFYPLNPWEKQQPNNNNRQNKGKENGTRQPQAMPVGWVLGVRSKTTSINEDAGPSHPSTSDALSTTVKPPASSSSIASVLPPHPSFSLIQENGLRYGIESLFRFYSYGLEKKLRPKLYNDFQEATLQDVKRGHTFGLEKFLAFLKCLWHCKYSTQLEVMPQIAKELARYRSTDLFATEPAKAAKLELQNESKNRSGGRNVMV

SEQ ID NO: 119831 - protein, 124 aa, Heterodera glycines
  misc_feature (26)..(26): Xaa can be any naturally occurring amino acid
  Coding regions on vcDNA: vcDNA=SeqID_46254; Strand=+; Position=1-418
  Homolog annotation: Hit_ID=BAA88337.1; Match level="QueryCoverage =98%, HitCoverage=12%, E-value=4e-15, Identity=37%"; Hit description =ORF2 [Platemys spixii]
  Essential gene: C elegans homolog=ZK250.3; Phenotype=Clr,Lvl,Sck
KTIIRMYKTYVRPQLEYAVEIWNPNXKKDIERIEKVQKFFTRKAFKKCGLLHRSYSERLEICQLIELAKRRNIADLTIAFKIMKGFTSLDASKLFTFSDRSSRRPLLLRMRRTTAKSKNNFFNL

SEQ ID NO: 119832 - protein, 255 aa, Heterodera glycines
  Coding regions on vcDNA: vcDNA=SeqID_46255; Strand=-; Position=1 -125,249-321,531-748,911-1036,1092-1202,1249-1295
  Homolog annotation: Hit_ID=CAD89746.1; Match level="QueryCoverage =92%, HitCoverage=43%, E-value=6e-75, Identity=62%"; Hit description =Hypothetical protein T11G6.1b [Caenorhabditis elegans] sp|P34183|SYH_ CAEEL Histidyl-tRNA synthetase (Histi
  Essential gene: C elegans homolog=T11G6.1a; Phenotype=Emb,Gro
IFTLVNSHLSFSKLLCSQSFVKRIVYTHRSGRQVVKVMALLEAVMKKKMELGDDFKSKYELKTPKGTRDFGPEQMATREKVLAIVTETFKRHGAVTMETPVFELREVLMGKYGEEGTKLVYDLADQGGELCSLRYDLTVPFARYLAANKVEKIKRYQIAKVYRRDQPVMTKGRYREFYQCDFDIAGNGDFDIAGNGEVMVQEAECLKIMDEVLTKLDIGAFEIRVNHRLLLDGVFAALRVNHRLLLDGVFAALRV

SEQ ID NO: 119833 - protein, 140 aa, Heterodera glycines
  Coding regions on vcDNA: vcDNA=SeqID_46256; Strand=+; Position=1 -75,350-697
  Homolog annotation: Hit_ID=NP_492006.1; Match level="QueryCoverage =82%, HitCoverage=21%, E-value=5e-54, Identity=80%"; Hit description =asparagiNyl tRNA Synthetase (61.2 kD) (nrs-1) [Caenorhabditis elegans] emb|CAA95808.1| Hypothetical prote
  Essential gene: C elegans homolog=F22D6.3a; Phenotype=Emb,Lva
MTCDTVNRVMADPEIRELIQQQWQKPILLNRFPHGIKAFYMSRCADQPELTESVDLLMPGVGEIVGGSMRIWKEDELLGAFQKADIDPKPYYWYVDQRKYGGCPHGGFGLGLERFVCWLANQHHIRDVCLFPRYIGRCAP

SEQ ID NO: 119834 - protein, 293 aa, Heterodera glycines
  misc_feature (10)..(10): Xaa can be any naturally occurring amino acid
  misc_feature (252)..(252): Xaa can be any naturally occurring amino acid
  Coding regions on vcDNA: vcDNA=SeqID_46257; Strand=+; Position=1 -34,463-1216,2895-3000
  Homolog annotation: Hit_ID=NP_504179.1; Match level="QueryCoverage =97%, HitCoverage=27%, E-value=1e-45, Identity=36%"; Hit description =predicted CDS, protein of unknown function DUF32 and RNA-directed DNA polymerase family member (5E747) [C
  Essential gene: C elegans homolog=ZK250.3; Phenotype=Clr,Lvl,Sck
YCGLIIENMXTKIYSFLAKNQPEFFCLFLTFQKAFDSVPHNLLLYKLEKIGIRGKLLKWIKEFLSNRIFRVKIGDSLSSIKVGSGVPQGSVLGPLLFLIYINDLPDVIPSGVNIKLYADDVKIYICYKTRSEIEIMHKTLHNLFEWANKWQIKVSVQKTFILYLGFKNPKETYKFDGNTINAVDTIRDLGVNIDNKLLFSDHILQITKNAYSHIRSLFRIIKSKSSKIWIILYKIFPSGRFNSPSYRQHKIXQKIYSIYGRLMCLPYKFPLMCSTPLKNFSKILPYISMSGLS

SEQ ID NO: 119835 - protein, 150 aa, Heterodera glycines
  misc_feature (144)..(144): Xaa can be any naturally occurring amino acid
  Coding regions on vcDNA: vcDNA=SeqID_46258; Strand=+; Position=1 -108,142-221,264-336,2945-2971
  Homolog annotation: Hit_ID=CAE69165.1; Match level="QueryCoverage =91%, HitCoverage=21%, E-value=1e-25, Identity=52%"; Hit description =Hypothetical protein CBG15197 [Caenorhabditis briggsae]
  Essential gene: C elegans homolog=C13B9.3; Phenotype=Ste
SGNLALVTRQYVADMTRARLEGLLNAFPKLITSDKVLAQRQHTFVETNSVRYVYQPMDNITSDKVLAQRQHTFVETNSVRYVYQPMDNIYMVLITTKASNILEDLETLRLFSRVIYMVLITTKASNILEDLETLRLFSRVVVKXCVYNKN

SEQ ID NO: 119836 - protein, 436 aa, Heterodera glycines
  Coding regions on vcDNA: vcDNA=SeqID_46259; Strand=+; Position=1-1311
  Homolog annotation: Hit_ID=NP_508269.1; Match level="QueryCoverage =99%, HitCoverage=66%, E-value=3e-51, Identity=30%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MAFHKIDTDSVNSITNALDFFRIPPTNVSVSSSKVFELLPSNPLTDTPYHFKLHSSQNYIDLSKCYLLTEFRIHKENANGQLVNLTIDDINIAPIQMIGQTFIRNIKMSINGREIFNANALMAYKTYFSHELSYSTTAKDSHLNAAGYYRDTGDSLEMGDGCTARRDLFANSNVAQFIAKIDTDLFNQPLYLINFCELDIEILPNDNEFVLIAPTGGRYRFEVVGLKLYVKKVSLMDGLALDIARKLEVKPARYAVRKTMMKSVFISPGRYEFTANLFMDQIPRRVTMGLVANTDYVGSIRRSPFNFQPFNVREISIVANGRSYPQAPYDLDYPNGKYVRPFNDMNEAVGFANSSESNGITFAQYGKTHCIYVFNLTNSGDDQAALFDLIKNGTTAVSIKFNHPVPEGGIMLVVMGECDSLVMLDKNRSISTDITI

SEQ ID NO: 119837 - protein, 235 aa, Heterodera glycines
  Coding regions on vcDNA: vcDNA=SeqID_46260; Strand=-; Position=1 -193,238-387,434-799
  Homolog annotation: Hit_ID=XP_315359.1; Match level="QueryCoverage =99%, HitCoverage=44%, E-value=8e-69, Identity=52%"; Hit description =ENSANGP00000021039 [Anopheles gambiae]
  Essential gene: C elegans homolog=F48E3.1a; Phenotype=Emb
DLDIAPDFFDFFLATRPLLESDRSLFCVSAWNDNGKKGLVDLSFGASLLFRSDFFSGLGWMMTKDFWNELRPKWPRAFWDDFLREPEQRKNRSCIRPEISRTAMTEFGRIGASKGLFFNRHLRRVFLNRMPVNFTRIDLSGFIRSEYDASFLERVYSAQKVQMENILEWSKNSGDCRIEYESMEEFVSIALRVGVMADSKAGVPRTAYRGVVTCFLNGTRLFIAPPKNGWNGYDR

SEQ ID NO: 119838 - protein, 114 aa, Heterodera glycines
  Coding regions on vcDNA: vcDNA=SeqID_46261; Strand=+; Position=1 -198,808-891,1564-1626
  Homolog annotation: Hit_ID=NP_496281.1; Match level="QueryCoverage =68%, HitCoverage=18%, E-value=5e-25, Identity=69%"; Hit description =mitochondrial ribosomal protein S22 (48.3 kD) (2K875) [Caenorhabditis elegans] emb|CAB60995.1| Hypothetic
  Essential gene: C elegans homolog=C14A4.14; Phenotype=Emb,Lva
MISNAESLLVMFISPKDRTVVVREQDGTLRTALPEEHDRMNRLFFVQPNRPVNEPPLFAMTDEWLQKTLDRDEHEFVLDWACHFYEPDAPKFVENKHKNSMIKLVRFPYNPLMD

SEQ ID NO: 119839 - protein, 451 aa, Heterodera glycines
  Coding regions on vcDNA: vcDNA=SeqID_46262; Strand=+; Position=1 -1005,1051-1400
  Homolog annotation: Hit_ID=I51116; Match level="QueryCoverage=98%, HitCoverage=55%, E-value=7e-25, Identity=23%"; Hit description=NF -180 - sea lamprey gb|AAA80106.1| NF-180
  Essential gene: C elegans homolog=Y55B1BR.3; Phenotype=Emb
MQPDLQPPYCDGRSPTLVNRLPPFHSTTPMITTMAQTSAKSVEKTNEEEMAQSKKGKAKATTAEFSGDEKETDEGEEEKDKGGKVEKKEKQQKGSDKEKEGQRQQKILPQLEQIEEQTEWQPVREEEAKKETDDERAQQDGENERGKEKERQEEEGAKEKEGREHEQQKSAQRKKTTNVPGNAIEPAIISSRKPAIVTIQSKEIEEMPPDAFDDGSIRTAPTPRAQQMEELEREISGSIVPELIVPQVIVGGKRKEEKGEDEEEKGDGRQKGNGKRKEEGGKGKEEKGDKEEQKGKGGEKENGKGKEEEEEGNGSKTSAFLQEKTDEHNANGNDKGTTNSKAKNEIRIEPIGTKGRTNAKAKPTAIPAEEAEEGREDEQRQQQAEEKPEQHEPASSSAVPPSPPQRQRPTTPEAKRTARPSTEMATTEEQRETPKGKIDKEKATHSGTHQQ

SEQ ID NO: 119840 - protein, 280 aa, Heterodera glycines
  Coding regions on vcDNA: vcDNA=SeqID_46263; Strand=-; Position=1 -603,1225-1464
  Homolog annotation: Hit_ID=AAH74533.1; Match level="QueryCoverage =45%, HitCoverage=30%, E-value=4e-12, Identity=33%"; Hit description =PRP19/PSO4 homolog [Xenopus tropicalis] ref|NP_001005435.1| PRP19/PSO4 homolog [Xenopus tropicalis]
  Essential gene: C elegans homolog=T10F2.4; Phenotype=Emb
MTLLIIKSYGVAQRVLTVDGVQEFPGLVKIVWYFNFYKLYRLCKIKDAESLEKFYIAKNEEAHAELDAVDQILNEPFLLGSALAAAAVDGGGGGGDDDVDDALIIAGEDVIKFFLNFYYFFKATGPPKKSTKRGGKKYRALREKAQALRNTATEAASTLSSSSSVNTSMFKKMSIEYARRVAQLREHRKKKLPGISEELVNVKIWSTEQPNALHTIAIHGKAVTDVSLHPTGDYVLCSSEDSHWSFIDLHAGRPLVKVNNRSSPLLTTLLEFKKIFSGQI

SEQ ID NO: 119841 - protein, 102 aa, Heterodera glycines
  Coding regions on vcDNA: vcDNA=SeqID_46264; Strand=+; Position=1 -162,445-591
  Essential gene: C elegans homolog=M01F1.6; Phenotype=Lva
KMQRLAKLANTGGLLIPLSGAVQTISTRGVLRIPHWENHIRFDPRFGRKRPCQDLMTPFWLRPKHYVGDPMEPYHTPYGITFARVDDQKRLVREGPNSCFDD

SEQ ID NO: 119842 - protein, 356 aa, Heterodera glycines
  Coding regions on vcDNA: vcDNA=SeqID_46265; Strand=-; Position=1 -142,219-414,649-833,896-1155,1237-1524
  Homolog annotation: Hit_ID=NP_496175.1; Match level="QueryCoverage =47%, HitCoverage=22%, E-value=5e-24, Identity=42%"; Hit description =C2H2 type zinc finger containing protein, Dorsal Intercalation and Elongation defect DIE-1 (die-1) [Caeno
  Essential gene: C elegans homolog=C18D1.1; Phenotype=Emb
PPQMELMAHHHNESPPVGRLAPKLSLSSTPGTISGNGPGDNQTTAFTEALSPDHSQQMAVMQQLAAQLGLSNGGNATEGERNALEQLLGSGGLHLAELMAHAQNQQQNTDMNSQSALFQHQLIAHIGGTDAPQQQQQSTASNDTQSTVNALAMLAAAGINGGSGTTQQQQQQLFGQLLGSNPFSQGTTPSLMFNNSSAFGGINPTEFDGAAMLAKLSAEFAAVAQAQHGQSGAISATTVQSTGGPSTQQNGAMGRGHTPAPSNKPPPQKRQYSSTSKNFCDLCNKEVCNKYFLRTHMLKMHNIIIDENKQLIANIDTVDKERKGEVKFRLEMSRGNGWRIVIGLVPPLGVTFAIPA

SEQ ID NO: 119843 - protein, 290 aa, Heterodera glycines
  Coding regions on vcDNA: vcDNA=SeqID_46266; Strand=-; Position=1 -106,166-306,384-491,573-646,685-774,838-879,1050-1233
  Homolog annotation: Hit_ID=EAL20280.1; Match level="QueryCoverage =98%, HitCoverage=32%, E-value=4e-58, Identity=42%"; Hit description =hypothetical protein CNBF0920 [Cryptococcus neoformans var. neoformans B-3501A]
  Essential gene: C elegans homolog=F56D2.6a; Phenotype=Emb,Lva
AESSRDEMLSMYGVILLDEVHERTMITDVVMGLVKRIMRHRPRIMRHRPELRVVVMSASLQTGTFVQYFSEFDYLTMKISGRTFPVEIKLTFEPNEYISKAVLTFEPNEYISKAVEKAIAIHRREAHGDILLFLCGQDEIERACEMLEEIERACEMLEEEAKKCRESGIGRLDVLPLYGSMQLEDVLPLYGSMQLEQQRKLLEAEQNQLTNGERRRRCIVATNVAETSMTIDGVVYVIDPGFCKRNIYNPNSKIESLLVQHISRASAVQRAGRAGRTRPGKCFRLYTEHC

SEQ ID NO: 119844 - protein, 346 aa, Heterodera glycines
  Coding regions on vcDNA: vcDNA=SeqID_46267; Strand=-; Position=1 -296,469-550,599-680,721-843,903-1016,1108-1242,1283-1488
  Homolog annotation: Hit_ID=AAM97979.1; Match level="QueryCoverage =79%, HitCoverage=24%, E-value=1e-116, Identity=74%"; Hit description= Membrane calcium atpase protein 3, isoform c [Caenorhabditis elegans]
  Essential gene: C elegans homolog=Y67D8C.10a; Phenotype=Prz
MNVQSPLYAVPCKIDPSPSRRTATLDRMSPDSGHRDSAGVSGAGAFDVTIEELRTLMEFRGGEALEKISTDYGNTLGLCERLATDPNNGIANTQDELKRRRDAFGANEIPPLPPKSFFTLVWEALQDVTLIILLSAAVVSLALSFYNPGSELGGGKDETEQEAGWIEGAAILISVVVVVLVTALNDYTKERQFRGLQAKIETEHKFAVIRGGKQLQVVVNELVVGDIAQVKYGDLLPTDGVLIQSNDLKIDESSLTGESDQIKKSAEHDPMLLSGTHVMEGSGRMVITAVGVNSQTGIIMTLLGAAKSAMEDERKEKLREEKRRTRRRSKASGQWEHWPIEENGIR

SEQ ID NO: 119845 - protein, 147 aa, Heterodera glycines
  Coding regions on vcDNA: vcDNA=SeqID_46268; Strand=-; Position=1 -62,299-442,616-694,779-937
  Homolog annotation: Hit_ID=XP_397365.1; Match level="QueryCoverage =56%, HitCoverage=16%, E-value=2e-20, Identity=53%"; Hit description =similar to SUMO1/sentrin specific protease 1 [Apis mellifera]
  Essential gene: C elegans homolog=T10F2.3; Phenotype=Gro,Stp
MPTNKSSKLFGTARCPLKRYSCSRLTLSSTKIYKKMVLPVSNDGLERSTFSRTKCSSYPSICPIIGAWRDYLEQESLDKRKRPFDSEGWMMECRKDIPSQSNFSDCGMFSCLFAEYASRRAPITFTQKHISYFRERMCFEIYQKSLL

SEQ ID NO: 119846 - protein, 121 aa, Heterodera glycines
  Coding regions on vcDNA: vcDNA=SeqID_46269; Strand=-; Position=1 -153,212-422
  Homolog annotation: Hit_ID=CAE68727.1; Match level="QueryCoverage =95%, HitCoverage=13%, E-value=2e-14, Identity=34%"; Hit description =Hypothetical protein CBG14653 [Caenorhabditis briggsae]
  Essential gene: C elegans homolog=F32A6.3; Phenotype=Emb
MDNGLFEEAWERAVRNSEMLRENSVLEVGKRLVNHLMEQKAYDLAVNFLPQVCSTHKVEWEFYVNEFERHHQILKLVPIIPTKDPQLEPECYESVLLAALYMRPKLFDAIVSHWNADIYRA

SEQ ID NO: 119847 - protein, 386 aa, Heterodera glycines
  Coding regions on vcDNA: vcDNA=SeqID_46270; Strand=+; Position=1 -78,169-312,364-753,796-916,966-1060,1301-1448
  Homolog annotation: Hit_ID=A55163; Match level="QueryCoverage=100%, HitCoverage=69%, E-value=1e-127, Identity=58%"; Hit description =nucleolar protein Nopp140, hepatic - rat prf||2103261A nuclear protein NAP57
  Essential gene: C elegans homolog=K01G5.5; Phenotype=Gro
SHEVVAWVKRILRVKKTGHSGTLDPKVSGVLVSGVLVVCVDRTTRLAKSQQNAGKEYVAIFKLHNPVESVKTIRQALDKLTGALFQRPPLISAVKRQLRLTGALFQRPPLISAVKRQLRIRTVYECKLIEYSPSQQMGVYWMSCEAGTYVRTHIVHLGLMLGVGAQMQELRRVRSGVTGENDHIVTLHDIMDAQYLYDQHKDESYLRRIIRPLEALLVQHKRIVVKDSSVNAICYGAKILIPGILVNAICYGAKILIPGILRYENGIEINEEIVIVTTKGEAVCIAIALMTTSTIAITDHGVVAKIALMTTSTIAITDHGVVAKIKRVIMERDTYARKWGLGPVASKKKAMIKDGLLDKHGKPNESTPKGYVPGMMDYSLSKVKAS

SEQ ID NO: 119848 - protein, 80 aa, Heterodera glycines
  Coding regions on vcDNA: vcDNA=SeqID_46271; Strand=-; Position=1-245
  Homolog annotation: Hit_ID=NP_492513.1; Match level="QueryCoverage =87%, HitCoverage=39%, E-value=4e-26, Identity=80%"; Hit description =SKp1 Related, ubiquitin ligase complex component (20.0 kD) (skr-1) [Caenorhabditis elegans] emb|CAB03027.
  Essential gene: C elegans homolog=F46A9.5; Phenotype=Emb
SYGDLSPLFTLNLAQFNCVALIKAANYLDVRGLLDVACKTVANMIKGKSPDEIRRTFNIKNDFTPEEEEQIRRENAWCED

SEQ ID NO: 119849 - protein, 196 aa, Heterodera glycines
  Coding regions on vcDNA: vcDNA=SeqID_46272; Strand=+; Position=1 -190,992-1076,1530-1655,1819-2010
  Homolog annotation: Hit_ID=NP_500514.1; Match level="QueryCoverage =93%, HitCoverage=40%, E-value=2e-34, Identity=42%"; Hit description =putative cytoplasmic protein of bilaterial origin (51.1 kD) (4E981) [Caenorhabditis elegans] sp|Q19910|YK
  Essential gene: C elegans homolog=F30B5.4; Phenotype=Ste
IRNALLFALLTVPILIIGNGPAGIALSALLSGWRPFYNKRVPHPDPHLHAQLTRMASSSSDDNSNILSARKTPAAPEGTPFSVLYDCLARPAASSPVPSSSCLCWRRRERDAISHIVLGDQQIGGSWTEYDDHMLTVSAVEWMDLPGFSLAADFVGDAQLAQQRPRAGLYTYLNAYVDAMGLRHNFKLFTRVTHIE

SEQ ID NO: 119850 - protein, 244 aa, Heterodera glycines
  Coding regions on vcDNA: vcDNA=SeqID_46273; Strand=+; Position=1-735
  Homolog annotation: Hit_ID=NP_741200.1; Match level="QueryCoverage =99%, HitCoverage=58%, E-value=2e-18, Identity=28%"; Hit description =mesocentin, extracellular matrix adhesion molecule required for proper gonad positioning and sensory map
  Essential gene: C elegans homolog=K07E12.1a; Phenotype=Pvl
MPVVDAEGTPLARDPASGRYLDPADGTPIAVDDQGRPLDRSGNVLSKNIYDEYVWVDVGLVSPDGLPARTAGGRIGAEATTATLHDDHAVDGAELVPSDEGGPVAALPDDRVPTRVEKGECRVQEAVIDLVVAVNDELLQAHGDRLRQALDDLLDQHLDLAADATRVALLQYGKSVAVPVSLGGYHERDQLLDQLGQLRSTASNLLGLPDLSAAYEASLQQFESFGRGGNVPKVLLVVSSGEDM

SEQ ID NO: 119851 - protein, 148 aa, Heterodera glycines
  Coding regions on vcDNA: vcDNA=SeqID_46274; Strand=+; Position=1 -59,101-236,349-397,509-711
  Homolog annotation: Hit_ID=CAE64416.1; Match level="QueryCoverage =81%, HitCoverage=32%, E-value=3e-11, Identity=27%"; Hit description =Hypothetical protein CBG09110 [Caenorhabditis briggsae]
  Essential gene: C elegans homolog=C56G2.3; Phenotype=Gro,Stp
VYDYFSEFIPKSFDDKEWVRTMECSSVVERVNYWAFLALSQHRKDLDEMKHNQSVEHTDSFFKEQLRLYNAGGMGYSEDAYYRTIEESKKLAQQLTLGESPRILFDCQFLPQMTQRIYGKVAKSAVHAYFVWFWNFTMIFISLISHQI

SEQ ID NO: 119852 - protein, 326 aa, Heterodera glycines
  misc_feature (2)..(2): Xaa can be any naturally occurring amino acid
  Coding regions on vcDNA: vcDNA=SeqID_46275; Strand=-; Position=1 -55,108-230,284-337,380-460,515-602,667-1104
  Homolog annotation: Hit_ID=AAO33395.1; Match level="QueryCoverage =97%, HitCoverage=25%, E-value=3e-70, Identity=46%"; Hit description =karyopherin-beta 3 variant [Xenopus laevis]
  Essential gene: C elegans homolog=C53D5.6; Phenotype=Emb,Lva
LXIQHPRVRYAVCNAIGQMCTDFQPTMCTDFQPTIQKKCHERIVPVLLEAMADMSVPRVAAHAAAAMVNFCEDCPKVNFCEDCPKSIISIYLPSIMERLESVLSQTFQQMMIMERLESVLSQTFQQMMTNGKKLVLEQIITTIASVADAAIITTIASVADAAQDHFAKFYGNLMPPLKYIFFENAKDDNLKLLRGKTIECISLIGMAVGAELFETDADSVMQVLLSSGVKFENNDDPQISYFISAWARICKILGKGFAKYLDMIMPAVLSAADFKPSVALVDGKDTDDNEDWDYMPIDENRSLGVHTAGLEDKVTACEMLCCSRAS

SEQ ID NO: 119853 - protein, 94 aa, Heterodera glycines
  Coding regions on vcDNA: vcDNA=SeqID_46276; Strand=+; Position=1 -125,232-288,482-586
  Homolog annotation: Hit_ID=NP_730760.1; Match level="QueryCoverage =97%, HitCoverage=50%, E-value=1e-45, Identity=94%"; Hit description =CG8385-PE, isoform E [Drosophila melanogaster] ref|NP_730759.1| CG8385-PD, isoform D [Drosophila melanoga
  Essential gene: C elegans homolog=B0336.2; Phenotype=Emb
LIFVVDSNDRERVGEAREELMRMLAEDELRDAVLLVFANKQDLPNAMNAAEVTDRLGLHTLRNRNWYIQATCATSGDGLYEGLDWLSNQLKNRG

SEQ ID NO: 119854 - protein, 438 aa, Heterodera glycines
  Coding regions on vcDNA: vcDNA=SeqID_46277; Strand=-; Position=1 -51,534-635,1106-1223,1318-1628,1853-1998,2187-2230,2435-2697,2938 -3060,3591-3749
  Homolog annotation: Hit_ID=NP_728859.1; Match level="QueryCoverage =94%, HitCoverage=91%, E-value=1e-56, Identity=32%"; Hit description =CG17723-PE, isoform E [Drosophila melanogaster] ref|NP_728858.1| CG17723-PD, isoform D [Drosophila melano
  Essential gene: C elegans homolog=C15B12.7a; Phenotype=Unclassified
MGAGHRAEQQAAANRLQLVFGYISHSMALIADSFHMLSDVIALCIAFGCLKSIQRLLNPEPIKNPLHVLVVGLIGFFINLIGMIMFRGHVGHTHAAHGVEDVRSEVLEVAAEAAAAAAAAKADEPLFGAGNADGRRRNHRCCRDGTKRAQQRGGHNEVDEEEQNRAISMSDLEAVEESLMSRVPRHKHCKIGWMSAGHLNMHAVFLHVLSDAVGSVIVIATALVAWKVEGVEWLKLYMDPMLSIVLVCLMVCTTLPLVHETALILLQTTPSFVNIDSLQSKLLHIDGIVAVHEFHVWRLVGERIIATVHIRFRTLRHYVLAAEQIRSLFHDNHIHSTTIQPEFAEMDTSGSVSELECAFACLPNNCAMLENGDVTCCGKDKRTPPKKIVTSTSIAIEEEEQQRPTDATTGDGGTAFFTAGSGSSSSSSTNSSPEQSGS

SEQ ID NO: 119855 - protein, 254 aa, Heterodera glycines
  misc_feature (130)..(130): Xaa can be any naturally occurring amino acid
  Coding regions on vcDNA: vcDNA=SeqID_46278; Strand=+; Position=1-776
  Homolog annotation: Hit_ID=NP_510671.1; Match level="QueryCoverage =98%, HitCoverage=25%, E-value=4e-58, Identity=44%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
VDCIYIDFQKAFDSVPHELLLYKLEKIGIRGKLLMWIKDFLSNRTFRVKIGDDLSSSKVGSGVPQGSVLGPLLFLIYINDLPDALPSGVRIKLYADDVKLYICYSKNRNSMHKALHNLSEWANKWQIRIXIKKTFVLHLGNKNPKEIYKIDGNIINVVDTIRDLGINIDNKLQFSNHVTQIIKNAYLRMRSLFRVIKSKSSRIWIILYKTYVRPLLEYAPEVWNPSLLKNIKKIEKSQKYFTKRSLFQCSLPPI

SEQ ID NO: 119856 - protein, 41 aa, Heterodera glycines
  Coding regions on vcDNA: vcDNA=SeqID_46279; Strand=+; Position=1-190
  Essential gene: C elegans homolog=Y105E8A.16; Phenotype=Lva,Sma
MRIHKRIINLNSSSDVLKKITGISIEPGVDVEVTIAESPSN

SEQ ID NO: 119857 - protein, 164 aa, Heterodera glycines
  Coding regions on vcDNA: vcDNA=SeqID_46280; Strand=+; Position=1 -54,104-261,321-506,583-679
  Homolog annotation: Hit_ID=CAE69561.1; Match level="QueryCoverage =100%, HitCoverage=100%, E-value=6e-52, Identity=67%"; Hit description=Hypothetical protein CBG15773 [Caenorhabditis briggsae]
  Essential gene: C elegans homolog=ZK1010.1; Phenotype=Emb
MQIFVKTLTGKTITLEVEASDTIENVKAKIQDKEGIPPDQQRLVNQANLRKRIMEKMALSDFRWETIGGWTHFGRLQHSGTPPNLRTTIFTGSSPLFQKESTLHLVLRLRGGIIEPSLRMLAQKYNCDKQICRKCYARLPPRATNCRKKKCGHSNDLRIKKKLK

SEQ ID NO: 119858 - protein, 138 aa, Heterodera glycines
  misc_feature (1)..(1): Xaa can be any naturally occurring amino acid
  Coding regions on vcDNA: vcDNA=SeqID_46281; Strand=-; Position=1 -103,296-464,497-581
  Homolog annotation: Hit_ID=CAD91428.1; Match level="QueryCoverage =70%, HitCoverage=82%, E-value=2e-30, Identity=67%"; Hit description =ribosomal protein S20 [Crassostrea gigas]
  Essential gene: C elegans homolog=Y105E8A.16; Phenotype=Lva,Sma
XAFPYKDDKPQEAAPVEDRIRITLTSQNVKSLEKVCEQLIRGAKDENLVVKGPVRMPTKILRITTRKTPCGEGSKTWDRFQVNKPTEILELHQEKQINKYIKNQQWSQNTHQEKQINKYIKNQQWSQNTEREIGQKGH

SEQ ID NO: 119859 - protein, 93 aa, Heterodera glycines
  Coding regions on vcDNA: vcDNA=SeqID_46282; Strand=+; Position=1 -110,445-616
  Homolog annotation: Hit_ID=AAN05584.1; Match level="QueryCoverage =98%, HitCoverage=80%, E-value=1e-36, Identity=80%"; Hit description =ribosomal protein L30 [Argopecten irradians]
  Essential gene: C elegans homolog=Y106G6H.3; Phenotype=Emb,Lva
MVTKSGKYCLGYKQALKTLRSGKAKLVIISSNTPTLRRSEVEYYAMLSKTGVHEYHGNNIELGTACGKLFRVSMLSITDPGDSDIIRTMPTEA

SEQ ID NO: 119860 - protein, 331 aa, Heterodera glycines
  Coding regions on vcDNA: vcDNA=SeqID_46283; Strand=-; Position=1 -171,228-473,528-592,650-774,830-1068,1129-1278
  Homolog annotation: Hit_ID=NP_491237.1; Match level="QueryCoverage =83%, HitCoverage=90%, E-value=6e-83, Identity=51%"; Hit description =protein phosphatase 1A (34.6 kD) (1E406) [Caenorhabditis elegans] gb|AAB42233.1| Yeast glc seven-like pho
  Essential gene: C elegans homolog=W09C3.6; Phenotype=Ste
MAREEYCFDATAAAAAEQSRPSATTSTLVQGDGLSSSFVDAIIRKVRQSPVQRFTDEITDEELKQLCKAATDIFRMQPTLVRIQPPVVVVGDIHGQFTDLQRIFHTHGNPPEQQYVFLGDYVDRGPQSLETIVLLFCYKVKYPANFMLLRGNHECANINRVYGFFDEVNRRYQRPGPRRLYDLFNQTFAWMPYVGLIGDKILCMHGGLSDQINSLEQLSHLNRPQIDPPLRTLEIDLLWADPARGVRGVIPNTRGAGIAFGEDVVERVCDMLCLDYIIRAHQVVMDGVEYFAGRRLITLFSAPRYTGRNNTGATLTIAPNLSHSITRFPPA

SEQ ID NO: 119861 - protein, 364 aa, Heterodera glycines
  Coding regions on vcDNA: vcDNA=SeqID_46284; Strand=+; Position=1 -342,402-1153
  Homolog annotation: Hit_ID=CAE75423.1; Match level="QueryCoverage =100%, HitCoverage=17%, E-value=1e-160, Identity=75%"; Hit description=Hypothetical protein CBG23416 [Caenorhabditis briggsae]
  Essential gene: C elegans homolog=K12F2.1; Phenotype=Bmd,Lva,Unc
MFVLEQEEYKREGIAWTFIDFGLNLQACIELIEKPLGVISMLDEECIVPKASDMTFVQKLIDQHLGKHPNFQKPKPPKGKQAEAHFAIVHYAGTVRYNANSFLEKNKDPLNDSAVSVLKAAQDNELLLNIFEDYVTQEEAAELAKTGQSSGKKKGKSSSFMTVSMMYRESLNNLMNMLYQTHPHFIRCIIPNEKKQSGLLDSALVLNQLTCNGVLEGIRICRKGYPNRMQYPDFKVASQFKTIAINTKQSQHRYAILAAEESKVPDEKQASKQITDKLATDGELKDEEFKLGNTKIFFKAGILARLEDLRDAKLSVIMTGFQSRIRWFLAQTDVKRRIQQRAGLLILQRNIRGWCTLRNWDWFK

SEQ ID NO: 119862 - protein, 377 aa, Heterodera glycines
  Coding regions on vcDNA: vcDNA=SeqID_46285; Strand=+; Position=1 -119,194-1208
  Homolog annotation: Hit_ID=NP_498735.1; Match level="QueryCoverage =99%, HitCoverage=89%, E-value=6e-39, Identity=29%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MSRVYLFLELSIQKEDAGGRWVPIEAADQLVGPIQCIGQTLKCKTQLYDSGTLYPYKAYLTNELSFPNSAKGHFMASAGYHPSLKHDSATDAGFLARCARFEGGRKARFLSRLDFDLGNQELYLLNNMDVLFTIYRAKNTFLLQNLAPAPAVGAAARQQYALYLHDIKLYMKVVEVQPSLNLSIYKTLEKQPATYAVRKTEVKSVFLTAGRTEMDHNIFSAAIPRRLTIALVANGAFNGQLAQSPFNFKPYSIREISVHAGGQIYPAVPHRMDFSGAAYIRPFVDMYEALGMANSERSMDITLDQFRDGWTIFVVPMTSTLDDSCGFELLRSGTTSIRLTFNEEIPAGGVEMVVLGEFDQLIMIDYNRHIVSDSKIA

SEQ ID NO: 119863 - protein, 120 aa, Heterodera glycines
  Coding regions on vcDNA: vcDNA=SeqID_46286; Strand=-; Position=1 -91,135-265,1977-2117
  Homolog annotation: Hit_ID=NP_498565.2; Match level="QueryCoverage =34%, HitCoverage=12%, E-value=7e-12, Identity=68%"; Hit description =small nuclear ribonucleoprotein (rnp-7) [Caenorhabditis elegans] gb|AAA62536.2| Rnp (rrm rna binding doma
  Essential gene: C elegans homolog=K04G7.10; Phenotype=Emb
MEGIGVIWAAVVGSEVDSDCAMELLTETALVGSQMSARGHRTRGQVQCWRKGLCSFGPASTEGERRQIIQTNCQRKEKEELMAYKIEQGIATWTPADNPKATVDPYKTLFIGRIVKKNTW

SEQ ID NO: 119864 - protein, 201 aa, Heterodera glycines
  misc_feature (120)..(120): Xaa can be any naturally occurring amino acid
  misc_feature (186)..(186): Xaa can be any naturally occurring amino acid
  Coding regions on vcDNA: vcDNA=SeqID_46287; Strand=-; Position=1 -79,716-845,893-1089,1542-1669
  Homolog annotation: Hit_ID=AAH26944.1; Match level="QueryCoverage =94%, HitCoverage=38%, E-value=1e-36, Identity=45%"; Hit description =Sfrs4 protein [Mus musculus]
  Essential gene: C elegans homolog=Y111B2A.18; Phenotype=Emb
SSRYGPPIQTRYRMLVTNLSTRCSWQDLKDLMRNAGEVTYADAHKKVRNEAVVCFATHEDLRRAVERYQGKDINGRRIKLVDDSEGYRAQKVQGKDINGRRIKLVDDSEGYRAQKVRTFXPMPFPRKFLSRSRSPRSRSRSPRSRTRSPPSRSRSPRSHGRSRSRSRSRSPTPSRSRSRSPNDEKXTNEEESMMEHLFVGW

SEQ ID NO: 119865 - protein, 172 aa, Heterodera glycines
  Coding regions on vcDNA: vcDNA=SeqID_46288; Strand=-; Position=1 -97,159-386,436-629
  Homolog annotation: Hit_ID=CAE59883.1; Match level="QueryCoverage =100%, HitCoverage=4%, E-value=2e-67, Identity=70%"; Hit description =Hypothetical protein CBG03363 [Caenorhabditis briggsae]
  Essential gene: C elegans homolog=Y67D8C.5; Phenotype=Emb
FVGRVIAKAIYDNKQLDCYFTRAFYKHILNKHVRYQDIESEDPDLFKSLEFLLNNAVEDLGAELTFTVEVEEFGVRSTRQLLENGNKTTVTDANKHEYVHLMCQMKMTGSIRQQLNAFLEGFYEVIPKKLISIFNEQELELLISGLPDIDIDDLCANTEYKTYTRTSPQIQW

SEQ ID NO: 119866 - protein, 180 aa, Heterodera glycines
  Coding regions on vcDNA: vcDNA=SeqID_46289; Strand=-; Position=1 -264,328-437,616-781
  Homolog annotation: Hit_ID=NP_491278.1; Match level="QueryCoverage =73%, HitCoverage=36%, E-value=6e-21, Identity=39%"; Hit description =CD45 family member (1E541) [Caenorhabditis elegans] gb|AAB52356.1| Hypothetical protein F47B3.1 [Caenorha
  Essential gene: C elegans homolog=K07F5.8; Phenotype=Stp
MDCNRYRDVICAEQGRVRLDNGRYIHANWITALGEQRFICTQGPLETTCADFWTMIVQENIEGIVMLCDTVEQNKTKCHQYWPTPDKKQLHFANKTITVHFIEETALEPDLYRTKLSVLSRNGSMNRTDWNTGGAAHCLRYSAAWTSTQHPLVGAQPPSASGPKCADAGPIPLHILRDFA

SEQ ID NO: 119867 - protein, 153 aa, Heterodera glycines
  Coding regions on vcDNA: vcDNA=SeqID_46290; Strand=-; Position=1 -174,565-657,705-898
  Homolog annotation: Hit_ID=CAE62148.1; Match level="QueryCoverage =98%, HitCoverage=22%, E-value=3e-40, Identity=54%"; Hit description =Hypothetical protein CBG06194 [Caenorhabditis briggsae]
  Essential gene: C elegans homolog=B0495.4; Phenotype=Lva
FHAYKKVAETVPDSALLIVLGFALGQLLRLFRVERHIYMFEANTFFLYLLPPIIFEAGFYMPTNLLWENYDSILLFAFVGTIWNTVAIGFTLYWLGTFGIFSMPFSICQALTFAASISSVDPVAVIGVFEQINVNKFLFINVFGEALFNDAAA

SEQ ID NO: 119868 - protein, 460 aa, Heterodera glycines
  Coding regions on vcDNA: vcDNA=SeqID_46291; Strand=-; Position=1 -87,139-417,2168-2340,2398-2561,2812-3245,3522-3767
  Homolog annotation: Hit_ID=CAE73030.1; Match level="QueryCoverage =55%, HitCoverage=97%, E-value=8e-61, Identity=41%"; Hit description =Hypothetical protein CBG20397 [Caenorhabditis briggsae]
  Essential gene: C elegans homolog=C01A2.5; Phenotype=Emb,Lva,Unc
MDKGRSKSPNDNKEEEETQSAKEDKTDHKTNEQMLLVRTGLKLKRGTLFKKKRNVDPKTIDLTIKKEQEGPRKTKAELAFLKRQEETAFDRLSKRAQISHREKVEKFNKQMEELTEFNDIPKQYKMGADGGTIPKRCELVKKKRKKEKIEKSYEAATKWRTCQLSQQPLKKPIVCCKLGRLYNKEAVLEAKLDKTLAKNKATEHIHAFSDVKELMLTDNKAWKDNGPEKGDIYIDMNETPWVCPITALPMNGVNNFFVNWKCGCVFSEKAHNELKTDSCYGCGGPMQEQQFIKLYPDEELFLLYEQRIVDEIAQRKLKAGEKKRKTTGDSKGAEHQQKKSKVEEETKFSSIQDNPNVPKAVKSMFTTSEEAKKQPTAHWKIICICWFASDYSLEQMDGLTEPMLSTRPSPSIGAEGKERFARENHSEIERRRRNKMTHYINELADMVLKVAVAIAIKHFM

SEQ ID NO: 119869 - protein, 101 aa, Heterodera glycines
  Coding regions on vcDNA: vcDNA=SeqID_46292; Strand=-; Position=1 -171,983-1114
  Homolog annotation: Hit_ID=CAE68264.1; Match level="QueryCoverage =56%, HitCoverage=50%, E-value=7e-19, Identity=80%"; Hit description =Hypothetical protein CBG13941 [Caenorhabditis briggsae]
  Essential gene: C elegans homolog=W09G12.5; Phenotype=Emb,Lva,Lvl
MNKPDLVLFVGEAWVGNEAVDQLVKFNQALADNSAVGEQARLIDGIVLTKFDTIDDKKLGKKLEGIGNNAMNDGGEERRNGGENADRNQNGAQKEEAEEIE

SEQ ID NO: 119870 - protein, 122 aa, Heterodera glycines
  misc_feature (4)..(4): Xaa can be any naturally occurring amino acid
  misc_feature (96)..(96): Xaa can be any naturally occurring amino acid
  misc_feature (110)..(110): Xaa can be any naturally occurring amino acid
  misc_feature (119)..(119): Xaa can be any naturally occurring amino acid
  Coding regions on vcDNA: vcDNA=SeqID_46293; Strand=-; Position=1 -111,156-385
  Homolog annotation: Hit_ID=AAL78225.1; Match level="QueryCoverage =88%, HitCoverage=74%, E-value=2e-43, Identity=87%"; Hit description =putative pyruvate dehydrogenase [Heterodera glycines]
  Essential gene: C elegans homolog=T05H10.6a; Phenotype=Emb
ASQXIHKSMVIPSPDIDKKVRQEVDEAVKVALSDEVLPPEALFSDLLPPEALFSDLYANTPPLAVRGTTADATVTQPFVSTAEVLRKMGREPKNYXENERTDSQRRIDNXEKHGIINCXSII

SEQ ID NO: 119871 - protein, 233 aa, Heterodera glycines
  misc_feature (155)..(155): Xaa can be any naturally occurring amino acid
  Coding regions on vcDNA: vcDNA=SeqID_46294; Strand=+; Position=1-703
  Homolog annotation: Hit_ID=NP_510671.1; Match level="QueryCoverage =97%, HitCoverage=23%, E-value=1e-43, Identity=38%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
LNWLTDFLTNRTFKVRINQQFSKEFPIKSGVPQGSVLGPILFLIFINDLSPVIPDGISLKLFADDTKIYRYNTESQRKKLDEALHCVNQWAQRWGLQFHQKNQLLLYLGKDNFKIPYQFNGKTIKETQTIRDLGILIDNKLTFKSHISAILQKAXLRSRTLFQKIKSKSSKTWIKIYKSYIRSLLEYSSENWNPHIKKEIVRLEKFQKFFTRRVFLKCHLPVLPYSDRLKYLT

SEQ ID NO: 119872 - protein, 307 aa, Heterodera glycines
  Coding regions on vcDNA: vcDNA=SeqID_46295; Strand=+; Position=1 -268,690-776,827-1108,1497-1590,1639-1830
  Homolog annotation: Hit_ID=CAE67413.1; Match level="QueryCoverage =95%, HitCoverage=24%, E-value=5e-24, Identity=28%"; Hit description =Hypothetical protein CBG12901 [Caenorhabditis briggsae]
  Essential gene: C elegans homolog=Y51A2D.15; Phenotype=Bmd,Unc
ASNPAEMFELRAELNAHEKLAEEKITECQHLRANLELARKEVREAEEHETVLRADIDKLERELADQRRTTMPMQTHQLTVDKLESTERKSQQLEQRFTAQLDTLQREKFEAEAQLQTQKRQQRDCRAEMDALRERAGCDADQWERQRKALESERNALRARLDLEEANARELHAAKCEAESAARNAAEYERQVHEREERMRKLETELAQQRQQTDAEKKKSQLYREELITEQNRLSDLLGRLRSVCLMALRSGADEAADTSCCLEPTCMQDDLQLIAIIDDLLMKALTDARREADALRVQQQKQIREL

SEQ ID NO: 119873 - protein, 260 aa, Heterodera glycines
  Coding regions on vcDNA: vcDNA=SeqID_46296; Strand=-; Position=1 -163,273-382,426-611,860-979,1030-1257
  Homolog annotation: Hit_ID=XP_318694.1; Match level="QueryCoverage =58%, HitCoverage=43%, E-value=3e-16, Identity=35%"; Hit description =ENSANGP00000010291 [Anopheles gambiae]
  Essential gene: C elegans homolog=F59E12.11; Phenotype=Emb
MGNEHSGGRFGGNGTNKEKGDDDGGQTSPSTSTGIPASFSFLAKKRNSAKSAVMGSIVVVIEGASCSSSAVPGKDVDLRRIKEIPRFLPLLRGVLPGHRDIPEVQQKIDSKSILSFMHRLQQHFKSCAQTVATEQGRMFARIVEIDQLISSLFKKTSTATKRLDALNNELRRVGTFSSQLEEIQASLLDLSSSANSLNQLLSFDDRLPPLQFAFTPILTRKKLSENAGTMLPQNSDNINSGDRTAIERDLRKVSELRVVD

SEQ ID NO: 119874 - protein, 245 aa, Heterodera glycines
  Coding regions on vcDNA: vcDNA=SeqID_46297; Strand=-; Position=1 -96,147-270,444-538,636-755,808-1038
  Homolog annotation: Hit_ID=NP_683690.1; Match level="QueryCoverage =97%, HitCoverage=99%, E-value=2e-37, Identity=39%"; Hit description =osteoclast stimulating factor 1 [Rattus norvegicus] gb|AAM82159.1| osteoclast stimulating factor [Rattus
  Essential gene: C elegans homolog=Y106G6H.14; Phenotype=Ste
FLTPMDGPPPPPMAKPGRIRMFRSLKQFVPTKAGELKLYGEDIVAGELKLYGEDIVYVKEAPEGTKSCEAKSSTGHTEGILPKQFAVEQHMELIEFPLHEAARAGDLSFLRECLDNKMSVNGLDRSGSTALHWAAYAGHTPILKHLLSVPNVTLLAQNKLGDSPLHAANKLGDSPLHAASAKGRLDCVHLLVEAGANAHVRNRRGQRPVDVTGDPQVGALLKTTMTTTGDDMTEGDEDYLEEEDD

SEQ ID NO: 119875 - protein, 292 aa, Heterodera glycines
  Coding regions on vcDNA: vcDNA=SeqID_46298; Strand=+; Position=1 -206,415-680,723-876,927-1121
  Homolog annotation: Hit_ID=NP_609399.1; Match level="QueryCoverage =85%, HitCoverage=67%, E-value=2e-69, Identity=55%"; Hit description =CG5313-PA [Drosophila melanogaster] gb|AAF52944.2| CG5313-PA [Drosophila melanogaster] gb|AAM51048.1| SD1
  Essential gene: C elegans homolog=F31E3.3; Phenotype=Emb
TLNKKLRNNERKYFLNVYKLILVSKLIDEDKLPHLLFYGPPGTGKTSTILAAARKIFSPKNIQSRVLELNASDERGIGVVREKIINFTSSQGLHDMAFKLVILDEADAMTKDAQNALRRIIEKYTDTTRFCIICNYLSRIIPALQSRCTRFRFAPLSQFRFAPLSQKQVLPRLDYIIEQERLPAVTDGAKNSLFKLSKGDMRRVINILQSTALSTSAVDEENIYKCVGSTALSTSAVDEENIYKCVGYPHPNVVKDIFRALLDNSIEIAYKSKLKILNIFLFMSFFVARFIF

SEQ ID NO: 119876 - protein, 201 aa, Heterodera glycines
  misc_feature (29)..(29): Xaa can be any naturally occurring amino acid
  Coding regions on vcDNA: vcDNA=SeqID_46299; Strand=-; Position=1 -187,240-281,338-490,604-627,776-894
  Homolog annotation: Hit_ID=CAE68338.1; Match level="QueryCoverage =80%, HitCoverage=30%, E-value=1e-33, Identity=46%"; Hit description =Hypothetical protein CBG14059 [Caenorhabditis briggsae]
  Essential gene: C elegans homolog=T14F9.4a; Phenotype=Unclassified
IMQCQRMAQKKGRGPKSLIATAAVLSICXNSIRPFQFINLIKFQRYDPAQPRTVTSFKGTQKLIFEGYRYQKLIFEGYRYNIHHIVPAKGVKTWRCVCAKKLIVPAKGVKTWRCVCAKKLTCSRSWCKGRAETWDDDGQGISKGEHNHPAEHEVAELEYFKSQLILAAIASPNANLNELIDEAIGFMSEGVSFGSRESLKK

SEQ ID NO: 119877 - protein, 210 aa, Heterodera glycines
  Coding regions on vcDNA: vcDNA=SeqID_46300; Strand=-; Position=1 -116,185-425,620-854
  Homolog annotation: Hit_ID=CAE56922.1; Match level="QueryCoverage =95%, HitCoverage=35%, E-value=2e-36, Identity=35%"; Hit description =Hypothetical protein CBG24767 [Caenorhabditis briggsae]
  Essential gene: C elegans homolog=T19H12.11; Phenotype=Gro
LFEVFVNVDEFTDFPRPLFPNFIFIGGLELRNTRAQSPPYKSELLKGRKGVVPYKSELLKGRKGVVFFSMGSAVKTDVLPAPFMKNVIGAFAELPDWHFIVKIEPDDEQSRRMAENVPNIRLTSWAPQPAILSHPRLRLFITHGGYNSLLEGAQSGTPVLSIGFFADQRRNALVAQRNGWGRAFENWKLLEGMNEFRETVREMLEEDNEQ

SEQ ID NO: 119878 - protein, 459 aa, Heterodera glycines
  Coding regions on vcDNA: vcDNA=SeqID_46301; Strand=-; Position=1 -64,111-147,206-407,460-582,683-813,1020-1122,1168-1452,1698 -1770,1824-1873,1917-2060,2104-2269
  Homolog annotation: Hit_ID=CAE71253.1; Match level="QueryCoverage =82%, HitCoverage=50%, E-value=1e-86, Identity=44%"; Hit description =Hypothetical protein CBG18133 [Caenorhabditis briggsae]
  Essential gene: C elegans homolog=C30C11.4; Phenotype=Bmd,Gro
MAGIDFGNLTCYMAVARNKGIEIVENDYSLHATPSCVSFGQFARMMGFGAKQQLNVNYGNSVVNFKHILGRTFNDKVVQTFRQHIPCGLMGKFTDDQIEIKVTHLGTTRVLSPEQVVACLLTHLRVQLSRSLGTDATECVINVPFFYEENQRRALLNAGRIAGLSLRLITDPAALAYCYGMYNGANLPPPEQPARLVAFVDVGHSSVQASLIAFSAGKAEVLAASFDLTVGGVHFDALLRDYFNEDFGKRFKIDARKTPRAWLRLLDECEKALTMKGTNELELSDQKANVGKQSAHSLCNRMLCERHRRQRSDAKVGDIFDVELVGGSSRIPRIKQIVAEFFKKVPKTTMNQDDALARGCALRSAMLYPAYQVKKFIVIDRYEMPIDPSALSDEEKLKEEIRAEQEMQTADLRDKQRSDAKNAFEEYCFKTQHTMEGEQLAKGKESDEERHKCIEKCKG

SEQ ID NO: 119879 - protein, 81 aa, Heterodera glycines
  Coding regions on vcDNA: vcDNA=SeqID_46302; Strand=-; Position=1 -84,262-361,411-469
  Homolog annotation: Hit_ID=CAE63049.1; Match level="QueryCoverage =100%, HitCoverage=60%, E-value=1e-27, Identity=65%"; Hit description= Hypothetical protein CBG07320 [Caenorhabditis briggsae]
  Essential gene: C elegans homolog=C31E10.7; Phenotype=Gro,Lvl,Unc
MTASRRLTRAEVAEHNNSSDAWIIIGNKVYDVTKFLDEHPGGMEVLMEKAGEDRTEAFEDIGHSTDARQMKEDFLVGEIVE

SEQ ID NO: 119880 - protein, 154 aa, Heterodera glycines
  Coding regions on vcDNA: vcDNA=SeqID_46303; Strand=+; Position=1 -207,513-630,671-810
  Homolog annotation: Hit_ID=NP_497617.1; Match level="QueryCoverage =92%, HitCoverage=45%, E-value=7e-23, Identity=34%"; Hit description =phosphotyrosyl phosphatase activator (42.9 kD) (3D872) [Caenorhabditis elegans] gb|AAK29984.1| Hypothetic
  Essential gene: C elegans homolog=Y71H2AM.20a; Phenotype=Emb,Lva
MVDQCFSKPKREILGIGDVSKWLNSEAHHKYMGFLRRLNSAVKTVPTTSSDIIIGETARKIISILDLLEDGQSLLSDLFPENLKSAVLEIWPYLMDSFGNSTRIDYGSGHETSFLIFLFCLYEIGVLHSPDDDRASILRVFHRLFFAQITNKNL

SEQ ID NO: 119881 - protein, 217 aa, Heterodera glycines
  Coding regions on vcDNA: vcDNA=SeqID_46304; Strand=+; Position=1 -195,264-399,447-542,593-819
  Homolog annotation: Hit_ID=CAE57186.1; Match level="QueryCoverage =99%, HitCoverage=91%, E-value=4e-56, Identity=52%"; Hit description =Hypothetical protein CBG00030 [Caenorhabditis briggsae]
  Essential gene: C elegans homolog=ZK686.4; Phenotype=Unclassified
MSFLQRPPSSVKDHRRTWDRTEYEVKAQERLTTEREALEIKKGNIRPPPKGPKIKREMLKPREFKVDLESKVGRQVVINKTTPSSETGGYYCNICDCVVKDSINFLDHINGKNHQRNLGFSMKVKKSTVEEVRERFSMKKAQKETLRNEDVEEKQRDLKEEEAKMADLKRMQRERQKETSRKRTAAAVTAPPTDEEADAELMKVMGIGTFGSNKRKK

SEQ ID NO: 119882 - protein, 116 aa, Heterodera glycines
  Coding regions on vcDNA: vcDNA=SeqID_46305; Strand=+; Position=1 -240,311-421
  Homolog annotation: Hit_ID=NP_496176.1; Match level="QueryCoverage =99%, HitCoverage=24%, E-value=1e-29, Identity=52%"; Hit description =esterase A family member (52.5 kD) (2K387) [Caenorhabditis elegans] emb|CAA88435.1| Hypothetical protein
  Essential gene: C elegans homolog=M28.6; Phenotype=Unclassified
NTNTFNNPQLFELEQAAALGVSRAKDVAKIFSLMLSGELISPKSLTRLLKPQFVDRIDYVMMIPVSRGFGFMYEKHPRKSGKWLFGHPGFGGSTLMVDPEEELVIAYVCNGMKTGK

SEQ ID NO: 119883 - protein, 126 aa, Heterodera glycines
  Coding regions on vcDNA: vcDNA=SeqID_46306; Strand=-; Position=1 -147,247-480
  Homolog annotation: Hit_ID=AAV34867.1; Match level="QueryCoverage =93%, HitCoverage=74%, E-value=2e-46, Identity=77%"; Hit description =ribosomal protein S11-1 [Bombyx mori]
  Essential gene: C elegans homolog=F40F11.1; Phenotype=Ste
MTEQTERAYQRQPTVFLNDKFRTQGIGKKAANKDRYWKNVGLGFKTPREAIEGIYIDKKCPFTGNVSIRGRILTGVVIKNKMQRTIVIRRDYLHFVPKYRRYEKRHKNMSVHCSPCFRQELTKELS

SEQ ID NO: 119884 - protein, 982 aa, Heterodera glycines
  Coding regions on vcDNA: vcDNA=SeqID_46307; Strand=+; Position=1-2946
  Homolog annotation: Hit_ID=NP_741579.1; Match level="QueryCoverage =11%, HitCoverage=20%, E-value=4e-39, Identity=67%"; Hit description =C2H2 type zinc finger containing protein (5J271) [Caenorhabditis elegans] gb|AAM29659.1| Hypothetical pro
  Essential gene: C elegans homolog=C01B7.1a; Phenotype=Lva
MGSNEIRNALLDVAAPDEQNGQQAVRNEAGRGGGNFEQQHVDGGLRIRLQNVGRNNGQQWQIRNENSNDGHRILHPAPQNVRPRTSTPYENMFEELRVEHTVECRPHNQNLQANFQNMLNNGVAMQNQRVTAPTGLQSHPQQIHPHPIQQTQPQQPSQPMPAQPVFQQGFPGFIWGYPGQFPYGPYPTAFGYPPQQNFGYVNPNLQQPPIFNQQFPPPVLQHANYAMGVPSQQQPIVQANQQREVLQPVAQQQNPPITNRPNNFGTQNAGAEIRQTENEIRGPGMDQVAYALIMSQIPYLKGNEGAEKIKEFFKRFDANTAEWSNAKRITSLESKLFGRAERAFKSACSTEPYRYESIKREMFRQLEETDAREWSAFDQIMTGIRRKNDEDLDSLAERVITLVRRAYPGLTDHLVDDYAIKHLIRTFDNSELALSLELGRTPGMTFDHFVGMAARAEATQRATRRMASQNAIQRGRQNEANSTGGFFNNSQTQQTNDNRPKCYNCGKLGHVARNCFRRQAEQNGQMRNFEHIPTTGANCTPMPSNPNTNFMSKPEQNANQHRPQHFQSRNFLKQNFLIERKEVKDNEDAVKCTGVLNNEPEMEEFFKSFWEEHEDNFEAAGKKELCLIGKIMTTNVTIFDQPAISMMDGGAQVSLIKAEFLKNILESQKLEGTNLKIWPKTRNVVDINGKRVECYGIILLPVVRRGCEAVEIMFHITDAPIGHPILFGTNALGLLGFKIFDAPNGELVEFECVDNKSDSMRVIYSTLVEPYSTKFVELSISPDFDDKNVLITPKEENDRIRVESSVDKGRKGKVITAITNFSHKAVILKQNEEIAAVEELKQIANADDCLGRIVRNRPGPMTSKKRVLGLCAECDKPITAGARQMHMFYHLGKDMNTYRFRCKHAGCKVQDYRKDQMENHQSKAHGKVDAEMMEDRSMELYNMVQEMSMQLLGTKGNTPGPTAVKAQQIYEQQMREMEANLG

SEQ ID NO: 119885 - protein, 85 aa, Heterodera glycines
  Coding regions on vcDNA: vcDNA=SeqID_46308; Strand=+; Position=1 -144,1040-1073,1123-1202
  Essential gene: C elegans homolog=W03C9.3; Phenotype=Unclassified
MSSFFCYGVIAIFPLKSAPCVSGDSGVGKTSLMNQYVNKRFSNQYKATVSARDGVNVEEAFQAIARAALARDSQETHDFPGRFAG

SEQ ID NO: 119886 - protein, 201 aa, Heterodera glycines
  Coding regions on vcDNA: vcDNA=SeqID_46309; Strand=-; Position=1 -128,357-487,553-653,829-1071
  Homolog annotation: Hit_ID=NP_741303.1; Match level="QueryCoverage =66%, HitCoverage=32%, E-value=6e-37, Identity=56%"; Hit description =signal recognition particle receptor (4B988) [Caenorhabditis elegans] emb|CAB04354.1| Hypothetical protei
  Essential gene: C elegans homolog=F38A1.8; Phenotype=Emb,Ste
SSLKFDGRLALSRGRELANTEMLKQHVEDVLKAEQYAAWHVNDGAKPKGISASGGWFSAFKSLVGTKQLARGDIEPAMEKMKEMLITKNVASEPAERICESVAAKLEGKVIGTFNRVASTLLTPKRRVDILRDILDAKAQKRPYVIVFCGVNGVGKSTNLAKVNSEEEVFPLSVFSANRSLFGSMRMAIACSLPPAIRSGR

SEQ ID NO: 119887 - protein, 373 aa, Heterodera glycines
  Coding regions on vcDNA: vcDNA=SeqID_46310; Strand=+; Position=1 -120,181-261,416-523,595-821,1021-1126,1175-1243,1374-1527,1643 -1746,1868-2017
  Homolog annotation: Hit_ID=NP_506070.1; Match level="QueryCoverage =92%, HitCoverage=25%, E-value=9e-54, Identity=36%"; Hit description =RAD50 homologue, RADiation sensitivity abnormal/yeast RAD-related RAD-50 (150.3 kD) (rad-50) [Caenorhabdi
  Essential gene: C elegans homolog=T04H1.4; Phenotype=Emb
MVQFIGLKIAGVRSIGDKPQCINFLSPLTIIQGPNGTGKTTIIEALNYVTTGALPAGKMQTFIHNAQIANKARVDALAQLNFRDIKGNKCTATKRMNASATHSGKLSTKSDEFTLRIEDKFGNLKSVSSKISDFNKESVMILLTFCTKFLSQFKMLNLLGVPKAVLEHVLFCHQEEANWPLSEPKELKLRFDAIFEVTKYVKALDHIKKNIKELGMQIQLIDKELPHLENNMRARADLRLRFDETLTALKHNRKSIEHQLKTEREAVDGELRNIRKHLEMATKCNHEFEIIQGQINAQKRFLEGMPPLTHKGTREQLQQQIDELKRSATAREADEHRASVVRQVKSIAFEMDQCKKLEEAYRTKLMQHESRRM

SEQ ID NO: 119888 - protein, 106 aa, Heterodera glycines
  Coding regions on vcDNA: vcDNA=SeqID_46311; Strand=-; Position=1 -114,450-536,753-869
  Homolog annotation: Hit_ID=NP_498013.1; Match level="QueryCoverage =100%, HitCoverage=55%, E-value=3e-11, Identity=33%"; Hit description= bzfb xenla basic fgf-repressed zic binding protein homolog like (3F951) [Caenorhabditis elegans] gb|AAA6
  Essential gene: C elegans homolog=C35D10.5; Phenotype=Gro
MALCRVQQSLEAMAYIYFMHQVLEVFNTDWYTRLDKAAKEMGMSVNKRKEGMALHAIYISTLHDYDEGFFGDDRVLAAAVWRSFFLQLPDVCPAQINRVVRYMRAT

SEQ ID NO: 119889 - protein, 899 aa, Heterodera glycines
  Coding regions on vcDNA: vcDNA=SeqID_46312; Strand=-; Position=1 -2415,2709-2993
  Homolog annotation: Hit_ID=NP_741578.1; Match level="QueryCoverage =28%, HitCoverage=26%, E-value=6e-63, Identity=46%"; Hit description =C2H2 type zinc finger containing protein (103.5 kD) (5J271) [Caenorhabditis elegans] gb|AAA96114.2| Hypot
  Essential gene: C elegans homolog=C01B7.1a; Phenotype=Lva
MTGIRRKNDEDLDSLAERVITLVRRAYPGLTDHLVDDYAIKHLIRTFDNSELALSLEMGRTPGMTFDHFVGMAARAEATQRATRRMASQNAIQRGRQNEANSTGGFFNNSQTQQTNDNRPKCYNCGKLGHVARNCFRRQAEQNGQMRNFEHIPTTGANCTPIPSNPNTNFMSKPEQNANQHRPQHFQSRNFLKQNFLIERKEVKDKEDAVKCTGVLNNEPEMEEFFKSFWEEHEDNFEAAGKKELCLIGKIMTTNVTIFDQPAISMMDGGAQVSLIKAEFLKNILESQKLEGTNLKIWPKTRNVVDINGKRVECYGIILLPVVRRGCEAVEIMFHITDAPVGHPILFGTNALGLLGFKIFDAPNGELVEFECVDNKSDSVRVIYSTLVEPYSTKFVELSISPDFDDKNVLITPKEENDRIRVESSVDKGRKGKVINAITNFSHKAVILKQNEEIAAVEEVKQIANADDCFGRIVHNRPGPMTSKKCVLGLCAECDKPITAGARQMHMFYHLGKDMNTYRFRCKHAGCKVQHYRKDQMENHQSKAHGKVDAEMMEDRSMELYNMVQEMSMQLLGTKGNTPGPTAVKAQQIYEQQMREMEGNLGVRKRRRPEYFGCNLLSANINNNVISRSSGLPIYDSANRRVEDLECRLCNKFILNRIKGFHILWHLNTDLNIVRYGCKHCNFKHDRPQSVVAHGIREHGDEASCEDLLYNFEDELKQMSKACFGVERLFEKEIRRRNRLERFARCSTENSSAGRAEDDDNYQHGNNESKLSQQIVRRRSQQHIMNLRVSLKSENVGRDWTPKEPDFHNSHEAPMDNRLRFAQEIKDSIRDCYPQLFIDAPIPTKEDIEKLRDSLNLSDQVLVCDKDEEGEEGEREEDGEEAAMDKDHANEEEEEAETR

SEQ ID NO: 119890 - protein, 293 aa, Heterodera glycines
  Coding regions on vcDNA: vcDNA=SeqID_46313; Strand=+; Position=1 -78,137-595,926-1102,1398-1565
  Homolog annotation: Hit_ID=CAE62730.1; Match level="QueryCoverage =98%, HitCoverage=27%, E-value=5e-24, Identity=28%"; Hit description =Hypothetical protein CBG06891 [Caenorhabditis briggsae]
  Essential gene: C elegans homolog=F54F2.1; Phenotype=Ste
MPFVSDSSKARCRVNQPQNLNPANLAISNEHVPTPGPGGVHGGAISLEDAEAAAEEEVAETPAVHGGGVATGRMKEEADEELEEEEVEEDGEEEADGEEAEGDGGEEYNSNGETRRRKRNARRKTATRQRSDREESGVASAAVRRNLRQQRQMLREAVEQAKEAGTATEYHGVLGRKTLLWVNTLIDEDLLEADLSSLAFARISALPFAPKYSPPPLVIAVNTEVNPTDPEAGTWELPCGFFKRNRPPREKARLSRGPAAAATNGGEHFGEENGRGRGGYYADNQARYAQPQM

SEQ ID NO: 119891 - protein, 132 aa, Heterodera glycines
  Coding regions on vcDNA: vcDNA=SeqID_46314; Strand=+; Position=1 -160,811-893,1122-1276
  Homolog annotation: Hit_ID=NP_490675.1; Match level="QueryCoverage =99%, HitCoverage=58%, E-value=3e-58, Identity=88%"; Hit description =RAB family member (23.4 kD) (rab-11.1) [Caenorhabditis elegans] gb|AAB54158.1| Rab family protein 11.1 [C
  Essential gene: C elegans homolog=F53G12.1; Phenotype=Emb,Ste
VDSKTVKAQIWDTAGQERYRAITSAYYRGAVGALLVYDIAKHVTYENVERWLKELRDHSDQNIVIMLVGNKSDLRHLRAVPIKFLLSPKTDEAKAYAERNQLSFIETSALDATNVEDAFTNILTEIYRSVST

SEQ ID NO: 119892 - protein, 102 aa, Heterodera glycines
  Coding regions on vcDNA: vcDNA=SeqID_46315; Strand=-; Position=1 -68,127-365
  Homolog annotation: Hit_ID=NP_505070.1; Match level="QueryCoverage =36%, HitCoverage=3%, E-value=4e-10, Identity=78%"; Hit description =valyl tRNA Synthetase (vrs-1) [Caenorhabditis elegans] pir||T28995 hypothetical protein ZC513.4 - Caenorha
  Essential gene: C elegans homolog=ZC513.4; Phenotype=Emb,Lva
MKLLRLRSYLHFSCNLHVRNLTNLSKFGTYNEKAIQLIQQHYDEATSSSHQFVDSPSQEVFRMVLPPPNVTGNLHIGHAITVALEDAICRYQRLLGKKVVEE

SEQ ID NO: 119893 - protein, 92 aa, Heterodera glycines
  Coding regions on vcDNA: vcDNA=SeqID_46316; Strand=-; Position=1-279
  Homolog annotation: Hit_ID=CAE61909.1; Match level="QueryCoverage =98%, HitCoverage=9%, E-value=6e-18, Identity=46%"; Hit description =Hypothetical protein CBG05905 [Caenorhabditis briggsae]
  Essential gene: C elegans homolog=F49E8.3; Phenotype=Emb
MCSWTQQMGFPLVSVEQRVLEGDRRELRLSQTRFLADGGRDEANNSPIWQVPFSVATAADPTQAKAKFLLVKVEDKFILDGVKADEWVKVNE

SEQ ID NO: 119894 - protein, 49 aa, Heterodera glycines
  Coding regions on vcDNA: vcDNA=SeqID_46317; Strand=-; Position=1 -63,112-195
  Homolog annotation: Hit_ID=NP_491641.1; Match level="QueryCoverage =97%, HitCoverage=38%, E-value=4e-14, Identity=81%"; Hit description =atpase H+ transporting lysosomal (14.5 kD) (1G178) [Caenorhabditis elegans] gb|AAK21386.1| Vacuolar h atp
  Essential gene: C elegans homolog=F46F11.5; Phenotype=Emb
MASHTAGIQQLLAAEKRAAEKINDARKRKAQRLKQAKQEAQAEIDQYRH

SEQ ID NO: 119895 - protein, 181 aa, Heterodera glycines
  Coding regions on vcDNA: vcDNA=SeqID_46318; Strand=+; Position=1 -4,154-695
  Homolog annotation: Hit_ID=BAA88337.1; Match level="QueryCoverage =78%, HitCoverage=14%, E-value=1e-16, Identity=39%"; Hit description =ORF2 [Platemys spixii]
  Essential gene: C elegans homolog=ZK250.3; Phenotype=Clr,Lvl,Sck
MEHISKIIRNAYIRIFQILRVLKSREIKTLTAAYKTFVRPQLEYATEVWNPNLKKDIDKIERVQKFFTRKALRKCGFVYKKYGERLKITGLHKLEERRKINDLTTAFKIIKGFTSLDAGKSFFFSERPRRPLLLRVKRHTAKTQNNFFNRIVKSWNNLPVVAVQINKAKEFRGLLKAMSSE

SEQ ID NO: 119896 - protein, 203 aa, Heterodera glycines
  Coding regions on vcDNA: vcDNA=SeqID_46319; Strand=+; Position=1 -279,399-729
  Homolog annotation: Hit_ID=NP_494218.2; Match level="QueryCoverage =99%, HitCoverage=34%, E-value=1e-72, Identity=69%"; Hit description =chaperonin (2C531) [Caenorhabditis elegans] gb|AAF35963.3| Hypothetical protein F54A3.3 [Caenorhabditis e
  Essential gene: C elegans homolog=F54A3.3; Phenotype=Emb,Lva
MVADVIRTSLGPRAMLKMLMDPMGGIVLTNDGNAILREITVKHPAAKTMIEIARTQDEETGDGTTSVIILAGEFLAQAEQFLEQSIHPTVIIHGYRMALEDIIEWTEEKFRFYFGVDESNTFSSSPFSKPVDLASESELTTVVKSCLGTKMLAKYMDLAVNIALSAVRTIDVTNNDFREIDIKRYCRIEKIPGAAIEDSNVVK

SEQ ID NO: 119897 - protein, 47 aa, Heterodera glycines
  Coding regions on vcDNA: vcDNA=SeqID_46320; Strand=-; Position=1-141
  Homolog annotation: Hit_ID=NP_057126.2; Match level="QueryCoverage =100%, HitCoverage=17%, E-value=5e-10, Identity=61%"; Hit description= exosome component 3 isoform 1 [Homo sapiens] gb|AAH02437.1| Exosome component 3, isoform 1 [Homo sapiens
  Essential gene: C elegans homolog=F59C6.4; Phenotype=Lva
VDIGSIDLALLNFTSFEGATKRNRPNVKVGDLIYGLVILTSKQLEPE

SEQ ID NO: 119898 - protein, 224 aa, Heterodera glycines
  Coding regions on vcDNA: vcDNA=SeqID_46321; Strand=-; Position=1 -79,133-335,392-505,569-847
  Homolog annotation: Hit_ID=AAN15196.1; Match level="QueryCoverage =100%, HitCoverage=59%, E-value=1e-123, Identity=100%"; Hit description=actin [Globodera rostochiensis] gb|AAN78299.1| actin 1 [Heterodera glycines] gb|AAG47837.2| actin 1 [He
  Essential gene: C elegans homolog=T04C12.5; Phenotype=Ste
MYVAIQAVLSLYASGRTTGLVLDSGDGVTHTVPIYEGYALPHAILRLDLAGRDLTDYLMKILTERGYSFVTTAEREIVRDIKEKLCYVALDFEQEMATAASSSSLEKSYELPDGQVITVGNERFRCPEALFQPSFIGMESAGIHESTYNSIMKCDIDIRKDLYANNVLSGGTTMYPGIADRMQKEMTALAPSTMKIKIIAPPERKYSVWIGGSILASLSTFQQM

SEQ ID NO: 119899 - protein, 129 aa, Heterodera glycines
  Coding regions on vcDNA: vcDNA=SeqID_46322; Strand=-; Position=1 -122,406-672
  Homolog annotation: Hit_ID=CAE56114.1; Match level="QueryCoverage =69%, HitCoverage=15%, E-value=4e-29, Identity=64%"; Hit description =Hypothetical protein CBG23720 [Caenorhabditis briggsae]
  Essential gene: C elegans homolog=F54H12.6; Phenotype=Lva
SFRHKKTNTYLKVSSLFLPRKNMRTLLVGTSTFKASMMLNEDFDLFGDEESDDEEKKRITKERLKAYAEKKAKKPGPVAKSNVIYDVKPWDDTIDIKEIEAKVRSVQCDGLVWGASKILPVAFGVQKLQ

SEQ ID NO: 119900 - protein, 442 aa, Heterodera glycines
  Coding regions on vcDNA: vcDNA=SeqID_46323; Strand=+; Position=1 -80,143-561,1048-1142,1580-1699,1749-2020,2066-2312,2372-2466
  Homolog annotation: Hit_ID=NP_490830.2; Match level="QueryCoverage =95%, HitCoverage=82%, E-value=6e-34, Identity=32%"; Hit description =protein nucleolar (1B671) [Caenorhabditis elegans] gb|AAK29904.3| Hypothetical protein Y48G8AL.5 [Caenorh
  Essential gene: C elegans homolog=Y48G8AL.5; Phenotype=Ste
MEVSPKSDSNAFDPKHRKKTCTISKQRQPEKGIRQNYELNKFERRNDSLFGFYKKQRIVPDSEWDRFCEILATELPSSFRIQRSLPERDCLANFLEQHFFKQIASIAATSESDGVGIHPPKSVPFVPYAYQTKMPRSMLRRHPILKEFHEFLVNETELVRINGHYNEGFVLANDSDYKRCYLLVRQTLKRMPTANVAVLEDEAVIAQLLRKSNGTVELVDISDRLKELKRMPGISEWKVFDKEMNEVRAVDDVRAESKRLFKPSMFPPTLEEASQMHLERCFRILPHLHDSGGFFVALLRKKGPKSENDLQRQIEGTNAQMKSGPPSFRKSTAKRARLSNKEDPFIFLEENGQRDDRFVSELDTHFGISPSELPHSNLLLRSHNTERKKEIYFVNDAIRDFLRFNAKRFRIVNAGVGVLKRIVSDKVAQCPYRLKQDVMGGD

SEQ ID NO: 119901 - protein, 242 aa, Heterodera glycines
  misc_feature (64)..(64): Xaa can be any naturally occurring amino acid
  misc_feature (175)..(175): Xaa can be any naturally occurring amino acid
  misc_feature (180)..(180): Xaa can be any naturally occurring amino acid
  misc_feature (232)..(232): Xaa can be any naturally occurring amino acid
  Coding regions on vcDNA: vcDNA=SeqID_46324; Strand=+; Position=1 -703,944-983
  Homolog annotation: Hit_ID=NP_510671.1; Match level="QueryCoverage =97%, HitCoverage=24%, E-value=2e-41, Identity=36%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
PVKKVSSGVPQGSVLRPLLFLIYINDLPDALPSGVRIKLYADDVKLYISDPEIMHKALHNLSEXANKWQIRILIKKTFVLHLGNKNPKEIYKIDGNIINVVDTIRDLGINIDNNLQSSNHVTQIIKNAYLRMRSLFRIIKSKSSRIWIILYKTYVRPLLEYAPEVWNPSIQKNIXKIEKXQKYFTKRVLFKCSLPPIPYQQRLEYLQLPTIESRRKLSDLIMAHKIIYGNFXFIKTKSDLVN

SEQ ID NO: 119902 - protein, 123 aa, Heterodera glycines
  Coding regions on vcDNA: vcDNA=SeqID_46325; Strand=-; Position=1 -196,345-517
  Homolog annotation: Hit_ID=NP_500188.1; Match level="QueryCoverage =100%, HitCoverage=76%, E-value=2e-60, Identity=95%"; Hit description= vacuolar proton ATPase VHA-3, Vacuolar proton ATPase (16.4 kD) (vha -3) [Caenorhabditis elegans] ref|NP_4
  Essential gene: C elegans homolog=Y38F2AL.4; Phenotype=Emb,Gro,Unc
MTYDLETAERAAYAPFFGYIGAASAQIFTVFGAAYGTAKSAVGICSMGVMRPELIMKSVIPVIMAGIIGIYGLVVAMVLKGKVTSASNGYTLNNGFAHLAAGLTCGLCGLGAGYAIGIVGDAG

SEQ ID NO: 119903 - protein, 203 aa, Heterodera glycines
  Coding regions on vcDNA: vcDNA=SeqID_46326; Strand=+; Position=1 -131,180-391,437-705
  Homolog annotation: Hit_ID=NP_612395.1; Match level="QueryCoverage =91%, HitCoverage=35%, E-value=2e-13, Identity=29%"; Hit description =hypothetical protein BC008207 [Homo sapiens] gb|AAH08207.1| Hypothetical protein BC008207 [Homo sapiens]
  Essential gene: C elegans homolog=F25H8.2; Phenotype=Unclassified
MINIVDYRDSCASTDEEDDLFFHRVSSNQAQENNDDDSESEFIKILEMCRKHREFSAAKMGEDSQNKPRSLNKRDKVFDSEYYSLPAIDQLNIQVKEETEFKRFGVVDSHINFLAKIKPDKDTPHLGYETILFNHDKKPIGEIFEIFGTVTDTLYALRFNDESDAVAKLPVGEVIYYANSDNAMTKPVFPKELAKYLLVIASC

SEQ ID NO: 119904 - protein, 609 aa, Heterodera glycines
  Coding regions on vcDNA: vcDNA=SeqID_46327; Strand=+; Position=1 -228,319-447,630-755,808-1026,1381-1560,1610-1903,1956-2372,2550-2786
  Homolog annotation: Hit_ID=NP_502283.1; Match level="QueryCoverage =96%, HitCoverage=57%, E-value=1e-126, Identity=40%"; Hit description= SPT transcription factor family member (133.4 kD) (spt-5) [Caenorhabditis elegans] emb|CAA92985.1| Hypot
  Essential gene: C elegans homolog=K08E4.1; Phenotype=Emb
MTEEEMERYFQERHAAQVATHQGDMDEDAYDDITQNGLLPSTKDPNLWIVKCRLGEEKTTCLRLMRKYLTFVNTDEPLQIKSVIVKEGLKGMIYIEAFKMAHVAKAIEGISALNQFKITSKTLYKDDLAQVDWVDISQNRVNLKLIPRIDYTRLRGALRSQDDRIMKKKRRPLPAPFDLDRIKLAYSELVLCSMYSLGFRSIGGEVTNDGDFYIFEGGHYRRGFLYKSFPMNAINWNYFSFKEPLTLNASELRKYFKPGDHVRVIAGRYEGDTGLIVRVEDNVVIMLSDLTMGEMKILPKDVQLCAEVATGVERMGQYQYQDLVMLDKETVGVIVRLERENVEVLSMHGKILRVNPQTIECKKNSRFVKALDSQKNTIQAGDTVKVVEGFLARKKETEEERQGEIKHLFRNWAFVFSRKYPQNGGMFVCKARNLALIGGSKASESQINTTILDNSQLMSPRPNPLESPRTIHGGMTPHSGSSVVGAQSVRGDHGFKGLFLDGHLFLLIQIFLAPSVVGSIATSATGVGRQHTVNFDINKVMEVGGAVPRELMDTAGAMTPGTATIGGRTPMYGGAQTPMYGGAATPMHDSCNQYLYYSNSEFAELFQRF

SEQ ID NO: 119905 - protein, 148 aa, Heterodera glycines
  Coding regions on vcDNA: vcDNA=SeqID_46328; Strand=-; Position=1 -122,210-534
  Homolog annotation: Hit_ID=NP_497909.1; Match level="QueryCoverage =91%, HitCoverage=19%, E-value=2e-11, Identity=27%"; Hit description =prion-like Q/N-rich domain protein, Prion-like Q/N-rich domain protein PQN-45 (84.0 kD) (pqn-45) [Caenorh
  Essential gene: C elegans homolog=F56F3.1; Phenotype=Ste
MDVPRQQLTTYRCYNKEELLMIRESNYCRTRPVFLLKDFDNDDGLFSPDKWLQHKWKCEGVENRVRRKAASQTSAGSGGGGGSVSGNSTATVITPQQETDKQQANIKAARLRRGASTTSNGMDFKPDFVGAFGMGERSELSEWAGDDN

SEQ ID NO: 119906 - protein, 225 aa, Heterodera glycines
  misc_feature (222)..(222): Xaa can be any naturally occurring amino acid
  Coding regions on vcDNA: vcDNA=SeqID_46329; Strand=+; Position=1 -157,200-387,444-569,669-782
  Homolog annotation: Hit_ID=CAE71197.1; Match level="QueryCoverage =92%, HitCoverage=69%, E-value=1e-64, Identity=61%"; Hit description =Hypothetical protein CBG18056 [Caenorhabditis briggsae]
  Essential gene: C elegans homolog=F56F3.5; Phenotype=Emb,Ste
MAVGKNKMGKKGAKKKAVDPFTRKEWYDIKAPAMFTHRNVGKTLVNRTQGTRISSDFLKGRVYEVSLGISSDFLKGRVYEVSLGDLNSTDADFRKFRLICEEVQGKICLTNFHGMTFTRDKLCSIVKKWHTLIEANVAVKTTDGFTLIEANVAVKTTDGFLLRLFCIGFTKRNANQIKKTSYAKTSQVRMIRAKMVEIMQKEVWSSNLFPCYVVSMSSLLCXVSS

SEQ ID NO: 119907 - protein, 72 aa, Heterodera glycines
  Coding regions on vcDNA: vcDNA=SeqID_46330; Strand=+; Position=1-219
  Homolog annotation: Hit_ID=P53022; Match level="QueryCoverage=100%, HitCoverage=57%, E-value=3e-35, Identity=94%"; Hit description=Major sperm protein 2 gb|AAA29147.1| major sperm protein
  Essential gene: C elegans homolog=ZK546.6; Phenotype=Emb
MNPPNGVLGPKESVNVAVSCDAFDPGSEDTKGDRVTVEWTNTPDPAATAFKLEWFQGDGMVRRKNLPIEYNV

SEQ ID NO: 119908 - protein, 780 aa, Heterodera glycines
  Coding regions on vcDNA: vcDNA=SeqID_46331; Strand=-; Position=1 -164,209-471,513-686,968-1073,1167-1338,1389-1586,1739-2299,2350 -2550,2599-2700,2749-3147
  Homolog annotation: Hit_ID=NP_491102.2; Match level="QueryCoverage =32%, HitCoverage=41%, E-value=1e-33, Identity=38%"; Hit description =extragenic suppressor of bimD6 mutation (1D654) [Caenorhabditis elegans] gb|AAC17564.3| Hypothetical prot
  Essential gene: C elegans homolog=M01B12.5a; Phenotype=Unclassified
MLLHNQRLVIIDVSQSVEHDHPHSLEFLRMDIGNVTRFFKSKDAAVLGMKRLFEVTFTLQAIVDPLIDDLAFEQILQNERMDGPLPDDMLFMKAYIPHKLDNITHYERDYEMEKRGIELNNPFQKTIGRTMDVKKSEEEDFCGNDEHLDGLDSDTNNEEPFESSEEQSDVSDEGENDDKQLKKNKKTVYQKYVRVRGESSIIIMDGGVTRSLYIGRDKTLEVLKRKEAVERELRAKREVKIREQHERMERAAQLKEAELRDRARMKQQRELERQKAVLDRRCAQMEQLNARKMELLKRTHHGSSRIVTLNQAKKPVYAFGSSTPRKLAFLENIQQQQRDSGGSRNSPMGMRGSTPSLAQGPSNTAPTTSRFQNPLSLDGRAGGSSIMTRSVVGALGNGIGTTPNRKNNFNKPPAQPTKQTPNSIKKQRKMANQGMIQTNEGMLTAGQNITKEVQQEKQNSPTLTATNKTNEGMLTTEQNIINEVQSNEGMLTADQNIINEVQSNEGMLTADQNIINEVQQEKQNSPTLTATNTSFYTAHESSSIGEVSMYEHVPLTENEPIITPPKSTTPPVLIVIPNQEEKEERRRHIKELLARTRQEANGPPNAQNNGMTNVNGESSVVPSTTPSLPISASNPLLPQRDASALVQDINAKYLHKFQKQQQKDGEMTANSQANPRNSTNLSKELDESGSADKEGTFCLPGQAITAFHSISFNTNLLLKVISANDQFSHMASLTIFSKNEEERDERILLKQHPSPPDDPQINGNEINGKEFHPPEPTNAQ

SEQ ID NO: 119909 - protein, 215 aa, Heterodera glycines
  Coding regions on vcDNA: vcDNA=SeqID_46332; Strand=-; Position=1 -126,186-354,615-726,814-965
  Homolog annotation: Hit_ID=CAE72557.1; Match level="QueryCoverage =71%, HitCoverage=50%, E-value=1e-41, Identity=57%"; Hit description =Hypothetical protein CBG19741 [Caenorhabditis briggsae]
  Essential gene: C elegans homolog=K05C4.1; Phenotype=Emb
SSVMFYHDLHDNENSHDKELKQLVQMDDLAIPKFVMPPLGIKPKKFVRKHFGPNSRLPMAQFPKKFVRKHFGPNSRLPMAQFLKGTTTLSFVYKPKTPQDKGGVIVAVDSRATGGTYISSKTVEKIIPINDQLVATMAGGAADCQYWTRVVSKYCNLFELREGTQILFELREGTQISVAAASKYFANVMYDYRGQELVVSFVAVHFDVVQWHFKH

SEQ ID NO: 119910 - protein, 161 aa, Heterodera glycines
  Coding regions on vcDNA: vcDNA=SeqID_46333; Strand=+; Position=1 -78,439-597,775-940,1720-1802
  Homolog annotation: Hit_ID=NP_493106.1; Match level="QueryCoverage =68%, HitCoverage=28%, E-value=1e-21, Identity=55%"; Hit description =gdp-mannose family member (1M874) [Caenorhabditis elegans] emb|CAB04494.1| Hypothetical protein F56H6.5 [
  Essential gene: C elegans homolog=F56H6.5; Phenotype =Egl,Lva,Lvl,Prz,Unc
MDKDDAKQFEEYRARKVAMITGISGQVSFDLPEYTAEVDAVGTLRLLDAIHACGLTRLVRFYQASTSELYGKVQEVPQRRLPSCIPIGLWSITARPTKCTPAMAFCSTMRVREEVKQKCKDKSNFNCLGETFVTRIGKGNGGQRHRTDEEESDGIDAGPMD

SEQ ID NO: 119911 - protein, 506 aa, Heterodera glycines
  Coding regions on vcDNA: vcDNA=SeqID_46334; Strand=+; Position=1 -129,181-393,436-594,646-818,868-938,989-1208,1261-1413,1474-1582
  Homolog annotation: Hit_ID=AAL40720.1; Match level="QueryCoverage =98%, HitCoverage=97%, E-value=0.0, Identity=64%"; Hit description =calreticulin [Meloidogyne incognita]
  Essential gene: C elegans homolog=Y38A10A.5; Phenotype=Unc
LGMLSSFPLLLSLVGLIAVHAEVFFKEEFSDDSWTDRWVTSKSKDDYGKFELSAGKFFGDKVRSKSKDDYGKFELSAGKFFGDKVRDQGLKTSQDARFYAISAKFPKKFSNKGKPLVVQFTVKHEQNIDCGGGYMKLMASDISQENFHGETPLMASDISQENFHGETPYHLMFGPDICGPGTKKVHVILGYKGKNQLIKKDIRCKDDELSHDDELSHLYTLILSPDNTYEVQIDGEKVESGELEADWDLLPAKKIKDPDAKKPEDWDDKEYIDDPDDKKPEYIDDPDDKKPDDWEKPEHIPDPDAKKPDDWDDEMAKKPDDWDDEMDGDWEPPMIDNPEYKGTWKPKQIKNPNYKGKWIHPEIDNPEYQPDDDLYLREDWGAIGIDIWQVKSGTIFDNILVADSVEDAIWQVKSGTIFDNILVADSVEDAKKHAADTFDQLKEAEKKQKEAHDEEERKKFEEEEKKRKEEEEEKKRKEEEEKKPKKDEEEVEEDEEEKKEEEHDEL

SEQ ID NO: 119912 - protein, 269 aa, Heterodera glycines
  misc_feature (256)..(256): Xaa can be any naturally occurring amino acid
  Coding regions on vcDNA: vcDNA=SeqID_46335; Strand=-; Position=1 -52,103-157,215-323,423-713,763-915
  Homolog annotation: Hit_ID=NP_506706.1; Match level="QueryCoverage =99%, HitCoverage=26%, E-value=6e-76, Identity=59%"; Hit description =DNA replication licensing factor Mini Chromosome Maintenance (90.7 kD) (mcm-3) [Caenorhabditis elegans] e
  Essential gene: C elegans homolog=C25D7.6; Phenotype=Emb
TEGKCVYKDHQVFSQELPEAAPPGHLPRNIDVELPEAAPPGHLPRNIDVIADDDLADCCKPGDRIRVIALDDDLADCCKPGDRIRVIALFRVLPNKQAGMSTGNFRSVLIANNIQLLSKEMEPSFEPEDIKEMRKMSRHKNIFELLARSLAPSIYGHEEVKKAILCLLLGGCEKILENGTRLRGDINVLLIGDPSVAKSQMLRYVIHTAPRVIATTGRGYVIHTAPRVIATTGRGSSGVGLTAAVVHDSDTGERRXKAGAMVLADRGIV

SEQ ID NO: 119913 - protein, 683 aa, Heterodera glycines
  Coding regions on vcDNA: vcDNA=SeqID_46336; Strand=+; Position=1 -138,411-1684,1731-2085,2211-2492
  Homolog annotation: Hit_ID=XP_216845.2; Match level="QueryCoverage =73%, HitCoverage=64%, E-value=7e-67, Identity=34%"; Hit description =similar to groucho-related protein [Rattus norvegicus]
  Essential gene: C elegans homolog=W02D3.9; Phenotype=Emb
MKPSVKDLLDRVLDEYNHLQQQLHNVRVELEKSQQERDTLHRYSLMRHPFGTFPAFRLKCALPFEHVIPLLPQEHQAPAVQAIERAKTINQQVVFDFIFSIWALRLGCYFDCQRPSTAAAAICFDSARAWFHDESDGIWESDGGDDVSEMRRQKHYIRIIMNCRGIKPEDAIQAAAMFNNLLKNPMLGATAAGLPPPVGLNGPGTSVASNVGPMVAPNSTSLPPNGDDGPTPTTQPGRSSSALNSSSGAGIGHNRPRSGSRTSTPNSMAAKRTKLEPEEGDGELEIDVSWCNVRTEELLEFQVQNDDASSSAAPSHHTNGRTSQPPRQNHSVKDAERDSASASSSRDSTTPRSGKQQALTVLPCHSFQLSPCQLSSTPGSSAAGFASIMPTADANMAHMFLNTAFGGHFPGNLNRQMFLGLGAGNAPLGAAAGMPTANGKPAYAFKVSQGEPNLMPVQFPSDASQGPEVPKGLKRIGDLPHGDVVCAVTMARNGRHVFTGGKGAVKMWDIGERIGLASSAGGSISPSSSTIADGTNGRVGSAEPWTPVNTFPCLKDSYVRSCKLFPDASTLIVGGETRTICVWDLNSEKVKAMLDCDAEACYALAISADCRLCFACCSSGSIVIWDLQSEQKVAQLDGHTDGASCVDLNGDGLRLWTGGLDNTVRCWDIRERSELSKNVLESQ

SEQ ID NO: 119914 - protein, 345 aa, Heterodera glycines
  Coding regions on vcDNA: vcDNA=SeqID_46337; Strand=+; Position=1 -705,1250-1582
  Homolog annotation: Hit_ID=NP_502969.1; Match level="QueryCoverage =66%, HitCoverage=65%, E-value=6e-30, Identity=35%"; Hit description =reverse transcriptase SjR1 family member (4R582) [Caenorhabditis elegans]
  Essential gene: C elegans homolog=ZK250.3; Phenotype=Clr,Lvl,Sck
MYADDVKLYYAHENDDHSNQLDKAIEALEKWSKINGLEISTEKCFVLYLGKKNMKKEYFINSKKISESDNVRDLGIIIDSKLNFSEHISKIIRNAYLRSFQILRVLKSREIKTLTAAYKTFVRPQLEYATEVWNPNLKKDIDKIERVQKFFTRKALRKCGFVYKKYGERLKIAGLHKLEERRKINDLTTAFKIIKGFTSLEAEQNFFFSERPRRPLLLRVKRHTAKTQNNFFHRIQIHLALKQKHNARLKDVKTNEILAQIQSNWRRFWKTRHATYKYMPNDLYEHWAAVQGQWQDLTFLARQLVQQLVTDKYNVAKYFQHIKQLLPERNLFYQLAEEHAKNITR

SEQ ID NO: 119915 - protein, 254 aa, Heterodera glycines
  misc_feature (136)..(136): Xaa can be any naturally occurring amino acid
  Coding regions on vcDNA: vcDNA=SeqID_46338; Strand=+; Position=1 -79,414-593,1164-1329,2107-2334,2799-2914
  Homolog annotation: Hit_ID=NP_490781.1; Match level="QueryCoverage =95%, HitCoverage=15%, E-value=1e-54, Identity=43%"; Hit description =ZFH-2 (1B307) [Caenorhabditis elegans] gb|AAB97603.3| Hypothetical protein ZC123.3 [Caenorhabditis elegan
  Essential gene: C elegans homolog=ZC123.3; Phenotype=Gro,Lvl,Pvl,Unc
NNNNNSHNNNNAANKRFRTHLTPMQVQIMKSLFNDFKTPSMAECDALGQKIGLHKRVVQVWFQNARAKERKCAGGSCTGSGAGWCHCHLCGVEFDARLSLQEHIFGIEHVERVRERASKCAEFAPASLRHRRHSRXQTMPAPIILQALSHLCYDPTVFGTPVPALKIPKCVMQQILADMAQRREHTLFTQDGLELGELAAKVDADDFAAAGTTDLEVGWGCTQCGNVFQQSEQLQNHQKLICVGGRRVPAGPNP

SEQ ID NO: 119916 - protein, 115 aa, Heterodera glycines
  Coding regions on vcDNA: vcDNA=SeqID_46339; Strand=-; Position=1 -39,824-1135
  Homolog annotation: Hit_ID=XP_321042.1; Match level="QueryCoverage =99%, HitCoverage=3%, E-value=3e-34, Identity=60%"; Hit description =ENSANGP00000022374 [Anopheles gambiae]
  Essential gene: C elegans homolog=T21E12.4; Phenotype=Emb
FDFSNLNKVFKRAAEQIVRLQRMAAELSAFYRTIDRTWVTLERIQFVGACNPPTDPGRNPLSARFLRHVPVIYVDYPGRTSLNQIYGTFARAMLSTMQIRGMAKPLTEEMTDFYL

SEQ ID NO: 119917 - protein, 219 aa, Heterodera glycines
  Coding regions on vcDNA: vcDNA=SeqID_46340; Strand=-; Position=1 -96,165-362,404-456,531-638,687-771,820-938
  Homolog annotation: Hit_ID=NP_871873.1; Match level="QueryCoverage =100%, HitCoverage=30%, E-value=2e-55, Identity=51%"; Hit description= RNA polymerase II termination factor (1H18) [Caenorhabditis elegans] gb|AAO38599.1| Hypothetical protein
  Essential gene: C elegans homolog=F54E12.2; Phenotype=Emb
MAVDANFKAYSCILSLLLRLRQACVHLSLTRNAIDIDAFKQDEGETDSDAENLVAKALEMSMAQMSLEEEALERNEEREKDEGQQIERLFEKEHQSTKVNALMNRLDGVVQNGDKCVIVSQWTSMLALIEFHLRQKAISFTSITGEVRTEERQSRVDAFNRTNTGPKVMLLSLTAGGVGLNLIGGNHLFMIDLHWNPALELQASDRIHRLGQKKNVFIH

SEQ ID NO: 119918 - protein, 165 aa, Heterodera glycines
  Coding regions on vcDNA: vcDNA=SeqID_46341; Strand=+; Position=1 -138,191-376,416-517,807-878
  Homolog annotation: Hit_ID=NP_503425.2; Match level="QueryCoverage =100%, HitCoverage=100%, E-value=1e-58, Identity=68%"; Hit description=UNCoordinated locomotion UNC-60 (unc-60) [Caenorhabditis elegans] gb|AAL02461.1| Uncoordinated protein
  Essential gene: C elegans homolog=C38C3.5a; Phenotype=Let
MSSGVMVNSECQNAFQQLSEGKRYRYIIYKIVDKEVIVEVAVSSEDIGSTGTESYDDNSKAAYETFVKDLKERTEGFVDCRYAVFDFKFQTQRPGAGTSKMDKIVFIQLCPDGASIKKKMLYASSASAIKASLGTAKILQFQVSDESEIAHKELLSKLNDKYRDN

SEQ ID NO: 119919 - protein, 299 aa, Heterodera glycines
  Coding regions on vcDNA: vcDNA=SeqID_46342; Strand=+; Position=1 -110,151-286,358-487,588-730,831-1013,1061-1257
  Essential gene: C elegans homolog=Y34D9A.4; Phenotype=Rup,Unc
IMSEDELDKLKGEVDALQTFVNKRLEKALQLQAESKRIFETIRPSINSFNEDYLHFLRVDLDSQSTVLSSDFLKKMEKLNERLKDHHDLWAKQVVFRYDELLVKLDELSAKCFQPSTEFPAKPNLKNLSEKELLKLEEEVRIRQQMYERAKPVFDKLNEWMANWKQKLDIERRQQKIVEQKLPKLLNELCELCNDYVKNFQLNDIIIDGLRADKYAESKMQNYHQDKGVQKAQKQFSNPPLKRSTSNRPATSSTSRRNVFVPRNSCGRAAPRALNPIGEKQQTPTTSRKEGETKHATRK

SEQ ID NO: 119920 - protein, 39 aa, Heterodera glycines
  Coding regions on vcDNA: vcDNA=SeqID_46343; Strand=-; Position=1-118
  Homolog annotation: Hit_ID=CAE73105.1; Match level="QueryCoverage =100%, HitCoverage=3%, E-value=3e-10, Identity=74%"; Hit description =Hypothetical protein CBG20485 [Caenorhabditis briggsae]
  Essential gene: C elegans homolog=F28B3.7; Phenotype =Emb,Lva,Lvl,Pvl,Unc
MEGHGFLYSLEIENFKSFKGKHYIGPFKRFSAIIGPNGS

SEQ ID NO: 119921 - protein, 148 aa, Heterodera glycines
  Coding regions on vcDNA: vcDNA=SeqID_46344; Strand=-; Position=1 -256,352-540
  Homolog annotation: Hit_ID=NP_491099.1; Match level="QueryCoverage =100%, HitCoverage=79%, E-value=5e-26, Identity=43%"; Hit description= actin related protein 2 3 complex 16kDa, Actin Related protein 2/3 compleX component ARX-7 (arx-7) [Caen
  Essential gene: C elegans homolog=M01B12.3; Phenotype=Emb
KLDVDAFDPDKFIDGDEAETPVGQGPDEGQVRQFLQANQNVEALKAALSNAPLRTKNQVRKGHHETAEWTDWQMKSQEMAGNAEFALKDKTTSLVVRVLTSFKSADIEAALKSLSAEEMDLLMKYIYKGMELLPDGQNCASLLAWHSQ

SEQ ID NO: 119922 - protein, 189 aa, Heterodera glycines
  Coding regions on vcDNA: vcDNA=SeqID_46345; Strand=+; Position=1 -243,301-407,469-592,637-729
  Homolog annotation: Hit_ID=NP_491970.2; Match level="QueryCoverage =71%, HitCoverage=5%, E-value=7e-36, Identity=47%"; Hit description =suppressor with Morphological effect on Genitalia SMG-1, Male ABnormal MAB-1, nonsense-mediated mRNA decay
  Essential gene: C elegans homolog=C48B6.6a; Phenotype=Pvl
LQFNAENDESKQQKLGSIGKTIPTKQQRQSAHLKKGVGKESGETADNASIGGKKKEGDKEPEPERPMEQFYNKLKAVFAANRVPKECLNDRKRWPNEVLKIVLKELGDETPKDILAKELWIYAATSDDWWMNTQNFARTAAVSSMLGALIGLGDRHLDNVLVDLHSGQIVHVDYNICFGKGRTLRVPET

SEQ ID NO: 119923 - protein, 266 aa, Heterodera glycines
  Coding regions on vcDNA: vcDNA=SeqID_46346; Strand=-; Position=1 -148,191-358,410-470,515-611,657-749,848-896
  Homolog annotation: Hit_ID=CAE59414.1; Match level="QueryCoverage =98%, HitCoverage=25%, E-value=1e-48, Identity=44%"; Hit description =Hypothetical protein CBG02783 [Caenorhabditis briggsae]
  Essential gene: C elegans homolog=F29C12.4; Phenotype=Lva
GIESCGYHDLVEELAFFNEVEDGSVLRKEEIPQEYREEAKILRQELLENLANCDDVIAECYLNLANCDDVIAECYLNEVTPSVKEIKEAIRRATIKRSFVPVLVGSALKNKGVQQMIDAIVHYLPNPSEVDNFVNLYDIDAIVHYLPNPSEVDNFVNLYDKNDNAERKNDNAERVLMDPLRTANSEKQKPFIGLAFKLEAGNFGQLTYFRIYQGRLVKGAGNFGQLTYFRIYQGRLVKGDTIYATRDGRKVRIKRLVRMHANTMED

SEQ ID NO: 119924 - protein, 63 aa, Heterodera glycines
  Coding regions on vcDNA: vcDNA=SeqID_46347; Strand=-; Position=1 -78,217-329
  Homolog annotation: Hit_ID=NP_498457.1; Match level="QueryCoverage =98%, HitCoverage=18%, E-value=5e-16, Identity=62%"; Hit description =malate dehydrogenase (35.1 kD) (mdh-1) [Caenorhabditis elegans] gb|AAB53985.1| Malate dehydrogenase prote
  Essential gene: C elegans homolog=F20H11.3; Phenotype=Emb,Gro
CAYVKSDVVEALDYFAGPLELGPNGVEKILPLGDLTAYEKELISKAVPELKKEIAKGVNFIKQ

SEQ ID NO: 119925 - protein, 104 aa, Heterodera glycines
  Coding regions on vcDNA: vcDNA=SeqID_46348; Strand=+; Position=1 -232,4155-4223,5016-5033
  Homolog annotation: Hit_ID=CAE68356.1; Match level="QueryCoverage =93%, HitCoverage=26%, E-value=4e-28, Identity=58%"; Hit description =Hypothetical protein CBG14093 [Caenorhabditis briggsae]
  Essential gene: C elegans homolog=F49H12.1; Phenotype=Gro,Pvl,Stp,Unc
RVHKCDQCQKAFRFKSNLFEHKSLHLGSSSRNPFVCPFCSKTCRLKGNLKKHLQVHVTSAEDLECLWKPFSRSVRPQAVVAESPSMPQGTDGGAPAAPPPFGNK

SEQ ID NO: 119926 - protein, 48 aa, Heterodera glycines
  Coding regions on vcDNA: vcDNA=SeqID_46349; Strand=+; Position=1-146
  Homolog annotation: Hit_ID=AAM94277.1; Match level="QueryCoverage =100%, HitCoverage=40%, E-value=1e-15, Identity=81%"; Hit description= small nuclear ribonucleoprotein D2-like protein [Chlamys farreri]
  Essential gene: C elegans homolog=C52E4.3; Phenotype=Emb,Lva,Unc
MVLEDVKEMWTELPKKGKGKKKSKPVARDRFIPKLFLRGDSVILVLKN

SEQ ID NO: 119927 - protein, 63 aa, Heterodera glycines
  Coding regions on vcDNA: vcDNA=SeqID_46350; Strand=+; Position=1 -63,112-195,266-310
  Homolog annotation: Hit_ID=NP_491641.1; Match level="QueryCoverage =76%, HitCoverage=38%, E-value=4e-14, Identity=81%"; Hit description =atpase H+ transporting lysosomal (14.5 kD) (1G178) [Caenorhabditis elegans] gb|AAK21386.1| Vacuolar h atp
  Essential gene: C elegans homolog=F46F11.5; Phenotype=Emb
MASHTAGIQQLLAAEKRAAEKINDARKRKAQRLKQAKQEAQAEIDQYRHLMSPIAFYFMNPIK

SEQ ID NO: 119928 - protein, 121 aa, Heterodera glycines
  Coding regions on vcDNA: vcDNA=SeqID_46351; Strand=+; Position=1 -246,311-428
  Homolog annotation: Hit_ID=AAR85527.1; Match level="QueryCoverage =87%, HitCoverage=42%, E-value=1e-22, Identity=47%"; Hit description =14-3-3b protein [Meloidogyne incognita]
  Essential gene: C elegans homolog=M117.2; Phenotype=Emb
MDLPLIKLCMLKVIELDAKLNENERKLLGVAYRKSVTGQRFAWRVIASVLARGKGTKRQLEMVKQLLNKLEREVEERCREILDLLDRVLIKEAADDEAKVFYLKLKADHFRYLAETRAVKN

SEQ ID NO: 119929 - protein, 491 aa, Heterodera glycines
  Coding regions on vcDNA: vcDNA=SeqID_46352; Strand=-; Position=1 -155,292-481,524-713,763-875,1206-1348,1394-1518,1627-1760,1801 -1917,2425-2733
  Homolog annotation: Hit_ID=CAE72581.1; Match level="QueryCoverage =69%, HitCoverage=38%, E-value=1e-71, Identity=40%"; Hit description =Hypothetical protein CBG19769 [Caenorhabditis briggsae]
  Essential gene: C elegans homolog=W04A4.5; Phenotype=Unclassified
MCEDASMKMLEKECLSLEYYPHLANLCKNSEQNVRVVALRILTKFALVYPEEKVMASKGFKIRLHDDAFSIVCDAMNDLEVKVRAQAANLLGFFENVSESFLDQTLDKKLMRNMTMLNTNVRNTKNALSAGVGYIGGWSTGKKMGEDMPIEKLEDESQSLIPTGSCGAFVTALEDEFMAVRQAAVYSLGKLARNRPVFASACIDHLADMFNDEIQQDATADNRMALHTLLAKSNLADSNCVSQCLKKLLHSLRRFPMDKFSIFGCLSGIGQNHSSLVQPLVNDLLDVHPIFDTPEQSIDDDFCKDYLARLILVLNAASHRSVLCSLIPSYALKHYRYLRRSWPEIVPKILEFDHEKLHQCDSSPFLCPFLAVGPEDKTIEKENDAKTARIEYPDQTFDLHRPRRGDFLRLDSSTVHLQTNVVVSAQRWATSASVIFTPGIISTKSDESVAQRIVGKGQKDSLNQHIMPFASAENIARKCRISFNIHPMQQA

SEQ ID NO: 119930 - protein, 505 aa, Heterodera glycines
  Coding regions on vcDNA: vcDNA=SeqID_46353; Strand=+; Position=1 -123,297-473,531-603,857-1142,1352-1424,1472-1536,1607-1667,1728 -1805,1852-1894,1936-2037,2153-2189,2251-2472
  Homolog annotation: Hit_ID=NP_505407.1; Match level="QueryCoverage =98%, HitCoverage=97%, E-value=4e-98, Identity=45%"; Hit description =potassium voltage-gated channel subfamily B member 2 (5J797) [Caenorhabditis elegans] pir||T29789 hypothe
  Essential gene: C elegans homolog=C32C4.1; Phenotype=Unclassified
LSPGSPLSPTDISVPSIVELRRPSIRMNVGGRSAQLTLEKIRQRADRSRLSQFAEKDHAQRVLECDAFLNGEYYFERSATVFENILDYYVTGKLHRPMEICPICPIRWRDELEFWRIPLTALAECCLHLPSRRIRGNSSRHSSSPPPSSSSSICQGVAFSRVRLILWTFLENPRSSAAAKVLSVVSASFVLLSLAGLILSSMKEFQIKNDEPFYLFNWLPFSCMLFFTLEYLLRFAVIPHKWSFVKQPLNIIFVKQPLNIIDLLTIVPFLLEAFCLICLINFLIDHLGALIVIRVLRLARLARVARIFKLARYSIGLRAFGETMRKSAAELSMLGMFLLTMRKSAAELSMLGMFLLTGIMLFSTAIYFFERGIMLFSTAIYFFERDEPNSKFYSIPSAWWWCVATMTTVGYGDLVPVTTGGKVVAAIASVCVVAAIASVCGIIVLAFPISMIIDKFAESTGHGQRVFDETVAQGEVPLEANKSNVLLGSPTGRGMSRRRTKSRRY

SEQ ID NO: 119931 - protein, 139 aa, Heterodera glycines
  Coding regions on vcDNA: vcDNA=SeqID_46354; Strand=-; Position=1 -69,145-327,387-440,504-563,619-672
  Homolog annotation: Hit_ID=NP_491926.1; Match level="QueryCoverage =98%, HitCoverage=99%, E-value=1e-28, Identity=46%"; Hit description =lipid Binding Protein LBP-6, adipocyte P2 family member (15.6 kD) (lbp-6) [Caenorhabditis elegans] gb|AAK
  Essential gene: C elegans homolog=W02D3.7; Phenotype=Unc
MSEKFVGKWNLESSENFDDFMKEVGVNFLTRKAAGCVKPVLEFEVSNAGEHWKMTSTSTFTTWNCEFDLNKEFEVKTADGRTVKTIFAYENGKLTEKQSKLKDDEKDSYYERYIDESGKLVITMEAGSVKAKRVYTKAA

SEQ ID NO: 119932 - protein, 189 aa, Heterodera glycines
  Coding regions on vcDNA: vcDNA=SeqID_46355; Strand=+; Position=1 -115,405-505,554-856,914-945
  Homolog annotation: Hit_ID=CAE73453.1; Match level="QueryCoverage =100%, HitCoverage=26%, E-value=7e-55, Identity=56%"; Hit description= Hypothetical protein CBG20902 [Caenorhabditis briggsae]
  Essential gene: C elegans homolog=Y48B6A.1; Phenotype=Lva
NDYDHVGYTLSGDKIKKDAIKTDEIDAFLQKEEDSDYWRKVFDRQSGQQMALTDQQVEKLNAIADNRFPEIGYNPYPPFYNPYPPFLDIFSSVREIHPISNRPPDKRSFVPSADERRIVGRMVHAIKMGWLKSPKAQKKEEPRLYDLWDDEGDEQRKSKSQMARVRMHLPAPKVSPPHESYPHESYNPP

SEQ ID NO: 119933 - protein, 237 aa, Heterodera glycines
  Coding regions on vcDNA: vcDNA=SeqID_46356; Strand=-; Position=1 -26,338-456,502-587,640-827,869-993
  Homolog annotation: Hit_ID=NP_501141.1; Match level="QueryCoverage =98%, HitCoverage=17%, E-value=1e-66, Identity=57%"; Hit description =solute carrier family 12 member (4H981) [Caenorhabditis elegans] gb|AAA81476.1| Temporarily assigned gene
  Essential gene: C elegans homolog=R13A1.2; Phenotype=Emb
IKPELIRDRTGLSLDGRMVVAQLAWPTEWVVLVGSFLSTFGAALQCLCSAPRLLQSIAPRLLQSIAKDNVIPFLKRFAKVTKSNEPFFGLLLTTLIAELGILMGAMDPFFGLLLTTLIAELGILMGAMDTIAAVLDFFFLMCYAFVNIICALHSILGAPNWRPRFVYYHWSLSVLGAALCLFIMFSTHWQYAVFSIWSLSVLGAALCLFIMFSTHWQYAVFSIMFCFAIYKYVEWKG

SEQ ID NO: 119934 - protein, 126 aa, Heterodera glycines
  Coding regions on vcDNA: vcDNA=SeqID_46357; Strand=-; Position=1 -66,114-199,1012-1240
  Homolog annotation: Hit_ID=NP_492457.1; Match level="QueryCoverage =57%, HitCoverage=8%, E-value=1e-28, Identity=84%"; Hit description =translation Elongation FacTor (94.8 kD) (eft-2) [Caenorhabditis elegans] emb|CAB02985.1| Hypothetical prot
  Essential gene: C elegans homolog=F25H5.4; Phenotype=Emb,Lva
QLLPTATNLQHDDGTDFPRERIEAFSNVAIVIGDLISDAVLQIQNFSEHPDAISMFFELERKDLAFVKGESQADIEQVDGKSQKYNGFLINLIDSPGHVDFSSEVTAALRVTDGALVVVDCVSGFI

SEQ ID NO: 119935 - protein, 77 aa, Heterodera glycines
  Coding regions on vcDNA: vcDNA=SeqID_46358; Strand=+; Position=1 -60,256-426
  Homolog annotation: Hit_ID=NP_078976.2; Match level="QueryCoverage =100%, HitCoverage=19%, E-value=3e-30, Identity=71%"; Hit description= Smad nuclear interacting protein [Homo sapiens] emb|CAI20552.1| Smad nuclear interacting protein (SNIP1)
  Essential gene: C elegans homolog=C32E8.5; Phenotype=Bmd,Emb,Lva,Unc
YNEPPEAKLPKLRWRLYPFKGDDTLPVFYIHRQSAYLIGRDRKIADFPVDHPSCSKQHAALQYRSLQYERSDGSIGR

SEQ ID NO: 119936 - protein, 111 aa, Heterodera glycines
  Coding regions on vcDNA: vcDNA=SeqID_46359; Strand=-; Position=1 -134,722-796,847-973
  Homolog annotation: Hit_ID=NP_498409.1; Match level="QueryCoverage =83%, HitCoverage=58%, E-value=6e-11, Identity=34%"; Hit description =mitochondrial ribosomal protein S17 (18.4 kD) (3H520) [Caenorhabditis elegans] gb|AAB53829.1| Hypothetica
  Essential gene: C elegans homolog=C05D11.10; Phenotype=Lva
MQQLSKKSAWVSKVSGELLLAKVKQITTIGLQRDTCVKVKISKNNFYEYNRMFFMSSAYEWSLDPESKCRVGDVVLIRRLSEIHRPSKTVQYAVEKARNSSFCRHAINKWH

SEQ ID NO: 119937 - protein, 170 aa, Heterodera glycines
  Coding regions on vcDNA: vcDNA=SeqID_46360; Strand=-; Position=1 -109,160-302,361-618
  Homolog annotation: Hit_ID=CAE57680.1; Match level="QueryCoverage =98%, HitCoverage=31%, E-value=2e-66, Identity=75%"; Hit description =Hypothetical protein CBG00674 [Caenorhabditis briggsae]
  Essential gene: C elegans homolog=K01C8.10; Phenotype=Emb,Lva,Ste
LVELSKAQDIEAGDGTTTVVVLAGSLLDAAEKLLAKGIHPTTISDSFQRAATFSEKVLEEMATPIDINDDDELVKLAMTSLNSKVVSQHSHLLAPMAVQAVKKLMSSPEDSSVNLKLIKVVKKLGETVEESQLIEGALIDQKSMGHGGPARVEKAKIGLIQFQISPPKPN

SEQ ID NO: 119938 - protein, 83 aa, Heterodera glycines
  Coding regions on vcDNA: vcDNA=SeqID_46361; Strand=+; Position=1 -21,250-466,695-708
  Homolog annotation: Hit_ID=NP_510144.1; Match level="QueryCoverage =72%, HitCoverage=14%, E-value=4e-12, Identity=53%"; Hit description =branched-chain amino acid aminotransferase, cytosolic, ECA39 (47.3 kD) (eca-39) [Caenorhabditis elegans]
  Essential gene: C elegans homolog=K02A4.1; Phenotype=Emb,Lvl
MRRKFTRIASWVDIYHFIYIIKDFDADELLKVIIELVRLDRDWVPAKSPASLYIRPTLIGTDPVSPVDPPRSVKMFVLTGHGK

SEQ ID NO: 119939 - protein, 232 aa, Heterodera glycines
  misc_feature (212)..(212): Xaa can be any naturally occurring amino acid
  Coding regions on vcDNA: vcDNA=SeqID_46362; Strand=+; Position=1 -202,499-601,881-961,1131-1220,1271-1451,1682-1707
  Homolog annotation: Hit_ID=NP_501578.1; Match level="QueryCoverage =97%, HitCoverage=28%, E-value=1e-49, Identity=47%"; Hit description =TWiK family of potassium channels (87.5 kD) (twk-19) [Caenorhabditis elegans] emb|CAA92568.1| Hypothetica
  Essential gene: C elegans homolog=ZC410.4a; Phenotype=Unclassified
FPGIPLMLITLNELGKFLYKTINEFIAMLNNRCKMLHKFCKRFKKKHWKKEGKSGDEEMDEEMEKDSTQNASDFGILMEEATESEEENGEEEEEEEDEHGIPRMHVMVAIVTTFAWIFLCAALFKLWEEWTYWNSLYFMFISLLTIGLGDVNVHRRDLMVFCFMVFCFIFVIIGLSLVSMCINVIQSSLEDFYRKMLMKILADYQASLNKGXNMYGQFLGIIQCWRENDPDP

SEQ ID NO: 119940 - protein, 348 aa, Heterodera glycines
  misc_feature (12)..(12): Xaa can be any naturally occurring amino acid
  misc_feature (15)..(15): Xaa can be any naturally occurring amino acid
  Coding regions on vcDNA: vcDNA=SeqID_46363; Strand=+; Position=1 -192,272-436,544-697,804-989,1043-1218,1252-1356
  Homolog annotation: Hit_ID=CAE62343.1; Match level="QueryCoverage =93%, HitCoverage=51%, E-value=8e-57, Identity=40%"; Hit description =Hypothetical protein CBG06418 [Caenorhabditis briggsae] pir||S27782 esterase precursor - Caenorhabditis br
  Essential gene: C elegans homolog=K07C11.4; Phenotype=Gro
LTKASPFPGVFXIVXLPQIVPTVVHTMFGPVKGFTDIDGANSSLVDVFLGIPFAQPPVGHLRFEKPRKPRPLVTHWDGILDGTEHRKSCVPHARPDWQNELLGQYSFSEDCLYMNIFAPHGAEEQLLPVLVLIHGGAFSIGSVRQFSDHRDIGAKFVSHGIVVVAIQYRLGVFGFASSGDPQMPGNFGLWDQLAALQFIRQNIRRFGGNPEDITLFGHSAGAASVSALGISPHSRHLFQRAILFQRAIQMAGSVFSSFLLGAHVHRLTLGLVETLDCEEPPKECLKRKSVDEIHAAVERMNCCIEGPAKVRLGNCCIEGPAKVRLGPRIDGDFFPRDIPSLVDTSPKK

SEQ ID NO: 119941 - protein, 83 aa, Heterodera glycines
  Coding regions on vcDNA: vcDNA=SeqID_46364; Strand=-; Position=1 -139,417-527
  Homolog annotation: Hit_ID=CAE73732.1; Match level="QueryCoverage =100%, HitCoverage=40%, E-value=6e-34, Identity=80%"; Hit description= Hypothetical protein CBG21258 [Caenorhabditis briggsae]
  Essential gene: C elegans homolog=K11H12.2; Phenotype=Gro,Stp
GFLIYRVRIRRGGRKRQVTKGQTYGKPKTHGVNQLKNTRSLQAVAEARAGRRLGELRVLNSYWVGQDSTYKFFEVILVDPSHK

SEQ ID NO: 119942 - protein, 110 aa, Heterodera glycines
  Coding regions on vcDNA: vcDNA=SeqID_46365; Strand=+; Position=1 -113,210-429
  Homolog annotation: Hit_ID=NP_500604.1; Match level="QueryCoverage =93%, HitCoverage=62%, E-value=6e-50, Identity=83%"; Hit description =ubiquitin conjugating enzyme (19.1 kD) (ubc-9C) [Caenorhabditis elegans] gb|AAK67232.1| Ubiquitin conjuga
  Essential gene: C elegans homolog=F29B9.6; Phenotype =Emb,Gro,Pvl,Stp,Unc
MAGIAAGRLTEERKAWRKDHPFGFIARQCKKEDGTLDLYNWICAIPGPKSTIWEGGLYKLRMIFKDDFPSTPPKCRFEPPLFHPNVYPSGTVCLSLLDENKDWCATHRGF

SEQ ID NO: 119943 - protein, 362 aa, Heterodera glycines
  misc_feature (317)..(317): Xaa can be any naturally occurring amino acid
  misc_feature (359)..(359): Xaa can be any naturally occurring amino acid
  Coding regions on vcDNA: vcDNA=SeqID_46366; Strand=+; Position=1-1116
  Homolog annotation: Hit_ID=NP_510671.1; Match level="QueryCoverage =97%, HitCoverage=36%, E-value=4e-65, Identity=37%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
NNKWKKKLDCIYIDFQKAFDSVPHELLLYKLEKIGIRGKLMWIKDFLSNRTFRVKIGDDLSSSKVGSGVPQGSVLGPLLFLIYINDLPDALPSGVKIKLYADDVKLYISDTEIMHKALHNLSEWANKWQIRISIKKTFVLHLGNKNPKEIYKIDGNIINVVDTIRDLGINIDNKLQFSNHVTQIIKNAYLRMRSLFRVIKSKSTRIWIILYKTYVRPLLEYAPEVWNPSLLKNIKKIEKCQKYFTKRVLFKCSLPPIPYQQRLEYLQLPTLESRRKLSDLFMAHKIIYGRTEIPLKYSNLLNTLTFPFIDLTRNINXAKKPFAGRVTKIWKPLYKRIIEINSLNQFKNKIKTISIPVKXTEK

SEQ ID NO: 119944 - protein, 355 aa, Heterodera glycines
  Coding regions on vcDNA: vcDNA=SeqID_46367; Strand=-; Position=1 -106,170-231,409-523,882-1056,1208-1334,1613-1909,2199-2382
  Homolog annotation: Hit_ID=AAK94490.1; Match level="QueryCoverage =100%, HitCoverage=35%, E-value=3e-41, Identity=32%"; Hit description= PAZ/Piwi domain protein [Heterodera glycines]
  Essential gene: C elegans homolog=F55A12.1; Phenotype=Emb
MRPDEHRFTAADSPYFRSNSSFLGIGMDKSVRIVENGLKQGDVAGAKAAMVVQVQKTPFHLVESMLEKFEKVVPRWNGGLLENGELAHVSRMLRGLYVHTTYNQQAIQRFPISAFSPTNAKTEIMMVEDGQITVEQYYARRYDIKLRSPIFSGAPCAPLVIRRERGKSTHYPMELLKICDYQRVRSAQMTPETHQEMIKACAIPPFLLRRQTDQLTNVLALNQSDHLARASIRFAERPMEVPARILNPMKLKYADDKLEMPNDTCRWRAGRYLLPAQINSWCAIALVDNSRDNNISLANWRDFVDRYRQMMQMKGMKVLAPSVTEVYNVGNFDLRDRFTRMQNSGVEFVLVGHPK

SEQ ID NO: 119945 - protein, 126 aa, Heterodera glycines
  Coding regions on vcDNA: vcDNA=SeqID_46368; Strand=+; Position=1 -112,617-781,930-1033
  Homolog annotation: Hit_ID=AAB47548.1; Match level="QueryCoverage =99%, HitCoverage=97%, E-value=7e-38, Identity=53%"; Hit description =similar to nonmuscle myosin essential light chain encoded by GenBank Accession Number U25057 [Toxocara can
  Essential gene: C elegans homolog=T12D8.6; Phenotype=Emb
MNKTDDQLAECREIFCYFDSKGDEKINVKQVEKGQWENTRISFEEFVPIFQTVSKSRAQYTKDQFVEGLSHFDREGNGTIAVAELKHLLTNLGERLSEEEVEQLLAGHDVANGFVSIDSFIETVLR

SEQ ID NO: 119946 - protein, 132 aa, Heterodera glycines
  Coding regions on vcDNA: vcDNA=SeqID_46369; Strand=+; Position=1 -210,442-630
  Homolog annotation: Hit_ID=CAE67086.1; Match level="QueryCoverage =96%, HitCoverage=27%, E-value=1e-51, Identity=72%"; Hit description =Hypothetical protein CBG12497 [Caenorhabditis briggsae]
  Essential gene: C elegans homolog=F43G9.10; Phenotype=Emb
MTEEERRNYLRMNPKIITNQQNKGKYKFLQKYYHRGAYFLDKEDDVLRRNFAEATGEDVFDKSVLPKVMQVKNFGKASRSKWTHLTAEDTTDHQGVWATPTPLSAKFVAKHAAGMKNVFEKPSAKKRKIGGD

SEQ ID NO: 119947 - protein, 105 aa, Heterodera glycines
  Coding regions on vcDNA: vcDNA=SeqID_46370; Strand=-; Position=1 -96,436-543,875-988
  Homolog annotation: Hit_ID=XP_394536.1; Match level="QueryCoverage =92%, HitCoverage=22%, E-value=4e-18, Identity=43%"; Hit description =similar to ENSANGP00000012356 [Apis mellifera]
  Essential gene: C elegans homolog=F43D2.1; Phenotype=Gro,Pvl,Rup,Unc
MDKEYMSKIVTNAWTFVNDSLGTTLCLLWEPEVIAIALLYMSFKMERMEEQQIGRTFHFDASTEWWNLYVQNLTVPMMDDICHKVLDSIAPANGEDAPMANGTKN

SEQ ID NO: 119948 - protein, 250 aa, Heterodera glycines
  misc_feature (234)..(234): Xaa can be any naturally occurring amino acid
  Coding regions on vcDNA: vcDNA=SeqID_46371; Strand=+; Position=1 -100,196-310,360-408,462-550,594-683,733-851
  Homolog annotation: Hit_ID=AAC47745.1; Match level="QueryCoverage =91%, HitCoverage=64%, E-value=2e-63, Identity=53%"; Hit description =collagen [Meloidogyne javanica]
  Essential gene: C elegans homolog=F46C8.6; Phenotype=Dpy,Gro
LLFKFASKSIWEQICCSTTASRRRRADGTSAIPTQQCTSCVQLQCPPGPPGPPGVAGEDGADGLPGRPGKPGLDGLDVPLEPEPSYLDGLDVPLEPEPSYPCVICPAGPPGNRGPQGEPGRPGPCVICPAGPPGNRGPQGEPGRPGPQGEPGPPGLPGRPGKPGRVGDAGPLPGRPGKPGRVGDAGPPGSRGEPGEPGIKGPPGDDSIGGTPPGDDSIGGTGIKGPPGPPGQNXKKCVDKWSITCQIKAR

SEQ ID NO: 119949 - protein, 139 aa, Heterodera glycines
  Coding regions on vcDNA: vcDNA=SeqID_46372; Strand=-; Position=1 -54,106-230,275-356,400-490,541-606
  Homolog annotation: Hit_ID=CAE73046.1; Match level="QueryCoverage =82%, HitCoverage=25%, E-value=4e-37, Identity=62%"; Hit description =Hypothetical protein CBG20416 [Caenorhabditis briggsae]
  Essential gene: C elegans homolog=H25P06.2a; Phenotype=Emb,Gro,Unc
MLEMNGVGNSKDYDTKVKAILEQCRISQKLLNYTEHFNYPYVSEVTYYEQLLKIGQGTFGEVFKARCKRTGKLVALKKILMENEKEGFPITALREIKMLQRLRHQHITELVEVCTSKQKSGKEKFCFYLVFTFCEHDLA

SEQ ID NO: 119950 - protein, 93 aa, Heterodera glycines
  Coding regions on vcDNA: vcDNA=SeqID_46373; Strand=-; Position=1 -131,220-370
  Homolog annotation: Hit_ID=NP_495365.1; Match level="QueryCoverage =94%, HitCoverage=14%, E-value=1e-23, Identity=57%"; Hit description =RaPsYn related (rpy-1) [Caenorhabditis elegans] gb|AAC46691.1| Rapsyn protein 1 [Caenorhabditis elegans]
  Essential gene: C elegans homolog=C18H9.7; Phenotype=Unclassified
MGLSNFQSSLQQFEKAMKIANANADKLLELQLSLGLGNLFTLIRDLNKALVFLQNALGILQGIEANHVHAKYKSAILYQLSVILRLKGRYSGD

SEQ ID NO: 119951 - protein, 201 aa, Heterodera glycines
  misc_feature (174)..(174): Xaa can be any naturally occurring amino acid
  misc_feature (180)..(180): Xaa can be any naturally occurring amino acid
  misc_feature (190)..(190): Xaa can be any naturally occurring amino acid
  Coding regions on vcDNA: vcDNA=SeqID_46374; Strand=-; Position=1 -179,228-323,462-543,658-890
  Homolog annotation: Hit_ID=CAE62879.1; Match level="QueryCoverage =68%, HitCoverage=19%, E-value=9e-49, Identity=70%"; Hit description =Hypothetical protein CBG07065 [Caenorhabditis briggsae]
  Essential gene: C elegans homolog=W07E6.1; Phenotype=Lva
IKKARKIEKMAKFRVKRLFQLYFHIFSAFQLLLKDLCSYYDYNEFLMEKFMELFPTGAELLEFLDLLEFLDSNEQPRPVTIRSNPLKTRRGELAKALISRGMNVDPAAKWTKVGLVVYDSQVPVGATPEYLAGHYSIQGLSSFLPVMALAPQPNERILASLKGGGGWESINLAXILTSRXKMVNSCNNKXLLAVILQNSFF

SEQ ID NO: 119952 - protein, 190 aa, Heterodera glycines
  Coding regions on vcDNA: vcDNA=SeqID_46375; Strand=+; Position=1 -58,992-1151,1185-1313,1386-1472,2048-2087
  Homolog annotation: Hit_ID=CAE71930.1; Match level="QueryCoverage =97%, HitCoverage=54%, E-value=9e-34, Identity=43%"; Hit description =Hypothetical protein CBG18993 [Caenorhabditis briggsae]
  Essential gene: C elegans homolog=K11G9.4; Phenotype=Gro,Lvl,Sck
GRGGQQQRPFRSVLCLPTLAETEEKRKKADEEKRKRTDQTKRRVFRLQKGETETDSPVSGMFIKVKPTLGMAEELRQATAELDESALFVNVTEELRQATAELDESALFVNVTEETREAINAIPNVIGESICALCKIRFGDVFRLAMHKIRFGDVFRLAMHKCPRIRHEEYRCDECEKVFGCPANLASHRR

SEQ ID NO: 119953 - protein, 126 aa, Heterodera glycines
  Coding regions on vcDNA: vcDNA=SeqID_46376; Strand=-; Position=1 -33,78-230,351-486,576-631
  Homolog annotation: Hit_ID=NP_500617.1; Match level="QueryCoverage =99%, HitCoverage=12%, E-value=6e-43, Identity=62%"; Hit description =dehydrogenase, E1 component and Transketolase, central region (115.7 kD) (4F462) [Caenorhabditis elegans]
  Essential gene: C elegans homolog=T22B11.5; Phenotype=Emb,Lva
MCNEDDGIDLKSVALDEAFVARQLNETNWIVANCTTPANFFHLLRRQIHSPFRKPLIVFTPKSLLRHPLAKSPVDDFLPGTSFRRAIPEEGSASNNPAAVERLVFCSGKVYYDIFDERRKQGLEDK

SEQ ID NO: 119954 - protein, 301 aa, Heterodera glycines
  misc_feature (24)..(24): Xaa can be any naturally occurring amino acid
  Coding regions on vcDNA: vcDNA=SeqID_46377; Strand=+; Position=1 -133,222-368,519-676,722-965,1024-1149,1229-1257
  Homolog annotation: Hit_ID=BAA07501.1; Match level="QueryCoverage =96%, HitCoverage=79%, E-value=2e-88, Identity=61%"; Hit description =XRad51.1 [Xenopus laevis] sp|Q91918|R511_XENLA DNA repair protein RAD51 homolog 1 (XRAD51.1)
  Essential gene: C elegans homolog=Y43C5A.6a; Phenotype=Emb
GIHPSDIKRLRESYIGSCGISWGXPELERVKGIDQKVEKIYTEAKKLVPMSFTLASVIHCKRSQLILIETGSRELNRLLGGGIETSSITEVFGEFRTGKSQLCHTLAVTCQLPVDMGGAEGKCLWIDTEGTFRPERLLAVAERFKLDGQAVLENVFKLDGQAVLENVAYARCHNTDHQMRLLMEGASMMAECRYALVVVDSVMALYRTDYTGRGELSARQQHLACFLRGLMKLAEEFGVAVLVTNQVFGVAVLVTNQVVAQVDGNAGMFQTDPKKPIGGNIMAHSSTTRQNFQNFKKRGGK

SEQ ID NO: 119955 - protein, 286 aa, Heterodera glycines
  Coding regions on vcDNA: vcDNA=SeqID_46378; Strand=+; Position=1 -142,251-465,753-1043,1139-1349
  Homolog annotation: Hit_ID=CAE67177.1; Match level="QueryCoverage =49%, HitCoverage=14%, E-value=2e-35, Identity=57%"; Hit description =Hypothetical protein CBG12609 [Caenorhabditis briggsae]
  Essential gene: C elegans homolog=ZC308.1a; Phenotype=Emb
MVHIVQTLRNTKQSDNGGKTQQMVEATVAENGQQQTQKKHSDSAGSSTSSVVPCPAELALCRQAVLVNSDQQQQQQLHDYEQRPVIVGYDFNAGIQWEALLDSFLTTGFQASHMGIAIQQQFIWLLIQLSERIRDFHYNEDQTHAQLNRKLQLRDQLYYAISPIFPSTIELFLINDAPNAPFCCSVCGLYIVGSSLNGFGTKRSDLDLCLMITNRDIDQRSDAVVVLSSVMRTLESNQIVAEQNLILAKVPILRIKFIGTFHDITVDLNATTRWPFGHAFDVYYSP

SEQ ID NO: 119956 - protein, 405 aa, Heterodera glycines
  Coding regions on vcDNA: vcDNA=SeqID_46379; Strand=-; Position=1 -113,158-315,674-756,839-1113,1200-1393,1577-1647,1691-1798,1843-2058
  Homolog annotation: Hit_ID=CAE64847.1; Match level="QueryCoverage =63%, HitCoverage=30%, E-value=9e-36, Identity=27%"; Hit description =Hypothetical protein CBG09643 [Caenorhabditis briggsae]
  Essential gene: C elegans homolog=T21C9.2; Phenotype=Unclassified
TIQNLVALAADQFDDGGSTASAKKALPRVRSSTEVLNPQRVIRRRDSICTSTSAPNQIDQTEETHWITQCEQKEGNTEQIGGQRAADDAKAEGKDGGSFSADGNGTHRSPVFATIHQQRQNGVSSSDFAHTFLINPTFFAPLSERIDTEPWQPNRIPYVYQRIVDKFRLSGALSDVEENVEDEHEDDDDEREGNRDYLVLGGSKRFIVVGSATSLLRVLAQYSDLLFLFPQCSMELTMDIVQILKAFNSRTCQLILGAGARQLVGLKMISVKHLDHEGEIKGKMLGLMDRELIGALEEWKLEGKVPTAAFQQIVMQIGKFYSSYSAVMPAELTTDILLKIHENFKLYLRQHLNSRGISPHDSIAYGMAGQDFAYYIENVRALPDCKSFPVDTIGDVIQHKYSLPP

SEQ ID NO: 119957 - protein, 317 aa, Heterodera glycines
  Coding regions on vcDNA: vcDNA=SeqID_46380; Strand=+; Position=1 -117,164-214,432-580,768-884,946-1038,1119-1339,1406-1611
  Homolog annotation: Hit_ID=CAE65222.1; Match level="QueryCoverage =100%, HitCoverage=21%, E-value=3e-29, Identity=28%"; Hit description= Hypothetical protein CBG10098 [Caenorhabditis briggsae]
  Essential gene: C elegans homolog=C38C10.5a; Phenotype=Emb
MELTRLGDEPTTRWTLLNIRILVESAEVGEGQQMVHPLQINFLHQMVQEKLDTANEALQIAKINRSGKGSEGSSQQYIRVDEYNEKECRLAISYWLRREDGTIHGRLSSHYRMLIFGDKNNSHVGLKIRHHPPSTELPTIDHEQSPSLQRLLNETVLFRCRERLLAVKQLLEAAFRTLSSQPNTKCPSSASPSSTNSEDTAQQFVHQSGHSLLTLSCPLVLIGDCHPDECLTVAVNTFSGAVIARVEVLGQREEIHKLEHQLNTCPTVLLHSSASSLSAFSVSSIGRLLARLRVLVIGERLNRALVGMQATKALSTD

SEQ ID NO: 119958 - protein, 163 aa, Heterodera glycines
  Coding regions on vcDNA: vcDNA=SeqID_46381; Strand=+; Position=1 -295,1996-2058,2524-2655
  Homolog annotation: Hit_ID=CAE65135.1; Match level="QueryCoverage =39%, HitCoverage=39%, E-value=3e-24, Identity=86%"; Hit description =Hypothetical protein CBG10001 [Caenorhabditis briggsae]
  Essential gene: C elegans homolog=R10E11.8; Phenotype=Ste
MWQSEQITEIGTIVEINERFTPTEVIPKYVMTTSGSASCPTKVIRRQANFPLEHFRRDHQVNVVLKSVQLSSGIKIHPSFILPGNSPFRWHPDIIRPNGTGIACMAVARPDLVMKAIIPVVMAGIVAIYGLVVAVIISGRLEAAGPGYTIDRGFSQFAAGLVC

SEQ ID NO: 119959 - protein, 145 aa, Heterodera glycines
  Coding regions on vcDNA: vcDNA=SeqID_46382; Strand=+; Position=1-435
  Homolog annotation: Hit_ID=CAE65135.1; Match level="QueryCoverage =58%, HitCoverage=51%, E-value=2e-34, Identity=82%"; Hit description =Hypothetical protein CBG10001 [Caenorhabditis briggsae]
  Essential gene: C elegans homolog=R10E11.8; Phenotype=Ste
FESLTQTTKYNFDFLVQVLELALFYHFLKLIFSIFHPLPKKTENSVVMAGIVAIYGLVVAVIISGRLEAAGPGYTIDRGFSQFAAGLVCGLCGLGAGYAIGVVGDAGVRGLSQQPRLFVGMILMLIFSEVRRRDGPRILAWGGGV

SEQ ID NO: 119960 - protein, 43 aa, Heterodera glycines
  misc_feature (16)..(16): Xaa can be any naturally occurring amino acid
  Coding regions on vcDNA: vcDNA=SeqID_46383; Strand=-; Position=1-228
  Homolog annotation: Hit_ID=NP_499264.1; Match level="QueryCoverage =90%, HitCoverage=8%, E-value=3e-13, Identity=94%"; Hit description =citrate synthase (51.5 kD) (3L304) [Caenorhabditis elegans] emb|CAA83004.1| Hypothetical protein T20G5.2 [
  Essential gene: C elegans homolog=T20G5.2; Phenotype=Emb
VSRALGCLSQLIWARXMGLPLERPKSHSTDGLIKLAAAATAAK

SEQ ID NO: 119961 - protein, 611 aa, Heterodera glycines
  Coding regions on vcDNA: vcDNA=SeqID_46384; Strand=+; Position=1 -264,308-502,1183-1461,1507-1641,1750-1833,1883-1991,2035-2330,2656 -2813,2862-3064,3109-3221
  Homolog annotation: Hit_ID=CAE74345.1; Match level="QueryCoverage =99%, HitCoverage=82%, E-value=5e-58, Identity=30%"; Hit description =Hypothetical protein CBG22063 [Caenorhabditis briggsae]
  Essential gene: C elegans homolog=Y48G1A.5; Phenotype=Emb
MRSNKLWTEIILVVNTVSRHVCHRLTLLSKVAEPLTQLYARMLQFLPDPANQNTQLGPSDRLSWLQIVLELTRIYHSLISQDLPEYFEDNLTPWMEGFLQLLELKLPELEAKSVDLEPNEHDKLRCEICEIATLFSQRFEECFIPYTERFIASINVADFYQEHVRSDLLLGPVNDLPILRGDALKFLVLFRKQLKPEQLIECLRGQNGLLECSIIRFLSSAHVLIHHYVAYAVERLFLMKNPTNPQETLFNASNVPIDLLIDALFDCFQVPQACETHYVMKALMRAFSLIDMITEAVRVPKNPLFVHYIFESLCVLIRRAYSKVSGGLDQHVIPIIELILGNDLSDFVPYVLQIIALMLDQSQSEKQRGIEMSQEAYVRFFPTLLRPDYWLRSANVPALVLVFESFIRCVPQLVFSAQYSDQILGIFQRLIGSKAYDQHGFRLANTFISHLDLNSLEAIQSGIYGMMLDKILLNEMQAMPQTTTYEEKRIVTIGAAKLITETTAFLGPRYAQIIELAVNILEAFEHKTSAVVDTAVQEREETAEVSELEYSDPYCKLSYAQHPEPFAPEIGNIKMHFAQAVLFTVRETNPENFDCLNARVQNCLRAYSSTI

SEQ ID NO: 119962 - protein, 497 aa, Heterodera glycines
  misc_feature (110)..(110): Xaa can be any naturally occurring amino acid
  misc_feature (122)..(122): Xaa can be any naturally occurring amino acid
  Coding regions on vcDNA: vcDNA=SeqID_46385; Strand=+; Position=1 -99,187-268,315-601,752-813,856-942,1008-1063,1196-1307,1349 -1432,1500-1618,1676-1759,1815-1853,1902-1967,2114-2200
  Homolog annotation: Hit_ID=NP_509013.2; Match level="QueryCoverage =98%, HitCoverage=42%, E-value=3e-87, Identity=40%"; Hit description =PaTched Related (110.8 kD) (ptr-4) [Caenorhabditis elegans] gb|AAK68251.3| Patched related family protein
  Essential gene: C elegans homolog=C45B2.7; Phenotype=Dpy,Lva,Prz,Unc
SAHLGLGDRLGNLTAEAFRAYGAFVGRNQFWFEVFMAIFTLATLPGLFFLKINLDLYKLFVPLDAPVRFEFESLFVPLDAPVRFEFESQKLYNQIPPGKLDFPPGRPLRXSPPTLRPLLLKXMKRPPPNRPPTNLKTFRRRGTRETQPKKCTKVKKNSGKRKSKFEGKHPSVPQHNDILRFYVVHRDYENLLHSDTLGKLFMYNLLHSDTLGKLFMYTNEMMKVAMEYDGETWVFEWVFEDFCKRGPAQEQCSNENIWLKHAENLFRSNGTRHNPNLQLSYPVMYLFNRPKDIGNIIYGVNDIGNIIYGVNVTGQKHEIVGARVLTIHWFVAFPLAGNNLAAFLKYREGLNRFWDEKTAESQINFIPHNKAMDDELRLIIETAVPFAVPKAMDDELRLIIETAVPFAVPATLQLMLFVYLTNLASDVRKFVYLTNLASDVRKSKPIESKPIEAFFGVISVCLSLVATFGITFFAGLHFSPVCSTMLFLILAVGVDDA

SEQ ID NO: 119963 - protein, 208 aa, Heterodera glycines
  Coding regions on vcDNA: vcDNA=SeqID_46386; Strand=-; Position=1 -114,173-288,747-934,1140-1281,1831-1888
  Homolog annotation: Hit_ID=CAE59922.1; Match level="QueryCoverage =98%, HitCoverage=22%, E-value=8e-80, Identity=74%"; Hit description =Hypothetical protein CBG03408 [Caenorhabditis briggsae]
  Essential gene: C elegans homolog=T14G10.5; Phenotype=Gro,Ste,Unc
TLRFAAVRTISMDYPQAVISCNVDLEQLITDSNRSIATLAISIATLAITTLLKTGAEASVERLMKQIGTFVSEISDEFKIVVIEAIRSLCHRYPRKHATLMNFLASMLRDEGGFDYKKAIVDTIITIVEDNPSAKDLGLSHLCEFIEDCEHAALATRVLHLLGREGPTTANPSRYIRFIYNRVILESTQVRAAAVTALAKFGAECGAA

SEQ ID NO: 119964 - protein, 272 aa, Heterodera glycines
  Coding regions on vcDNA: vcDNA=SeqID_46387; Strand=-; Position=1 -267,773-955,1278-1613,1740-1772
  Homolog annotation: Hit_ID=NP_510290.1; Match level="QueryCoverage =88%, HitCoverage=18%, E-value=6e-45, Identity=40%"; Hit description =kinase (XO299) [Caenorhabditis elegans] emb|CAB03829.1| Hypothetical protein C04A11.3 [Caenorhabditis ele
  Essential gene: C elegans homolog=C04A11.3; Phenotype=Gro,Unc
MANILYFFPSVRPLFHFVPQESDFVEQQMRSQEVFLLRARDRHREKLCLLEKQFLEQKHQLERSMETALWELEEAQLAEKHALLTQQFRRTHMLARHAKEQEHVRRINQSKEEQLLRALTADRKALPKVLRNEAKTRTMMFRKSLEVDLPGESDTWTAKVRMFEEREKQRMRLKMEEYDQKCKRKLAQLVERNQEVMRELEEIHVGKAFKNATKNCQCFLFVVQNEKRNMLLENERTKLAEYEQEYQQLLAEWKASLPARKAAPNIHHIFND

SEQ ID NO: 119965 - protein, 210 aa, Heterodera glycines
  Coding regions on vcDNA: vcDNA=SeqID_46388; Strand=+; Position=1 -138,303-425,898-945,991-1062,1107-1193,1239-1300,1343-1442
  Homolog annotation: Hit_ID=CAE65212.1; Match level="QueryCoverage =58%, HitCoverage=15%, E-value=4e-39, Identity=65%"; Hit description =Hypothetical protein CBG10087 [Caenorhabditis briggsae] sp|Q61IS6|SPK1_CAEBR Serine/threonine-protein kina
  Essential gene: C elegans homolog=B0464.5a; Phenotype=Emb
MNAGSIDNDHDHYHNSIKNSSPKLSYDSVNCWSMESEGSSVNNDENPNPEMDDEMMEEEAAHHEDDQVANILDLKTTIISFNPIAAGLLECVRDSDPTDESLQRVVQLLDSFTISGVNGVHVCMVFEVLGCNLLKLIIRSSYAGLPIMLVKRIVKQVLEGLRYLHDKCHIIHTDIKPENVLITMSHEEIKKLAEDAILAGKTGRDMSGSA

SEQ ID NO: 119966 - protein, 500 aa, Heterodera glycines
  misc_feature (4)..(4): Xaa can be any naturally occurring amino acid
  Coding regions on vcDNA: vcDNA=SeqID_46389; Strand=+; Position=1 -133,187-263,316-504,555-646,709-877,930-1142,1196-1369,1420 -1516,2008-2058
  Homolog annotation: Hit_ID=NP_491486.1; Match level="QueryCoverage =98%, HitCoverage=30%, E-value=2e-65, Identity=36%"; Hit description =SMC protein, N-terminal and structural maintenance of chromosome protein SMC, C-terminal (1F522) [Caenorh
  Essential gene: C elegans homolog=F28B3.7; Phenotype =Emb,Lva,Lvl,Pvl,Unc
YLIXVMEGHGFLYSLEIENFKSFKGKHYIGPFKRFSAIIGPNGSGKSNLMDAISFVLGERTNHLRVRGKSNLMDAISFVLGERTNHLRVRKLGDLVHGASISMPASKTCCVRDLVHGASISMPASKTCCVRMIYRNPDGTERTFQRTTSELRVDDNVVNLSQYHKALEEINIFSKARNFLVYQGAVEQIAMARNFLVYQGAVEQIAMQNPKEMTQLFEELSKSAEFSAEFKDEYEKLKEEMHQAEARAQKNLNKKRDITKELREVMMEKNEARRFQTLKEELVIQNRTLFLVQVIQNRTLFLVQLFFAEKSKQFVEEGLEQLRLDLEKKKSDRSEFESDLHEKQRAAKDVHREKQRIEIRLQREERKVLNRRPNVTKSKQQLDHCCERKVLNRRPNVTKSKQQLDHCCLKLDSVRKAYETAKRAMDSQEKTVKEAEERIKSVMGEKAVLEEEKAVLEEELNKESQALQLNLSKEQVSRFLPQRNSAPHLRPGIQKRWNLA

SEQ ID NO: 119967 - protein, 246 aa, Heterodera glycines
  Coding regions on vcDNA: vcDNA=SeqID_46390; Strand=+; Position=1 -168,251-489,561-681,844-936,992-1111
  Homolog annotation: Hit_ID=NP_741578.1; Match level="QueryCoverage =93%, HitCoverage=27%, E-value=2e-28, Identity=30%"; Hit description =C2H2 type zinc finger containing protein (103.5 kD) (5J271) [Caenorhabditis elegans] gb|AAA96114.2| Hypot
  Essential gene: C elegans homolog=C01B7.1a; Phenotype=Lva
MTHPQSVAAHGIREHGDEASCEDLLYNFEDELKQMSKACFEKERLFEKEIRRRNRLERFARCSTENSSAGRAEDDDNSQHGNNESKLSQQIVRRRSQQHIMNLRVSLKSENVDRDWTPKEPVRKRRSGGRRFFGSRGRKPMSRKARDVMIKLREVSMRLGGAQYFKKRSNEAISCEKCGKLVINRLSDHAYSHLEGCDLFKCQQCNLGHFSRETIVRHLKDFHNSHEAPMDNRLRFAQVTIVLTWF

SEQ ID NO: 119968 - protein, 190 aa, Heterodera glycines
  Coding regions on vcDNA: vcDNA=SeqID_46391; Strand=-; Position=1 -243,304-483,552-701
  Homolog annotation: Hit_ID=CAE58505.1; Match level="QueryCoverage =99%, HitCoverage=59%, E-value=3e-34, Identity=38%"; Hit description =Hypothetical protein CBG01655 [Caenorhabditis briggsae]
  Essential gene: C elegans homolog=B0218.5; Phenotype=Unclassified
MSLIGRGLFDLLSAAGDVFSPGTAIGVSLQLLDALEALHKIDYLHLDVKLENAAIGRAETNESRRIFLIDFGLARRYISQSGRARKQRSKTHFRGTPMYASISAHARADYCRADDIESWFYTLVDMYTGKLPWTHVTSERRTGKMKRLRLSHKPKEVQQRALHALLKKCPPIFYDILLHIVRFMRHFVPL

SEQ ID NO: 119969 - protein, 132 aa, Heterodera glycines
  Coding regions on vcDNA: vcDNA=SeqID_46392; Strand=-; Position=1 -171,228-452
  Homolog annotation: Hit_ID=AAB87136.1; Match level="QueryCoverage =84%, HitCoverage=35%, E-value=3e-22, Identity=46%"; Hit description =putative serine/threonine protein phosphatase PP1 isozyme 4 (TOPP4) [Arabidopsis thaliana] sp|P48484|PP14_
  Essential gene: C elegans homolog=W09C3.6; Phenotype=Ste
MAREEYCFDATAAAAAEQSRPSATTSTLVQGDGLSSSFVDAIIRKVRQSPVQRFTDEITDEELKQLCKAATDIFRMQPTLVRIQPPVVVVGDIHGQFTDLQRIFHTHGNPPEQQYVFLGDYVDRGPQSLETI

SEQ ID NO: 119970 - protein, 183 aa, Heterodera glycines
  Coding regions on vcDNA: vcDNA=SeqID_46393; Strand=+; Position=1 -65,126-524,745-829
  Homolog annotation: Hit_ID=AAA65224.1; Match level="QueryCoverage =100%, HitCoverage=46%, E-value=3e-55, Identity=46%"; Hit description= polyadenylate-binding protein
  Essential gene: C elegans homolog=Y106G6H.2a; Phenotype=Gro,Stp
TEEAANSANAKVNAMLLDGKKVFVGKFLPRSARDKQIGDPSSRFTNVYVKNFGDAMNSEKLSEVFSQFGEIISAKVMEDDSGKSKGFGFVAYKDHESAARAVEKMNEVSVPGSEKVEQKFTVCRAQKKSERQAELKRRYEQYKAERIQRYQGVNLYVKNLHDTINDETLRSNFESYGNITSAK

SEQ ID NO: 119971 - protein, 103 aa, Heterodera glycines
  Coding regions on vcDNA: vcDNA=SeqID_46394; Strand=-; Position=1 -31,74-154,203-354
  Homolog annotation: Hit_ID=CAE61462.1; Match level="QueryCoverage =98%, HitCoverage=66%, E-value=8e-34, Identity=50%"; Hit description =Hypothetical protein CBG05354 [Caenorhabditis briggsae]
  Essential gene: C elegans homolog=F36A4.10; Phenotype=Bmd,Dpy
QVIPGENGPPGEPGPVGPPGEPGPVGPPGPPGKVGQPGKDGAIGPKGRNGPEGRNGPEGIPGPNGFSGPPGPNGPPGKSGEKGICPKYCAMDGGVFFEDGTRR

SEQ ID NO: 119972 - protein, 225 aa, Heterodera glycines
  Coding regions on vcDNA: vcDNA=SeqID_46395; Strand=+; Position=1 -111,155-350,397-569,888-986,1035-1130
  Homolog annotation: Hit_ID=CAE72561.1; Match level="QueryCoverage =69%, HitCoverage=21%, E-value=2e-27, Identity=46%"; Hit description =Hypothetical protein CBG19745 [Caenorhabditis briggsae]
  Essential gene: C elegans homolog=K05C4.6; Phenotype=Dpy,Emb,Rup
MAKEEAIVCGALEALVPLLAPQTAIPQSGPNPKLQAMVADSLYFLLLDNLQCKLTFLSLQGPRYLVEILKSNPGYVKLFYAVVRCIRSISTCAENKASLIAIGGLELLHRAFNFIDDDKRKLTTLSAIRNLSDVATNLETLAPLVAELVSLIADHNDEELSLLSTQRPPIVKAALGLVRNCSLSNENLKLILSEKNADGETVLSLSVALLEQSGKQLAHELERSL

SEQ ID NO: 119973 - protein, 43 aa, Heterodera glycines
  Coding regions on vcDNA: vcDNA=SeqID_46396; Strand=+; Position=1 -63,530-595
  Homolog annotation: Hit_ID=CAA24918.1; Match level="QueryCoverage =100%, HitCoverage=41%, E-value=1e-13, Identity=86%"; Hit description= unnamed protein product [Homo sapiens]
  Essential gene: C elegans homolog=ZK131.1; Phenotype=Unclassified
MSGCGKGGKGLGKGGAKRHRKGTRYNIQGITKPVIRRLARCGG

SEQ ID NO: 119974 - protein, 181 aa, Heterodera glycines
  Coding regions on vcDNA: vcDNA=SeqID_46397; Strand=+; Position=1 -222,306-434,488-682
  Homolog annotation: Hit_ID=CAE65896.1; Match level="QueryCoverage =90%, HitCoverage=27%, E-value=1e-80, Identity=82%"; Hit description =Hypothetical protein CBG11063 [Caenorhabditis briggsae]
  Essential gene: C elegans homolog=C38C6.6; Phenotype=Lva,Lvl,Mlt,Unc
MALIHLMALNRKLKLLENTDGNLCRATDERTYKLTTKLCPPPEDPNFTLCSTFTKSVWQKDYWQKQGAIDVWMKFFERAPNRAEMEKEFFSQLDNPLLGKAFKLAIIGEWLAANSLDQGSYTPTNSELLEFWVSKRAPDRLLACEHGVVDYEIEGSKVKTNVLFEAATTAGNVKGQNDGSN

SEQ ID NO: 119975 - protein, 344 aa, Heterodera glycines
  Coding regions on vcDNA: vcDNA=SeqID_46398; Strand=+; Position=1 -160,287-372,433-550,610-797,930-1008,1104-1244,1295-1449
  Homolog annotation: Hit_ID=CAE66704.1; Match level="QueryCoverage =95%, HitCoverage=38%, E-value=9e-84, Identity=50%"; Hit description =Hypothetical protein CBG12049 [Caenorhabditis briggsae]
  Essential gene: C elegans homolog=T21E3.1; Phenotype=Ste
KDETRVVLRFPSFGDDPSADSFIHANYVRSPVLFNDFIVTQAPMSNTISDFWRMVWQEKVCYIFMLISRKESKRCAPYWPKNSKPLALHGLTISKPLALHGLTIQNEGIETSSRDPFFRVTKIRIIGPDNTELRLEHWQADMNNSLRLEHWQADMNNSENVEAPLRLLRLSRSCTAPTIIHDHLGISRAACLVAAEICICQLIRGGPIQYIVQNAVHYLRSFRPFSVETPMQYIFIHRVVQHFIHRVVQHFIRPFVGIPSGFEQDYIRWLDERSQRLFVDDFDREVSNYRLLSRLLSPRVDPDMLPLVRRRERPELRREMHAPVGELPLPADGMRTLRRYAIQS

SEQ ID NO: 119976 - protein, 278 aa, Heterodera glycines
  misc_feature (5)..(5): Xaa can be any naturally occurring amino acid
  Coding regions on vcDNA: vcDNA=SeqID_46399; Strand=+; Position=1 -170,226-426,467-614,671-808,856-908
  Homolog annotation: Hit_ID=AAH64253.1; Match level="QueryCoverage =87%, HitCoverage=40%, E-value=1e-60, Identity=51%"; Hit description =Hypothetical protein MGC76249 [Xenopus tropicalis] ref|NP_989348.1| hypothetical protein MGC76249 [Xenopus
  Essential gene: C elegans homolog=C55A6.9; Phenotype =Bmd,Emb,Lva,Lvl,Unc
LRGMXWKLFLRMGVFHSSAHFLTKFRRSVVCRVKYGNTLPDLPFEPKFLQSPFISFRFIGYKPSSLEFRFIGYKPSSLEKCFKYELLTEPDLNVKIDLIDPMTYYCEPDEKTTLDPIDEQLLEDENTSQLNTRRSIQHRKVVPWMRSIQHRKVVPWMRKTEYISTEFSRYGIGHERPDTKIGYGMKNRIKDEFEYKFEYKDRDSQIAAIQRTFSEVQKPVRHHYSKKGVTAVEEMPIFPDFELWRYPFAPVIFDADPLPFELWRYPFAPVIFDADPLP

SEQ ID NO: 119977 - protein, 150 aa, Heterodera glycines
  Coding regions on vcDNA: vcDNA=SeqID_46400; Strand=+; Position=1 -60,153-545
  Homolog annotation: Hit_ID=XP_396561.1; Match level="QueryCoverage =86%, HitCoverage=54%, E-value=9e-49, Identity=70%"; Hit description =similar to ENSANGP00000006082 [Apis mellifera]
  Essential gene: C elegans homolog=H27M09.2; Phenotype=Emb
MADDDAETFKLWRVRKTVMQMCHDRGYLVTQDELDQTLDQFKDQFGDRPSERRPGRGELTILVAHNDDPTGESYREGALLKCRFLDQMYVFFPDDPKIGIKTIKQICQQMQEQNITRAIIVVQSGMTPSAKQVEKFDWEKCWLMNHSFII

SEQ ID NO: 119978 - protein, 111 aa, Heterodera glycines
  misc_feature (7)..(7): Xaa can be any naturally occurring amino acid
  Coding regions on vcDNA: vcDNA=SeqID_46401; Strand=-; Position=1 -43,410-616,936-1020
  Homolog annotation: Hit_ID=CAE59733.1; Match level="QueryCoverage =96%, HitCoverage=31%, E-value=3e-27, Identity=57%"; Hit description =Hypothetical protein CBG03169 [Caenorhabditis briggsae]
  Essential gene: C elegans homolog=F07H5.2; Phenotype=Unclassified
SKALHVXKLPSYCLEALSIDSARGVSINAHNASGQNTASLNLQADGRANVMCERFEVVDRQMNVLFSVDSQEIGLNLENLRILDDGGSIFEGAIQTSIVRPEPDSPLRWGG

SEQ ID NO: 119979 - protein, 103 aa, Heterodera glycines
  Coding regions on vcDNA: vcDNA=SeqID_46402; Strand=+; Position=1 -67,131-373
  Homolog annotation: Hit_ID=CAE63623.1; Match level="QueryCoverage =96%, HitCoverage=34%, E-value=1e-23, Identity=50%"; Hit description =Hypothetical protein CBG08117 [Caenorhabditis briggsae]
  Essential gene: C elegans homolog=T04G9.4; Phenotype=Gro,Prz,Unc
VTEQCFCKRWAFSLKKSMESENFERHFRLAVQSVTAEDYEKMRQYRHREDSLATLAGRLFLRKAVQCLCGVRWADIEISRTERGKPFIVRPENISIGLNVSHQ

SEQ ID NO: 119980 - protein, 91 aa, Heterodera glycines
  Coding regions on vcDNA: vcDNA=SeqID_46403; Strand=+; Position=1 -93,149-260,563-770
  Homolog annotation: Hit_ID=CAD91446.1; Match level="QueryCoverage =83%, HitCoverage=40%, E-value=8e-13, Identity=42%"; Hit description =signal sequence receptor beta-like protein [Crassostrea gigas]
  Essential gene: C elegans homolog=T04G9.5; Phenotype=Emb
IFNYTSPWVTYYVTEDAKQATFGYSTAPGEGNIYRLKDYERRFSSKIGIWLVFLLLALPTTLLPFFLWYKFQQKYATKSGTSGQQNSKKAQ

SEQ ID NO: 119981 - protein, 38 aa, Heterodera glycines
  Coding regions on vcDNA: vcDNA=SeqID_46404; Strand=-; Position=1 -114,169-171
  Essential gene: C elegans homolog=Y73B6A.5a; Phenotype=Ste
MDGPEPYSTRSDVYSFGICVYELLTSRLPYEEIKNRDQ

SEQ ID NO: 119982 - protein, 246 aa, Heterodera glycines
  misc_feature (245)..(245): Xaa can be any naturally occurring amino acid
  Coding regions on vcDNA: vcDNA=SeqID_46405; Strand=-; Position=1 -146,193-231,278-377,430-501,605-667,719-847
  Homolog annotation: Hit_ID=CAB58173.1; Match level="QueryCoverage =95%, HitCoverage=55%, E-value=1e-36, Identity=36%"; Hit description =putative nucleosome binding protein [Anisakis simplex]
  Essential gene: C elegans homolog=D2096.8; Phenotype =Gro,Pvl,Rup,Stp,Unc
VRLSILIRFPHFPFGFSLFFHFAENPYFTNAVLTKHYEVNLDVDPQKPFSYDGPTIVKSQGFSYDGPTIVKSQGCDIDWKDGKCDIDWKDGKNVTQKIVKKKQKKGAQAGKYVTKTVTNESFFNFFDPKVTTITEVTNESFFNFFDPKVTTITEEMVSGDDIEEQKTNDDFEVGQIIREQLIPRAVLFFTGEAAEEDEYDEFQLIPRAVLFFTGEAAEEDEYDEFDDEEEMGDEQSEEEDNAMHXR

SEQ ID NO: 119983 - protein, 55 aa, Heterodera glycines
  Coding regions on vcDNA: vcDNA=SeqID_46406; Strand=+; Position=1 -39,311-439
  Homolog annotation: Hit_ID=XP_528980.1; Match level="QueryCoverage =78%, HitCoverage=21%, E-value=2e-10, Identity=74%"; Hit description =PREDICTED: similar to H3 histone, family 3B [Pan troglodytes]
  Essential gene: C elegans homolog=ZK131.7; Phenotype=Emb,Gro
MPPARGSRTVTVQEASEAYLVRLLENTNLAAANANRVTIMPSDIQMSRHIRGETL

SEQ ID NO: 119984 - protein, 158 aa, Heterodera glycines
  Coding regions on vcDNA: vcDNA=SeqID_46407; Strand=-; Position=1 -129,647-789,914-1007,1082-1189
  Homolog annotation: Hit_ID=NP_496980.1; Match level="QueryCoverage =96%, HitCoverage=38%, E-value=9e-26, Identity=39%"; Hit description =kinesin light chain-like protein (45.3 kD) (2O626) [Caenorhabditis elegans] emb|CAA22452.1| Hypothetical
  Essential gene: C elegans homolog=Y54G11A.8a; Phenotype=Gro
MAFSIKQLFSFNRTDVLDDDPLKDKVKRAMLHRKYGEWAAAVQVLNEALNEAVELGNEIFVSRMYYELATTFWESGQLENAEHLLKLLHGRYLTLHRSSGLSPEVIENSLRLADVYTRMGKLDVAEDAYKYCLTTQMEVMEKHLAEYHVARGAMVEID

SEQ ID NO: 119985 - protein, 734 aa, Heterodera glycines
  Coding regions on vcDNA: vcDNA=SeqID_46408; Strand=+; Position=1 -25,157-257,454-497,563-700,805-856,1212-1446,1792-2052,2520 -2607,2956-3235,3727-3963,4681-4818,5170-5427,5972-6213,6812-6902
  Homolog annotation: Hit_ID=NP_492127.1; Match level="QueryCoverage =100%, HitCoverage=88%, E-value=0.0, Identity=33%"; Hit description =EGF motif related, Low-density lipoprotein Receptor Related (lrp-1) [Caenorhabditis elegans] emb|CAA98124.
  Essential gene: C elegans homolog=F29D11.1; Phenotype =Bmd,Dpy,Lva,Lvl,Unc
DEGGRCSRDLCVADRAGCQYKCHNSPEGPICSCPLGEQLINKTKCEPENECLDPRTCSQHSQHCTDEKHGFRCSCDPAYELEPDKRTCKVTENRADMRVYVSNRNRIYIYWSDSSLENWRTFAAQVENAVALAWDSVDDRIYWSDIRDKRIYSATRNGTDVQTFIGIGLDITEGIAVDWVGRNLYWVDSSLNTIEIASLQKPGVRAVLLHDDIDQPRGLAVDPRVALMFWTDWGQHPRIERANMDGTGRTILVNTKIYWPNSIALDFTTNRVYFADSKLDYIDFVNYDGKGRTQVIANSKFVQHPHAMSIFEDFIYYSDRRLQRLQLYPKYPNGTNQDYPSHTFSKALGVVTVHPVLQPKLMTTSACSVSPIPCSHICALGNNGTYTCICPSGMVLDTDKHRCVADHRPFLLMVFKTMITGTSLAGGAKDSTAKQRAEMAGITPISGLQNAHDADFDAQTQKLFHLEHGSMARLVMATVISDARIYKSGFLGNNRTQLLTAQIPNDPFCMAYDWNGRNLYVGNKISQTIEVVRTEGEQFRAVILHNDQTPTAVAQPIAIAVDSDRGLLFWLDQGKGGVATKVARADMDGGNPLVLVNIDLAELDHLALDTVNHRVYFTEAKAGRITSVSYEGQDKHYLLNDPAKQPRAIAFFNNRILYSDSAFDKIFAGEFVGDEQPPEFSEFRANVEQLNNLKIIHPSTEKHPCHENNGNCDQLCIPGQRGEITCLCGTSFTL

SEQ ID NO: 119986 - protein, 208 aa, Heterodera glycines
  Coding regions on vcDNA: vcDNA=SeqID_46409; Strand=+; Position=1 -105,176-302,539-819,1163-1276
  Homolog annotation: Hit_ID=NP_996950.1; Match level="QueryCoverage =79%, HitCoverage=27%, E-value=1e-23, Identity=35%"; Hit description =senescence downregulated leo1-like [Danio rerio] gb|AAH66443.1| Senescence downregulated leo1-like [Danio
  Essential gene: C elegans homolog=B0035.11; Phenotype =Bmd,Emb,Gro,Stp,Unc
MTHRKMTMNMAEKTNKAQKVKVLAQVGDNPEAERRELIRTEEEKLRAAARREAQQRRIRERPRMAGLTPGFLEGYESDEGGESLAAIKRRYQHAPYSAGGAHDGGAAGRRSSMAGGRGGSSDESAEEEERDRRARKAINEAKIYSDDEEEVGGASGTGPINGDGAGDDSDAFQKILNNAPFLVHFVFGSKGLTDLTTTGSEAVPPITV

SEQ ID NO: 119987 - protein, 441 aa, Heterodera glycines
  Coding regions on vcDNA: vcDNA=SeqID_46410; Strand=+; Position=1-1326
  Homolog annotation: Hit_ID=NP_498735.1; Match level="QueryCoverage =95%, HitCoverage=100%, E-value=1e-47, Identity=30%"; Hit description= predicted CDS, putative cytoplasmic protein family member (3J53) [Caenorhabditis elegans] gb|AAK84536.1|
  Essential gene: C elegans homolog=F19G12.2; Phenotype=Unclassified
MTFHKIDASSIDSITNAVDFFSIPPTNVTVSSSKVFEILLSNPLTDTPYHFKIHSSQNYIDLSKCYILTEFRMRKLTSPNGEWGYLDATDQVVPIQLIGHTFIRDMKIAINGREIFNSNSLMAYKTYLSHELSQSLEAKVSHLTAAGYDREDANNLQNANSEGFKSRRQRYLGGRTAQYIAKIDADLFNVPQYLINHCEIDITIQPHDDNFLLIDTLDPPGQPYSIELVGLKLYCKKVSLMDGLALELAKKLEMKPARYAVRKTMMKALFISPGRYEFNANLFMDQVPRRVTMGLVANSDYVGNIKRSPFNFQHFNVRELSVVANGRSYPQAPYDIDYENWKFVRPYNDTQEALGFANSTYGNGIDYFSFLHTHCIYVFNMTNSGDDHGGLFDLIKKGCTAVNIKFKKPVPDGGITLIVMGEADSIYFLDKNRTIATDTTI

SEQ ID NO: 119988 - protein, 227 aa, Heterodera glycines
  Coding regions on vcDNA: vcDNA=SeqID_46411; Strand=-; Position=1 -121,245-370,433-869
  Homolog annotation: Hit_ID=CAE66920.1; Match level="QueryCoverage =28%, HitCoverage=28%, E-value=5e-17, Identity=54%"; Hit description =Hypothetical protein CBG12308 [Caenorhabditis briggsae]
  Essential gene: C elegans homolog=F27C1.2a; Phenotype=Sma,Stp
MDGRNHNHAHHHESHVQISTTSLPPANPIDGIVNSLPDLNAFISVHSHGHHHHDHGHAMKMFFHGGFREVILFDFWRTETFYGLFFSLILVFMMAVLYEGAKWFRVYFQLWVSFDSICLPFLYPLKSFKTSVSQKSSGCISMDAVRGKFRRSQHGVEAALIEKATAAVTNSSASGCNACDGTADDSLKNTIGSQQQVYAPTVVRPAPISPNMTINRWTYRTLLLICS

SEQ ID NO: 119989 - protein, 120 aa, Heterodera glycines
  Coding regions on vcDNA: vcDNA=SeqID_46412; Strand=+; Position=1 -109,480-731
  Homolog annotation: Hit_ID=CAA60629.1; Match level="QueryCoverage =99%, HitCoverage=99%, E-value=1e-50, Identity=80%"; Hit description =unnamed protein product [Acanthamoeba sp. 4b3]
  Essential gene: C elegans homolog=F25B5.4a; Phenotype=Emb
EGIPANDQRLIFAGKQLEDGRTLADYGVQKEAKIHLVLRLRGGMQIFIKTLTGKVITLEVDSMDSVENVKRKITDKEGIPADHQRLVFAGKQLEDGRTLADYGVQKEATVHLVLRLRGGG

SEQ ID NO: 119990 - protein, 127 aa, Heterodera glycines
  Coding regions on vcDNA: vcDNA=SeqID_46413; Strand=+; Position=1 -70,122-255,357-510
  Homolog annotation: Hit_ID=NP_494781.1; Match level="QueryCoverage =99%, HitCoverage=26%, E-value=2e-33, Identity=57%"; Hit description =. protein (50.8 kD) (2E714) [Caenorhabditis elegans] gb|AAA83580.1| Hypothetical protein ZK430.7 [Caenorh
  Essential gene: C elegans homolog=ZK430.7; Phenotype=Lva
MKVKVISRHPDEYQRETKHDIFKVPRNPRNYAAPPDPFQQQVEYTRALNAAKLERMFAKPFLAAFDGHNEAVNLLVVNLLVKHPTRLSTVLSGARDGQVRVWHLATRRCLHVLQAHSGPINGLSVDA

SEQ ID NO: 119991 - protein, 299 aa, Heterodera glycines
  Coding regions on vcDNA: vcDNA=SeqID_46414; Strand=-; Position=1 -128,174-208,251-402,465-549,660-829,880-936,993-1079
  Homolog annotation: Hit_ID=NP_509673.1; Match level="QueryCoverage =97%, HitCoverage=45%, E-value=8e-81, Identity=53%"; Hit description =phosphatidylserine synthase 1 (58.7 kD) (XK585) [Caenorhabditis elegans] emb|CAA87373.1| Hypothetical pro
  Essential gene: C elegans homolog=ZC506.3; Phenotype=Sma
CTDVRVNCSDVLERLWGMDIFAVGHFLGWAMKALLIRHSIICWYISIWWELTECWYISIWWELTEIVFSHLLPNFQECWWDAIIIVFSHLLPNFQECWWDAIILDVLLCNGLGICCGLWICRCLEMQQFHWESIKNIRTLRGKNIRTLRGKLKRVVLQFTPESWITVNWLQTLVTLVGLKRCIAIYAFIMVWLATELNVFFLKHVLAIDTSHPIVFWHIIFIGLIAAPTIRQYYLYVTDPQYYLYVTDPKIKRMGMQCWLYLAICALEASILYLAICALEASICVKFGREQLPAIKLWL

SEQ ID NO: 119992 - protein, 217 aa, Heterodera glycines
  Coding regions on vcDNA: vcDNA=SeqID_46415; Strand=-; Position=1 -161,241-733
  Homolog annotation: Hit_ID=NP_500944.1; Match level="QueryCoverage =87%, HitCoverage=60%, E-value=4e-16, Identity=30%"; Hit description =putative cytoplasmic protein family member (4H15) [Caenorhabditis elegans] gb|AAC48087.1| Hypothetical pr
  Essential gene: C elegans homolog=F19G12.2; Phenotype=Unclassified
MRVKAYMMTEWGFQKDVKKGLCEASCYYVDDVDQDDYTNSGLKTERHVLLMGPIIHRNTDDFLIIAPSYVSGNAVIANPHTYHINIHDIRIYIKTVDVTQALNNVISNQLQTTPAKYPMRKIEIRSLFIPRGTSDLSHNVFTSIVPRRLIAGFVSTGAYTGNPKESPFVFEHAKIRSISVEANGNIFPGSPYSLNFDRNKYIRAFVDMYTGLGMDDG

SEQ ID NO: 119993 - protein, 403 aa, Heterodera glycines
  Coding regions on vcDNA: vcDNA=SeqID_46416; Strand=-; Position=1 -31,173-1353
  Homolog annotation: Hit_ID=NP_508269.1; Match level="QueryCoverage =95%, HitCoverage=57%, E-value=8e-43, Identity=29%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTTLKKIDTANNQFCDLNKTFLYLSTSIERKDKSNWIPITKDSEADQHVGVIQNFGHSFVKTLKVSISGVESYDSGIYYAFRAYMMTELGFSEDVKKGLCEASCYYVDDVDQNDYTNSGFKNRASRFADGAKCETMVKLNFDLGRQPNLLLNNSDVIFSIHRNTDDFLIMAPPYVSGNAVIANPHTYRINIHDIRIYVKTVDVTQSLNNVISNQLQTTSAKYPMRKIEIRSLFIPRGTSDLSHNVFTSIVPRRLIVGFVSTGAYTGNPKESPFVFEHAKIRSISVEANGNIFPGSPYSLNFDRNKYIRAFVDMYTGLGMDDGERTMSINIQKFVNGWCFFVIPMTSTLEDTPGFELIRNGTTSIKVQFNEPIKDGGYEMIVLGEFDSILSINANRVLSSDGSI

SEQ ID NO: 119994 - protein, 78 aa, Heterodera glycines
  Coding regions on vcDNA: vcDNA=SeqID_46417; Strand=-; Position=1 -156,569-646
  Homolog annotation: Hit_ID=NP_725894.1; Match level="QueryCoverage =67%, HitCoverage=45%, E-value=4e-18, Identity=75%"; Hit description =CG9291-PA, isoform A [Drosophila melanogaster] ref|NP_523794.1| CG9291-PB, isoform B [Drosophila melanoga
  Essential gene: C elegans homolog=Y82E9BR.15; Phenotype=Emb,Lva
MSSSDLLAHNSSTSGSSSGATDKLAVFGGCEGPDACYVMLVSSDGHEFVIRKEHALISKTIRAMLSGPGQYAESETNE

SEQ ID NO: 119995 - protein, 382 aa, Heterodera glycines
  misc_feature (380)..(380): Xaa can be any naturally occurring amino acid
  Coding regions on vcDNA: vcDNA=SeqID_46418; Strand=-; Position=1 -159,322-405,1051-1229,1367-1535,2077-2261,2433-2494,2522-2746
  Homolog annotation: Hit_ID=CAE70001.1; Match level="QueryCoverage =95%, HitCoverage=53%, E-value=2e-84, Identity=45%"; Hit description =Hypothetical protein CBG16408 [Caenorhabditis briggsae]
  Essential gene: C elegans homolog=B0395.3; Phenotype=Unc
MMINSFVELFNTSPPPPQTLPSLPVPPLAQTTEKFLKFAEPLLSEAEFSTTVNLVNCFLESKEANELQRLLEQRGRKLVNWLTPWWLNVAYLAARTPLPIVTSPGITFPKFDFAVPGTEAQLQCAAKMVQAALKYHHKIINDQLPVDKAGGVPFDMSQYRLMFGTTRIPGHGTDTIRYGKDRPSWARHILVTRDGRTFHVPVYDGAGNPLTIGQLVAQLGHVIDQQQGKKARAINIVSSDGREMWATVYARIRGKERDPTELGLVEDALFVMSLDRSASASLQFDPDDRNMAQALHGGGTRQNSLDRSASASLQFDPDDRNMAQALHGGGTRQNANNRWFDKTLQFHLNECGYGGITYEHTPAEGPPLAMLLDFICEQLXGN

SEQ ID NO: 119996 - protein, 108 aa, Heterodera glycines
  Coding regions on vcDNA: vcDNA=SeqID_46419; Strand=+; Position=1 -162,325-489
  Homolog annotation: Hit_ID=NP_728118.1; Match level="QueryCoverage =93%, HitCoverage=35%, E-value=1e-15, Identity=39%"; Hit description =CG32495-PC, isoform C [Drosophila melanogaster] gb|AAN09450.1| CG32495-PC, isoform C [Drosophila melanoga
  Essential gene: C elegans homolog=M176.2; Phenotype=Emb,Lva
DAIKNPDNYVLKPSEEGGGNNFWGKKITEKLQTFTKQQLSAYILMQRLKPLKIKNYLVRPHKRPVKLVEAVSELSTFGYLIADGDTVYKNVSDGHMVNDGGIFKKVQY

SEQ ID NO: 119997 - protein, 204 aa, Heterodera glycines
  Coding regions on vcDNA: vcDNA=SeqID_46420; Strand=-; Position=1 -562,1397-1450
  Homolog annotation: Hit_ID=NP_509377.1; Match level="QueryCoverage =98%, HitCoverage=39%, E-value=2e-26, Identity=36%"; Hit description =predicted CDS, reverse transcriptase like family member (XI784) [Caenorhabditis elegans] gb|AAB37984.1| H
  Essential gene: C elegans homolog=ZK250.3; Phenotype=Clr,Lvl,Sck
FADDVKLYVSYKKRNERIKLNTALQNIENWASLNGLKISPDKTFIIFFGKNNSKQQYKLCNKIINEVESINDLGVLIDNKLKFSDHYLKITKAAYLRIRYIAKFLKSRSIRVWTTVYKTYIRPLLEYAPEIWNPKLKKDIIKIERCQKYFTKALFKCRLIPYIPYQQRLSFFKIQSLEERRKVIDLKLNKNFVFGKFFLKIFMT

SEQ ID NO: 119998 - protein, 261 aa, Heterodera glycines
  Coding regions on vcDNA: vcDNA=SeqID_46421; Strand=+; Position=1 -189,235-399,443-593,881-1013,1059-1154,1201-1252
  Homolog annotation: Hit_ID=NP_495784.1; Match level="QueryCoverage =77%, HitCoverage=34%, E-value=2e-29, Identity=39%"; Hit description =component of the meiotic and mitotic spindle poles, ZYGote defective : embryonic lethal ZYG-9 (156.2 kD)
  Essential gene: C elegans homolog=F22B5.7; Phenotype=Emb
MTQISFVAASATKCVMLFAKGLGAKFTPHVSFVVPVIFDKFKGKKQLLRDALVECIDVIAANTSFGKLSKALLNALTSKQNLSQKSQTDLFIYRLFRSLPAKDVPKGLLKDLVAILSKHGFDAASEVRDSSFAALGAIMKCIGERDLCCFISLELAKDANKMAKIAEKQWHSHFPCANVKIYKLSQFKAIAAAELQKSTPVQNSPADLWAPFHFLMPGYLSTRAVFQCGTFWHVEMHAPRSSSAKMENKHFNCSIANAFPL

SEQ ID NO: 119999 - protein, 186 aa, Heterodera glycines
  Coding regions on vcDNA: vcDNA=SeqID_46422; Strand=+; Position=1 -165,332-415,470-781
  Homolog annotation: Hit_ID=NP_494712.1; Match level="QueryCoverage =84%, HitCoverage=50%, E-value=2e-78, Identity=93%"; Hit description =proteasome Regulatory Particle, Non-ATPase-like, S13 (34.6 kD) (rpn -11) [Caenorhabditis elegans] gb|AAC26
  Essential gene: C elegans homolog=K07D4.3; Phenotype=Emb
MERLLRLGGLSGLGAGSLNATPHDSNQVDTSETVYISSLALLKMLKHGRAGVPMEVMGLMLGEFVDDYTVNVIDVFAMPQSGTGVSVEAVDPVFQAKMLDMLKQTGRPEMVVGWYHSHPGFGCWLSGVDINTQQSFEALSDRAVAVVVDPIQSVKGKVAFLISLPVKLHFRLSSMLFALLTHRQLH

SEQ ID NO: 120000 - protein, 127 aa, Heterodera glycines
  Coding regions on vcDNA: vcDNA=SeqID_46423; Strand=+; Position=1 -212,267-440
  Homolog annotation: Hit_ID=AAK94490.1; Match level="QueryCoverage =100%, HitCoverage=12%, E-value=5e-61, Identity=88%"; Hit description= PAZ/Piwi domain protein [Heterodera glycines]
  Essential gene: C elegans homolog=F55A12.1; Phenotype=Emb
VVHPKRSEFFLNSHVAIKGTACTPHYTVLRDENNMSMDTLQTMVHYLCFGHQIVTKPTSLPSPVYIANEYAKRGRDIYSYYAKNGIDNLELFAKRKGVEWPLRTHDDMTKVLSFLNTKDLRELRINA

SEQ ID NO: 120001 - protein, 120 aa, Heterodera glycines
  Coding regions on vcDNA: vcDNA=SeqID_46424; Strand=+; Position=1 -99,332-595
  Homolog annotation: Hit_ID=CAE62215.1; Match level="QueryCoverage =80%, HitCoverage=35%, E-value=7e-33, Identity=54%"; Hit description =Hypothetical protein CBG06266 [Caenorhabditis briggsae]
  Essential gene: C elegans homolog=C42C1.5; Phenotype=Lva
MKALILVGGYGTRLRPLTITQPKPLVEFANKPMIVFSVEDEPMGTAGPLALASDLLGDTEPFFVLNSDVICTFPFAEMMHYHRKHGRQGTIAVTKVSYFYVCGGCKKLKFLDLHKLTHCD

SEQ ID NO: 120002 - protein, 92 aa, Heterodera glycines
  Coding regions on vcDNA: vcDNA=SeqID_46425; Strand=-; Position=1 -85,133-180,471-614
  Homolog annotation: Hit_ID=AAH60429.1; Match level="QueryCoverage =94%, HitCoverage=26%, E-value=5e-31, Identity=65%"; Hit description =MGC68713 protein [Xenopus laevis]
  Essential gene: C elegans homolog=C10H11.8; Phenotype=Gro
VHEKNVTSVGFQVDGAWMYTGGEDCMAKIWDMRNNQLNCQRIFQVNTPVHSVVLHPNQVELIVADSTGAIYLWDLRSDRDDSLITEVDMSEF

SEQ ID NO: 120003 - protein, 358 aa, Heterodera glycines
  Coding regions on vcDNA: vcDNA=SeqID_46426; Strand=+; Position=1 -25,84-148,1110-1218,1263-1369,1466-1558,1603-1829,1976-2084,2374 -2468,2511-2754
  Homolog annotation: Hit_ID=NP_496239.1; Match level="QueryCoverage =63%, HitCoverage=37%, E-value=1e-53, Identity=43%"; Hit description =eukaryotic translation initiation factor 2A (2K709) [Caenorhabditis elegans] emb|CAA91279.1| Hypothetical
  Essential gene: C elegans homolog=E04D5.1a; Phenotype=Emb
MRYKVSYGMIPKIVLVAVSHLAITASTSLINQPAMIQLRSLSDSLEVLFSKASFTCDRCIMNWNSKGNALLVTASVDVDKSNKVSNVFFTSFSILSVKSYYGVTLNKQGPVHCVQWAPNSKEFCVCYGFMPSKVSIFNTRGDTVWELSEGHRNEVYFNPQSTILVTCGFGNIASGKMEFWNLETRSEICAFCAPHTTHFEWAPDGQHICTSTTAPRLRTDNGFKLWTYRGDFVYEQKYDREELWEPNKRRKCQNALRQFAEGIADANGALRPTASERKTAEKGRKREERDKFGRDGRGEENSDIAEEIGRYFEAEDEKGRGPSVGVEPNGQNTQRRTIAGGNGTTDGHGQLLKELAFN

SEQ ID NO: 120004 - protein, 332 aa, Heterodera glycines
  misc_feature (33)..(33): Xaa can be any naturally occurring amino acid
  misc_feature (193)..(193): Xaa can be any naturally occurring amino acid
  misc_feature (243)..(243): Xaa can be any naturally occurring amino acid
  misc_feature (325)..(325): Xaa can be any naturally occurring amino acid
  Coding regions on vcDNA: vcDNA=SeqID_46427; Strand=-; Position=1-1027
  Homolog annotation: Hit_ID=NP_510671.1; Match level="QueryCoverage =97%, HitCoverage=33%, E-value=3e-59, Identity=39%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
KESVIFPLFKKGDKFNPKNYRPISIPCSLCRVXKKILRNITNLLKNNKISEYQLVFVRNRSTTSQLITVVEDYDAIINGKNVDCIYIDFQKAFDSVPHNLLLYKLEKIGIRGKLLMWLKSFLSNRTFRVKIGDSLSSSKKVGSGVPQGSVLGPLLFLIYINDLPDALPSGVNIKLYADDVKMYISYKARSDLXIMHKALHNLFEWNKWQIKVSVQKTFLLYLGSKYKFDGNTINAVDTIRDLXVNIDYKLQFSDHINQITRNAYLRMRSLFRIIKSKSSKIWITLYKTYIRPLLEYAQEVWNPSLQKNIKKIEKCQKYFTKRVFXMQPSTNS

SEQ ID NO: 120005 - protein, 181 aa, Heterodera glycines
  Coding regions on vcDNA: vcDNA=SeqID_46428; Strand=-; Position=1 -126,192-380,483-713
  Homolog annotation: Hit_ID=XP_310552.1; Match level="QueryCoverage =95%, HitCoverage=29%, E-value=3e-15, Identity=31%"; Hit description =ENSANGP00000017318 [Anopheles gambiae]
  Essential gene: C elegans homolog=M176.2; Phenotype=Emb,Lva
MVERFFPNPEEAPLIKAIRDTFAKMWRIEGNENNQAFSELIERVKKQPNNFVMKLTEYALSDALNNNEVKKIYFGEEILEALASFDADKRSAYILMEKLRPMSVKNHIIWAEDGEESSGEDFLEDVTPELGIFGTLLGNIVNGEVLYNAQFGHQLKTKLASENARGITTGNCAFDTAYLVD

SEQ ID NO: 120006 - protein, 269 aa, Heterodera glycines
  Coding regions on vcDNA: vcDNA=SeqID_46429; Strand=+; Position=1 -366,427-606,662-778,831-977
  Homolog annotation: Hit_ID=AAP94888.1; Match level="QueryCoverage =93%, HitCoverage=77%, E-value=3e-60, Identity=46%"; Hit description =P34 [Ascaris suum]
  Essential gene: C elegans homolog=B0218.5; Phenotype=Unclassified
MTKLNTLRDGDEKHFCRCLDLGRDEQKDQQSGQMKKFNYIVMSLVGRGLDGVVKDAGGRLSLGSAVGVSIQMLAALRGLHTVGYLHRDIKPGNSTIGRPESNEIRLLYLIDFGMARKYTKDDGAHRRPRAATIFRGSPRYASIAAHLGLEYSRKDDIESWFYCMIELFKGALPWANVGETKEIGEAKIKRQKKQPEAVRHQAIADLLSGCPNEFGQVLKYIDMKYNDKPDYDWIIATLRNSLSNAGVQEFPYDWETTDKTTPQVSSYFT

SEQ ID NO: 120007 - protein, 112 aa, Heterodera glycines
  Coding regions on vcDNA: vcDNA=SeqID_46430; Strand=+; Position=1 -60,190-257,322-424,769-841
  Homolog annotation: Hit_ID=NP_495684.1; Match level="QueryCoverage =98%, HitCoverage=30%, E-value=1e-26, Identity=53%"; Hit description =ubiquitin -terminal hydrolase (2I328) [Caenorhabditis elegans] pir||T19070 hypothetical protein C08B11.7
  Essential gene: C elegans homolog=C08B11.7; Phenotype=Emb,Lva
TNEAGNWCLIESDPGLFTELISGLGVKGTQVEELYSIDDEQHLFRPIYGLIFLFKFRPIYGLIFLFKWRPGEELEGTPMPDAPVYFAQQVITNACASQALHLLLNISSSDVQ

SEQ ID NO: 120008 - protein, 446 aa, Heterodera glycines
  Coding regions on vcDNA: vcDNA=SeqID_46431; Strand=-; Position=1 -1195,1492-1637
  Homolog annotation: Hit_ID=NP_508269.1; Match level="QueryCoverage =86%, HitCoverage=58%, E-value=3e-42, Identity=29%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MAFHKIDNDSVNSITNALDFFRIPPTNVSVSSSKVFELLPSNPLTDTPYHFKLHSSQNYIDLSKCYLLTEFRIRKENVNGQLIDMKADDLHIAPIQMIGQTFIRNIKMSINGREIFNSNALMAYKTYFSHELSYSTTAKDSHLNAAGYYRDTGDALETGDGCIARRNLFANSNVAQFIAKIDTDLFNQPLYLINFCELDIEILPHDNDFVLIAPTAGAPRYHFEVLGLKMYVKKVSLMDGLALDIARKLELKPARYAVRKTMMKSMFISPGRYEFTANLFMDQIPRRVTMGLVANTDYVGTIRRSPFNFQPFNVREISIVASGRSYPQAPYDLDYPNGKYIRPFNDMNEAVGFANSSESNGITFAQYGKTHCIYVFNLTNSGDDQATLFDFDQEWDYRYFLLLQQQQQIQEYSLDQLNHQLSPPPPSQPLPQLPLALPQRLQKVKN

SEQ ID NO: 120009 - protein, 90 aa, Heterodera glycines
  Coding regions on vcDNA: vcDNA=SeqID_46432; Strand=+; Position=1 -44,361-589
  Homolog annotation: Hit_ID=CAE65161.1; Match level="QueryCoverage =84%, HitCoverage=18%, E-value=2e-17, Identity=53%"; Hit description =Hypothetical protein CBG10030 [Caenorhabditis briggsae]
  Essential gene: C elegans homolog=F58A4.4; Phenotype=Emb
MKFAYPQLDAKVTAGLNHLLKSPFSVHPENGNVAVPLSAKEIRAFDPNVVPRIDKLLAQLASLQSSQENKENQRSIGKKFYRQITRDCFY

SEQ ID NO: 120010 - protein, 252 aa, Heterodera glycines
  Coding regions on vcDNA: vcDNA=SeqID_46433; Strand=+; Position=1-757
  Homolog annotation: Hit_ID=EAK89192.1; Match level="QueryCoverage =95%, HitCoverage=3%, E-value=2e-73, Identity=55%"; Hit description =very large probable mucin, 11700 aa long protein with signal peptide and pronounced Thr repeat (308 aa long
  Essential gene: C elegans homolog=ZK945.9; Phenotype=Gro
MFYQTVCLLLLLSASNDVAVFGQEETTTTSTSSTSTSTTSSTSTSTTPTTTSSTSTSTTPSTTTSSTSTSTSTTPTTTSSTSTSTTPTTTSSTSTSTTPTTTSSTSTSTTPSTTTSSTSTSTSTTPTTTSSTSTSTTPTTTSSTSTSTTPTTTSSTSTSTTPTTTSSTSTSTTPTTTSSTSTSTTPTTTSSTSTSTTPTTTSSTSTSTTPTTTSSTSTSTTSSTTSSTSTSSTSSTTSSTSTSTTPSTTSSA

SEQ ID NO: 120011 - protein, 150 aa, Heterodera glycines
  Coding regions on vcDNA: vcDNA=SeqID_46434; Strand=+; Position=1 -116,607-778,948-1112
  Homolog annotation: Hit_ID=CAE69463.1; Match level="QueryCoverage =89%, HitCoverage=72%, E-value=1e-18, Identity=38%"; Hit description =Hypothetical protein CBG15659 [Caenorhabditis briggsae]
  Essential gene: C elegans homolog=W04B5.4; Phenotype=Lva
MDELGEQCATFSDPMPADPPKLWVAWLYTDFYGSGRKIRDQVTKLFGKDAKPGEMQVFKNTLSTNKQLWKIKHLLEIRPVTFPNGEPGQEDATHLEQAVQVELRQLIRTAFTPTHKFSPRYLASRLMSKDVTKQDVYEDTVYNPENISIG

SEQ ID NO: 120012 - protein, 56 aa, Heterodera glycines
  Coding regions on vcDNA: vcDNA=SeqID_46435; Strand=-; Position=1-320
  Homolog annotation: Hit_ID=AAQ63317.1; Match level="QueryCoverage =100%, HitCoverage=100%, E-value=3e-19, Identity=71%"; Hit description=40S ribosomal protein S29 [Hippocampus comes] gb|AAK95214.1| 40S ribosomal protein S29 [Ictalurus puncta
  Essential gene: C elegans homolog=B0412.4; Phenotype=Dpy,Emb,Ste
MVHENIHWSRPRKFGPGSRSCRVCFSHHGLIRKYSLNICRRCFREYASDIGFKKLD

SEQ ID NO: 120013 - protein, 359 aa, Heterodera glycines
  Coding regions on vcDNA: vcDNA=SeqID_46436; Strand=-; Position=1 -161,211-342,382-421,501-579,746-905,959-1138,1193-1244,1299-1357
  Homolog annotation: Hit_ID=NP_077719.2; Match level="QueryCoverage =99%, HitCoverage=55%, E-value=1e-59, Identity=29%"; Hit description =notch 2 preproprotein [Homo sapiens] emb|CAI18974.1| Notch homolog 2 (Drosophila) [Homo sapiens] emb|CAH7
  Essential gene: C elegans homolog=R107.8; Phenotype=Egl,Pvl
STEVCLNGCMNDQNGSHCQCQTGWKGQRCQEDIDECQLSEKLCQNGGKCVNTIGGFYCECPIGGFYCECPSDFVGYLCEVPHRPTDPCLANHFPCLNGAQCHENIDWRWECECLPGFDWRWECECLPGFEGKHCERAVDECDKHCERAVDECDMGMMTCLNGGKCAHAKNNYNLKKLNFIAGDFCEQDINECELGATLCKNGGTCVNRHGSYMCICVGGFSGKFCEINIDDCVDNLCYASGKFCEINIDDCVDNLCYAGSTCVDGIARYDCRCAPDRIGTKCQKFTKAINTKQLGALCDTNPFNGSYTCLCDEGWKCDTNPFNGSYTCLCDEGWKGQNCTGQNCTDDVDECSDEMTRCF

SEQ ID NO: 120014 - protein, 135 aa, Heterodera glycines
  Coding regions on vcDNA: vcDNA=SeqID_46437; Strand=-; Position=1 -43,192-339,381-569
  Homolog annotation: Hit_ID=XP_420317.1; Match level="QueryCoverage =98%, HitCoverage=18%, E-value=1e-31, Identity=51%"; Hit description =PREDICTED: similar to fatty acid Coenzyme A ligase, long chain 4; fatty acid-Coenzyme A ligase, long chai
  Essential gene: C elegans homolog=F37C12.7; Phenotype=Rup,Unc
KLLEKMGSKRINSESKLERNVEPDDLAMIMYTSGSTGKPKGVLLSHRNIITAASGQSAVISVRCTSDTIIGYLTSDTIIGYLPLAHILEVCAEIVCLSKGCRVGYSSPSTLHDRAVKIKRGTTGDCVELKPTLIA

SEQ ID NO: 120015 - protein, 122 aa, Heterodera glycines
  Coding regions on vcDNA: vcDNA=SeqID_46438; Strand=-; Position=1 -22,146-373,481-596
  Homolog annotation: Hit_ID=CAE70786.1; Match level="QueryCoverage =100%, HitCoverage=22%, E-value=5e-25, Identity=43%"; Hit description= Hypothetical protein CBG17542 [Caenorhabditis briggsae]
  Essential gene: C elegans homolog=C37H5.9a; Phenotype=Emb
NNMDPQRLSLFLLSVRSFRFSYGVRYDFSSVMHYDSKIAARQFGMKTMTAKVNPEENDAKMGQREGLSPSDAEALSKMYCRPKECVDANVYCGTWATQNRCYQNGSANVWMANNCQKSCAFC

SEQ ID NO: 120016 - protein, 510 aa, Heterodera glycines
  misc_feature (84)..(84): Xaa can be any naturally occurring amino acid
  Coding regions on vcDNA: vcDNA=SeqID_46439; Strand=+; Position=1 -33,2780-3016,3085-3220,3267-3505,3548-3685,3724-3840,3911-4323
  Homolog annotation: Hit_ID=CAE66574.1; Match level="QueryCoverage =100%, HitCoverage=33%, E-value=0.0, Identity=65%"; Hit description =Hypothetical protein CBG11891 [Caenorhabditis briggsae]
  Essential gene: C elegans homolog=T25G3.2; Phenotype=Emb,Ste
EFFLFQLFRDLSSRPPPLEPHMHSRILLNTPYGGRLVLALECGSLLFVHLKDKRLIRHKKRWSQVMYMYFLLGHRIMDSHLSVXDKQLQADNTYILAIDGDSKADNTYILAIDGDSKFEPAAVIRLLHLMNLKSDVGCACGRIHPIGEGVMVWYQKFEYAIVMVWYQKFEYAIAHWFQKAAEHVFGCVLCAPGCFSLFRASALMDDNVMHKYTKTASEPRHFVQYDQGEDRWLSTLLLKQGYRVEYAAASDAETYAPEGGYRVEYAAASDAETYAPEGFEEFFNQRRRWTPSSIANTLDLLADYKLASSNNASISRLYILYQMVVIDLLADYKLASSNNASISRLYILYQMVVIVFSLLGPAIIFTMLVYAQVAAFAVDSTRVLFYNAVPVCGFIFCCFTMDSSVQLTYAKIASVIYAFIMLAVLIATTNQIVLETVFSPTSMFVLGMVLIFSFASCIHPKEFANIIYGSIFFLMIPSTYVFLSLYSLINLNVINWGTREAVAKATGQAT

SEQ ID NO: 120017 - protein, 227 aa, Heterodera glycines
  Coding regions on vcDNA: vcDNA=SeqID_46440; Strand=-; Position=1 -10,129-253,534-601,668-782,839-891,997-1124,1265-1419,1702-1728
  Homolog annotation: Hit_ID=AAR97530.1; Match level="QueryCoverage =98%, HitCoverage=47%, E-value=1e-53, Identity=45%"; Hit description =Rhesus protein 2 [Caenorhabditis briggsae] emb|CAE64631.1| Hypothetical protein CBG09391 [Caenorhabditis b
  Essential gene: C elegans homolog=F08F3.3; Phenotype=Emb
MPCHFQDVHGTLIIGFGFLVAFLRRYGFASFTISMMLTSFTLELSLLVRGFLTDEFATNGKFYVNLQNMINADYTAAVVLISYGALCGKLSPMQYLLMALIEAPFSIFNEYILVKMLGVQDIGGSMVIHVFGAVFGLVAGRILYNKNWRESEHFGSVYHSDILTFIATGFLWVFWPSFNATNAFGVDARNRAIVNTYTALIGSTITAFILSSFFSKNEKFNIRHLTN

SEQ ID NO: 120018 - protein, 168 aa, Heterodera glycines
  Coding regions on vcDNA: vcDNA=SeqID_46441; Strand=+; Position=1 -162,799-1042,1086-1186
  Homolog annotation: Hit_ID=CAE60645.1; Match level="QueryCoverage =63%, HitCoverage=13%, E-value=3e-34, Identity=64%"; Hit description =Hypothetical protein CBG04291 [Caenorhabditis briggsae]
  Essential gene: C elegans homolog=F10G7.1; Phenotype=Gro,Pch,Unc
MGESEDGKADDEQSILSAGEESEMDAGNDDDDGTDEAARERFRQQRENLQWPDELERFMPSQGAFCATLFAPVTYPPTNVTVFLAHNSQPAELVAYGILLNVNPDRIVLKRTVLSGHPYKVNKRTAVVRYMFYNREDIEWFKPVELYTHEGRRGRIKQANWTTCQPLV

SEQ ID NO: 120019 - protein, 86 aa, Heterodera glycines
  Coding regions on vcDNA: vcDNA=SeqID_46442; Strand=-; Position=1-256
  Homolog annotation: Hit_ID=NP_492127.1; Match level="QueryCoverage =100%, HitCoverage=1%, E-value=2e-27, Identity=66%"; Hit description =EGF motif related, Low-density lipoprotein Receptor Related (lrp-1) [Caenorhabditis elegans] emb|CAA98124
  Essential gene: C elegans homolog=F29D11.1; Phenotype =Bmd,Dpy,Lva,Lvl,Unc
FRAVILHNDQTPTAVAQPIAIAVDSDRGLLFWLDQGKGGVATKVARADMDGGNPLVLVNIDLAELDHLALDTVNHRVYFTEAKAGR

SEQ ID NO: 120020 - protein, 86 aa, Heterodera glycines
  Coding regions on vcDNA: vcDNA=SeqID_46443; Strand=-; Position=1 -107,516-612,661-714
  Homolog annotation: Hit_ID=AAH70989.1; Match level="QueryCoverage =65%, HitCoverage=18%, E-value=9e-15, Identity=69%"; Hit description =MGC78865 protein [Xenopus laevis]
  Essential gene: C elegans homolog=Y6D11A.2; Phenotype=Emb
MHSRGEYVKGTTFQYHKTKLAATAVGLIGREKAYTFSKFDTVDVVFADFDGILYHASNPDGGDKSKLMLSISLKFYKELQEHGADE

SEQ ID NO: 120021 - protein, 155 aa, Heterodera glycines
  Coding regions on vcDNA: vcDNA=SeqID_46444; Strand=+; Position=1 -96,492-653,908-1117
  Homolog annotation: Hit_ID=EAL32779.1; Match level="QueryCoverage =97%, HitCoverage=24%, E-value=2e-27, Identity=44%"; Hit description =GA19893-PA [Drosophila pseudoobscura]
  Essential gene: C elegans homolog=M176.2; Phenotype=Emb,Lva
MKADKVTAIHKTFTGLYGLDDPDNENTKRVIQDAIAHPDNYVMKPSREGGGNNFWGDEIPKKLREMSRAELSGHILMQKVHAFSAPNYMVRPNERVQHGNVVTELSTFGTLLGHVKTKAVLHNAQQGHYARSKPEGATEGGVYGGGGVVDSPFLF

SEQ ID NO: 120022 - protein, 96 aa, Heterodera glycines
  Coding regions on vcDNA: vcDNA=SeqID_46445; Strand=+; Position=1 -111,489-665
  Homolog annotation: Hit_ID=AAN05591.1; Match level="QueryCoverage =94%, HitCoverage=36%, E-value=3e-23, Identity=59%"; Hit description =ribosomal protein L7 [Argopecten irradians]
  Essential gene: C elegans homolog=F53G12.10; Phenotype=Emb,Lva
MTEAKKLPEVPETLLKRRKIRAAQRAARAKNSLNTIKKAKAKKTEIFKRAEHYLVEYRQKQRQLVALKREAKKVGNYYVPDEPKLAFVVRIKGINK

SEQ ID NO: 120023 - protein, 405 aa, Heterodera glycines
  Coding regions on vcDNA: vcDNA=SeqID_46446; Strand=-; Position=1 -944,989-1263
  Homolog annotation: Hit_ID=AAS38911.1; Match level="QueryCoverage =97%, HitCoverage=95%, E-value=8e-37, Identity=32%"; Hit description =similar to Leishmania major. Ppg3 [Dictyostelium discoideum]
  Essential gene: C elegans homolog=ZK945.9; Phenotype=Gro
STSISTPSSSSTGTESSTSSSSTSTPSSTISTSTESSTSSTSISTPSSSSTITSSTSSSTPSSSSTSTSTLSFSSTTSASTTNTESSASSTGSTPSSSSTISASSPSTESSTISTSTSTPSSSSTPSTESSTSSVTSSSPTCIESTSTIFTSAESSTTRASSPITESSTVSSSSYSTPSTASTSSMAQHDQSHYMIQEYCKLVESYQKLVTKTITTMQMYETKTNEYNEVKKQNEQLEESNKQMNEQNSQMKEEKKQMEQKQIEMEKSMSETEQIKAETEKSYSQLQSDYEQMQSQCTKKEDGQVVVPKPNFPTPCSDNLMNGNCTDPSYMKTCLDPVSKQYTNSLAIISFHRRITTPCPCPNAASLAQKCAPQSLPASTFPSRSVAATPAVAAAVRKLRMESDC

SEQ ID NO: 120024 - protein, 167 aa, Heterodera glycines
  Coding regions on vcDNA: vcDNA=SeqID_46447; Strand=-; Position=1-510
  Homolog annotation: Hit_ID=NP_510671.1; Match level="QueryCoverage =97%, HitCoverage=16%, E-value=2e-33, Identity=43%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
KKIGIRGKLLMWIKDILSNRTFRVKIGDDLSSSKVGSGVPQGSVLGPLLFLIYINDLPDALPSGVRIKLYADDVKLYICYSKNRNSMHKALHNLSEWANKWQIRISIKKNFVLHLGNKNPKEIYKIDGNIINVVDTIRDLGINIDNKLQFSNHVTQIIKNAYLRMRS

SEQ ID NO: 120025 - protein, 276 aa, Heterodera glycines
  Coding regions on vcDNA: vcDNA=SeqID_46448; Strand=-; Position=1-847
  Homolog annotation: Hit_ID=NP_510671.1; Match level="QueryCoverage =98%, HitCoverage=27%, E-value=4e-36, Identity=32%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
DALPSGVRIKLYADDVKLYICYKARTETEINNLSEWANKWQIRISIKKNFVLHLGNKNPKEIYKIDGNIINVVDTIRDLGINIDNKLQFSNHVTQIIKNAYLRMRSLFRVIKSKSSRIWIILYKTYVRPLLEYAPEVWNPSLLKNIKKIEKSQKYFTKRVLFKCSLPPIPYQQRLEYLQLPTLESRRKLSDLFMAHKIIYGRTDLNPFEILKPSERFNIPFYRLNSKYKLGKKFILLRGGTKIWNQLDKKLIEINSLNQFKNKIKTISFSLNLFYS

SEQ ID NO: 120026 - protein, 206 aa, Heterodera glycines
  Coding regions on vcDNA: vcDNA=SeqID_46449; Strand=+; Position=1 -81,128-307,350-706
  Homolog annotation: Hit_ID=NP_651187.1; Match level="QueryCoverage =68%, HitCoverage=7%, E-value=1e-21, Identity=40%"; Hit description =CG10198-PA [Drosophila melanogaster] gb|AAF56190.2| CG10198-PA [Drosophila melanogaster]
  Essential gene: C elegans homolog=ZK328.5b; Phenotype=Emb
MLRSIASFYEKNVKSLDISVVYESVQQSRLNEIDDSHLSSDIQNPPSRLEFQRTPEKSTRSEPSATSAEISTHNQSPLSEIVPTQQMQPQPHPPSKEYRVKLIRPEYYCKPSAEELEECFREDGSLRIECGLTVGRVGYGSVFWKGPIQLDGPIDFDEIVHFRNKEVVVYPDETKRPEVGTGLNTAAEVSLERVWPIDPKTKQPIK

SEQ ID NO: 120027 - protein, 74 aa, Heterodera glycines
  Coding regions on vcDNA: vcDNA=SeqID_46450; Strand=+; Position=1 -141,471-553
  Homolog annotation: Hit_ID=CAE67724.1; Match level="QueryCoverage =97%, HitCoverage=24%, E-value=6e-16, Identity=48%"; Hit description =Hypothetical protein CBG13299 [Caenorhabditis briggsae]
  Essential gene: C elegans homolog=C18D11.4; Phenotype=Lva
HTSERDLKQLFGRWGEVESVQIVYDRYSGRSRGFGFVYFTNTKEAARAKDNMADVVIDGMKVRIDYSVTRGGGP

SEQ ID NO: 120028 - protein, 152 aa, Heterodera glycines
  Coding regions on vcDNA: vcDNA=SeqID_46451; Strand=-; Position=1 -192,267-345,716-903
  Essential gene: C elegans homolog=R06F6.1; Phenotype=Emb
FDFSLFDDSDFANRSWVDIIDEEERERSKSTALSTTPSVVSSSAPNKRRHILPTPQKGWAEPNKGWCTDEATLERRDKELQKMKEKPTYKQKSTHIEHRKRRKQQRSGQRGLNYGSVKCSERGQGIEMNLRIFDSGAKSDQIWTLTVRYASL

SEQ ID NO: 120029 - protein, 57 aa, Heterodera glycines
  Coding regions on vcDNA: vcDNA=SeqID_46452; Strand=+; Position=1-171
  Homolog annotation: Hit_ID=XP_522943.1; Match level="QueryCoverage =100%, HitCoverage=8%, E-value=5e-12, Identity=57%"; Hit description =PREDICTED: similar to goosecoid [Pan troglodytes]
  Essential gene: C elegans homolog=K11H12.2; Phenotype=Gro,Stp
MGAYKYMQELWRKKQSEVMRYLLRIRCWQYAKWRPSIAARGPRGRRRRAAWATRRSK

SEQ ID NO: 120030 - protein, 145 aa, Heterodera glycines
  misc_feature (10)..(10): Xaa can be any naturally occurring amino acid
  misc_feature (30)..(30): Xaa can be any naturally occurring amino acid
  misc_feature (35)..(35): Xaa can be any naturally occurring amino acid
  Coding regions on vcDNA: vcDNA=SeqID_46453; Strand=+; Position=1 -165,562-701,1341-1472
  Homolog annotation: Hit_ID=NP_499964.1; Match level="QueryCoverage =95%, HitCoverage=68%, E-value=1e-36, Identity=55%"; Hit description =ribosomal Protein, Large subunit (24.1 kD) (rpl-15) [Caenorhabditis elegans] gb|AAC24397.1| Ribosomal pro
  Essential gene: C elegans homolog=K11H12.2; Phenotype=Gro,Stp
IGQYVYMFWXKLFFAFVRFRVRDLKWVEKXMSYSXSAPMKTPEKNKKNYYFFMWQGFLIYRVRIRRGGRKRQVTKGQTYGKPKTHGVNQLKNTRSLQAVAEARAGRRLGELRVLNSYWVGQDSTYKFFEVILVDPSHKVRFVSCL

SEQ ID NO: 120031 - protein, 91 aa, Heterodera glycines
  Coding regions on vcDNA: vcDNA=SeqID_46454; Strand=+; Position=1 -63,199-411
  Homolog annotation: Hit_ID=NP_501503.1; Match level="QueryCoverage =81%, HitCoverage=20%, E-value=3e-11, Identity=41%"; Hit description =polynucleotide 5'-kinase 3'-phosphatase (46.2 kD) (4J500) [Caenorhabditis elegans] emb|CAA91035.2| Hypoth
  Essential gene: C elegans homolog=F21D5.5; Phenotype=Unclassified
MEGEENGEVRVIREDSFYVGDIRPKNDHSCADRLFALNLSLTFQTPEQFFSKVSAEEPFRLPEFNPSQFLREHSAQSVPSPFPRPPISNSN

SEQ ID NO: 120032 - protein, 163 aa, Heterodera glycines
  Coding regions on vcDNA: vcDNA=SeqID_46455; Strand=-; Position=1 -43,116-234,504-602,805-973,1309-1364
  Homolog annotation: Hit_ID=AAK26376.1; Match level="QueryCoverage =93%, HitCoverage=60%, E-value=4e-69, Identity=52%"; Hit description =beta-transducin repeat-containing protein [Heterodera glycines]
  Essential gene: C elegans homolog=K10B2.1; Phenotype=Emb,Lon,Lva,Pvl
FIKNVSNLWVYSAKIWIWSRPSLGCVQTLSGHTGSVLCLQYDNQMIASGSSDATVRIWDVNTGEQLKTLVHHCEAVLHLRFQDGMLVTCSKDRSIAVWDMASPRDIEVRRVLVGHRAAVNVVDFDHKYIVSASGDRTIKVTDRSNAKRLGTMGYGCFGVVCRQ

SEQ ID NO: 120033 - protein, 102 aa, Heterodera glycines
  Coding regions on vcDNA: vcDNA=SeqID_46456; Strand=+; Position=1 -69,130-288,432-512
  Homolog annotation: Hit_ID=NP_496488.1; Match level="QueryCoverage =69%, HitCoverage=19%, E-value=1e-11, Identity=43%"; Hit description =protein RAD23 repair 23 (2L942) [Caenorhabditis elegans] emb|CAA93780.1| Hypothetical protein ZK20.3 [Cae
  Essential gene: C elegans homolog=ZK20.3; Phenotype=Sck,Ste
MPELLFKTITQQSFTIEVEETATIGEVKRKIQQVKGAEYPAENQKLIFNGRVLEDAMLVSELNFAAPKFIVIMVMRILKSLFLVIFKLNEMRFLPTPSVQSV

SEQ ID NO: 120034 - protein, 174 aa, Heterodera glycines
  Coding regions on vcDNA: vcDNA=SeqID_46457; Strand=+; Position=1 -421,682-785
  Homolog annotation: Hit_ID=CAE57680.1; Match level="QueryCoverage =81%, HitCoverage=23%, E-value=4e-45, Identity=70%"; Hit description =Hypothetical protein CBG00674 [Caenorhabditis briggsae]
  Essential gene: C elegans homolog=K01C8.10; Phenotype=Emb,Lva,Ste
MSPSLSVANSNVSRPLGQPKVAGFKDKDKPESVRTSNIVAAKAVADAVRTSLGPRGMDKMIQSGNGEVTITNDGATILNQMSVVHPTAKMARFVLFAFINCTVQLVELSKAQDIEAGDGTTTVVVLAGSLLDAAEKLLAKGRPAIFPSLGTNGGAGSEETDEFTGGLKCQSEVD

SEQ ID NO: 120035 - protein, 96 aa, Heterodera glycines
  Coding regions on vcDNA: vcDNA=SeqID_46458; Strand=+; Position=1-6,63- 347
  Homolog annotation: Hit_ID=P53021; Match level="QueryCoverage=100%, HitCoverage=76%, E-value=7e-49, Identity=92%"; Hit description=Major sperm protein 1 gb|AAA29146.1| major sperm protein
  Essential gene: C elegans homolog=ZK546.6; Phenotype=Emb
MRVINPGTKRIGYAFKTTKPKRINMNPPNGVLGPKESVNVAVSCDAFDPGSEDTKGDRVTVEWTNTPDPAATAFKLEWFQGDGMVRRKNLPIEYNV

SEQ ID NO: 120036 - protein, 115 aa, Heterodera glycines
  Coding regions on vcDNA: vcDNA=SeqID_46459; Strand=+; Position=1 -135,197-386
  Homolog annotation: Hit_ID=CAE74082.1; Match level="QueryCoverage =92%, HitCoverage=25%, E-value=5e-34, Identity=70%"; Hit description =Hypothetical protein CBG21737 [Caenorhabditis briggsae]
  Essential gene: C elegans homolog=F56H6.5; Phenotype =Egl,Lva,Lvl,Prz,Unc
LSGLLKRLEEDCIGSAPAVMDKDDAKLEEYRARKVAMITGISGQDGSYLAEFDGSYLAEFLLAKGYQVHGVIRRSSSFNTGRIEHLYSNPMTHAVGSSFNLHYGDMTDSSCLIKL

SEQ ID NO: 120037 - protein, 783 aa, Heterodera glycines
  Coding regions on vcDNA: vcDNA=SeqID_46460; Strand=+; Position=1 -295,1235-1522,1568-1891,2032-2352,2635-2751,2809-3815
  Homolog annotation: Hit_ID=NP_508269.1; Match level="QueryCoverage =40%, HitCoverage=46%, E-value=3e-36, Identity=31%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MQNGIQKILNEAKKIDPEITTDDVNKFLEKQRTYTIHKPIRKKFPRLKTVPSGFHTDWQCDLCIFDQLKKHNDGYKYLLVCIDVLSRMIFSAPAKSKKKEPDIKIWFDKMVEMGTEIQTSRNELKSFQEEVDKAKNTTLEHVEKNDMKEAKKSADVAKGIARQAKTKYTSTLEGYNDKSEKGFNGMVVRLNEALEAEKGPQKRERLANEDVQFNYDSIDQKFIVYLSSAVTHIDLSKHLAYVLGFKNTRLFHAEEATYMPDLTGGVRQLYIYAPNLIENTIIGNQMAPLLRIVNVVDDPGSIKKYILKMTHVFFDPESVDWSSFITPQHGRGQKQYFVGSKYQRGFGFLGNVARFLTPIARNIASSAGHEGLAAGQRVLSDIAQGRDLRDAVREHSRQGLTNLTDKLQQYNQFCDLNKTFLYLSTSIERKDKSNWIPITKDSEADQHVGVESYDSGIYYAVRAYMMTELGFSEDVKKGLCEASCYYVDDVDQNDYTNSGFKNRASRFADGAKCETMVKLNFDLGRQPNLLLNNSDVIFSIHRNTDDFLIMAPPYVSGNAVIANPHTYRINIHDIRIYVKTVDVTQSLNNVISNQLQTTPAKYPMRKIEIRSLFIPRGTSDLSHNVFTSIVPRRLIVGFVSTGAYTGNPKESPFVFEHAKIRSIGVEANGNIFPGSPYSLNFDRNKYIRAFVDMYTGLGMDDGERTMSINIQKFVNGWCFFVIPMTSTLEDTPGFELIRNGTTSIKVQFNEPIKDGGYEMIVLGEFDSILSINANRVLSSDGSI

SEQ ID NO: 120038 - protein, 183 aa, Heterodera glycines
  misc_feature (26)..(26): Xaa can be any naturally occurring amino acid
  Coding regions on vcDNA: vcDNA=SeqID_46461; Strand=-; Position=1 -228,575-632,786-924,1125-1250
  Homolog annotation: Hit_ID=CAE63933.1; Match level="QueryCoverage =86%, HitCoverage=85%, E-value=3e-64, Identity=74%"; Hit description =Hypothetical protein CBG08510 [Caenorhabditis briggsae]
  Essential gene: C elegans homolog=Y48G8AL.8a; Phenotype=Emb,Lva
SLVLIFTMSVETSIVSFSFMPIFIFXNTHETARAIKHMPLKRAIRFLENVREKKEIVPFRHFNGGVGRKAQAQAWGTTQGRWPKKSAEFLLQLLRNAESNAEVKGLDVDHLVIDHIVVQAAAKMRRRTYRAHGRINPYMSSPCHIEVILTEKKDVVAKPAGALVKVKKESKKKQRRQLARGEF

SEQ ID NO: 120039 - protein, 474 aa, Heterodera glycines
  misc_feature (248)..(248): Xaa can be any naturally occurring amino acid
  misc_feature (373)..(373): Xaa can be any naturally occurring amino acid
  Coding regions on vcDNA: vcDNA=SeqID_46462; Strand=-; Position=1 -99,283-511,1497-1716,1839-1965,2175-2247,2367-2664,2803-2920,5022 -5167,5359-5426,5527-5573
  Homolog annotation: Hit_ID=NP_501127.2; Match level="QueryCoverage =94%, HitCoverage=31%, E-value=1e-98, Identity=44%"; Hit description =RNA Polymerase, Class III (C), rna polymerase (rpc-1) [Caenorhabditis elegans] gb|AAA83341.2| Rna polymer
  Essential gene: C elegans homolog=C42D4.8; Phenotype=Lva
NRKLTIFPVLSLTHLQNRVLKILPISVTDFLKNKNFFVSIITHNQDTFVIIRNNQLLCGSLDKALLGSESKCSIFYRLLCDWGEGHAIEAMWRLARISAVYFSNRGFSIGIGDVKPNVNLLQEKSVLLNTGYKICDHLNKSMRLERQKDKPDLGLVEELESKILKELSSIRDQAGKACKQYLSRKKAPLTMAQCGSKGSFINIAQMIALVGQQSISGKRPSDGFENRSLPHFERKNFCPWVADFFIAXNFYKGLQPLNFKPKFFSPKNYFLTLKIFTISLSYYYFYSLQLCQDLAVNYGNTVRTSTNEVVQFTFGDDGLDPAYMEAKDGRPLDFQHMLAQVRNTNNTRRKQFKFAVIKTVYTSNIKKEFSVKXLNFGSLVLEKLNSSEQKNRNNFNLLILHFGDRTRSRGGHSTRCRDCEPIAARRRALLNATGFSLGQMRQFLDICAMRICRATAEPGTAVGAIAATSIGNYN

SEQ ID NO: 120040 - protein, 456 aa, Heterodera glycines
  Coding regions on vcDNA: vcDNA=SeqID_46463; Strand=-; Position=1 -192,239-401,444-547,593-1279,1324-1410,1451-1585
  Homolog annotation: Hit_ID=CAE60150.1; Match level="QueryCoverage =98%, HitCoverage=64%, E-value=2e-81, Identity=41%"; Hit description =Hypothetical protein CBG03700 [Caenorhabditis briggsae]
  Essential gene: C elegans homolog=C03D6.3a; Phenotype=Unclassified
MSLFPEGFNRTGFLISAYLYEKCDMSIEMAVREFAECRPNGIYKQYYLDDLRKRYGDEDEDEMTFPGRPLWENGPISDDEFTNNGAFVMEATSNNSDVGIASNGPSSSSNNGTQMAKNITKLSGKGAPKFMDGKVVNVSYVEEPNKRRQVQDKTRLFCGYGSKVFPGSQPVSLEGPQGNNNIEFLAQEPYMVSWKADGVRWRICEEKSISNELFRYLVLIDGKYQVYAFDRDNNPFLIRSMAFIRHPRQKPLEDDDFVHDTLVDAEMVIDQNEGQQIPRLLIYDLVRFQVEDRLTKIGKIINCYKGEDLRQKPFNVRFEMIENELIRPRTEAFKAGLLKREEEPIGVRRKGFWNIESTRRLLEPGFLSCHEVDGLVFQPVNGGYVSGRCDKLLKWKPPELSSIDFRLDIKKVIRPGELPEFVGNLHVLHADKPFATIKATRQLLPYNNKIIECKFS

SEQ ID NO: 120041 - protein, 405 aa, Heterodera glycines
  Coding regions on vcDNA: vcDNA=SeqID_46464; Strand=-; Position=1 -338,749-905,959-1060,1168-1314,1406-1578,1630-1720,2142-2348
  Homolog annotation: Hit_ID=AAH75600.1; Match level="QueryCoverage =99%, HitCoverage=45%, E-value=1e-63, Identity=34%"; Hit description =Nuclear cap binding protein subunit 1, 80kDa [Xenopus tropicalis] ref|NP_001006788.1| nuclear cap binding
  Essential gene: C elegans homolog=F37E3.1; Phenotype=Lva,Sma,Unc
MDIDADGVEMKKKRMPAGEDIGPKLVNMIKKLDDQLHGASIESAIESLANVLEDNLDPYEGQIIHILYEWSVFVAFASVEAPKNARKSILFRNRVYVYCMIHSTECQTNCVTCAAYLPEKITIFSTLVGLLNVRSADFGERLLKKFMDEFHHTFTSGEYDISIRIATFLCDLCNARVVTPESIVSFMENFVDLATEENVIKSNFFVYLVLHTLPWVGTELYAKLPAKLNDIMARISLYIGKRTKPHFDMLKIWSATDYPKQEDYLDSLWSQLQNLCQNDWMERHILRTYAFFEDVLVASGAHQLPELDQHVLMTSKKHPMPHIVFRLFGKDDVMESDVVLPIPNAIERFLVEEDLHWIIDNNYLDWKLCAHSLLQYHRKDTVPLNYVIIETVFNQLFRLPAASHH

SEQ ID NO: 120042 - protein, 41 aa, Heterodera glycines
  Coding regions on vcDNA: vcDNA=SeqID_46465; Strand=+; Position=1-239
  Homolog annotation: Hit_ID=XP_376154.2; Match level="QueryCoverage =100%, HitCoverage=27%, E-value=2e-15, Identity=92%"; Hit description= PREDICTED: similar to ribosomal protein S15; rat insulinoma gene [Homo sapiens]
  Essential gene: C elegans homolog=F36A2.6; Phenotype=Lva
VEIRAEMIGYYLGEFSITYKPVKHGRPGIGATHSSRFIPLK

SEQ ID NO: 120043 - protein, 74 aa, Heterodera glycines
  Coding regions on vcDNA: vcDNA=SeqID_46466; Strand=+; Position=1 -99,568-690
  Homolog annotation: Hit_ID=NP_504050.1; Match level="QueryCoverage =91%, HitCoverage=20%, E-value=2e-09, Identity=45%"; Hit description =predicted CDS, putative protein family member, with at least 5 transmembrane domains (5E270) [Caenorhabdi
  Essential gene: C elegans homolog=R08F11.2; Phenotype=Unclassified
MAEICLAVNRCMEIASPKMARFLFEGKRIFIWMLFPAAYGLYLSIFTKSPCFSSIYIAWFSNPHIGYISGSEEN

SEQ ID NO: 120044 - protein, 438 aa, Heterodera glycines
  Coding regions on vcDNA: vcDNA=SeqID_46467; Strand=+; Position=1-1317
  Homolog annotation: Hit_ID=NP_508269.1; Match level="QueryCoverage =99%, HitCoverage=66%, E-value=3e-51, Identity=31%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MAFHKIDNDSVNSITNALDFFRIPPTNVSVSSSKVFELLPSNPLTDTPYHFKLHSSQNYIDLSKCYLLSEFRIRKENANGQLVDLAADEVAPIQLIGHTFIRNIKMSINGREVFNANSLMAYKSYFSHELSYSTAAKDSHLNAAGYYRDTGGVLEVGDGCTARRNLFVGSRTAQFMAKIDADLFNQPLYLINFCELDIEILPNDNDFVLITPPGVAAATRYHFEVVGLKMYVKKVSLMDGLALDIARKLELKPARYAVRKTLMKSLFISHGRFEFTSNLFMDQIPRRITMGLVANADYVGTVSRSPFNFQPFNVREISIIANGRSYPQAAYDLDYPNGKYVRPFNDMNEAVGFANSSESNGITLAQFGTTHCIYVFNLTSSGDDQAALFDLIRNGTTAVSIKFNQAVPAGGIMLVVMGECDSLVMLDKNRSISTDITI

SEQ ID NO: 120045 - protein, 674 aa, Heterodera glycines
  Coding regions on vcDNA: vcDNA=SeqID_46468; Strand=+; Position=1 -171,237-378,509-663,881-1015,1063-1104,1164-1315,1360-1588,1676 -1897,1949-2063,2128-2246,2313-2548,2651-2762,2817-2915,2968-3063
  Homolog annotation: Hit_ID=NP_955953.2; Match level="QueryCoverage =99%, HitCoverage=85%, E-value=1e-165, Identity=46%"; Hit description= cullin 1 [Danio rerio] gb|AAH66480.1| Cullin 1 [Danio rerio]
  Essential gene: C elegans homolog=D2045.6; Phenotype=Emb
ECQRLSGDQLLDYYTEQWTKFQFSSTVVNGIFSYLNRHWIRRNIDEAVRPGILEVYNLAVSIWKSVIFDELHHNITSAALALVEKDRNGERITTRLISGVVASYIELGINEHDPAADVGGPATAAVAQQQQQNSVVHRPSVKYQVYRNYFEQRFLEVEQRLSEERDRCQIYLDNTTMDSLMEACDTALIKHHLELFHDKFESLLTRQQNDHLGRMYTLCSRVPNGLAKLKEILKAYIEQEGKAAIQQIAREASNNPKQYIDCILKKHKLYNRLVVDSFKTDHGFVQSMDCAFRKFINNNAVTEMARNASKSSQLLVLYCDQLLRKSARNKEDEKMDEYLDQVMTVFKYIDDKDMFHAFFHKFLCKRLVYDTSASEEQERCMIAKLKHMCGFEYTSKLERLLTDVALSRDHSEQYKQQPRTSNVDFSVIVVMSNVWPLGQPVQFDIPRPLLDCIDSYTQYYTNRFNGRKLTWALQMCRGELVSTSNTFKDKYSFLCNTQQIAILMQYNERNTYTLDELHVALGTDFPADQLCAVVQSLVKTNLLKLTSADGTALTETKLDDKEQKFTFNSEFKSRKLKVDLVRAMSSARETKKESEDVQKTVDEDRKLVIQAAIVRIMKMRKSLKHQLLVAEVLNQLTTRFQPKVPIIKKCIDSLIEKEYLKRSEEDSDLYEYLA

SEQ ID NO: 120046 - protein, 102 aa, Heterodera glycines
  misc_feature (4)..(4): Xaa can be any naturally occurring amino acid
  Coding regions on vcDNA: vcDNA=SeqID_46469; Strand=-; Position=1 -102,191-274,480-575
  Homolog annotation: Hit_ID=AAH46434.1; Match level="QueryCoverage =93%, HitCoverage=68%, E-value=6e-29, Identity=47%"; Hit description =Zinc finger protein 135 (clone pHZ-17) [Homo sapiens] ref|NP _003427.2| zinc finger protein 135 (clone pHZ-
  Essential gene: C elegans homolog=F25D7.3; Phenotype=Pvl,Sma
FLLXKQCAECGKTFAHCQTLHNHRRTHTGEKPYGCEFCDKAFCEFCDKAFAQQNHLDCHRRIHTGDRPYECDFCGQRFAHSNTLVNHRRVHTGEKPYEVNYR

SEQ ID NO: 120047 - protein, 268 aa, Heterodera glycines
  Coding regions on vcDNA: vcDNA=SeqID_46470; Strand=-; Position=1 -149,200-263,353-512,557-639,896-1062,1322-1358
  Homolog annotation: Hit_ID=CAE69096.1; Match level="QueryCoverage =92%, HitCoverage=17%, E-value=9e-30, Identity=33%"; Hit description =Hypothetical protein CBG15118 [Caenorhabditis briggsae]
  Essential gene: C elegans homolog=M01E10.2; Phenotype=Unclassified
RIQTTNRSLISLFAKGFHEQRDCFAELGGLENVTLEIEAQCGMSSAESISPTGLNLSVVLIFAARRISPTGLNLSVVLIFAARRSLVTPIEHSFPIEHSFLLQCFLPSSPRSFVLNTDLDTNVPPQPISHTISLEMAPPKCNYSLRRDSPNGPMVDKAHIGQTIYDSPNGPMVDKAHIGQTIYHRWECQGGKEISEVFGMRCTADSDLLSDLQYADDRLLAVARATVFSLRESDSLRFSCKLTLCVRREAHCEGIIPPITGPLTIALL

SEQ ID NO: 120048 - protein, 98 aa, Heterodera glycines
  misc_feature (11)..(11): Xaa can be any naturally occurring amino acid
  Coding regions on vcDNA: vcDNA=SeqID_46471; Strand=+; Position=1 -25,996-1140,1197-1313
  Homolog annotation: Hit_ID=CAE71891.1; Match level="QueryCoverage =90%, HitCoverage=23%, E-value=3e-23, Identity=51%"; Hit description =Hypothetical protein CBG18949 [Caenorhabditis briggsae]
  Essential gene: C elegans homolog=W01A11.2; Phenotype=Emb
LLNPRGFDFVXIIMPLLSVIVPFCLFFYTKFWWIVCLYFVWFLYDFDTPRRGSRNWLWYLWYKNSFIWKHFADYFPIKLIKTADLPPINNYILGHDLI

SEQ ID NO: 120049 - protein, 121 aa, Heterodera glycines
  Coding regions on vcDNA: vcDNA=SeqID_46472; Strand=-; Position=1 -71,114-191,443-542,899-934
  Homolog annotation: Hit_ID=AAH14288.1; Match level="QueryCoverage =100%, HitCoverage=100%, E-value=5e-33, Identity=57%"; Hit description=Lsm2 protein [Mus musculus] ref|NP_067000.1| LSM2 homolog, U6 small nuclear RNA associated [Homo sapiens
  Essential gene: C elegans homolog=T10G3.6; Phenotype=Gro,Stp
MLFFSFFKSMVGREVIVELKNDLSICGTLHSVDQYLNMKINDISVTDVDRICGTLHSVDQYLNMKINDISVTDVDRHPHMISVKNCFVRGSVIRYVHLPTDGIDTALLQEASRKEILQSRQ

SEQ ID NO: 120050 - protein, 50 aa, Heterodera glycines
  Coding regions on vcDNA: vcDNA=SeqID_46473; Strand=-; Position=1-152
  Homolog annotation: Hit_ID=NP_495732.1; Match level="QueryCoverage =100%, HitCoverage=12%, E-value=5e-12, Identity=70%"; Hit description= disabled homolog 1 (44.0 kD) (2I519) [Caenorhabditis elegans] pir||T23752 hypothetical protein M110.5c -
  Essential gene: C elegans homolog=M110.5a; Phenotype=Emb,Gro,Slu
FPVAKISFIARDTSTDARAFGFVFGTADGKHKFYGVKTARTADHAVLSIR

SEQ ID NO: 120051 - protein, 113 aa, Heterodera glycines
  Coding regions on vcDNA: vcDNA=SeqID_46474; Strand=-; Position=1 -198,255-398
  Homolog annotation: Hit_ID=NP_492004.1; Match level="QueryCoverage =84%, HitCoverage=23%, E-value=4e-14, Identity=40%"; Hit description =tyrosine kinase (kin-14) [Caenorhabditis elegans] emb|CAA95813.1| Hypothetical protein F22D6.1 [Caenorhab
  Essential gene: C elegans homolog=F22D6.1; Phenotype=Sma
MAHRRPVKKMEPNARVPVKWLSPEAFAERCFTAKSDTWACGVMCWEIFANGEAPYGQTGGTDVAVSVINGTRLSFPKDAPSKLVEFILQHIWDAETSGRYSMAAVHDWLKRHT

SEQ ID NO: 120052 - protein, 116 aa, Heterodera glycines
  Coding regions on vcDNA: vcDNA=SeqID_46475; Strand=+; Position=1 -87,151-206,254-380,428-508
  Homolog annotation: Hit_ID=CAE64456.1; Match level="QueryCoverage =74%, HitCoverage=73%, E-value=3e-13, Identity=45%"; Hit description =Hypothetical protein CBG09169 [Caenorhabditis briggsae]
  Essential gene: C elegans homolog=C07H6.2; Phenotype=Gro
MRQSTNQTPVTRTTTTTITEQQREGGGDQTNSEQFVLRLEAPPDTRPRVQWSTGTVDNENMGKKKSKCCCIYKKKRSWDDPNASSEDDDGQTDPDSLDLYDVFFSWTNLDEYGTNR

SEQ ID NO: 120053 - protein, 241 aa, Heterodera glycines
  Coding regions on vcDNA: vcDNA=SeqID_46476; Strand=-; Position=1 -145,208-318,700-762,825-901,1049-1146,1200-1286,1480-1544
  Homolog annotation: Hit_ID=CAE65149.1; Match level="QueryCoverage =99%, HitCoverage=39%, E-value=2e-47, Identity=45%"; Hit description =Hypothetical protein CBG10015 [Caenorhabditis briggsae]
  Essential gene: C elegans homolog=C13D9.7; Phenotype=Unclassified
CSVQIPSLLLLRLTVPCASQHWSKPISALHAFMAPLLLCRVPMCAIHPFVPPFVLPFVPPFVLGELALLLSVLLALFVLCFTKLQKEPSCYRRCAAYFGFAISIAWIYATASEVMVMNVVLMFGTISGIPHQILGLTAIAWANSIGDLIADVTVARQGTPRMAFSAAIGAPLFNLMVGFGTTFLIAELQGKLMVGFGTTFLIAELQGKVIIVSDFGRVANPVALVMFVFLALSLLCTLLLL

SEQ ID NO: 120054 - protein, 350 aa, Heterodera glycines
  Coding regions on vcDNA: vcDNA=SeqID_46477; Strand=+; Position=1 -483,545-661,993-1286,1333-1491
  Homolog annotation: Hit_ID=NP_491791.1; Match level="QueryCoverage =44%, HitCoverage=96%, E-value=1e-37, Identity=50%"; Hit description =putative mitochondrial protein, with a coiled coil-4 domain, of bilaterial origin (19.1 kD) (1G786) [Caen
  Essential gene: C elegans homolog=T01B7.5; Phenotype=Lva
MDFGFLNDSTNKWGKNQRNYYGTSYVDKDFGGVNDSEEEEMLQLEEEDAISRQKKIETGNSLVDFDCLIANSTIKNKGRSKLFEVLHISVAKETPEKETAQGKPLENVIQIYFTSNNVAQIGRTFEQNVCDLQSETSTDGGNFDDGGPCVSKEMRRKINYEIRKNKGIRKDKGRRKAKQRHSRVMKRTQYEKALIKRKSQPGAPRPRVFLPDFWIKLVEQPSKGYNRLPKNAAAFEIDLKMSRMDVREYLEKIYKYPVRDVRIRVTMGDITWDHPKDRDKRRALWKEEDRKIAIVFFKKGFIAEVPDLFPGRGTDAEIDQMKKFQEQDANTFNSRFVNRGRAGIGEMLPI

SEQ ID NO: 120055 - protein, 736 aa, Heterodera glycines
  misc_feature (368)..(368): Xaa can be any naturally occurring amino acid
  misc_feature (380)..(380): Xaa can be any naturally occurring amino acid
  Coding regions on vcDNA: vcDNA=SeqID_46478; Strand=+; Position=1 -128,326-394,448-678,786-924,1095-1174,1249-1425,1477-1550,1611 -1944,2412-2654,2998-3144,3329-3593,3653-3748,3869-4003
  Homolog annotation: Hit_ID=NP_506153.1; Match level="QueryCoverage =100%, HitCoverage=37%, E-value=1e-108, Identity=34%"; Hit description=TEMO (5N87) [Caenorhabditis elegans] emb|CAA98425.1| Hypothetical protein C14C10.5 [Caenorhabditis eleg
  Essential gene: C elegans homolog=T28B8.4; Phenotype=Emb
NFLALAEKLLTIAKDENLHWRQIDFAETLLSLLLRKDCDLPEGVVLHFFKLLTSDIINTRKIASVFCSSWLKIHRQKCSSWLKIHRQKAVKEDVVIPSVGGKFLLYDAANAPSDADKWDSAKFHSNVHPGFYTWPSKFRVYAPPSEQKWVSFLYYEQILEQAIVTMFKDNKFMERFLTFFSLEKSEWTFSNSKCLSLFQRIFRSFNDILLPEFLEMLDKLLDIGHESHHRLESHHRLASELVTGMVSGSKLWQYAKVKKVQERLEQRLTDTFLGLTEEVEKNWGTALATIFGACEPRVTNFGACEPRVTNWLIQMLFGLAKRPTDNIYLPNIYLPFRRLYLLQSGLNQVRKTTFFHFLMPFVLHCLVXMANSERMAPIVXTLHGSCQRIGLFLSKCPLAYRKVNKMINEIWDKYKNRMGNRWSFFRQFADNGVPNSLSEALRSSVGVSADVPHTESALSLDGIVVTPADEHKREKLALITLLNYFSSLSTHWAQLLRPFATSIFQLIPLFSHYSNENTDEELRGCCNAQLVRYMGLSTVASAADLEELFATCTTLRERASWWKSKVCLLRFLQVFAFTNQFFISAHPNGFSALEQLIIDFLCDPRFDVRVAAAETLGGLIRAAIIAVDQQFLAKARDMANSTDPITRHSGVLALSAIVRAIVRAFPYSVPDFLPDVLMALARHSKEPHPIYKDTVKRALNEFKRTHQDEWHTHKLTFTEDQLLVLTNVMISPSYYV

SEQ ID NO: 120056 - protein, 498 aa, Heterodera glycines
  Coding regions on vcDNA: vcDNA=SeqID_46479; Strand=+; Position=1 -49,136-292,338-580,629-749,808-1007,1056-1295,1721-1823,1881-2003
  Homolog annotation: Hit_ID=NP_496176.1; Match level="QueryCoverage =91%, HitCoverage=82%, E-value=1e-115, Identity=46%"; Hit description= esterase A family member (52.5 kD) (2K387) [Caenorhabditis elegans] emb|CAA88435.1| Hypothetical protein
  Essential gene: C elegans homolog=M28.6; Phenotype=Unclassified
FGKCSPKFANVEKAFRRHRHFADGWEREGASLAIYWKGQLVVDLCGGYADKASLKRWGEETRTVLFSVTKAVAALAVQMLIDRGHAVAALAVQMLIDRGHIAYSDKISVFWPEFARNGKENITLEDVLLHRAGLAALDETVTMKAARDHVRMAQILEAQTPNWPLGTRSGYHAVTFGWLIDQIITRSGYHAVTFGWLIDQIIRRVDPQKRGISQFVREEITDKHNIDFHLGLPLSLSHTVSRIDFHLGLPLSLSHTVSRLTFPSFWYQLREFVYDPRVIVVQGVLHLRTRNSLRTRIAENATWIRIDGNTNTFNNPQLFELEQNTNTFNNPQLFELEQAAALGVSRAKDVAKIFSLMLSGELISRKSLIRLSKPQIINQIDYVMKVPFSKGHGFMFEKHPRKEGKWLFGHPGFGGSSVMMDPEEELVIAYVSNGMKSGMGELTRTFRRLKLAAFDSIKMGELTRTFRRLKLAAFDSIKAISDGRTDAKIRRNIINLTA

SEQ ID NO: 120057 - protein, 137 aa, Heterodera glycines
  Coding regions on vcDNA: vcDNA=SeqID_46480; Strand=-; Position=1 -93,331-537,1353-1466
  Homolog annotation: Hit_ID=NP_509852.2; Match level="QueryCoverage =23%, HitCoverage=8%, E-value=7e-09, Identity=81%"; Hit description =putative protein family member (39.3 kD) (XL685) [Caenorhabditis elegans] emb|CAA92025.2| Hypothetical pro
  Essential gene: C elegans homolog=W04G3.3; Phenotype=Unc
MIGNPTAMSVALFLFALSLSNIANGIVHFVQLQLTDKDKENVEKATSFTNSLLERLGLAGQNDAQQQKGDIRRQPPVSSYQTDELAALGADLAANRIDLHYDYAVVSNWVRYPVFVIARDPERFHRQHMKKVGPKGD

SEQ ID NO: 120058 - protein, 287 aa, Heterodera glycines
  Coding regions on vcDNA: vcDNA=SeqID_46481; Strand=+; Position=1 -255,306-364,407-475,517-874,926-1048
  Homolog annotation: Hit_ID=CAA11816.1; Match level="QueryCoverage =64%, HitCoverage=98%, E-value=2e-32, Identity=46%"; Hit description =histone 1 [Mytilus edulis]
  Essential gene: C elegans homolog=C30G7.1; Phenotype=Egl,Unc
MSSAPSIASPTLQAPASSQQTPKKSLTPTKASKSKSLKTAKPKAMKASKPKLPKASKPKSPKVSKSKAPKVKTAKAPSNHPSYSSMIKKAIAELKEKKGSSRTAILKYLMSHYQLGENATKVVLLEKTLKLGLKRGVVSGELKQVKGIGASGSFRLGGSGTPKTSDVKKSPKKRIAAKKPSVMKATPKKAKKAVPKKSPAAKKAKPTAAAKPEVPLPVSPAVTKSKTAKALKKDVPKKSKMAKRSPKIAKKSKTPKKATGGAKTSRKVKNVVASKSAKKDVGVDAAS

SEQ ID NO: 120059 - protein, 47 aa, Heterodera glycines
  Coding regions on vcDNA: vcDNA=SeqID_46482; Strand=+; Position=1-249
  Homolog annotation: Hit_ID=CAE62104.1; Match level="QueryCoverage =87%, HitCoverage=4%, E-value=9e-09, Identity=68%"; Hit description =Hypothetical protein CBG06138 [Caenorhabditis briggsae]
  Essential gene: C elegans homolog=M04B2.1; Phenotype=Lvl,Ste
LQLYIIYTLLGLERHLVMVRGLVTADLLAKARRKADSGRCKLCSKRY

SEQ ID NO: 120060 - protein, 212 aa, Heterodera glycines
  misc_feature (55)..(55): Xaa can be any naturally occurring amino acid
  misc_feature (201)..(201): Xaa can be any naturally occurring amino acid
  misc_feature (209)..(209): Xaa can be any naturally occurring amino acid
  Coding regions on vcDNA: vcDNA=SeqID_46483; Strand=-; Position=1 -463,711-907
  Homolog annotation: Hit_ID=NP_502173.2; Match level="QueryCoverage =59%, HitCoverage=14%, E-value=8e-40, Identity=61%"; Hit description =nuclear zinc finger protein, Mog interacting, Ectopic P granules MEP- 1, GEX (Gut on EXterior) Interacting
  Essential gene: C elegans homolog=M04B2.1; Phenotype=Lvl,Ste
CIQIKKEKKSCGFVSHRLISYQELRAHSIYVICMLCMSTPLQLFLNVINAIKKLXFILAKGNIRRPPLRTRPPPPLVGGGAAAPTSHAPTPYVCEICDLAQLTDREQYRVHLQAAHRQLLGKNNAEMASGAPLACSRCRDRFWTYEGLERHLVMVRGLVTADLLAKARRKADSGRCKLCSKRYAFNILQRLVSDHRIKVCXLHVYNCKXFNL

SEQ ID NO: 120061 - protein, 111 aa, Heterodera glycines
  Coding regions on vcDNA: vcDNA=SeqID_46484; Strand=+; Position=1 -126,338-547
  Homolog annotation: Hit_ID=BAC29807.1; Match level="QueryCoverage =59%, HitCoverage=86%, E-value=2e-17, Identity=46%"; Hit description =unnamed protein product [Mus musculus]
  Essential gene: C elegans homolog=T01D1.2a; Phenotype=Emb
MSSESDEQSADVNGLCSQSLRSDEKVCPDPDTIKMFIGQIPKPISNLGCCFVTYYHRKDAISAQNELHNVRTFPGLSHPIQMKPADVENKNGKEKANFTKLVTINLPVTVP

SEQ ID NO: 120062 - protein, 325 aa, Heterodera glycines
  Coding regions on vcDNA: vcDNA=SeqID_46485; Strand=-; Position=1 -120,187-399,443-691,743-1082
  Homolog annotation: Hit_ID=XP_321040.1; Match level="QueryCoverage =96%, HitCoverage=8%, E-value=3e-56, Identity=37%"; Hit description =ENSANGP00000022463 [Anopheles gambiae]
  Essential gene: C elegans homolog=T21E12.4; Phenotype=Emb
NESKGKILDDDSVIATLGKLRNEAQKSKKSAKTDQVMKEVVEIVSQKYYKLANACSLIYLMLHRLDEIHLLYNYSLDFLLDIFTTVLKSPQLGNVKDYDARLSIILQNLFSVMYSRVSIGMLHNDQIVMYSRVSIGMLHNDQILLASLLLRIYSRCCGAENAYEQELEQLTALPPEQVLSSAHMLMTKAFGSEFMQQDKVVNLREIILNEVQCKVQCKVPVLLCSATGYDVSNRVEDLAFELKMDILSIALGSAEGFEQADKALQSTSRSGRWILLKNVHLATEWLTQLEKKFRLHNPHPHFRLILTAEIGSALPSMSVYKLKIY

SEQ ID NO: 120063 - protein, 388 aa, Heterodera glycines
  Coding regions on vcDNA: vcDNA=SeqID_46486; Strand=+; Position=1 -636,681-1208
  Homolog annotation: Hit_ID=EAL49477.1; Match level="QueryCoverage =99%, HitCoverage=56%, E-value=3e-56, Identity=33%"; Hit description =hypothetical protein 42.t00003 [Entamoeba histolytica HM-1:IMSS]
  Essential gene: C elegans homolog=C32E12.4; Phenotype=Gro,Sck,Sma
ICREETYVRVQDSGDGRTEEATRPLTGQSKPRTDFAKKAVVQPMRQEKLSVTEQKTLLAPDEQKIREEEERKRKVEEETKRKEEERKRKEEEERKRKVEEETKRKEEEKKRKEEEERKRKEEDEKKRKEEERKRKEEEERKRKVEEEERKQKLKQDEEERKAKKKAEEEERKRKLKEEEQRKKALSEDKSAQRKSTLNMREEERIKAEQAEKESARQKARATGAVEEKSKQYTTTKTEDSFAYKRSKALEPKTVDEQKKRTFQPIQKPDPKAEEAFEKQVKKEWQWQNAVPKPIQMAELREQMRQGSRKLQSEFRDVSQGLKSASDEAKLKTKEERHRTVMDKASSAFGKAEQERRRQREQQESEAERAKREKEERESKEREKREKEK

SEQ ID NO: 120064 - protein, 288 aa, Heterodera glycines
  misc_feature (85)..(85): Xaa can be any naturally occurring amino acid
  Coding regions on vcDNA: vcDNA=SeqID_46487; Strand=-; Position=1-865
  Homolog annotation: Hit_ID=BAA88337.1; Match level="QueryCoverage =96%, HitCoverage=28%, E-value=7e-37, Identity=35%"; Hit description =ORF2 [Platemys spixii]
  Essential gene: C elegans homolog=ZK250.3; Phenotype=Clr,Lvl,Sck
FSGVPQGSVLGPSLFLIFINDLPSFITNEAASVGIKMYAYDVILYYAHENDDHSNQLDKAIEALEKWSKINRLEISTEKCFVLYXGKNNMKKEYFINSQRISESDNVRDLGIIIDTKLNFSEHIRKIVRNAYLRIFQISRVLKSREIKTLTAAYKTFVRPQLEYATEVWNPNLKKDIDKIERVQKFFTRKALRKCGFVYKKYGERLKITSLHKLEERRKINDLTTAFKIIKGFTSLDAGKSFFFSERLRRPLLLRVKRHTAKTQNNFFHRIVRNWNNLPVLAVQINKA

SEQ ID NO: 120065 - protein, 139 aa, Heterodera glycines
  Coding regions on vcDNA: vcDNA=SeqID_46488; Strand=+; Position=1 -83,137-189,337-435,866-1047
  Homolog annotation: Hit_ID=CAE70002.1; Match level="QueryCoverage =90%, HitCoverage=26%, E-value=9e-39, Identity=56%"; Hit description =Hypothetical protein CBG16409 [Caenorhabditis briggsae]
  Essential gene: C elegans homolog=B0395.2; Phenotype=Unc
LLATIFPSIIPGLALFLGIFYGLLHSWLSMLSMFAEALRFGDRRFYANWWSSRNMAEYYRNWNLVVHDWLYAYIYRDISMLGMRWGPAVSQCLVFFLSSFFHEYWFAVSLRMCYPAIFTLYFIFFGVKFCWHNAQVFVK

SEQ ID NO: 120066 - protein, 135 aa, Heterodera glycines
  Coding regions on vcDNA: vcDNA=SeqID_46489; Strand=-; Position=1 -136,182-454
  Homolog annotation: Hit_ID=NP_493569.1; Match level="QueryCoverage =89%, HitCoverage=38%, E-value=2e-25, Identity=50%"; Hit description =metaxin 1 (1P348) [Caenorhabditis elegans] emb|CAB07391.1| Hypothetical protein F39B2.11 [Caenorhabditis
  Essential gene: C elegans homolog=F39B2.11; Phenotype=Ste
PCSIDALVFGCLAPLLRTPLPNDRLQLHLSATPNLVRFVDSILSIYLPLPEKVIKEQAMARKKWQKLKMDAQQTMEEGRIERELRKAEKKERNSMHHILFFAISSITISLLFALHTGIIVVDTVDHKGKKKAKGG

SEQ ID NO: 120067 - protein, 374 aa, Heterodera glycines
  misc_feature (106)..(106): Xaa can be any naturally occurring amino acid
  misc_feature (290)..(290): Xaa can be any naturally occurring amino acid
  Coding regions on vcDNA: vcDNA=SeqID_46490; Strand=-; Position=1 -167,294-449,505-709,765-917,968-1057,1181-1426,3386-3446
  Homolog annotation: Hit_ID=CAE68594.1; Match level="QueryCoverage =91%, HitCoverage=58%, E-value=7e-59, Identity=38%"; Hit description =Hypothetical protein CBG14465 [Caenorhabditis briggsae]
  Essential gene: C elegans homolog=F15A8.6; Phenotype=Unclassified
VHFPRFASSSPFHTKSSLRGVHSLRDSAEFVDVFLGVPYAEPPVGALRFEKPIPPQKWDGVRSAVRSASACVPHARPSEREANDVSFSEDCLYLNVITPIWVIWVXEANASKLSQILVIIHGGGFEIGSAHRYDFSDIGEKFVRRGIMSVVVQHRLGILGFASSGDKTMPGNLGLWDLLAMLRWVRSNLGLWDLLAMLRWVRSEAKAFGGDPRRITLLGFSAGSAAVSALGMCPFARDLFHQAIQILFHQAIQIWHNFGTNKQEHRSLMRRKCWSERKASKNCTMRSKKXSLLLLKRIEFVFQFFVSQGPTRSDVNLNLAPVDGHFFPRDFPELIHESPPKRTLLGFSQLESLIFACMEPRECAETGHCQLSKS

SEQ ID NO: 120068 - protein, 82 aa, Heterodera glycines
  Coding regions on vcDNA: vcDNA=SeqID_46491; Strand=+; Position=1 -37,311-522
  Homolog annotation: Hit_ID=CAH73371.1; Match level="QueryCoverage =98%, HitCoverage=89%, E-value=2e-23, Identity=61%"; Hit description =H3 histone, family 3A [Homo sapiens]
  Essential gene: C elegans homolog=Y49E10.6; Phenotype=Emb
MARTKQTARKSTGTVALREIRRYQKSTELLIRKLPFQRLVREIAQDFKTDLRFQSAAIGALQVKQFIAKESRQNESIPVQYF

SEQ ID NO: 120069 - protein, 80 aa, Heterodera glycines
  Coding regions on vcDNA: vcDNA=SeqID_46492; Strand=+; Position=1 -131,215-324
  Homolog annotation: Hit_ID=NP_492998.1; Match level="QueryCoverage =90%, HitCoverage=5%, E-value=2e-18, Identity=54%"; Hit description =VAB-10A protein family member, Variable ABnormal morphology VAB-10 (vab-10) [Caenorhabditis elegans]
  Essential gene: C elegans homolog=ZK1151.1b; Phenotype=Bmd,Lva,Lvl,Unc
DHLDREYSRTDFSLDDGEQMLRQLDSVREYIQQLHARLLSLTDRCAQISPLWQRGERISKPLPVMALCEYKSKDKIHIRQ

SEQ ID NO: 120070 - protein, 112 aa, Heterodera glycines
  Coding regions on vcDNA: vcDNA=SeqID_46493; Strand=-; Position=1-336
  Homolog annotation: Hit_ID=AAT70232.1; Match level="QueryCoverage =75%, HitCoverage=22%, E-value=3e-22, Identity=65%"; Hit description =unc-87 [Heterodera glycines]
  Essential gene: C elegans homolog=F08B6.4a; Phenotype=Unc
MPTPNLQAGMGNGTHHQAEKGEHQAEKGEHQAEKGERNEDMKKSEATIPSQAGWNEGDSQKLMMTNFGTPRDVKGKHLKRIWELEFPEEAADSQQPTAPVNAAPQQQQQATQ

SEQ ID NO: 120071 - protein, 673 aa, Heterodera glycines
  Coding regions on vcDNA: vcDNA=SeqID_46494; Strand=-; Position=1 -201,422-629,1250-1392,1493-1905,2808-3216,3386-3829,4215-4418
  Homolog annotation: Hit_ID=NP_508033.2; Match level="QueryCoverage =90%, HitCoverage=27%, E-value=3e-66, Identity=50%"; Hit description =putative protein, with at least 9 transmembrane domains, 2 coiled coil-4 domains, of bilaterial origin (5
  Essential gene: C elegans homolog=F25C8.3a; Phenotype=Slu
MPPVKTKVEELSLKEEEQSTSQTIMTMTRTRRKQKQEMVRKAIRRAEERQRELREQYPLRATAVVQQVAYEPALFQHQLTAADSSQADDPALLEPVHQARQVVPVAQPLFPSAILSVVPTIVELLDDAQVDGSGVSGDCAWTRLATGRHPDPIPGVGGHPIPTFARGFHRILQHTGTRGAPFLSRLLLLPPLLLSPIAIGPFGHWPSAAAHPRACPPAEADRNGQSAADAQRPAPLARGGHSAAHFLPPRRIHAFALLPTPRGGDVFRHVPKHERSGTANDGRTAQIRMEQADREHVREDGECVHVRRLASVHQRDQWHYGRTICAFAPESRRAHQMLLCMQSMLPHLVRHMEEETNQRQQQAANALAALKLELSAYATLSVELRALVNSCDVLARGPTRSFDLAASGGGGGTAGGASLAPSSANRPHATDPRRGRSLGGGGADSPQFFDPPTIVEDEFVCFRLLTLCSMFVQLGSERLKELGRLSVGLDYSRGVMPELLDHKCHIKLSEVAVALLKLAPYDSNSLGCAGLRHYFTQVMPVVDWSVETNRSAINIILRRLDKTIAKIAKRPSTRRRANWGVISFWLVGLHQTLLNSPYIAHLHSLKLVFSLEMICGVENIGPLAERPEAILCQFLIPMFLRAAIPGKGGGSVLTSLTNSQTQIKKRHSSGPKT

SEQ ID NO: 120072 - protein, 124 aa, Heterodera glycines
  Coding regions on vcDNA: vcDNA=SeqID_46495; Strand=+; Position=1 -100,143-285,333-464
  Homolog annotation: Hit_ID=CAG09543.1; Match level="QueryCoverage =70%, HitCoverage=60%, E-value=3e-14, Identity=42%"; Hit description =unnamed protein product [Tetraodon nigroviridis]
  Essential gene: C elegans homolog=F23H12.2; Phenotype=Lva
MSGGVDFPDPSDPQANEIFFFSQITLGEEKMQTGHIEEGITHLSNAIVTCSKPDELLRIFQQTIPPECFSLLVQAIPGAKMRRNASSSYRHGREPIDLDCAKIDDIGDNAVDKKMFVLQDDELE

SEQ ID NO: 120073 - protein, 158 aa, Heterodera glycines
  Coding regions on vcDNA: vcDNA=SeqID_46496; Strand=+; Position=1 -70,172-354,396-619
  Homolog annotation: Hit_ID=AAT92172.1; Match level="QueryCoverage =100%, HitCoverage=100%, E-value=5e-67, Identity=82%"; Hit description=ribosomal protein S14 [Ixodes pacificus]
  Essential gene: C elegans homolog=F37C12.9; Phenotype=Emb,Ste
MASRKGKVKEEQPAVSLGPQVQEGENVFGVAHIFASFNDTFVHVTDLSGRETIVKITGGMRVKADRDEASPYAAMLAAQDVAERSYQNSPIVFKVGINALHVKLRATGGTKTKTPGPGAQAALRALARSGMKIGRIEDVTPIPSDSTRQKGGRRGRRL

SEQ ID NO: 120074 - protein, 320 aa, Heterodera glycines
  Coding regions on vcDNA: vcDNA=SeqID_46497; Strand=+; Position=1 -171,212-309,342-408,462-512,557-635,680-744,786-907
  Homolog annotation: Hit_ID=CAE72054.1; Match level="QueryCoverage =86%, HitCoverage=15%, E-value=5e-33, Identity=37%"; Hit description =Hypothetical protein CBG19140 [Caenorhabditis briggsae]
  Essential gene: C elegans homolog=T19A5.1; Phenotype=Gro,Slu
VEDLFDLNSPLPAIGQLEPECSDPALDPVLRELDSLPAFQYRHQLTKFYKPEKALRNTLRSLGSSGKVEQIETLRSLGSSGKVEQIEHVVARLYFAMKCVHSHNHEVHWALSTLSAEVHWALSTLSALYWRVKGDPVNAIKCLRHSLHKSAIKCLRHSLHKSPNIFKDVPLISLANIYHQAGFLHSADVPLISLANIYHQAGFLHSALIVGRKALEAGVDVVALHFTLANIYLEAGVDVVALHFTLANIYASLSDFPHALQFYHSTLALQSNFEPANASLSDFPHALQFYHSTLALQSNFEPANLRILVCFCICLPLFHR

SEQ ID NO: 120075 - protein, 630 aa, Heterodera glycines
  Coding regions on vcDNA: vcDNA=SeqID_46498; Strand=-; Position=1 -163,208-359,488-586,640-672,720-944,1067-1153,1204-1287,1487 -1582,1633-1695,1744-1865,1915-1948,2047-2163,2217-2306,2377 -2465,2508-2547,2647-2702
  Homolog annotation: Hit_ID=CAE72981.1; Match level="QueryCoverage =99%, HitCoverage=99%, E-value=1e-157, Identity=48%"; Hit description= Hypothetical protein CBG20323 [Caenorhabditis briggsae]
  Essential gene: C elegans homolog=Y80D3A.5; Phenotype=Unc
MGFLVVFLIASLFAWLSAWISRKFLRISQLVNRIPGPSTLPLVGNLHQIRLKPDEFFEQVQGLAYMFGEKNGFFEQVQGLAYMFGEKNGRIARAWLGPIPLAIIFGAEEVEPVLGSKKLLTKMFHYSFLSAWIGDGLLLSKPNKWRPRRKLLTPTFHYDILKDFVPFHYDILKDFVPVYNRHGTVYNRHGTTLVQKMEKIAESGEFVDIFHTITLCTLDIICEAALGVNIDAQRTIHSDYLDAVFAIKNIIFQRIVKPQFYPEFLFNIFGAGKEQKRCVQILHDFTNKAILARKAILARKKAMEEAGGIEKLVAKKVTEGGKRLALLDLMLDMEQHGQLDLAGIQEEVDTFTFEGHDTTSTALNWFLHLMGANPEGHDTTSTALNWFLHLMGANPEIQSRVQIQSRVQREIDQLLGPAEAELRYEQLGELRYLEACLKETLRLYPSVPLIALYPSVPLIARQCLAEICLAEICFSFHLLPATGIIIVASMIHRDRNYENPEVFDPERFLKFDPERFLKVDYLKHPYCYIPFSAGSRNCIGQRFALMEEKCLITKQRFALMEEKCLITKILRSFRVTSKLRTDEMRVSAELIIRPMRVSAELIIRPMFGNWIRNWIRLQKREIGELKKERQ

SEQ ID NO: 120076 - protein, 372 aa, Heterodera glycines
  Coding regions on vcDNA: vcDNA=SeqID_46499; Strand=-; Position=1 -12,285-390,1074-1279,1471-1568,2380-2530,2579-2914,3428-3637
  Homolog annotation: Hit_ID=NP_498633.1; Match level="QueryCoverage =89%, HitCoverage=68%, E-value=8e-44, Identity=44%"; Hit description =high Mobility Group protein (78.6 kD) (hmg-4) [Caenorhabditis elegans] gb|AAA19061.1| Hmg protein 4 [Caen
  Essential gene: C elegans homolog=T20B12.8; Phenotype=Emb
MGGFDYERVSAFTNAKWQKTLKKNELSLKGWNYGDAEFEEVESEAGQAIATLSDILLATPRGRYEIKVFQNHLSFHGKSYDYKVPLKTITRMFLLPHKDGRHMYFVLHVNPAVRQGQTRYPFLVLECSKEDYIELELGCTEEEYNSLFDYVQTKGLKIRNAQRLGEKAYKEADKFAGSSDEELDPYKEKLKDDARERAAGSESDSEDEDFNVEKEMKKRKADKDSSEGSGSEPDEEYSDDGTDVSDDLMGTDKGKEKEKEGAKKRKKDREEGKEEKGKKEKRKEKEGKKGEKKKDPNAPKRNQPYEQKAKEDKERYEREMSEYQSKKKEAGEGPSSAGQTSSQNQPKKSQSSPSKKPISKEFVDSSNSSDSD

SEQ ID NO: 120077 - protein, 175 aa, Heterodera glycines
  Coding regions on vcDNA: vcDNA=SeqID_46500; Strand=-; Position=1 -429,919-1017
  Homolog annotation: Hit_ID=P02270; Match level="QueryCoverage=97%, HitCoverage=100%, E-value=2e-46, Identity=61%"; Hit description =Histone H2A pir||HSIN21 histone H2A - sipunculid (Sipunculus nudus)
  Essential gene: C elegans homolog=T23D8.6; Phenotype=Emb
MSGRGKGGKAKTEDGKNKSRSSRAGLQFPVGRLHRLLRKGAFFGYLNFRLFVRNRVRASEFIEMDALIRDQFLIGFEFAFFKITGHYAERVGVGAPVYLAAVLEYLTAEVLELAGNASRDNRKTRINPRHLQLAVRNDEELNKLLSGVTISEGGVLPNINPVLLPKKSQHSEVSE

SEQ ID NO: 120078 - protein, 275 aa, Heterodera glycines
  Coding regions on vcDNA: vcDNA=SeqID_46501; Strand=-; Position=1 -90,645-754,794-929,1001-1130,1223-1365,1578-1796
  Essential gene: C elegans homolog=Y34D9A.4; Phenotype=Rup,Unc
MDLPTRECRVEQACEFMTNLLQDIRKSEEKIMSEDELDKLKGEVDALQTFVNKRLEKALQLQAESKRIFETIRPSINSFNEDDLHFLRVDLYNQSTVLSSDFLKKMEKFNERLKDHHDLWAEQVVFRYDELLVKLDELSAKCFQPSTEFPAKPNLKNLSEKELLNLEEEVRIRQQMYERAKPVFDKLNEWMASWKQKLDTERRQRKIVEQKVPKLLNELCELCNDYVKNFQLNDIIVEGLRADKYAESVMQSYHQDREVQKAQKVLRYHTSIDCF

SEQ ID NO: 120079 - protein, 146 aa, Heterodera glycines
  misc_feature (3)..(3): Xaa can be any naturally occurring amino acid
  Coding regions on vcDNA: vcDNA=SeqID_46502; Strand=+; Position=1 -76,140-183,439-576,935-1017,1090-1165
  Homolog annotation: Hit_ID=AAQ96595.1; Match level="QueryCoverage =83%, HitCoverage=21%, E-value=2e-44, Identity=75%"; Hit description =excitatory GABA receptor EXP-1B [Caenorhabditis elegans] gb|AAC67448.3| Expulsion defective (defecation) p
  Essential gene: C elegans homolog=H35N03.1; Phenotype=Emb
AEXSNEFSKFFKIFSFFRCPTDLTLFPFPFDSQTRKLGIESYGYTSDQVSYGWSKGQREALKLHKIRLPDFRIKEAFVTSQLESYATGNYSRLYVCFVFSRSAGFCFLQLIIPSTAVVITSAVVITSWVSLWVGNETSFQGKEEME

SEQ ID NO: 120080 - protein, 276 aa, Heterodera glycines
  Coding regions on vcDNA: vcDNA=SeqID_46503; Strand=+; Position=1 -132,182-422,474-634,673-825
  Homolog annotation: Hit_ID=BAC29030.1; Match level="QueryCoverage =99%, HitCoverage=72%, E-value=2e-33, Identity=36%"; Hit description =unnamed protein product [Mus musculus]
  Essential gene: C elegans homolog=Y57G11C.11; Phenotype =Age,Unclassified
GEIQQFASFAMFLWFDELHGCFRPLHSFNQLRIPWLSAHLATVSSLNAVHLPSSLNAVHLPLSGKQILDVGCGAGILSTSLCRRGALVTGLDADKSVLEIANGYKETMAPSLRKKIEFIPGTIERLAQEKDRTFDAVVSSEVVEFDAVVSSEVVEHVSDLPLFIRSCCKLARPNSPIFFTTINRTIWSQLLAKTIAEDLLRILPQGLHQFEQFVAPRDLRKLLAEDLLRILPQGLHQFEQFVAPRDLRKLLLDEQCSVGPVLGNGLHPFFNIWNWT

SEQ ID NO: 120081 - protein, 289 aa, Heterodera glycines
  Coding regions on vcDNA: vcDNA=SeqID_46504; Strand=-; Position=1 -209,742-929,1280-1359,1572-1715,1770-1838,2060-2234
  Homolog annotation: Hit_ID=NP_507092.1; Match level="QueryCoverage =96%, HitCoverage=86%, E-value=6e-62, Identity=45%"; Hit description =hydroxysteroid dehydrogenase 12 family member (5Q705) [Caenorhabditis elegans] emb|CAB07363.1| Hypothetic
  Essential gene: C elegans homolog=C56G2.6; Phenotype=Lva
EVIYAILPLFGLLFLLCLLFKFLRAIWRCVYPYFIARPKDLRRLVGAKWAVVTGASDGIGKEYAKQLANKGFNLMLISRSADKLKAVKEEIQPKQFLQPEVKWISFDLTNANIEDYEKWLSELSKMDIGMLVNNVGSFPPLMRFHELPGGHRSIAKDLLLNTMPHTILTAFVLKQMTERNKGIIVNIASVAAVFPLFHTALYSSVKKYLTKYLTWFSSILRKDYADTGIIIQSILPGIVLTKMSQSHTQTGLFCPTPEKFVNSALRTVGHADETTGCFAHQIQAILLCL

SEQ ID NO: 120082 - protein, 117 aa, Heterodera glycines
  Coding regions on vcDNA: vcDNA=SeqID_46505; Strand=-; Position=1 -226,274-401
  Homolog annotation: Hit_ID=XP_511009.1; Match level="QueryCoverage =96%, HitCoverage=42%, E-value=1e-28, Identity=60%"; Hit description =PREDICTED: hypothetical protein XP_511009 [Pan troglodytes]
  Essential gene: C elegans homolog=ZK1010.1; Phenotype=Emb
MIEIIILYVLFYSIIMRLCHRITAKKTTFIQIFVKTLGGMTLTIFAHSLDTIENVKAKIQDKEGIPPDQQRLIFSGKQLENGRTLADYNIQNESTLHLSLTLIGGARTRRQQSQEVA

SEQ ID NO: 120083 - protein, 221 aa, Heterodera glycines
  misc_feature (73)..(73): Xaa can be any naturally occurring amino acid
  misc_feature (78)..(78): Xaa can be any naturally occurring amino acid
  Coding regions on vcDNA: vcDNA=SeqID_46506; Strand=-; Position=1-689
  Homolog annotation: Hit_ID=NP_498735.1; Match level="QueryCoverage =95%, HitCoverage=47%, E-value=4e-15, Identity=29%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
REKTKAIGIPITKDSEADQHVGVIQNFGHSFVKTLKVSISGVESYDSGIYYAVRAYMMTELGFSEDVKKGSMXASCYXIDDVDQNDYTNSGFKNRASRFADGAKCETMVKLNFDLGRQPNLLLNNSDVIFSIHRNTDDFLIMAPPYVSGNAVIANPHTYRINIHDIRIYVKTVDVTQSLNNVISNQLQTTPAKYPMRKIEIRSLFIPRGTSDLSHNVFTSI

SEQ ID NO: 120084 - protein, 79 aa, Heterodera glycines
  Coding regions on vcDNA: vcDNA=SeqID_46507; Strand=-; Position=1 -115,172-296
  Homolog annotation: Hit_ID=CAE58986.1; Match level="QueryCoverage =100%, HitCoverage=43%, E-value=1e-25, Identity=72%"; Hit description= Hypothetical protein CBG02259 [Caenorhabditis briggsae]
  Essential gene: C elegans homolog=F25H2.11; Phenotype=Gro,Stp,Unc
MEKEQKSADDIAAFKKKIQAWVVSLLAKDRFKNLAFFIGENMAEGKGEGQVAIVEYRQENGEEVPTLMLIKEALIVEKC

SEQ ID NO: 120085 - protein, 150 aa, Heterodera glycines
  Coding regions on vcDNA: vcDNA=SeqID_46508; Strand=-; Position=1 -60,112-241,1061-1275,1336-1380
  Homolog annotation: Hit_ID=AAK71499.1; Match level="QueryCoverage =57%, HitCoverage=49%, E-value=7e-33, Identity=78%"; Hit description =translationally controlled tumor protein-like protein [Wuchereria bancrofti] sp|Q962A2|TCTP_WUCBA Translat
  Essential gene: C elegans homolog=F25H2.11; Phenotype=Gro,Stp,Unc
AVVVSALVLVGYLDEKSRDTVYSPQNISQTFLCIFNILSSASPVDDVLMTTHIAADLLHRLVIDDELASDSFPMKLVDDLIYEFKGRHVVRKEGEITMSGANPSAEEIDEGTEEAVERGIDFVLNHRLQEMNCYENQATFKGYVKDFMKK

SEQ ID NO: 120086 - protein, 182 aa, Heterodera glycines
  Coding regions on vcDNA: vcDNA=SeqID_46509; Strand=+; Position=1 -153,210-272,327-450,503-579,727-858
  Homolog annotation: Hit_ID=AAB22176.1; Match level="QueryCoverage =98%, HitCoverage=88%, E-value=2e-17, Identity=25%"; Hit description =14-3-3 regulatory protein [Xenopus laevis, pituitary gland, Peptide, 235 aa] pir||A56757 14-3-3 regulatory
  Essential gene: C elegans homolog=M117.2; Phenotype=Emb
MVQVDAKLDKNERTFLARAYKKLIDVRRETWRFFCNMDENPQDADTEEQKQARTDLRLKTHEGLLQLYREFLDVINEKLLPNANDEEASVFYHNMKGDFYRDQVDLLEEDERAESLIISEKSYEEGFTIATTKLKRSNPALEDANDELCEKEAAGDTEAALLLIQKQLTAWKPKNFAEDAAQ

SEQ ID NO: 120087 - protein, 257 aa, Heterodera glycines
  Coding regions on vcDNA: vcDNA=SeqID_46510; Strand=+; Position=1 -186,239-424,476-568,620-787
  Homolog annotation: Hit_ID=CAE60648.1; Match level="QueryCoverage =85%, HitCoverage=35%, E-value=3e-38, Identity=45%"; Hit description =Hypothetical protein CBG04294 [Caenorhabditis briggsae]
  Essential gene: C elegans homolog=F10G7.8; Phenotype=Emb
RNEAKVEVAVEPPTAIDQRDDIMTGRFGDGRLVKMEVDYSAQVDSQLIVADNLAKVFAMAAIESLEKLEKDSRINCDMAIESLEKLEKDSRINCDMRSNQRLLCHMVKLAFDANNWQLLCETAKTLCKKRLLIKSSIKKMVQECCEMVPKAPDASSKSTVQECCEMVPKAPDASSKSTLIDTLRAVTAGKIYLEVERARLTIYLEVERARLTKQVAEKLEAEGKLDEAREMMMELQVETYGTMQRKKGAIGQFNEQW

SEQ ID NO: 120088 - protein, 225 aa, Heterodera glycines
  Coding regions on vcDNA: vcDNA=SeqID_46511; Strand=+; Position=1 -110,165-285,361-410,619-696,1054-1176,1221-1298,1489-1521
  Homolog annotation: Hit_ID=CAE60648.1; Match level="QueryCoverage =99%, HitCoverage=40%, E-value=3e-44, Identity=44%"; Hit description =Hypothetical protein CBG04294 [Caenorhabditis briggsae]
  Essential gene: C elegans homolog=F10G7.8; Phenotype=Emb
KCVVFYLLLSAHDNEKWELLHRVNAMRELEQIPKHKELLELFIHQEELLELFIHQELIFWSKTIESEFAPILFAAQPPVEVISDSFQDGDGQKRRERLHDCVGEHNVRMVAKYYSRITFQRMAKLLEFGIEQMEAFVCKMIVDGVIPEVKIHRPSQIIYLSPKKNGAEVLDEWVFNVRKLTDTMNKVSWVFNVRKLTDTMNKVSQLIAKEEMVHKNVDLKDSPDE

SEQ ID NO: 120089 - protein, 209 aa, Heterodera glycines
  Coding regions on vcDNA: vcDNA=SeqID_46512; Strand=-; Position=1 -24,86-247,303-662,716-797
  Homolog annotation: Hit_ID=NP_491672.1; Match level="QueryCoverage =97%, HitCoverage=46%, E-value=6e-59, Identity=55%"; Hit description =proteasome Regulatory Particle, ATPase-like, S6a (48.1 kD) (rpt-5) [Caenorhabditis elegans] gb|AAC19196.1
  Essential gene: C elegans homolog=F56H1.4; Phenotype=Emb
MAHPAGDVTDAQVLEMSSDQIDERVRQLDEEIRVMRDEMRKIAYNIKTMGTKTKENNKQMQKYMKMPWLVANVVEILDLADDQAEGEEGSSSDLDARQKKGAVIKISKGLVMFLPRIGLVGPDELKPGDLVGIDNDTYHIIAKLPPHFDRRVKAMEVVERPTETYSEIGGCETQIKELQEAIVLPMTKKELFIKIGIHPPKGVLMYGPP

SEQ ID NO: 120090 - protein, 165 aa, Heterodera glycines
  Coding regions on vcDNA: vcDNA=SeqID_46513; Strand=-; Position=1 -23,327-405,509-619,662-892
  Homolog annotation: Hit_ID=NP_741529.1; Match level="QueryCoverage =94%, HitCoverage=30%, E-value=3e-35, Identity=50%"; Hit description =adenylosuccinate synthetase, possibly N-myristoylated (50.2 kD) (5F298) [Caenorhabditis elegans] gb|AAM29
  Essential gene: C elegans homolog=C37H5.6a; Phenotype =Emb,Gro,Pvl,Stp,Unc
LLTEIKKYISILLGAQWGDEGKGKVLDFLIGHHKIDIVARCQGGNNAGHTVLANGREYHFHLLPSGLASEKVLNIVGNGVVVNLDALFEVLNIVGNGVVVNLDALFEELESNKIEDSADRLFVSDSAHLVLPVHIATDIMRENALGQTRNKRNIKHRSNYLHFSE

SEQ ID NO: 120091 - protein, 276 aa, Heterodera glycines
  Coding regions on vcDNA: vcDNA=SeqID_46514; Strand=-; Position=1 -120,176-565,613-930
  Homolog annotation: Hit_ID=CAG10389.1; Match level="QueryCoverage =94%, HitCoverage=16%, E-value=8e-88, Identity=62%"; Hit description =unnamed protein product [Tetraodon nigroviridis]
  Essential gene: C elegans homolog=Y80D3A.2; Phenotype=Bmd
MQKQHQQNALPKEFVAEHFPFSKFFENRRHQSNLLPLKFELRDFEEDLTIALDGWERIKDIFKKLEEFRAFELLRNGRDRASYLLVIVWQGTLTTNDFSALTHCQVKEAKIIAMTCTHAALRRRELVDLGFRYDNILMEEAAQILEVETFIPLLLQDPQDGRSRLKRWVMIGDHHQLPPVVQNVAYQKFANMEQSLFARLIRLGVPSVQLDAQGRARAELASLYNWNYKNLGNLPHVLEQREFQCANPGFLHNFQFIDVPDFNGVGESTPSAYFYQ

SEQ ID NO: 120092 - protein, 338 aa, Heterodera glycines
  misc_feature (335)..(335): Xaa can be any naturally occurring amino acid
  Coding regions on vcDNA: vcDNA=SeqID_46515; Strand=+; Position=1 -152,212-261,596-839,880-943,990-1069,1239-1285,1343-1583
  Homolog annotation: Hit_ID=NP_494777.1; Match level="QueryCoverage =91%, HitCoverage=36%, E-value=8e-96, Identity=58%"; Hit description =myeloperoxidase family member (80.8 kD) (2E693) [Caenorhabditis elegans] gb|AAA83575.1| Hypothetical prot
  Essential gene: C elegans homolog=ZK430.8; Phenotype =Bmd,Dpy,Lva,Lvl,Unc
FRFKFRDGRTGFLKLSRFNNMLVLPFDDSRCASLSTCTASFVAGDIRANLFLFLGLSSMHIVFAREHNRIARSLQSMNPGWSGDRLFQESRKIVGAEIQAILYKEFLPRVLGSTFDRLIGPYNAYDANADPSVANEFTTAAYRFGHGMILEQYARLAENGIPAGPFPEQYARLAENGIPAGPFPFGEGVFKSQKLLFEGGIDPVLRGLWFGEGVFKSQKLLFEGGIDPVLRGLWSTAVKRPHRMTPAITERLFSTTDLTDLGSLNIMRGRDHGVPSYNKMRRFCGLSSATSFDALSDHISDPSVRAILSSNYASPGQPLKNGGALLQLFVLCSEXRPA

SEQ ID NO: 120093 - protein, 36 aa, Heterodera glycines
  Coding regions on vcDNA: vcDNA=SeqID_46516; Strand=-; Position=1 -63,210-255
  Homolog annotation: Hit_ID=P50566; Match level="QueryCoverage=100%, HitCoverage=34%, E-value=2e-13, Identity=100%"; Hit description =Histone H4 gb|AAA99966.1| histone H4 gb|AAA98456.1| histone H4 gb|AAA98449.1| histone H4 gb|AAA98445.1| hist
  Essential gene: C elegans homolog=ZK131.1; Phenotype=Unclassified
MSGRGKGGKGLGKGGAKRHRKVLRDNIQGITKPAIR

SEQ ID NO: 120094 - protein, 39 aa, Heterodera glycines
  Coding regions on vcDNA: vcDNA=SeqID_46517; Strand=+; Position=1 -108,198-209
  Homolog annotation: Hit_ID=P30757; Match level="QueryCoverage=100%, HitCoverage=31%, E-value=1e-10, Identity=79%"; Hit description =Histone H2B pir||S16084 histone H2B - sipunculid (Sipunculus nudus)
  Essential gene: C elegans homolog=H02I12.6; Phenotype=Gro,Pvl,Ste
MPPKPSGKGAKKAVKSTKAVRTGDKKRRKARKESYSVYI

SEQ ID NO: 120095 - protein, 125 aa, Heterodera glycines
  Coding regions on vcDNA: vcDNA=SeqID_46518; Strand=-; Position=1 -93,154-438
  Homolog annotation: Hit_ID=P53021; Match level="QueryCoverage=96%, HitCoverage=96%, E-value=1e-39, Identity=62%"; Hit description=Major sperm protein 1 gb|AAA29146.1| major sperm protein
  Essential gene: C elegans homolog=ZK546.6; Phenotype=Emb
MGQHPEDIATIPAHELHLNAPFNIRTIYNFRLINTGSKRIGFAFKTTKPKRIFLNPPCGTVGVGDTVNVIITVATFDPNNEDIKNDRVIVEWCNTPGPSDTVFKLEWFGEDGMVRRKNLPVIYNL

SEQ ID NO: 120096 - protein, 208 aa, Heterodera glycines
  Coding regions on vcDNA: vcDNA=SeqID_46519; Strand=-; Position=1 -168,311-471,521-815
  Homolog annotation: Hit_ID=NP_492444.1; Match level="QueryCoverage =88%, HitCoverage=24%, E-value=3e-39, Identity=46%"; Hit description =MIZ type zinc finger containing protein family member, GEX (Gut on EXterior) Interacting protein GEI-17 (
  Essential gene: C elegans homolog=W10D5.3a; Phenotype=Emb
VTLVRRLNSEILLNRILNNPNARRPLEKTKQIIVRRLNGDEDDVQMDSLKISLMDPLMRTRIKIPSRAAECTHLQCFDLNSYLMMSEKRPTWKCPVCDRNAIYSKLIIDAYFEQVLSAVASGDDEIELLRDGSWRLPLPPDTMGVDSDDQNVGVAAAAAVGDYGGAGTAEASAGGDDDDDIMVVTMPVAKKQRPPGGAGGASDAVSSD

SEQ ID NO: 120097 - protein, 229 aa, Heterodera glycines
  Coding regions on vcDNA: vcDNA=SeqID_46520; Strand=-; Position=1 -311,359-737
  Homolog annotation: Hit_ID=CAE70634.1; Match level="QueryCoverage =52%, HitCoverage=16%, E-value=1e-22, Identity=50%"; Hit description =Hypothetical protein CBG17326 [Caenorhabditis briggsae] gb|AAG41200.1| lin-14B1 [Caenorhabditis briggsae]
  Essential gene: C elegans homolog=T25C12.1a; Phenotype=Pvl,Sma,Stp,Unc
MAQLCKKLAEKRVFGSRLMAKTTFAMPNHSSYSNLPLPGIIYIYCTFIFYKHFILIETIRHANSKHGLLIYFADVCQKVLFDRVGKENEFKEYFREAMRKLAARCRRVRHARKFHHKQPQGVELAPSVGVVVGQSPFQQFAGRPVVGPNAIVALGHQQQQQHSMTTSGAAAGPSAAMSGSGIGQSQDTAQTMAAVNAALAELAHRRQQQQQMALQSSLGVGSSENKTNE

SEQ ID NO: 120098 - protein, 184 aa, Heterodera glycines
  Coding regions on vcDNA: vcDNA=SeqID_46521; Strand=+; Position=1 -165,605-811,1134-1316
  Homolog annotation: Hit_ID=AAH74666.1; Match level="QueryCoverage =98%, HitCoverage=98%, E-value=4e-57, Identity=56%"; Hit description =MGC69249 protein [Xenopus tropicalis] ref|NP_001004848.1| MGC69249 protein [Xenopus tropicalis]
  Essential gene: C elegans homolog=C48B6.2; Phenotype=Lva,Lvl
MVRTLKFHEKKLLKKVDFINWPAELDNSLHENKIMRRYHVEKREHYTLYNKLSREIREMAKRIRELDDKNPNKLVLARMLLGKLFDMGVIPTADTLERCDKVTASSFCRRRLPVVCHKMQMAPTVRKSSQLVEQGHVRVGVEMVTDPAFLVTRNQSDHITWTRESKVRRHLSTYNNELDDFEGC

SEQ ID NO: 120099 - protein, 37 aa, Heterodera glycines
  Coding regions on vcDNA: vcDNA=SeqID_46522; Strand=+; Position=1-111
  Homolog annotation: Hit_ID=NP_999958.1; Match level="QueryCoverage =100%, HitCoverage=17%, E-value=1e-12, Identity=81%"; Hit description= ribosomal protein S8 [Danio rerio] gb|AAH76163.1| Ribosomal protein S8 [Danio rerio] gb|AAS66962.1| ribo
  Essential gene: C elegans homolog=F42C5.8; Phenotype=Lva,Ste
MGISQDRWHKRRKTGGKRNPIHKKRKFEMGRPAANTK

SEQ ID NO: 120100 - protein, 88 aa, Heterodera glycines
  Coding regions on vcDNA: vcDNA=SeqID_46523; Strand=-; Position=1 -117,480-856
  Homolog annotation: Hit_ID=NP_493741.1; Match level="QueryCoverage =92%, HitCoverage=74%, E-value=9e-15, Identity=48%"; Hit description =maggie like (12.2 kD) (2A760) [Caenorhabditis elegans] gb|AAB71053.1| Hypothetical protein W10D9.5 [Caeno
  Essential gene: C elegans homolog=W10D9.5; Phenotype=Emb,Lva
SWEETAFERFEGLKEMFPTPVRSALSTTVQLTWVVAQNSFSFARSAAWVLSTSALLMVMPYIVDKELQDVEKAQLKQQQQLLLGGRPS

SEQ ID NO: 120101 - protein, 173 aa, Heterodera glycines
  Coding regions on vcDNA: vcDNA=SeqID_46524; Strand=-; Position=1 -114,376-537,904-1044,1809-1913
  Homolog annotation: Hit_ID=CAE67815.1; Match level="QueryCoverage =93%, HitCoverage=32%, E-value=1e-24, Identity=36%"; Hit description =Hypothetical protein CBG13395 [Caenorhabditis briggsae]
  Essential gene: C elegans homolog=M176.2; Phenotype=Emb,Lva
MVERFFPNDPKRVALIRSTFTGLWGLEVEDEATREVIEDAIRSHGNYVLKSQMEAGLGNFFDDQLAEMLQQMSTEDRGAYILQQRIKPLVVKNYLMREAKPAELEDVVSEMGIYGSLIGDQSNGRILHNAFDGHTIRSKRSDLNLGGVCCGGGAIDSPLLFPMSQMLDQPNGH

SEQ ID NO: 120102 - protein, 217 aa, Heterodera glycines
  Coding regions on vcDNA: vcDNA=SeqID_46525; Strand=+; Position=1 -375,489-767
  Essential gene: C elegans homolog=C16B8.4; Phenotype=Emb
MASQQQSLGTDQHPSSLAFRQGQLFFRQTAPGNPFLASAPIASELQILRVRPLCSQRLSSPEELLKSTPFSAVMAIDMAKESGRRTEQPLRFVIQWRRKVRGTQTSVEAEEEEQQTKESKWITASIEFDHTFHVTGIRAGHFHQFSVQLVSPLGPVGPTVRSHWLNFDAIIEQFEPDGPMRRDSLQFFARYNMDNGVAALVRWRRDRDGQSKAKGTK

SEQ ID NO: 120103 - protein, 243 aa, Heterodera glycines
  misc_feature (241)..(241): Xaa can be any naturally occurring amino acid
  Coding regions on vcDNA: vcDNA=SeqID_46526; Strand=-; Position=1-736
  Homolog annotation: Hit_ID=NP_504179.1; Match level="QueryCoverage =97%, HitCoverage=22%, E-value=2e-50, Identity=42%"; Hit description =predicted CDS, protein of unknown function DUF32 and RNA-directed DNA polymerase family member (5E747) [C
  Essential gene: C elegans homolog=ZK250.3; Phenotype=Clr,Lvl,Sck
STNSCEDWYEALLGKNVDCIYIDFQKAFDSVPHNLLLYKLEKIGIRGKLLLWIKGFLSNRTFRIKIGDALSSSKVGSGVPQGSVLGPLLFLIYINDLPDALPSGVKIKLYADDVKLYICYKARADTESMRKALHNLFEWANKWQIKVSIQKTFILYLVSKNPKETYKFDGNTINAVETIRDLGVNIDNKLQFSDHVNHITRNAYLRMRSLFRIIKSKSSKIWITLYKTYIRPLLEYAPEVXNQ

SEQ ID NO: 120104 - protein, 1209 aa, Heterodera glycines
  Coding regions on vcDNA: vcDNA=SeqID_46527; Strand=+; Position=1 -385,500-840,1074-1257,1330-1507,1845-1971,2417-2510,3000-3082,3136 -3319,3398-3506,3565-3716,3788-3887,3928-4041,4289-4375,4423 -4609,4658-4767,4830-5040,...
  Coding regions on vcDNA: Position=...5118-5253,5382-5562,5734 -5954,6098-6201
  Homolog annotation: Hit_ID=CAE71970.1; Match level="QueryCoverage =99%, HitCoverage=21%, E-value=0.0, Identity=66%"; Hit description =Hypothetical protein CBG19042 [Caenorhabditis briggsae]
  Essential gene: C elegans homolog=K11C4.5; Phenotype=Unc
VLYADQPTTFDVDLPMICSYLTYWWQHGLEGSRSLVLITQVTAEHINRLFCSLLTMMKDHVGRENAPWLCRAHFSAVPLIQYVTCDPVREQMLPVAEHLRQMAEKAFADEERMRTHPDEADDATVAEDNARLVRDVYAFFPILMKFTDLHRAKWLKMPSWESDGIYENVAVIFRIWSLSQHFKREELNYMAQFEDGEGTLSAMGAEMKTGKAAIAERKKRRREGQVGKMGEWGERTGQLAIRRDKHANSIVIACLKRLLPVGLNVFGGRELDIVQQSKERFLAKENEEKVCKFIRSRLTVPVRTRTDPTDKNAWQLSLYRKIGKSQMRGKEEMSQEAVVDKIANMAKVVAILHTVRGQNKIKKVISLQTEHPQAYKPSEWKKMVSSQRKRAVVACFRMIPVYSIPRHRGINYFLPVFSQHWLNDEDIDEDRLVSDICAVVEQQNSIVPDALRQLILCFQRAATSEESGQSNSRSDRLFIRYADVMCRSVHIGQSDRLFIRYADVMCRSVHIGQDGDEGGAMDDENEVDQAEKEEMAQTLRAEQGVLANRGAAIMVLMYLSAASGEPTVLMYLSAASGEPTEMVAQTLQLGIHLLNGGNKTIQKSMLNYLQLKKDVRFFTSSMLNYLQLKKDVRFFTSLSGLMNKCSVLNLEMFERQIKAEGLMGAALAAGEHQEHQNLNDAPFTCSLFRFMQLTCEGHNLDFQNYLRTQPGHTTSVNLINSTRTQPGHTTSVNLINSTVDYLLRLQESVMDFYWHYSSKEMIDENGKEYFLRAIQVCSQVFNTLTESIQGPCVGNQMTLAGPCVGNQMTLANSRLWDAINGFFFLFAHMMEKLYKNSTQLELLREFLNLQKDMVVLMLSMLEGNVLNGPIGKQMVNVLNGPIGKQMVDALVESQQCVEMILKFSDMFLKLKDLTTSQAFQDFDTNRDDLTTSQAFQDFDTNRDGWISPKEFQRAMEAQKMYSVEEITYLMMCTDVNNDGKIDYMEFTERFHNPARDIGFNLAVLLTNLKEHITNDPRLEKIVEKAGSLLDYFDPFLGRIEIMGSSKKVEKIYFEIQESWLEQWGKQQIRDSKNAFLFNVLQDDGGDQGKLEAFINFCEDTIFEMQHAAEISSGDSTTKVERAMRQRDYFLQQTYAGEQISKTLRAGYKCGMDAAAALRPENIQKELKRAAKKFSSMSWAELFTALALLCFRAGRAFFFFHLFLLSTAFR

SEQ ID NO: 120105 - protein, 383 aa, Heterodera glycines
  Coding regions on vcDNA: vcDNA=SeqID_46528; Strand=-; Position=1 -37,79-185,222-379,430-758,808-964,1005-1099
  Homolog annotation: Hit_ID=NP_491363.1; Match level="QueryCoverage =91%, HitCoverage=6%, E-value=2e-99, Identity=58%"; Hit description =dynein heavy chain, LEThal LET-354 (dhc-1) [Caenorhabditis elegans] gb|AAK21472.1| Dynein heavy chain prot
  Essential gene: C elegans homolog=T21E12.4; Phenotype=Emb
ERLANKIVLLFTLCKEQLSNQCHYDFGLRALKYVLLLFTLCKEQLSNQCHYDFGLRALKYVLVSAGNIKRDAIQPGEQAVASQMSEQQMLGEQAVASQMSEQQMLFQSVYDTLTPKLVSEDILFKSPLHQFFPDSPKQVESLKNEVLICKTEHFSCSPITGEKLKNEVLICKTEHFSCSPITGEKGNLWLEKVLQVYQITNRNHGLMLVGASGSVKTTAWKTLLKALENHERVEGVSHVIDAKSISKDTLYGTLDPNTREWTDGLFTHIIRKIIGNVRGELDKRQWIIFIIGNVRGELDKRQWIIFDGDVDPEWVENLNSVLDDYKLLTLPNGERLSIPPNVRIIFEVADLKVRIIFEVADLKFATMATVSRCGMVWFSEDFV

SEQ ID NO: 120106 - protein, 143 aa, Heterodera glycines
  misc_feature (141)..(141): Xaa can be any naturally occurring amino acid
  Coding regions on vcDNA: vcDNA=SeqID_46529; Strand=+; Position=1 -103,163-322,464-618
  Homolog annotation: Hit_ID=AAC46628.1; Match level="QueryCoverage =97%, HitCoverage=39%, E-value=2e-30, Identity=48%"; Hit description =cuticular collagen Bmcol-2
  Essential gene: C elegans homolog=T07H6.3a; Phenotype=Bmd,Gro,Unc
VTVPLAYQHFQQVGTQMQNEMDFCKLRSGNIWREVTRTQVVTRTQVLSQFTGGVRQPRAVNTGKSRRIRQYEGAAGSGATGVAASGAAGGSSAGGGGCCGCGVSQPGPPGPPGPSGPPGRRGSPGGSGQPGSDGENSKQSXIE

SEQ ID NO: 120107 - protein, 110 aa, Heterodera glycines
  Coding regions on vcDNA: vcDNA=SeqID_46530; Strand=+; Position=1 -102,600-659,747-917
  Homolog annotation: Hit_ID=NP_504050.1; Match level="QueryCoverage =100%, HitCoverage=35%, E-value=3e-16, Identity=38%"; Hit description= predicted CDS, putative protein family member, with at least 5 transmembrane domains (5E270) [Caenorhabd
  Essential gene: C elegans homolog=R08F11.2; Phenotype=Unclassified
MYNCNMYNVEDIPLADRQSIPLGLMFLTLGLICEVLYLPCMLAIRKHMDSTCFKFMFYIAVADMLALFISGVLTGYLALVGAVYCSYPKLIYTMGAWAICMLIFLLLPCN

SEQ ID NO: 120108 - protein, 191 aa, Heterodera glycines
  Coding regions on vcDNA: vcDNA=SeqID_46531; Strand=+; Position=1 -203,252-326,366-444,520-659,722-798
  Homolog annotation: Hit_ID=CAE64435.1; Match level="QueryCoverage =100%, HitCoverage=53%, E-value=4e-71, Identity=76%"; Hit description= Hypothetical protein CBG09138 [Caenorhabditis briggsae]
  Essential gene: C elegans homolog=T20B12.2; Phenotype=Emb
NLAVPMTPLPFAESAHRTPKQHHQPHSAAAQPPPSNMPAFVPATPFSNASVEIPSPTLQNIVSTVNLGVQLDLKQIALRARNAEYNPKSAFGAVIMRIREPRTTALIFSSGKMVCTGAKSEETSRLAARKYARIVQKIGFNAKFTEFKVQNMVGSCDVKFPIQLEGLCITHAQFSTYEPELFPGLIYRMVK

SEQ ID NO: 120109 - protein, 555 aa, Heterodera glycines
  Coding regions on vcDNA: vcDNA=SeqID_46532; Strand=-; Position=1 -1268,1358-1754
  Homolog annotation: Hit_ID=NP_508269.1; Match level="QueryCoverage =75%, HitCoverage=63%, E-value=8e-49, Identity=29%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MAFHKIDNDSVNSITNALDFFRIPPTNVSVSSSKVFELLPSNPLTDTPYHFKLHSSQNYIDLSKCYLLTEFRIRKENANGQLINLDIDDINIAPIQMIGQTFIRNIKMSINGRKIFNANALMAYKSYFSHELSYSTTAKDSHLNAAGYYRDTGDTLEMGGGCTARRDLFAGSNVAQFIAKIDTDLFNQPLYLINFCELDIEILPNDNDFVLIAPTGGRYRFEVVGLKMYVKKVSLMDGLALDIARKLEVKPVRYAVRKTMMKSMFISQGRYEFTANMFMAQIPRRVTMGLVANTDYVGTILRSPFNFQPFNVREISILANGRSYPQAPYDLVYPNGKYVRPFNDMNEAVGFANSSESNGITFAQYGKTHCIYVFNLTNSGDDQAALFDLIKNGTTAVSIKFNQPVPVGGIMLVVMGECDSLVIKLGLILFFLRISLPLVSSTLREQQQQQQQRQPENTYSAYLKNLTFTRQQYEPEYSYTEYLRRLSLSKRTTNIPFTTTPKVPPKSDKLIDEHVSAVLPPLIQMCKDRPEESSFFHQAVCWALFALYLMFIISL

SEQ ID NO: 120110 - protein, 204 aa, Heterodera glycines
  Coding regions on vcDNA: vcDNA=SeqID_46533; Strand=+; Position=1-637
  Homolog annotation: Hit_ID=NP_498735.1; Match level="QueryCoverage =99%, HitCoverage=48%, E-value=9e-22, Identity=30%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
VSLMDGLALDIARKLEVKPVRYAVRKTMMKSMFISQGRYEFTANMFMAQIPRRVTMGLVANTDYVGTILRSPFNFQPFNVREISILANGRSYPQAPYDLVYPNGKYVRPFNDMNEAVGFANSSESNGITFAQYGKTHCIYVFNLTNSGDDQAALFDLIKNGTTAVSIKFNQPVPVGGIMLVVMGECDSLVMLDKNRSISSDTTI

SEQ ID NO: 120111 - protein, 183 aa, Heterodera glycines
  Coding regions on vcDNA: vcDNA=SeqID_46534; Strand=+; Position=1 -200,594-747,916-989,1535-1665
  Homolog annotation: Hit_ID=XP_321016.1; Match level="QueryCoverage =92%, HitCoverage=20%, E-value=9e-30, Identity=40%"; Hit description =ENSANGP00000007830 [Anopheles gambiae]
  Essential gene: C elegans homolog=F43G9.12; Phenotype=Emb,Lva
SVLQGIGDLFVDTNDEFCQLGHILQRLLHWLAVDPSSFEQAYVPLCLPKLLGPFVRLQLVDWRPLKSPTQRPLYRMPWYRALLMAGLDNSGLEDLEHPSLVSLIPSVVEKIVFPKIAKIVREQWDPLSLHESSNLAQLLRSLRSILSDACLEELVVEGLLNRFTVLALRVGPPVDADQMSGSD

SEQ ID NO: 120112 - protein, 88 aa, Heterodera glycines
  Coding regions on vcDNA: vcDNA=SeqID_46535; Strand=-; Position=1 -122,319-463
  Homolog annotation: Hit_ID=NP_609452.1; Match level="QueryCoverage =90%, HitCoverage=19%, E-value=4e-18, Identity=50%"; Hit description =CG6724-PA [Drosophila melanogaster] gb|AAF53009.1| CG6724-PA [Drosophila melanogaster] gb|AAM50731.1| GM2
  Essential gene: C elegans homolog=F55F8.5; Phenotype=Lva
MVKASFHGHVGVVSDVCWHSTDQHLFVSASFDNTVKMWDVRSPRAALYDLMGHSDRVLCVDWTVPSRICSGSVDSTVKVFSHGTEENI

SEQ ID NO: 120113 - protein, 231 aa, Heterodera glycines
  Coding regions on vcDNA: vcDNA=SeqID_46536; Strand=-; Position=1 -41,99-180,618-757,844-922,1062-1165,1215-1275,1323-1406,1657-1694
  Homolog annotation: Hit_ID=AAQ84884.1; Match level="QueryCoverage =98%, HitCoverage=37%, E-value=4e-70, Identity=58%"; Hit description =calcitonin receptor-like protein SEB-1B [Caenorhabditis elegans] gb|AAT92086.1| Hypothetical protein C13B9
  Essential gene: C elegans homolog=C13B9.4a; Phenotype=Unc
YFKSVAFWWMFLEGGLYLHNLLVFAFFNKTPKLWPYLITAYGVPLAHTFCWLIVLLVKKHGQLERCLGSYYLETEFWILDGPRLLQLVLNAFFIFNVIRVLWLKVRDSQQSSSENLRKSVKAALMLIPLLGIPNIMQTIPFSPTQENITYFAIWTYCAYFAIWTYCASLSYMYQGFMIAIIYCFTNREVQSVIIYCFTNREVQSVLHNCYTRHRLSHSRTDELFRGATTAG

SEQ ID NO: 120114 - protein, 340 aa, Heterodera glycines
  Coding regions on vcDNA: vcDNA=SeqID_46537; Strand=-; Position=1 -602,650-753,796-874,921-1156
  Homolog annotation: Hit_ID=NP_445942.1; Match level="QueryCoverage =98%, HitCoverage=28%, E-value=1e-114, Identity=61%"; Hit description= exportin 1, CRM1 homolog [Rattus norvegicus] dbj|BAC65240.1| nuclear export factor CRM1 [Rattus norvegic
  Essential gene: C elegans homolog=ZK742.1a; Phenotype=Emb,Lva,Unc
KVIEIISEQLPLSFDIATSYANGTNEDQKFVSNFAQLLSTFFKEHSALVEITFPHPDEEQKAVKQAHLMALKYLLKISSEVEDIEVFKVSFLYGTLITLSPITQICLDYWNWLCMELFRESPFEQSEHSIIDALKRYNRQESPKRKLYIEVLSELRLLMISRMAKPEEVIVVVNENNEAVRELVKDTDSVVLYKTMRETLVLLTHLDYRDTELKMTEKLQNQVNGSEWSWKNLNTLCWAIGSISGAMHEDDEKRFLVTVIRDLLGLCEQKRGKDNKAVIASNIMYVVGQYPRFLRCHWKFLKTVINKLFEFMHESHEGVQDMACDTFIKIVIKCKSHFIS

SEQ ID NO: 120115 - protein, 130 aa, Heterodera glycines
  misc_feature (94)..(94): Xaa can be any naturally occurring amino acid
  misc_feature (125)..(125): Xaa can be any naturally occurring amino acid
  Coding regions on vcDNA: vcDNA=SeqID_46538; Strand=+; Position=1 -158,569-806
  Homolog annotation: Hit_ID=CAE67373.1; Match level="QueryCoverage =71%, HitCoverage=43%, E-value=4e-35, Identity=77%"; Hit description =Hypothetical protein CBG12849 [Caenorhabditis briggsae]
  Essential gene: C elegans homolog=B0261.4; Phenotype=Age,Gro,Ste,WT
TVEELRLKSNSDLHKLWYVLLKERNMLLTMDHAYKVRLRNMPNPERIDRVAESMERLEAVVHERNDAFLQLETGDSASPPKRTVTSFMGFTYEXENVKKQIYYGIFSSKTFKFVKYYILEVSCFXRRATA

SEQ ID NO: 120116 - protein, 138 aa, Heterodera glycines
  Coding regions on vcDNA: vcDNA=SeqID_46539; Strand=-; Position=1 -95,464-597,975-1055,1753-1859
  Homolog annotation: Hit_ID=XP_428887.1; Match level="QueryCoverage =94%, HitCoverage=26%, E-value=5e-31, Identity=50%"; Hit description =PREDICTED: similar to DUSP16 protein, partial [Gallus gallus]
  Essential gene: C elegans homolog=F08B1.1a; Phenotype=Sck
PADGHHFLRIPIKDSYSAKLLPHFDAAFEFIEAARASGHKVLVHCLAGISRSPTLVIAYVMRAKQVVSDEAYKFVKNLRPTISPNFNFLGQLMEYEKLLRDQKQMPSPNRRRRWFSLKRSRRPSLLIVGPASLLALMP

SEQ ID NO: 120117 - protein, 426 aa, Heterodera glycines
  misc_feature (137)..(137): Xaa can be any naturally occurring amino acid
  misc_feature (155)..(155): Xaa can be any naturally occurring amino acid
  misc_feature (264)..(264): Xaa can be any naturally occurring amino acid
  Coding regions on vcDNA: vcDNA=SeqID_46540; Strand=-; Position=1 -22,308-351,401-463,676-739,791-840,909-1176,1370-1453,1810-2013,2304- 2568,2808-2879,3020-3104
  Homolog annotation: Hit_ID=CAE65708.1; Match level="QueryCoverage =100%, HitCoverage=53%, E-value=9e-93, Identity=47%"; Hit description= Hypothetical protein CBG10785 [Caenorhabditis briggsae]
  Essential gene: C elegans homolog=F15C11.1; Phenotype=Egl
FLSNSANQDDWEAMMEISNTDEQEKIQEKIRELAGENALPTTDPNQCIICRRVLSCKSALQMHYRTHTGERPFKCRICQRAFERPFKCRICQRAFTTKGNLKTHMGVHRSKAPGNLKTHMGVHRSKAPLRIRCTICXTTACRRRKMPAEGCPTSXTAAHCTLIARASAPGTADIPCPICGHKSGDPGQLQQHMADIHGSAVPRGDVRPSPSPRMPPAPFPPMIVPPSLNDTEPNEPPLLVKEETEMQRHAEGTDGGESAVEEKXVKREKGKAQKTLSPDSSSSSEMQQRNCVSNKIPSKQYECPPVFLDWPFLPADPTIFSAADSPPPAFPKIPSAPRPPPPRGRVPLAKHQCRWCMKPFSSSSALVIHSRTHTGDRPFKCEECGRAFTTRGNLKVHMGTHSAPQNPSRRGRRIFDGGGVAARLPL

SEQ ID NO: 120118 - protein, 272 aa, Heterodera glycines
  Coding regions on vcDNA: vcDNA=SeqID_46541; Strand=+; Position=1 -46,91-333,420-604,982-1100,1153-1322,1378-1434
  Homolog annotation: Hit_ID=NP_495110.2; Match level="QueryCoverage =83%, HitCoverage=12%, E-value=7e-27, Identity=32%"; Hit description =putative protein, with a coiled coil-4 domain, of fungal and metazoan origin (2F960) [Caenorhabditis eleg
  Essential gene: C elegans homolog=C25H3.8; Phenotype=Gro
HLFHQQRQNAPGNIKVYDHHHPYETDLESGLTSDFDVQLELADGFAISLVGIVDEEGESKGLKQEELCYGRLSGIKLNVGKFKATYRINCHIDSIQMDNQIIGADRWHFLFCDPGALKDEPMVGLPALAFEMSYTPSEFFDVYEACPCPTLFICSELNKQLTLFSFENALVTLAPFCWLRYFCSLSRLLETLGNFYLNKLKRQKLNIIFAMDAFGNPMALGNELKEGLQGLIFEGDLAGFAFGIGYGAANSLSKVTSSMAQGKIFIIKQKII

SEQ ID NO: 120119 - protein, 222 aa, Heterodera glycines
  Coding regions on vcDNA: vcDNA=SeqID_46542; Strand=-; Position=1 -6,309-456,504-774,892-1135
  Homolog annotation: Hit_ID=NP_998080.1; Match level="QueryCoverage =90%, HitCoverage=35%, E-value=2e-27, Identity=36%"; Hit description =hypothetical protein zgc:85952 [Danio rerio] gb|AAH67715.1| Hypothetical protein zgc:85952 [Danio rerio]
  Essential gene: C elegans homolog=T01G9.5a; Phenotype=Emb
MLAKAAAKEWSTKLFSIPSSVIISKKDEESVDFIKVLFQMAKNAQPSIIFIDEIDAFLRSGTVQRGKAQFLVEMDKLSSNSAYHVLVIGATDQPKELDKEASRRFAKRIFVENPSQQTREKMIRKIVEENQHAFELRDEEIKQLASRTENYCFDDLLDLCQTVNLGVLHDASERNEFGQWETVAQLRHIKMNDLENAIEKVGFMATRTTYSVIHKSNSYNVV

SEQ ID NO: 120120 - protein, 140 aa, Heterodera glycines
  Coding regions on vcDNA: vcDNA=SeqID_46543; Strand=+; Position=1 -140,698-806,847-1020
  Homolog annotation: Hit_ID=NP_666329.2; Match level="QueryCoverage =50%, HitCoverage=7%, E-value=2e-18, Identity=63%"; Hit description =alanyl-tRNA synthetase [Mus musculus] gb|AAH33273.1| Alanyl-tRNA synthetase [Mus musculus] dbj|BAC39520.1|
  Essential gene: C elegans homolog=F28H1.3; Phenotype=Emb,Lva,Unc
MGGTGPCGPCSEIHYDRVGGRNAAHLVNTGDPMVVEIWNLVFIQYYRRKIKELFKRATIYGSQMLGMERMSMHLMVPVIVEQLGETFPEMAQNKHKIADAVRIEEERLWKQRDDGMRHLEELFRNHPPTSKVFPGELIES

SEQ ID NO: 120121 - protein, 448 aa, Heterodera glycines
  Coding regions on vcDNA: vcDNA=SeqID_46544; Strand=-; Position=1 -217,1104-1227,1281-1368,1702-1767,1813-1967,2165-2320,2500-2641,3052- 3102,3161-3298,3623-3772,3867-3926
  Homolog annotation: Hit_ID=CAE67815.1; Match level="QueryCoverage =80%, HitCoverage=95%, E-value=3e-39, Identity=27%"; Hit description =Hypothetical protein CBG13395 [Caenorhabditis briggsae]
  Essential gene: C elegans homolog=M176.2; Phenotype=Emb,Lva
MTFRQLDIKCLKSFFIGLSFFATFFVSTNIIKPLQSLVCITSPNNCKEFVNPSSDPNLTSSKIAPIFYLMIYRNAVLNYVEEAFSSRYEVQKLANYAIDWAFNNGMILRYDIRHNFIAQFSPVSLLPSPFPREAFEKAIAVQEDYMLNTVKSSKEDGMDRYEIKQIEANTGAITGLRIDRRTTELHQRLLKRIGRDPTNAPQNEGDTNLINSLFMAWESFGNSDALFVILSAKWNKYKYELRNIEDELERLSGGKLRVEYVPLLEGYENFSLADDNSLLLNGKIVGVVYSGLSALGYQANEKEMHTRKIVELSTAIKAPSLAIGISSSKKIQQLLASPGILERFFPDPAEADKVKAIRETFTGLWGLEKDDKQTEQLIANYFLRPFYAPKFGLVVSELGVYGTLMGDMLTRNVSSNVQRGHVLRTKSAGVNEGGISVGTAVGDSPYLF

SEQ ID NO: 120122 - protein, 120 aa, Heterodera glycines
  Coding regions on vcDNA: vcDNA=SeqID_46545; Strand=-; Position=1 -74,201-341,763-911
  Homolog annotation: Hit_ID=XP_420431.1; Match level="QueryCoverage =95%, HitCoverage=18%, E-value=1e-35, Identity=64%"; Hit description =PREDICTED: similar to U6 snRNA-associated Sm-like protein LSm6 (Sm protein F) [Gallus gallus]
  Essential gene: C elegans homolog=Y71G12B.14; Phenotype=Gro,Unc
RTINQRFALLFDINNNSTCKSVLHGVFCARYKMSAPTTLATNSRRQTPSEFLKKIVGKPVVVKLNSGADYRGILSCLDGFMNIALEQTEEYHGGQLKAKYGDAFIRGNNVLYISTQKRRM

SEQ ID NO: 120123 - protein, 74 aa, Heterodera glycines
  Coding regions on vcDNA: vcDNA=SeqID_46546; Strand=+; Position=1 -96,141-267
  Homolog annotation: Hit_ID=NP_492765.1; Match level="QueryCoverage =100%, HitCoverage=29%, E-value=3e-27, Identity=82%"; Hit description= proteasome Alpha Subunit (27.2 kD) (pas-5) [Caenorhabditis elegans] emb|CAB02097.1| Hypothetical protein
  Essential gene: C elegans homolog=F25H2.9; Phenotype=Emb,Lva
MFLTRSEYDRGVNTFSPEGRLFQVEYAIETVKLGSTSIGIHTKEGVLLAAERRSMSKLVVDDSMSKISEVEKHI

SEQ ID NO: 120124 - protein, 144 aa, Heterodera glycines
  Coding regions on vcDNA: vcDNA=SeqID_46547; Strand=+; Position=1 -180,232-486
  Homolog annotation: Hit_ID=NP_492765.1; Match level="QueryCoverage =71%, HitCoverage=40%, E-value=8e-26, Identity=56%"; Hit description =proteasome Alpha Subunit (27.2 kD) (pas-5) [Caenorhabditis elegans] emb|CAB02097.1| Hypothetical protein
  Essential gene: C elegans homolog=F25H2.9; Phenotype=Emb,Lva
ISLGRPFGVSMLFAGIDHTGAHLFHLDPSGTYIKCLAKAIGAGSDAAEQTLQEHCKNCDKKMEMAEAKQVALNTLKQLMEEKINSKNVEIVMIKPQTDKEGKTVAIGRKCIFCYLFPFSVGQNCVVRGIGVARNHFAIVVEGDG

SEQ ID NO: 120125 - protein, 686 aa, Heterodera glycines
  Coding regions on vcDNA: vcDNA=SeqID_46548; Strand=+; Position=1 -135,217-326,384-544,676-1113,1275-1294,1340-1437,1541-1728,1993 -2115,2253-2426,2505-2735,3082-3464
  Homolog annotation: Hit_ID=NP_741210.1; Match level="QueryCoverage =95%, HitCoverage=51%, E-value=6e-79, Identity=30%"; Hit description =actin-binding FH2 family member, CYtoKinesis defect CYK-1, LEThal LET-794 (cyk-1) [Caenorhabditis elegans
  Essential gene: C elegans homolog=F11H8.4a; Phenotype =Emb,Lon,Rup,Stp,Unc
QNDVHDLDSRTNTLPSSCKNSDREHILLQLLLKLVVGQRPEIQKVATYFSVINKCVSSVAFGDTALDQDTEKQNVFTGGDLDDEFDKMERDDGIKRLNKRLDSAVEEKQEAVSLQIKYYEKLKELQHECSELRKVAPSGRALPPATVLDLPLPKELGKIVNGTQKHGIAAGAAFPTGPGCPPPPPPPPPPPALLMPDHKRNKLVTAAGGSVPPPPPPPPPPSALRPGGGGPPMPPPPPPGFGTPPTAFLHAASPELPDYLKKKSGNQPEVPMKKLPWNAAIAKFSATGRMNCLPMNLAKRPPSKAKTPLVIQDAKMLQALAILQGSCKLSFKRWRNAILEVDEKALNAELVDKLKSALPPLEMINRLKKCTDDEMQRMPEGEQELLKSQGLKHFINLVLLVGNFMGRTKNSKDAFAFELSVLNKLVDTRDCDNSETLLHGLIRLLHRKFSGKFTTFALDDFHHVSKACRVDVSELSKNKIDQVATYLSGYKMQAENDRFNERIGAFVKQAKEDLVTVDSLWENMQRKWSAVQAYLCFDPKKYAMDRLFADVHTFKGHYQNARAEVLKDQLKGAVDGREGAKASSRKPFKPIQPIASEAAKRAQQRNSTSSRRELLLSNEGGGGGSTATTPARPQATKIGTTPNTVPFGAKDAAGGGDGGVIDKIEQMLEEGMYRIECQKRPFRVRR

SEQ ID NO: 120126 - protein, 220 aa, Heterodera glycines
  Coding regions on vcDNA: vcDNA=SeqID_46549; Strand=+; Position=1 -174,239-613,678-791
  Homolog annotation: Hit_ID=AAL78213.1; Match level="QueryCoverage =95%, HitCoverage=84%, E-value=3e-66, Identity=60%"; Hit description =probable protein kinase Hgg-20 [Heterodera glycines]
  Essential gene: C elegans homolog=R90.1; Phenotype=Lva,Unc
MEELVALSPGIRVGRWTITKKLGAGAFGAVYLCVNDQGEQAALKTEPVNTPHPLLVMEAHVMTKLDTLRDGDGKHFCRCLDLGRDEQQDQQSGQMKKFNYIVMSLVGRGLDGVVKDAGGRLSLGSAVGVSIQMLAALRGLHTVGYLHRDIKPGNSTIGRPESNEIRLLYLIDFGMARKYTRDDGSQHRPRVATNFRGSPRYAAISAHLGREYSRKDDIES

SEQ ID NO: 120127 - protein, 277 aa, Heterodera glycines
  Coding regions on vcDNA: vcDNA=SeqID_46550; Strand=-; Position=1 -73,127-183,251-440,765-849,896-1191
  Homolog annotation: Hit_ID=CAE67090.1; Match level="QueryCoverage =85%, HitCoverage=65%, E-value=3e-53, Identity=49%"; Hit description =Hypothetical protein CBG12501 [Caenorhabditis briggsae]
  Essential gene: C elegans homolog=F43G9.3; Phenotype=Gro,Unclassified
VSDGSSPTRSFSSVFHSLASGAIAGAFAKTAIAPLDRTKINFQVAFAKTAIAPLDRTKINFQVSPSRRYSFKAALRFVILTYREQGFVALFRGNSASLARVVPYAAVQFAAHEEFKHMLNVDKNRCPTPYRRFLAGTLAGVTAVVFTYPLDTAKARLSVSTKEEYQNLRAVFLKECRAKARLSVSTKEEYQNLRAVFLKECRAHGFLTFYRGIFPTLLGVMPYAGLSFFTYESCKLFYTSQTHLKPDITHNENAKFLLFFIPFYFFLEETGNPEPVV

SEQ ID NO: 120128 - protein, 175 aa, Heterodera glycines
  Coding regions on vcDNA: vcDNA=SeqID_46551; Strand=+; Position=1 -65,118-242,295-533,582-680
  Homolog annotation: Hit_ID=NP_491429.1; Match level="QueryCoverage =96%, HitCoverage=54%, E-value=8e-49, Identity=54%"; Hit description =protein phosphatase 1A (34.6 kD) (1F278) [Caenorhabditis elegans] gb|AAC24414.1| Hypothetical protein W09
  Essential gene: C elegans homolog=W09C3.6; Phenotype=Ste
IKYPSNFMLLRGNHECSNINKAYGFYEEIDRRYPRPGARRLFDLFNQVFAWMPFIGLIGEKILCMHGGISDKMRSLDQLSTLRRPHTRPPLRSLEIDLLWADPAQGIRGVVPSTRGAGILFGEDLVAQIRTRLGIDYIIRAHQLVLDGVEYFASRRLITVFSAQRYSGRTTREQR

SEQ ID NO: 120129 - protein, 655 aa, Heterodera glycines
  Coding regions on vcDNA: vcDNA=SeqID_46552; Strand=-; Position=1 -169,210-338,386-423,477-673,798-1063,1115-1238,1463-1554,2027 -2204,2248-2368,2430-2858,2923-2976,3035-3203
  Homolog annotation: Hit_ID=NP_494593.1; Match level="QueryCoverage =85%, HitCoverage=58%, E-value=4e-46, Identity=24%"; Hit description =eukaryotic initiation factor 2C2 family member (2D895) [Caenorhabditis elegans] gb|AAF60724.1| Hypothetic
  Essential gene: C elegans homolog=C16C10.3; Phenotype=Lva
MNRFRNQHFVFGNRMFEKNSVLQLQGIPLICKEGMQKNVRFVGDSPQQSTAVIQLDAKKSAFFPAIGLVDFVGYFINSDPHRLESDVQQKARVVNKQIKGLAVQTIHLPENQMTFSASGLTDRGANEITFTIDNHQTNLVQYYDQKYNRRLRYPCLACVIHRRGNQESYFPMEVLNIVDGQRVSLDKQTPKLAEQMIKKCQVLPVDLPRGIETQRDKGMIQNANPFFRAHEIRVETNMMQAEAQLLYPPAICFSAPIEKIEPNNRGVLDFRLADRGQPLPLRYSVPCKFPKVWAVVIVQNSVQRDQCSEHVSEQFAYYANNRCKFVLFFAPGKESAHAGVLTQHVAPKTVDKALGRQGAIMVLDNIMLKTNLKMGGANYEICAAQAFKEANRIRYDILSEQWLGRKRMFFGLDMSHAPPQTLFERRTGKAPAIPTIVGMAYTISEHLLQMNGTYWMQQPRVATVQMASPMVNAVKEALMTFNAKNGFFPEHIFVFRAGASEGEYKKVGETEELQKGDQLKVAYWEGGAFATAFAELTKERKMSKKPALTLIVCQRNSNYRIIPNNVRPGGRAPEQNCQPGTAMHSSLTEFLLVGHRTIQGTAQPLRCTVVIDTAEPRIKLSELEQISYALCYQHGICCSSTAVPGVLYSAGDLAK

SEQ ID NO: 120130 - protein, 54 aa, Heterodera glycines
  Coding regions on vcDNA: vcDNA=SeqID_46553; Strand=+; Position=1-163
  Essential gene: C elegans homolog=Y63D3A.8; Phenotype=Sck,Sma,Stp
IVPPNKKWRISNEFVSLFHSILSGIWALAILTRFDFHQIDDLVNKDSLDARYLV

SEQ ID NO: 120131 - protein, 114 aa, Heterodera glycines
  Coding regions on vcDNA: vcDNA=SeqID_46554; Strand=-; Position=1 -183,237-398
  Homolog annotation: Hit_ID=CAE72830.1; Match level="QueryCoverage =73%, HitCoverage=9%, E-value=3e-19, Identity=51%"; Hit description =Hypothetical protein CBG20114 [Caenorhabditis briggsae]
  Essential gene: C elegans homolog=W03F8.10; Phenotype=Emb
MDFFFYHLQINLIFLFVIIIPKFSQSESDRLRAEQLLNEHKRDFDRQYEENKARLEDISNTISSIDGALPALNLEVCGADSAPCDAVCGGPGPTCSRCGGSSCPGTLNLKNIKY

SEQ ID NO: 120132 - protein, 136 aa, Heterodera glycines
  Coding regions on vcDNA: vcDNA=SeqID_46555; Strand=+; Position=1-546
  Homolog annotation: Hit_ID=AAH73232.1; Match level="QueryCoverage =94%, HitCoverage=16%, E-value=4e-14, Identity=35%"; Hit description =MGC80562 protein [Xenopus laevis]
  Essential gene: C elegans homolog=W07E6.4; Phenotype=Emb
PHAKVESDEEGGAESGDEETAKERAAIEAAEDAAGELHQRLNIGAEKQHTGSTLTQPAPAAPTAGSVIIRDYDPKKSRGGPVSKTAAASTEKYIISPLTNERIPADKLHEHVRYNTVDPQFKEQRDRCVLAKGGLS

SEQ ID NO: 120133 - protein, 619 aa, Heterodera glycines
  Coding regions on vcDNA: vcDNA=SeqID_46556; Strand=-; Position=1 -106,199-346,408-548,651-810,898-1120,1328-1438,1703-1819,1959 -2097,2192-2471,2546-2592,2783-2899,2949-3081
  Homolog annotation: Hit_ID=CAE62877.1; Match level="QueryCoverage =92%, HitCoverage=82%, E-value=1e-162, Identity=53%"; Hit description= Hypothetical protein CBG07063 [Caenorhabditis briggsae]
  Essential gene: C elegans homolog=W07E6.4; Phenotype=Emb
AELRVSNREEDAQNIEPSMSGKQIVGLIIPPPDIRTIVDKTALFVARNGLEFEMKIKEREASNMRFNFLNPTDPYFAYYRNKVFNASADTQSASADTQSKVKLPEAVREHVQRAEFIPRLPPKPFEFCADPLTLNAFDLDLIHLTDLIHLTALFVARNGRQFLTQLMNREVRNFQFDFLKPQHSNFQYFTKLVEQYTKVLIPVLIPPKTIVDDLRASVTQHKILEDVRYRVGWDRHQKALKDREDQAVEKERIAYNQIDWHEFVVVQTVDFQPSETLNLPPLCTPKDVGARILLQQRTEAAKAAAESVAMDVMDQRLNIGAEKQHTGSTLTQPAPAAPTASVIIRDYDPKKSVSKTAAASTEKYIISPLTNERIPADKLHEHVRYNTVDPQFKEQRDREQMDRQDEDLVMAPGAEISRNIAKLAERRTDIFGIGEKGAEQTIIGKKLGEEERQMPRSDPKTIWDGQLSTIDATTRAAQQSVSLEQQISEIQRQHGYLPNPAAERQHGYLPNPAAERMVPFQQRPPPHQSTGGIASNVQKIVPVPQQPPQMSIPPAPAPPGGRPHMPPPPHMGMPPPPGGRPHMPPPPHMGMPPHGVMGAMPPHMQPGKQTHIWGSYMNK

SEQ ID NO: 120134 - protein, 306 aa, Heterodera glycines
  Coding regions on vcDNA: vcDNA=SeqID_46557; Strand=+; Position=1 -258,357-654,958-1166,1419-1574
  Homolog annotation: Hit_ID=AAD43464.1; Match level="QueryCoverage =99%, HitCoverage=70%, E-value=1e-139, Identity=66%"; Hit description= pre-mRNA splicing factor [Heterodera glycines]
  Essential gene: C elegans homolog=F49D11.1; Phenotype=Bmd,Emb,Lva
MDLLKSYDGSSSSDNEQELADIPSSSNHNKLLALKIPSINLTPNVIEQRAIQQVAVVDPKTKELYHNPRFDELFRPEVVPYVLLCRSGPQNPFKSEHQRAEKNTLTGYVEPAHFNAFHFERSLRSYDTLGYADNPTADTTSAKFVGDVGQAQEKAGESLFESVKTGGQKRKRVINYDASNVDGYTVKDDTDYLGRSFMEPPKYTGTNLREDFVPDRCFPPTKQAHTYSSHTKPVTAIRWFPRSAHMFISCSMDGKVKNRYTIGGHRAYVVKFNPDDDKQNIFMAGMSNKKIIQWDTRTGEIEQVEK

SEQ ID NO: 120135 - protein, 105 aa, Heterodera glycines
  Coding regions on vcDNA: vcDNA=SeqID_46558; Strand=-; Position=1 -85,135-261,315-491
  Homolog annotation: Hit_ID=NP_492852.1; Match level="QueryCoverage =83%, HitCoverage=61%, E-value=2e-10, Identity=37%"; Hit description =putative protein, with a coiled coil domain (16.7 kD) (1L537) [Caenorhabditis elegans] emb|CAB60435.1| Hy
  Essential gene: C elegans homolog=Y95D11A.1; Phenotype=Gro
MNSTSSSYRIGPQWWKKPIYQSPVVNPLERGPDFSFVDGRRLPFTTESEFNRRVKQVELGRKVVQYLAEIRHAEELYKENNLQREIVQQKIEQNMPKQKGTEELF

SEQ ID NO: 120136 - protein, 249 aa, Heterodera glycines
  Coding regions on vcDNA: vcDNA=SeqID_46559; Strand=-; Position=1 -124,188-290,351-492,667-780,836-869,930-1027
  Homolog annotation: Hit_ID=CAE66009.1; Match level="QueryCoverage =98%, HitCoverage=13%, E-value=1e-80, Identity=64%"; Hit description =Hypothetical protein CBG11201 [Caenorhabditis briggsae]
  Essential gene: C elegans homolog=C52E12.2a; Phenotype=Unc
CFQLVVGRIRSCPDWSGGEDEDVLSLGLFPGTYLEFSMDDRVFFQFEAAWDSSLHNVFFQFEAAWDSSLHNSPLLNRVSGYGENVYMTISAAYMEIENCAQSAIITKDLGLIVYARDSKISAASRFCRSLIGGISKSAEMNRVPGVYLLTVMEDSDPGTARRKRRILDTSSTYVRGEENLGTWRVRGEENLGTWRPRGDSIILPRGDSIILEHQLELEKLSKLQQVERMRLFLMVSDTPGGESRKINIL

SEQ ID NO: 120137 - protein, 99 aa, Heterodera glycines
  Coding regions on vcDNA: vcDNA=SeqID_46560; Strand=-; Position=1 -46,470-720
  Homolog annotation: Hit_ID=CAE65135.1; Match level="QueryCoverage =100%, HitCoverage=59%, E-value=2e-41, Identity=83%"; Hit description= Hypothetical protein CBG10001 [Caenorhabditis briggsae]
  Essential gene: C elegans homolog=R10E11.8; Phenotype=Ste
MAVARPDLVMKAIIPVVMAGIVAIYGLVVAVIISGRLEAAGPGYTIDRGFSQFAAGLVCGLCGLGAGYAIGVVGDAGVRDLSQQPRLFVGMNLMLIFSE

SEQ ID NO: 120138 - protein, 333 aa, Heterodera glycines
  misc_feature (7)..(7): Xaa can be any naturally occurring amino acid
  misc_feature (10)..(10): Xaa can be any naturally occurring amino acid
  misc_feature (57)..(57): Xaa can be any naturally occurring amino acid
  misc_feature (326)..(326): Xaa can be any naturally occurring amino acid
  Coding regions on vcDNA: vcDNA=SeqID_46561; Strand=-; Position=1-1004
  Homolog annotation: Hit_ID=NP_509377.1; Match level="QueryCoverage =93%, HitCoverage=58%, E-value=2e-58, Identity=40%"; Hit description =predicted CDS, reverse transcriptase like family member (XI784) [Caenorhabditis elegans] gb|AAB37984.1| H
  Essential gene: C elegans homolog=ZK250.3; Phenotype=Clr,Lvl,Sck
CNQHCLXSFXTNFSSKILEFLNSTRFFDKEQFGFLKNRSTTTQILKTMDDIYNSIQXNQQIDIIYIDFVKAFDSVPIDLLLQKIKKIGIEGKIYNFLTNFLKNRSFKVKIGDELSESFKIFSGVPQGSVLGPLLFLIFINDLPSFISNKASSVGIKMYADDVKLYYAHENDDHSNQLDKAIEALEKWSKINGLEISTEKCFVLYLGKNNKKKEYFINSKKISESESVRDLGIIIDSKLNFSEHISKIIRNAYLRIFQILRVLKSREIKTLTAAYKTFVRPQVEYATKVWNPNLKKDIDKIERVQKFFTRKALRKCGFVYKGVGKDXKSGLHKL

SEQ ID NO: 120139 - protein, 143 aa, Heterodera glycines
  Coding regions on vcDNA: vcDNA=SeqID_46562; Strand=-; Position=1 -329,688-787
  Homolog annotation: Hit_ID=NP_504952.1; Match level="QueryCoverage =83%, HitCoverage=14%, E-value=7e-19, Identity=40%"; Hit description =squamous cell carcinoma antigen like (5I52) [Caenorhabditis elegans] gb|AAK72085.1| Hypothetical protein
  Essential gene: C elegans homolog=F19F10.9; Phenotype=Emb
MDIATDFDGLGPIATGNGKSTVSESDEGELIGNKVSQNNSKKAEEDEGEEESTTYTNILGEEKDVTKGVGAMLKLAGQKGYLESGERKLEEGKLKHLESKRFSKVEQGRYDIEDKTMRKLERMGTTGTGPTRPFPEKAEYEPK

SEQ ID NO: 120140 - protein, 186 aa, Heterodera glycines
  Coding regions on vcDNA: vcDNA=SeqID_46563; Strand=-; Position=1 -225,751-906,1244-1423
  Homolog annotation: Hit_ID=NP_495784.1; Match level="QueryCoverage =46%, HitCoverage=24%, E-value=9e-12, Identity=47%"; Hit description =component of the meiotic and mitotic spindle poles, ZYGote defective : embryonic lethal ZYG-9 (156.2 kD)
  Essential gene: C elegans homolog=F22B5.7; Phenotype=Emb
MANDANIIVAASATKCVMFFAKGLRSKFTPYVSLVVPVIFTKFKEKKQLLRDALVECIDGIATYTVKMDNPIEMNDRIELLANANPSSRLFADSAKKRDEPKSRHNLTFNSTPDDPIATKKDADQTSNWAGAHDTAFLSGTLSSNQRIECGTQQIGYEKGVRTALSFSRGKAMPPSPMLFCARKIR

SEQ ID NO: 120141 - protein, 397 aa, Heterodera glycines
  misc_feature (389)..(389): Xaa can be any naturally occurring amino acid
  Coding regions on vcDNA: vcDNA=SeqID_46564; Strand=-; Position=1 -251,303-436,490-646,696-801,955-1026,1074-1228,1327-1491
  Homolog annotation: Hit_ID=CAE72605.1; Match level="QueryCoverage =98%, HitCoverage=48%, E-value=4e-52, Identity=34%"; Hit description =Hypothetical protein CBG19796 [Caenorhabditis briggsae]
  Essential gene: C elegans homolog=Y105E8B.2a; Phenotype=Gro
SESTGLTEDIKGPAHLLSSPRTLSQPIQQLIALGRTVYAVELYLRCRSVALRAAARELTISEEPLSYVRQVSGLFVNDILEVCQELSPHRDQVCQELSPHRDQLCQVLTWSSRELSVLLSLIRRHVIEVAPTMAVLTHTWRILMSKHTWRILMSKCAQLVPIGLDLSFEVNRLAAPSLKNALEANFGNILDSIRLRNSEERWTPFSLGTDQNLIRFLEEERWTPFSLGTDQNLIRFLEEMSDIGLQIEWVRSNSGAYRCALNLAQSGCLFARTALQLSRDLALLNTSPHLHQRDLALLNTSPHLHQLSDSLMHSIWTEQLAHLTAGMHKSVVHHCTSRFIVSQVLPLCEKVYELSENGTGILHTLKHEIPPFAALSAQANQHFFEQQKXSSEEVANV

SEQ ID NO: 120142 - protein, 85 aa, Heterodera glycines
  Coding regions on vcDNA: vcDNA=SeqID_46565; Strand=-; Position=1 -140,193-220,572-658
  Homolog annotation: Hit_ID=NP_502556.1; Match level="QueryCoverage =57%, HitCoverage=33%, E-value=3e-20, Identity=87%"; Hit description =putative protein (15.5 kD) (4O65) [Caenorhabditis elegans] emb|CAC44306.1| Hypothetical protein Y67H2A.5
  Essential gene: C elegans homolog=Y67H2A.5; Phenotype=Sck,Ste
MCSKPTNVFLFKRLVSPVQICCRSIKGGGLVHPVTGKEPPTLEEFDPLNPGEWQLGAYGKILPRLPEGTRCGGLVMGKYGLYNPK

SEQ ID NO: 120143 - protein, 213 aa, Heterodera glycines
  Coding regions on vcDNA: vcDNA=SeqID_46566; Strand=-; Position=1 -40,109-132,387-448,534-613,894-965,1026-1096,1623-1854
  Homolog annotation: Hit_ID=CAE57828.1; Match level="QueryCoverage =88%, HitCoverage=84%, E-value=7e-68, Identity=70%"; Hit description =Hypothetical protein CBG00853 [Caenorhabditis briggsae]
  Essential gene: C elegans homolog=ZK970.2; Phenotype =Emb,Gro,Pvl,Slu,Sma,Stp
FSRSTTAPVGIPFVVDNDGKTERVYDIYSRLLKDRIVCVMNPIDDFFAASVIAQLLFLQSESGKTAINMYINCPGGSVTAGLGIYDTMQHISAPVATWCIGQASSMGSLLLTAIGQASSMGSLLLTAGAKGMRTSLPNARIMVHQPSGGAYGTAADIVIRAEEINRMRKRLNEIYAMHTGQTVETIDQALDRWDRSDGSGKIFNILLESFRKF

SEQ ID NO: 120144 - protein, 86 aa, Heterodera glycines
  Coding regions on vcDNA: vcDNA=SeqID_46567; Strand=+; Position=1 -72,125-280
  Homolog annotation: Hit_ID=CAG02412.1; Match level="QueryCoverage =95%, HitCoverage=17%, E-value=2e-22, Identity=68%"; Hit description =unnamed protein product [Tetraodon nigroviridis]
  Essential gene: C elegans homolog=C26C6.2; Phenotype=Egl,Hya,Pvl
TFLAIIFCVALSEYDMVLAEDDEMKRMIESMKLFKRMIESMKLFDSICNNKWFLNTSIILFLNKKDLFEEKIRRSAPKMVLKNYSP

SEQ ID NO: 120145 - protein, 67 aa, Heterodera glycines
  Coding regions on vcDNA: vcDNA=SeqID_46568; Strand=+; Position=1 -88,464-577
  Homolog annotation: Hit_ID=NP_492029.2; Match level="QueryCoverage =100%, HitCoverage=52%, E-value=7e-35, Identity=86%"; Hit description= putative membrane protein (14.7 kD) (1H748) [Caenorhabditis elegans] emb|CAA95834.2| Hypothetical protei
  Essential gene: C elegans homolog=M05B5.2; Phenotype=Gro,Unc
SGQALNDPSTQYIEGRLANRRVWWCPSGYGYLAYCPQPTDWDNYNWCCTFPYFGSWKPSCCPFAIPT

SEQ ID NO: 120146 - protein, 174 aa, Heterodera glycines
  Coding regions on vcDNA: vcDNA=SeqID_46569; Strand=+; Position=1 -48,486-626,1023-1206,1330-1481
  Homolog annotation: Hit_ID=NP_502520.1; Match level="QueryCoverage =57%, HitCoverage=41%, E-value=7e-26, Identity=52%"; Hit description =ribonuclease PH-like (26.1 kD) (4N865) [Caenorhabditis elegans] emb|CAA97771.3| Hypothetical protein B056
  Essential gene: C elegans homolog=B0564.1; Phenotype=Lva
MDVGVENESVVLKIGFAFAMKVINEFGYRQDARTPSQIRNIVYQMGVYSHADGSAYIEQGETKADGANLAACVNVASLALADAGIPLRGLLSAVECGSADGLPCADLSSREHSELVPRLTMATVGGKDEIVLMDMKNLLHKNHLPSLLQMGVNACAQVHICLETAVFRVNYKHI

SEQ ID NO: 120147 - protein, 110 aa, Heterodera glycines
  Coding regions on vcDNA: vcDNA=SeqID_46570; Strand=+; Position=1 -77,330-370,423-468,1274-1444
  Homolog annotation: Hit_ID=NP_498517.1; Match level="QueryCoverage =89%, HitCoverage=34%, E-value=8e-16, Identity=38%"; Hit description =proteasome Regulatory Particle, Non-ATPase-like (49.1 kD) (rpn-6) [Caenorhabditis elegans] gb|AAA21173.2|
  Essential gene: C elegans homolog=F57B9.10; Phenotype=Emb
AQLVRELKKVDDKDLLVDVQLEESIGFYHLSNYTKARADARTIANTKYTPPAMQVMLDQSDEVHSIMTGKTAQKYAKTETEAMHAIAEAAKKRSLAEFNEVCNGAGEKAI

SEQ ID NO: 120148 - protein, 33 aa, Heterodera glycines
  Coding regions on vcDNA: vcDNA=SeqID_46571; Strand=-; Position=1-99
  Homolog annotation: Hit_ID=NP_492360.1; Match level="QueryCoverage =100%, HitCoverage=13%, E-value=5e-09, Identity=87%"; Hit description= proteasome Alpha Subunit (28.2 kD) (pas-4) [Caenorhabditis elegans] emb|CAB02269.1| Hypothetical protein
  Essential gene: C elegans homolog=C36B1.4; Phenotype=Emb,Lva,Unc
MEHYDRAITIFSPDGRLFQVDYAQEAVKKGSTA

SEQ ID NO: 120149 - protein, 134 aa, Heterodera glycines
  Coding regions on vcDNA: vcDNA=SeqID_46572; Strand=+; Position=1 -72,120-266,409-592
  Essential gene: C elegans homolog=C26C6.5a; Phenotype=Emb,Gro,Stp,Unc
MSDESEISSLNEADVTDLRERYENTQRQEVPKEVMVQREMQIRELESILRLEEAKLMMLKKLQQSQQKAAQKTQQQQNQQQQQQQENVRRLAPGVVQNSTGQAYKPKVAVVNPSQHQTGNTSKTNGTTPQHGKK

SEQ ID NO: 120150 - protein, 179 aa, Heterodera glycines
  misc_feature (173)..(173): Xaa can be any naturally occurring amino acid
  misc_feature (178)..(178): Xaa can be any naturally occurring amino acid
  Coding regions on vcDNA: vcDNA=SeqID_46573; Strand=+; Position=1 -52,106-201,247-308,372-476,563-691
  Homolog annotation: Hit_ID=AAC47233.1; Match level="QueryCoverage =87%, HitCoverage=73%, E-value=1e-50, Identity=65%"; Hit description =cyclophilin Ovcyp-2
  Essential gene: C elegans homolog=Y75B12B.2; Phenotype=Emb
SARPKVFFDVMVGGKSTGRIVMELFSDRIVMELFSDIVPKTAENFRALCTGEKGMGKSGKPLHYKGSKFHRVIPSFMLQKSGKPLHYKGSKFHRVIPSFMLQGDFTRGNGTGGESIYGNCFPDENFKEKHTVPGLLSMANVGPNTHGSQFFISTVKTEDVRQAYLAIFEIHDXHKLIXR

SEQ ID NO: 120151 - protein, 159 aa, Heterodera glycines
  Coding regions on vcDNA: vcDNA=SeqID_46574; Strand=-; Position=1 -121,391-558,644-781,940-989
  Homolog annotation: Hit_ID=NP_499949.2; Match level="QueryCoverage =100%, HitCoverage=12%, E-value=5e-26, Identity=40%"; Hit description= rac effector, Gut on EXterior GEX-2 (145.0 kD) (gex-2) [Caenorhabditis elegans] gb|AAB92078.6| Gut on ex
  Essential gene: C elegans homolog=F56A11.1; Phenotype=Emb,Gro,Pvl,Unc
ANRQVSANGRILHAAQLTDDVLVNFCFNTATRRFVRGKQLNYRKPSRGRPPAVAAQYEFGSKSLNSSFSNLSMMYGGFVGVPHFRVVAKLVGYQGISGISAILFDLLGLAQRLLNDQIKTHFRSLLGLMPKMCKLQRFEYGVEAISKDFIHQLRDFSAY

SEQ ID NO: 120152 - protein, 730 aa, Heterodera glycines
  misc_feature (426)..(426): Xaa can be any naturally occurring amino acid
  Coding regions on vcDNA: vcDNA=SeqID_46575; Strand=-; Position=1 -92,141-193,258-373,432-480,532-585,632-712,768-882,932-1126,1181 -1304,1363-1440,1576-1687,1731-1853,1909-1971,2022-2178,2304 -2418,2465-2537,2766-2918
  Homolog annotation: Hit_ID=NP_958866.1; Match level="QueryCoverage =95%, HitCoverage=78%, E-value=0.0, Identity=57%"; Hit description =integral membrane protein 1 [Danio rerio] gb|AAH63234.1| Integral membrane protein 1 [Danio rerio] gb|AAH46
  Essential gene: C elegans homolog=T12A2.2; Phenotype=Emb
KISKYDVFALFNIIFSFSEGAGLIAAALIAIVPGYISRSVAGIVPGYISRSVAGSYDNEGIAIFCMLLTYYFWGIAIFCMLLTYYFWIKSVKSGSIFNSVLCALSYFYMVSSWGGYVFLINLIPLHVLWGGYVFLINLIPLHVLTLICTGRFSHRIYVAYSTTLICTGRFSHRIYVAYSTVYSLGTILSVYSLGTILSMQIPFVGFQPVSTSEHMGAFGVAFGVFGLCQIVALAQWMRSKMTADRFQLLLRSVLLVFGVHVFSMCFHLHVFSMCFHLSILPEIAPWTGRFYSLLDPSYAKNNIPIIASVSEHQPTAWSSFYFDLQFLVFTFPAGLYFCFGLYFCFKKLTDQNIFIILYGLTSIYFAGVMVRLMLVLAPIMCILGGCILGGIAVSSTLGNYVVNVDLFGAEKKRREQRLSRCFFLHXISLAVTLAMSICLISFVYHSTWVTSEAYSSPSIVLSARSGDGGRISTWVTSEAYSSPSIVLSARSGDGGRIIFDDFREAYYWLRKNTPDDAKVDAKVMSWWDYGYQISAMANRTTIVDNNTIVDNNTWNNTHISRVGQAMASNESHAYEIMHELDVDYVLVIFGGVTGYSSDDINKFLWMVRIGGSTPEGRHIHENDYYTKNGEFRIDKEGSSTMLNCLMYKLCYHRFGSSTMLNCLMYKLCYHRFGTVYTEHGRATGYDRVRHAEIGNKNFNLLHLEEAYTSEHWIVRIYRSQKWVKKCLKGF

SEQ ID NO: 120153 - protein, 268 aa, Heterodera glycines
  misc_feature (43)..(43): Xaa can be any naturally occurring amino acid
  misc_feature (266)..(266): Xaa can be any naturally occurring amino acid
  Coding regions on vcDNA: vcDNA=SeqID_46576; Strand=-; Position=1 -405,471-651,787-890,944-1062
  Homolog annotation: Hit_ID=NP_871838.1; Match level="QueryCoverage =95%, HitCoverage=43%, E-value=5e-41, Identity=40%"; Hit description =DEAD/DEAH box helicase and helicase, C-terminal (1G216) [Caenorhabditis elegans] gb|AAO38637.1| Hypotheti
  Essential gene: C elegans homolog=F55F8.2a; Phenotype=Lva
RFILVPKCHEHLADLSALRFLVVDEIDRMLEQGHFENQEKEIXNLFILIVKNLLILFIISDLIIYAFCFGILNQFNLINLFGLSFEVRRIALSMSMRKGAANLSVIDLTPPQKTPQTRTECRMNCADLLQDLDLNLMYLLKRHGGRTLVFANSISAIRRMHSLLKKLALNTALLHGRMKEKERLKSVDKFKASDDSVLLATDVAARGLDFYGVQNIVHYQCPKTTESYIHSYIHRSGRTARASSAGLSVLFVPLDLHQYLKICRNXTK

SEQ ID NO: 120154 - protein, 122 aa, Heterodera glycines
  Coding regions on vcDNA: vcDNA=SeqID_46577; Strand=-; Position=1 -87,139-417,571-573
  Homolog annotation: Hit_ID=CAE71410.1; Match level="QueryCoverage =71%, HitCoverage=91%, E-value=2e-18, Identity=51%"; Hit description =Hypothetical protein CBG18320 [Caenorhabditis briggsae]
  Essential gene: C elegans homolog=K01G5.8a; Phenotype=Unclassified
MDKGRSKSPNHNNEAEETQSAKEDKTDHKTNEQMLLVRTGLKLKRGTLFKKKRNVDPKTIDLTIKKEQEGPRKTKAELAFLKRQEETAFDRLSKRAQISHREKVEKFNKQMEELTEFNDIPK

SEQ ID NO: 120155 - protein, 306 aa, Heterodera glycines
  misc_feature (81)..(81): Xaa can be any naturally occurring amino acid
  Coding regions on vcDNA: vcDNA=SeqID_46578; Strand=+; Position=1 -103,148-280,342-424,491-581,628-959,1122-1148
  Homolog annotation: Hit_ID=NP_494839.1; Match level="QueryCoverage =100%, HitCoverage=28%, E-value=2e-75, Identity=50%"; Hit description= domain protein (100.8 kD) (2E999) [Caenorhabditis elegans] gb|AAA81130.1| Tudor staphylococcal nuclease
  Essential gene: C elegans homolog=F10G7.2; Phenotype=Gro
DGKPEEFGEDAKLFVELRLLQRDVKVVLETTANQNFIGTVLHPRGNIAENFIGTVLHPRGNIAEFLLKEGLAKCVDWSGRXRGGAEKLREAERIAKEKRLRLIAKEKRLRLWKSFTGSSSTVKNAFTAKVVEIGLVDSLSVLKDNGVEIGLVDSLSVLKDNGEEMKVYFSSLRAPRREGTDGTSGGVREGTDGTSGGVQRQFRPLYDIPFMFEAREFLRRRLIGKSVQVIFDYVQPKQDQFPEKTCCTVMFNNQNVAVMLIERGFARAVRHGRDDDNRSPQYDALFAAEAQAEKDKKGIWAEKCTE

SEQ ID NO: 120156 - protein, 216 aa, Heterodera glycines
  Coding regions on vcDNA: vcDNA=SeqID_46579; Strand=+; Position=1 -84,190-276,346-465,1035-1226,1284-1448
  Homolog annotation: Hit_ID=NP_502753.2; Match level="QueryCoverage =94%, HitCoverage=48%, E-value=2e-92, Identity=72%"; Hit description =dihydrolipoamide dehydrogenase (52.6 kD) (4P233) [Caenorhabditis elegans] emb|CAB05249.2| Hypothetical pr
  Essential gene: C elegans homolog=LLC1.3; Phenotype=Emb,Lva
MEVNTKNILIASGSEVTPFPGIDIDEEQIVSSTGALALKKVPQKMVVIGAGVIGLELGSVWQRLGAEVTAVEFMSAIGGVGIDGEVSKQFQRSLTKQLNCDVLLVSIGRRPYTDGLGLNNVQLNTDEKGRVPVNERFQTAVPSIYAIGDVIQGPMLAHKAEDEGILAVEGIAGGPVHIDYNCVPSVVYTHPEVAWVGRAEEQIKQEVNKMMGWSRG

SEQ ID NO: 120157 - protein, 105 aa, Heterodera glycines
  Coding regions on vcDNA: vcDNA=SeqID_46580; Strand=+; Position=1 -45,357-404,487-578,659-732,816-874
  Homolog annotation: Hit_ID=CAA70477.2; Match level="QueryCoverage =100%, HitCoverage=61%, E-value=5e-32, Identity=68%"; Hit description= SEC-2 protein [Globodera pallida]
  Essential gene: C elegans homolog=F02A9.2; Phenotype=Bmd,Dpy
MEALKEKSEKLYNKAGKIDQLVPDAKAFVIGMIEKAKGMRPKAGEKPKLEELRTAANELIEKYKALNDEAKESLKSNFPKITSVIQNEKFQTLAKSLLKQEAPAA

SEQ ID NO: 120158 - protein, 269 aa, Heterodera glycines
  misc_feature (246)..(246): Xaa can be any naturally occurring amino acid
  Coding regions on vcDNA: vcDNA=SeqID_46581; Strand=+; Position=1 -154,280-654,710-961
  Homolog annotation: Hit_ID=NP_492785.1; Match level="QueryCoverage =89%, HitCoverage=53%, E-value=2e-75, Identity=55%"; Hit description =eukaryotic Initiation Factor (50.7 kD) (eif-3.E) [Caenorhabditis elegans] gb|AAC17647.1| Eukaryotic initi
  Essential gene: C elegans homolog=B0511.10; Phenotype=Emb,Lva
QVLEERDGLKDMCDSAAEILDTKDVKEMTDTTRDREGNNKVLEYIGERFGFTMEMLDSLYKYGKFLYECGNYLAASTYLDFYRNLIPQHDPNYLNAQYGKLASEILLQSWDHAKDDLNRLRAYVDSEPFGSELELLQHRAWILHWSLYIHFNYPKGRDEVIDLCLNQQPYLNTIQILCPHLLRYLAVILCPHLLRYLAVSVITSKNKQKASLKDLVKTIEVERGRILSQQLELGCLYLPFSGFATXNVKTKETTCIVTYVSGFTLSHLQ

SEQ ID NO: 120159 - protein, 151 aa, Heterodera glycines
  Coding regions on vcDNA: vcDNA=SeqID_46582; Strand=-; Position=1 -345,410-517
  Homolog annotation: Hit_ID=NP_509851.1; Match level="QueryCoverage =57%, HitCoverage=15%, E-value=7e-22, Identity=59%"; Hit description =putative protein family member (60.5 kD) (XL681) [Caenorhabditis elegans] emb|CAA92024.1| Hypothetical pr
  Essential gene: C elegans homolog=W04G3.2; Phenotype=Lva,Lvl,Unc
MSFCQVLYKTLTSGSVLPSSASANASASADPLNATSALGLPFPPSVSLPPVLAALFPDLNTSTPITLTAAQQEAIGENLEMIQNLIVQPSSPLCSPKPVAVAEFNLDAFMGQWYQVMYSPPLVQSACSVVSYRKLADINSGGIGSIFEVFE

SEQ ID NO: 120160 - protein, 336 aa, Heterodera glycines
  Coding regions on vcDNA: vcDNA=SeqID_46583; Strand=-; Position=1 -32,73-173,213-284,352-450,502-595,640-765,986-1265
  Homolog annotation: Hit_ID=CAE58533.1; Match level="QueryCoverage =90%, HitCoverage=74%, E-value=2e-68, Identity=46%"; Hit description =Hypothetical protein CBG01690 [Caenorhabditis briggsae]
  Essential gene: C elegans homolog=R08C7.2a; Phenotype=Gro
TRLLQQRLVAWQPILTAKTVIPLVFSISILFIPRLVAWQPILTAKTVIPLVFSISILFIPIGIVLLRISQSVQEYVVQYVNMPTSAQEYVVQYVNMPTSAKTTMRMANAFQGDVYFYYFQGDVYFYYALENFFQNHRRYMKSRNDQQLSGILQNTKDCTPFEKAPDRPLQNTKDCTPFEKAPDRPIAPCGAIANSLFNDSFQLNYLGRNGSFQLNYLGRNGNGYDISWSHEGLVWPVDLESKFRNPTCDGLHFCDSTVRPPNWQKDLCLLGGFQNADFVIWMRTAALPDFRKPCRKLTRTQMFADGLPSGTYQLLVHNNYNVNTFGGKKSFVISTT

SEQ ID NO: 120161 - protein, 106 aa, Heterodera glycines
  Coding regions on vcDNA: vcDNA=SeqID_46584; Strand=-; Position=1 -31,97-218,277-444
  Homolog annotation: Hit_ID=NP_729891.1; Match level="QueryCoverage =84%, HitCoverage=14%, E-value=1e-22, Identity=57%"; Hit description =CG10724-PB, isoform B [Drosophila melanogaster] gb|AAN11835.1| CG10724-PB, isoform B [Drosophila melanoga
  Essential gene: C elegans homolog=C04F6.4a; Phenotype=Gro,Slu
MTSSDEEFKKECTFASLPRTVRGMPLVVSSNSDGTKFLYCNGNSVFIRDEENIADCDVYTEHATLTTVAKYSPSEFYIASGDQSGKIRFWEPHNQSVSVDINLHLA

SEQ ID NO: 120162 - protein, 364 aa, Heterodera glycines
  Coding regions on vcDNA: vcDNA=SeqID_46585; Strand=+; Position=1 -215,389-470,519-600,641-763,823-936,1028-1162,1203-1397,1712-1858
  Homolog annotation: Hit_ID=AAM97979.1; Match level="QueryCoverage =95%, HitCoverage=29%, E-value=1e-121, Identity=67%"; Hit description= Membrane calcium atpase protein 3, isoform c [Caenorhabditis elegans]
  Essential gene: C elegans homolog=Y67D8C.10a; Phenotype=Prz
MSPDSGHRDSAGVSGAGAFDMTIEGLRTLMEFRGGEALEKISTDYGNTLGLCERLATDPNNGIANTQDELKRRRDAFGANEIPPLPPKSFFTLVWEALQDVTLIILLIAAVVSLALSFYNPGSELGGGKDETEQEAGWIEGAAILISVVVVVLVTALNDYTKERQFRGLQAKIETEHKFAVIRGGKQLQVVVNELVVGDIAQVKYGDLLPTDGVLIQSNDLKIDESSLTGESDQIKKSAEHDPMLLSGTRVMEGSGRMVITAVGVNSQMGIIMKLLGAAKSAMEDERKEKLREEKRTRRRSKASGQWEHWPIEENDIKLDGYNGAIPPGSAGRAKDDSEVQPAKKERSVLQTKLTRLAIQIGYA

SEQ ID NO: 120163 - protein, 312 aa, Heterodera glycines
  Coding regions on vcDNA: vcDNA=SeqID_46586; Strand=-; Position=1 -186,446-699,951-1095,1204-1557
  Homolog annotation: Hit_ID=CAE59749.1; Match level="QueryCoverage =70%, HitCoverage=21%, E-value=7e-45, Identity=41%"; Hit description =Hypothetical protein CBG03194 [Caenorhabditis briggsae]
  Essential gene: C elegans homolog=F46C5.6; Phenotype=Unclassified
HLIFAKLDRILVSCNNLMKGSTGSWRAHEAYLNGIAVLRNLVSTKDLLSNFVPLLKQEVLTARALPCRIAAAQTLLLMMREFATSRARQTIVDFFVHDIGHHSSCYRRRLLLDIVPLLLQYFSREFFIDKFLPAVLKLSADPISNIRLQLCRTLPKIKQYLMFPNNDESLSNLERVVRELLASEQNALSRQLIQQFACELSRTEMDKKECRANRAKLAEEKRLWTEHEDSTDETDEAEAGQQYSTEHTVTGSDAIGSPESGIFFEEDCWLGTGVGNSARPNNHQQMGGRLCRSATTTSISQHMETEVDKTFQ

SEQ ID NO: 120164 - protein, 104 aa, Heterodera glycines
  Coding regions on vcDNA: vcDNA=SeqID_46587; Strand=+; Position=1 -69,413-589,1831-1899
  Homolog annotation: Hit_ID=NP_503562.1; Match level="QueryCoverage =94%, HitCoverage=75%, E-value=3e-18, Identity=45%"; Hit description =adipocyte P2 (5C547) [Caenorhabditis elegans] gb|AAK70656.1| Lipid binding protein protein 9 [Caenorhabdi
  Essential gene: C elegans homolog=W02D3.7; Phenotype=Unc
MGEKFVGKWNLESSENFDDFLKEIGVSYLTRKAGACIKPVLEFEVNGNKWKMTSTSTFITISWEFELGQEKEVKTADGRIVKAEEKDSYYERYVDADGKLMIVR

SEQ ID NO: 120165 - protein, 471 aa, Heterodera glycines
  misc_feature (463)..(464): Xaa can be any naturally occurring amino acid
  Coding regions on vcDNA: vcDNA=SeqID_46588; Strand=-; Position=1 -67,138-290,335-406,499-679,736-795,846-987,1056-1224,1284-1358,1430 -1683
  Homolog annotation: Hit_ID=NP_497656.1; Match level="QueryCoverage =98%, HitCoverage=52%, E-value=1e-107, Identity=49%"; Hit description= FtsJ homolog 3 (3E173) [Caenorhabditis elegans] gb|AAF39869.1| Hypothetical protein H06I04.3b [Caenorhab
  Essential gene: C elegans homolog=H06I04.3a; Phenotype=Lva
MGKITKIGKQRKDKFYFLAKEAGFRSRAAFKLLQLNKRFEFLQRCRALVDLCAAPGGWLQVAEQQMPVSSLRIGVDLVRMNPIKNVDLVRMNPIKNCITLQGVIIEEKTRHAVRKELGTREADCVLHDGARNIGSNWAQDALQQNCLSLYALRLATQVLRKGGFFVSKIFRSADSQCLIGVFEKLFRIFRSADSQCLIGVFEKLFRKVHVWKPSASRLESAEIFVVCEQKVHVWKPSASRLESAEIFVVCEQYSKPDKVPSELLDSKKVFSDPDGGAYSKDNDSFCIRYSKDNDSFCIRGKERKAKALGYGNDALLGQHSGLGATEFVTSKNALQLLSRASELVLDSERVLNSEHTTNEVLDSERVLNSEHTTNEIKECLKDIKVCGPAELVCGPAELRSILKWRKKLVDEQKKEEKASKESVKSAEVVEGDTGEELEDKELEEIDDLIRTAKAEGKATLKKXXVNFEYHK

SEQ ID NO: 120166 - protein, 260 aa, Heterodera glycines
  Coding regions on vcDNA: vcDNA=SeqID_46589; Strand=+; Position=1 -104,180-256,308-389,458-517,606-779,947-1090,1142-1195
  Homolog annotation: Hit_ID=NP_509842.2; Match level="QueryCoverage =89%, HitCoverage=20%, E-value=6e-52, Identity=49%"; Hit description =myoblast growth factor receptor, EGg Laying defective EGL-15 (119.0 kD) (egl-15) [Caenorhabditis elegans]
  Essential gene: C elegans homolog=F58A3.2a; Phenotype=Pvl,Unc
QREGDFWSDLTSSYSITVEPVPMGRRERAARAKGEGAGETSPLSEYEVPTDAAWEVGRERLQLVDILGEGAFLQLVDILGEGAFGEVWRGLLSPTGDEDMPVMPVAVKRLKSAAQERELIILVSEMQILKSIGHHPNILRLIGCCTGLGPLLVVLELCEHGNLKDFLRKHRPAEAKREQSDSPGTSVPMPSTSATSTAPILNRQLTLRHLVRFGADIAKGMDFLASKKIIHRDLAARNGLGQIIHRDLAARNGLGQWHLP

SEQ ID NO: 120167 - protein, 92 aa, Heterodera glycines
  Coding regions on vcDNA: vcDNA=SeqID_46590; Strand=-; Position=1 -65,114-200,463-591
  Homolog annotation: Hit_ID=CAE67843.1; Match level="QueryCoverage =96%, HitCoverage=32%, E-value=1e-22, Identity=59%"; Hit description =Hypothetical protein CBG13430 [Caenorhabditis briggsae]
  Essential gene: C elegans homolog=W03D2.4; Phenotype=Emb,Ste
SVTNTIRYSKDKTADDDDDKDRVDITVKEKVNLNFSIKYLTNFTKATSLSDRVRLSMCDNVPLVVEYDIEGNGFLRFFLAPKIDEDKETMDD

SEQ ID NO: 120168 - protein, 863 aa, Heterodera glycines
  Coding regions on vcDNA: vcDNA=SeqID_46591; Strand=+; Position=1 -65,112-234,304-360,408-503,547-717,772-895,949-1263,1493-1598,1731 -1908,1968-2040,2086-2205,2260-2315,2459-2589,2637-2856,2902 -3082,3348-3514,3561-3754,3803-4017
  Homolog annotation: Hit_ID=CAG09381.1; Match level="QueryCoverage =97%, HitCoverage=68%, E-value=0.0, Identity=44%"; Hit description =unnamed protein product [Tetraodon nigroviridis]
  Essential gene: C elegans homolog=F53H4.1; Phenotype=Emb,Unclassified
MEKTVKGVKDDGEEANYMERIKEHRSLQELAKLKGDTFDDPNDFQTLSNDCRISNSVWNRLYRYQKRGVRWLYELHFQYVGGILADEMGLGKTIQLCVFLRSLSESQTISNIFRYKGLGPSLIVCPATLLHQWVKELNAWFPLCKVAVLHSSGAFSGPKATLIKRIGEHRGNGSILVTSYSTFMLSYEQISAVNWHYFILDEGHKIRNPEAKITLALKELRTPHRLILSGSPMQNNFRELWSLIDFIYPGRLGSLKEFMEKFSVPITQGGYANASAVQVRTAFKTACVLRDAISPYLLRRMKKDVQMVLQLPDKSEQILFCDITSEQRQLYLQYIESKACDDIVTGKQMPFAADFNVEDRQDMEFGFYQRSGKMVVLRELLRLWREQNHKVLLFSQSRQMLSIIESFVIIEGYSFLRMDGTTPIGSRQTLVEQFNKDPDLFVFLLTTKVGGLGINLTGANRVLIFDPDWNPSTDAQARERSWRIGQHRAVTIYRLQIFKHFLANRILDNPKQQRFFKTNELHELFTLGSSKSDRKYGTETAVIFAANGSEVSRKKLKNNMDKRRDEKEAENKAKAAERTDDGGKMPSADFNDSALSDEARERLKMVAKRLAANFGKTETDKAENGRRKRDKVLFEGKYKVPLLRKQVEVMEKKEEDNEETAPEGHSLSNKEQDDYVLSKLLSKKVGVHSALQHDQIIKESSAADIQLIEDEANAVAKRAADVLKRSRRRHLEFLSNASEFGPIQTKKSLFGRKRVAGFTIISNGIEKTDGNGGRDGAPKERTEKEEDDEEEEGCSKPFDGSEMLGRKKRGKCDASGAELLKSIRQRKERQLDIDGEGELAEGEEDEVGGQIQIFLNFCFPSLQ

SEQ ID NO: 120169 - protein, 484 aa, Heterodera glycines
  misc_feature (6)..(6): Xaa can be any naturally occurring amino acid
  misc_feature (171)..(171): Xaa can be any naturally occurring amino acid
  misc_feature (179)..(179): Xaa can be any naturally occurring amino acid
  Coding regions on vcDNA: vcDNA=SeqID_46592; Strand=+; Position=1 -52,311-370,731-842,903-996,1053-1243,1499-1540,1740-1894,2119 -2163,2246-2369,2423-2477,2762-2901,3197-3276,3364-3522
  Homolog annotation: Hit_ID=NP_493718.1; Match level="QueryCoverage =94%, HitCoverage=44%, E-value=4e-94, Identity=42%"; Hit description =PaTched Related (ptr-3) [Caenorhabditis elegans] gb|AAC48225.2| Patched related family protein 3 [Caenorh
  Essential gene: C elegans homolog=C41D7.2; Phenotype=Unclassified
QMMSHXLEYHRAGVMCSNYCRALTNTACAVVVMMILTAYLYVSIFGLLNIRAELRPEQLFLRSSDVIELLHLRNEYIMPFYYIMPFYAVCMVFVNKPGNFSDPVQRQRWHSLVSDFEGLPSSVGRFSTKVSDFEGLPSSVGRFSTKFWLRDYEQFVEQDPEARIKFENLDXYEIKFFIXSAGLVFRKLEFSMRNELAEFLQWPEFQGFLSANSSELVLSRFFFTTASYGTELREWSKRELLLGQWRRVADSVRSFVFLFTVQEDDAKFLDLIPTMIPQTIQSSACTLLCMFLVCLLFMTNPGALLVSNFAIFSTCIGVFGIQSLLGTLLDPIFMSVFGIQSLLGTLLDPIFMSAAIMSIGFSVDIPAHIAYHFYKTSVGEKAGTSLDVEQRLMDCLATIGFPVLEAGLSTLICTSSLFFVDLHMARVFARTVFARTMTLVVAIGLLHGLLVIPVMFSLCNTIRRRERQRPTVTGHAVIWPTTVL

SEQ ID NO: 120170 - protein, 179 aa, Heterodera glycines
  Coding regions on vcDNA: vcDNA=SeqID_46593; Strand=+; Position=1-537
  Homolog annotation: Hit_ID=CAE62158.1; Match level="QueryCoverage =100%, HitCoverage=68%, E-value=2e-57, Identity=38%"; Hit description= Hypothetical protein CBG06205 [Caenorhabditis briggsae]
  Essential gene: C elegans homolog=ZK617.1a; Phenotype=Unc
MEEHRPGNTSIFFPAAKRSECGTYELRLKNNVGETEGHFEVLVQDRPAPPKGSLAVDNVARDSCTLSWQPPEDDGGSEVTNYVVECRGVGSQVWVPVNNVVGTNSTVPNLQEGHEYEFRVCAVNAFGCSDPLNTDSAVVAMDPYGPPGRPEVTDHDNNQISIKWAPSTDTGGSPIAYYD

SEQ ID NO: 120171 - protein, 90 aa, Heterodera glycines
  Coding regions on vcDNA: vcDNA=SeqID_46594; Strand=-; Position=1 -22,85-167,218-385
  Homolog annotation: Hit_ID=NP_509787.2; Match level="QueryCoverage =85%, HitCoverage=39%, E-value=4e-16, Identity=51%"; Hit description =tumor protein D52 like (21.3 kD) (XL294) [Caenorhabditis elegans] emb|CAA92122.2| Hypothetical protein F1
  Essential gene: C elegans homolog=F13E6.1; Phenotype=Unclassified
MATPGIEASEDPTSNSNSAELSDAERELVIEELKKTENEIATLRQLLTARQKHVAQLKRKLGISPLNEITSEMAQGLKTVKETPAYVFVV

SEQ ID NO: 120172 - protein, 145 aa, Heterodera glycines
  Coding regions on vcDNA: vcDNA=SeqID_46595; Strand=-; Position=1 -93,367-415,472-687,843-878
  Homolog annotation: Hit_ID=NP_499264.1; Match level="QueryCoverage =100%, HitCoverage=27%, E-value=5e-53, Identity=72%"; Hit description= citrate synthase (51.5 kD) (3L304) [Caenorhabditis elegans] emb|CAA83004.1| Hypothetical protein T20G5.2
  Essential gene: C elegans homolog=T20G5.2; Phenotype=Emb
GVPKSTYWEYAYEDSMNLLAKLPTIAAMIYRNLYRDGSSVGVLDPNKDWSANFCHMLGYTERDWSANFCHMLGYTEREFVELMRLYLVIHSDHEGGNVSAHTCHLVGSALSDPYLSFAASMAGLAGPLHGLANQEVLFLTKMVAD

SEQ ID NO: 120173 - protein, 142 aa, Heterodera glycines
  Coding regions on vcDNA: vcDNA=SeqID_46596; Strand=-; Position=1 -67,116-270,514-720
  Homolog annotation: Hit_ID=NP_502368.1; Match level="QueryCoverage =91%, HitCoverage=11%, E-value=5e-34, Identity=54%"; Hit description =rac effector, Gut on EXterior GEX-3 (129.9 kD) (gex-3) [Caenorhabditis elegans] emb|CAA94604.1| Hypotheti
  Essential gene: C elegans homolog=F28D1.10; Phenotype =Bmd,Emb,Lva,Pvl,Stp,Unc
MTYKIGSDPSQLKFAEKLVILNDRTVGMLTRFYNMKKACADPKSRPQFLNDKSLDSAISTIVKRFPIIDIKRNSTAFSCVNEMKGDILKKLSLYYYTFADLLDLKDAILQLFTAMDANQCKLNIVCNGYDNQRRFVPRNIRN

SEQ ID NO: 120174 - protein, 247 aa, Heterodera glycines
  Coding regions on vcDNA: vcDNA=SeqID_46597; Strand=+; Position=1 -255,288-776
  Homolog annotation: Hit_ID=CAG08501.1; Match level="QueryCoverage =42%, HitCoverage=10%, E-value=6e-16, Identity=44%"; Hit description =unnamed protein product [Tetraodon nigroviridis]
  Essential gene: C elegans homolog=B0035.12; Phenotype=Emb,Gro,Unc
MGPVLPCIGQNNKKHEVMKKKEKNDEKMTLETNKMAGEKRKRPQSLSEKSFPYNAGLEKNKLFVKKLDWSCTGEELKVTKKRGNGKFGTVVDARIVTKWNGRSKGCAYVDFADEQSASAALMGADGTEIRGRKISVYLSNPPPTKRMKMEEATLDDHNLTTDKTNGATTSKTVDGKTEQKQAKQQTKPSRLMPRAAFLTGAGQRIGKASRLMLPMSGISKRSGNIATEGKSESPVGVVTESTKDMSL

SEQ ID NO: 120175 - protein, 301 aa, Heterodera glycines
  Coding regions on vcDNA: vcDNA=SeqID_46598; Strand=+; Position=1 -135,193-454,504-741,794-1064
  Homolog annotation: Hit_ID=CAB88203.1; Match level="QueryCoverage =99%, HitCoverage=99%, E-value=1e-158, Identity=84%"; Hit description= putative cuticular collagen [Globodera pallida]
  Essential gene: C elegans homolog=C15A11.6; Phenotype=Emb
MQETHIVLGIASVCSLLAIIATVVTLPSLYSEMSQMNSKVRDGVEAFRVNTDSAWTDLMDVQVVVTPPSKPRDNPFNSIFRAKRQLPGHCQCAGLQQPSCPPGPPGPSGPPGQPGQPGGAGQPGQPGQPGQPAPPCPPQNIPCPRCPAGPPGRPGGQGPPGQQGAPGQPGTPAQGGGPGTPGAPGPQGQPGQPGRPGAAGQPGQPGANGVVSRPIPGPKGPPGAPGQNGNPGGQGQPGQPGGQGPPGPPGAPGQPGQPGNSGQPGQPGAPGQPGKDSGYCPCPPRSSVLAVKKKMAAAKKA

SEQ ID NO: 120176 - protein, 330 aa, Heterodera glycines
  Coding regions on vcDNA: vcDNA=SeqID_46599; Strand=+; Position=1 -81,132-307,362-468,522-705,765-801,872-999,1046-1325
  Homolog annotation: Hit_ID=CAE65128.1; Match level="QueryCoverage =95%, HitCoverage=46%, E-value=2e-47, Identity=36%"; Hit description =Hypothetical protein CBG09993 [Caenorhabditis briggsae]
  Essential gene: C elegans homolog=ZK632.2; Phenotype=Pvl,Rup,Stp,Unc
PTISDLRYQQPFWALVPAEDKQEYFLEIIKEGTVIGTVRLHNSAHQKSFWSIGRFEPCDIKLEHPSVSRFHAILQYGECIKGRPGWFIFDMNSTHGVRLNKQPLKKRTYVPLHNGFVFQIAGSSRLFTVCGGPKREQKEEENKEKAQPMGKTENKKDAEEEGEDEEEQQLRYYEKDPLGWLQKYFEREGLPMHFQFTKSSSDGGGGGAGDLLAEFEDEQNKKRGRRHSDEGHWTCSIELVSDVSLTSGNVVTVSAPSKRLAQLQCSLVACERLNDACLLRISSLWNKRKNYTENDFYDSDEDTFLDRTGQIEEQREKRRKRFGVVNLTTD

SEQ ID NO: 120177 - protein, 317 aa, Heterodera glycines
  Coding regions on vcDNA: vcDNA=SeqID_46600; Strand=-; Position=1 -278,454-573,913-986,1077-1246,1291-1425,1883-2056
  Homolog annotation: Hit_ID=NP_496170.1; Match level="QueryCoverage =98%, HitCoverage=42%, E-value=6e-63, Identity=37%"; Hit description =procollagen-lysine precursor, LEThal LET-268 (84.4 kD) (let-268) [Caenorhabditis elegans] emb|CAA91321.1|
  Essential gene: C elegans homolog=F52H3.1; Phenotype=Emb,Lvl
MPLSSPADAIAIVAFVLKPTPYIEEFLHRLSLLEYPDKNSRVNLRIYNNQMYNKQHIETWAKRRSGKKNDDFGIVQILNGTAMGEHKIRAEAVQWAIEINADFLFLIDAEAHITAPDTLNILVQKAREDNNYRAILAPLLLRPDTVYSNFWGAVSESDYLDIIHGKSPAHVWNVPFIGAAIFVSKRKFEALSKAFVLKGGVDADISMAQFCRENGHFMFVDSSKGIQYFGFLVNSDSFSQLPKEARLNLELYDYPNNKKLWESRYIHPEYFTVLKPGTDVPLACPDVYDFPFLSERFCEELIEVMEEFGQWSEGKHQ

SEQ ID NO: 120178 - protein, 105 aa, Heterodera glycines
  Coding regions on vcDNA: vcDNA=SeqID_46601; Strand=-; Position=1 -66,311-478,876-960
  Homolog annotation: Hit_ID=CAE65191.1; Match level="QueryCoverage =54%, HitCoverage=42%, E-value=8e-13, Identity=50%"; Hit description =Hypothetical protein CBG10064 [Caenorhabditis briggsae]
  Essential gene: C elegans homolog=ZK1098.7; Phenotype=Lva
ATDKRQQILIEEAGDGQHTEKSILGLIIAGHLKWEQRPLWFDAYVAHSPHYEPKWDIKMPKRDEPLPQIFYQEDLIRAKKLLEMRNEEPKYELDQQQQQQPDQLN

SEQ ID NO: 120179 - protein, 71 aa, Heterodera glycines
  Coding regions on vcDNA: vcDNA=SeqID_46602; Strand=+; Position=1-216
  Homolog annotation: Hit_ID=XP_212881.2; Match level="QueryCoverage =83%, HitCoverage=13%, E-value=8e-21, Identity=77%"; Hit description =similar to High mobility group protein 1 (HMG-1) (Amphoterin) (Heparin-binding protein p30) [Rattus norve
  Essential gene: C elegans homolog=F40F8.10; Phenotype=Emb,Lva,Ste
MPFQQNPFFFFAFSVRRQVVNIPSFVVRLDSQKHIDLSAKSPYAGGRPGRVKRKNAKKGAGGGGSGGEEED

SEQ ID NO: 120180 - protein, 259 aa, Heterodera glycines
  misc_feature (97)..(97): Xaa can be any naturally occurring amino acid
  misc_feature (185)..(185): Xaa can be any naturally occurring amino acid
  Coding regions on vcDNA: vcDNA=SeqID_46603; Strand=+; Position=1-791
  Homolog annotation: Hit_ID=BAA88337.1; Match level="QueryCoverage =100%, HitCoverage=27%, E-value=3e-31, Identity=32%"; Hit description= ORF2 [Platemys spixii]
  Essential gene: C elegans homolog=ZK250.3; Phenotype=Clr,Lvl,Sck
DVKLYYTHENDDHSNQLDKAIEAMEKWSKINGLEISTEKCFVLYLGKNNMKKEYFINSQRISESDNVRDLGIIIDSKLNFSEHISKIIRNAYLRIFXILRVLKSREIKTLTAAYKTFVRPQLEYATEVWNPNLKKDIDKIERVQKFFTRKARGFVYKKYGERLKITGLHKLEERRKINDLTTAFXIIKGFTSLDAGKSFFSERLRRPLFLRVKRHTAKTQNNFFHRIVRNWNNLPVVAVQINKAKEFRGLLKAMSSGRI

SEQ ID NO: 120181 - protein, 258 aa, Heterodera glycines
  Coding regions on vcDNA: vcDNA=SeqID_46604; Strand=+; Position=1 -31,121-183,692-840,1224-1413,1777-1915,2095-2299
  Homolog annotation: Hit_ID=NP_725919.1; Match level="QueryCoverage =84%, HitCoverage=37%, E-value=8e-22, Identity=28%"; Hit description =CG9854-PB, isoform B [Drosophila melanogaster] ref|NP_536790.1| CG9854-PA, isoform A [Drosophila melanoga
  Essential gene: C elegans homolog=Y32F6A.3; Phenotype=Emb,Lva
MKIVVEQQKIETSLISAEYAQYNLIRTNPTNHPLLLTNGSHMMNAELDSSDLDLLCIVPAQINLNNFLYQLNISFFSMLKKNLTKAKVSSVSGRVPLIRIEQNQIEFDVLFVPVPLQYLVEGVNLESDQLIRELGTAEALYSLADRLIYSGLFGYFNGATLSVMATKICALFPFAPLAYLLYQFFSIYSNWNWASEPVMIEKLSEFPPQSTLKPPKIAENSMTVITPRFPEQNASFNVNKFTIRTIVEEIGIGKIFII

SEQ ID NO: 120182 - protein, 113 aa, Heterodera glycines
  Coding regions on vcDNA: vcDNA=SeqID_46605; Strand=-; Position=1-342
  Homolog annotation: Hit_ID=NP_495494.1; Match level="QueryCoverage =49%, HitCoverage=18%, E-value=7e-14, Identity=62%"; Hit description =MaoC-like dehydratase (32.7 kD) (2H487) [Caenorhabditis elegans] gb|AAA68358.1| Hypothetical protein E04F
  Essential gene: C elegans homolog=E04F6.3; Phenotype=Unclassified
SDWPGIQFDLSRVLHGEQYIELYAPFPADGARLRSEIRVADLLDKGANAVIISEGTTTKTKCAGDHQSSLILSEKNDQIAGLDGFGPKILPGWDPIYIIAAYDLLSLNCGGLI

SEQ ID NO: 120183 - protein, 158 aa, Heterodera glycines
  Coding regions on vcDNA: vcDNA=SeqID_46606; Strand=+; Position=1 -21,904-1068,1256-1346,1392-1580
  Homolog annotation: Hit_ID=NP_495711.1; Match level="QueryCoverage =91%, HitCoverage=32%, E-value=9e-32, Identity=45%"; Hit description =thyroid hormone receptor interactor 13 (48.0 kD) (2I449) [Caenorhabditis elegans] emb|CAA88312.1| Hypothe
  Essential gene: C elegans homolog=F10B5.5; Phenotype=Emb
SKNPQNLHSYVAKKFGAMAEEISLDDGDEGTVASHQWEMPSLEFENFWETLIFDGPIKNELLVYANSLLEISYAGADLSILPVNRLVLLHGPPGTGKTTPPGTGKTTLCKALAQKLAIRTQKRYKRAIVEVNSHSLFSWFSEEGEIKKLRLLIFYYFE

SEQ ID NO: 120184 - protein, 357 aa, Heterodera glycines
  Coding regions on vcDNA: vcDNA=SeqID_46607; Strand=-; Position=1 -302,363-630,686-929,983-1148,1199-1292
  Homolog annotation: Hit_ID=CAE67632.1; Match level="QueryCoverage =91%, HitCoverage=82%, E-value=1e-43, Identity=35%"; Hit description =Hypothetical protein CBG13187 [Caenorhabditis briggsae]
  Essential gene: C elegans homolog=C55B7.3; Phenotype=Emb
MSGGGSGRQNRGKTEAPRRPTRTQQTRQPGTQQQQRRPTPTQERSALAQPTLRRWEDTAEFFFALERFVNDTTPRSVQDLVSEFTELNAAPRPEPSPEFTRNLECNRYRDVICTEINRVRLHSGRYIHANWISTFGENRFICTQGPLETTCDDFWTMIVQENIEGIVMLCDTIEQNRIKCHQYWPTADNKLMRFANNQIIVKFGREHHVEGALYRTDLIVGAPQMRQGHLRVQHFHWRQWPDRGVPHSDLAPLRLLYHVIGVPRAVVHCSAGIGRTGTLVAVYLANQTLHLGQPLNIFALIRDLRRQRSQSIQTLDQYLYIYFVILRYAQNKASKLNINVNALNALVQALNSTMRRG

SEQ ID NO: 120185 - protein, 58 aa, Heterodera glycines
  Coding regions on vcDNA: vcDNA=SeqID_46608; Strand=-; Position=1-177
  Homolog annotation: Hit_ID=NP_493571.1; Match level="QueryCoverage =91%, HitCoverage=45%, E-value=2e-21, Identity=84%"; Hit description =ribosomal Protein, Small subunit (13.2 kD) (rps-26) [Caenorhabditis elegans] emb|CAB07387.1| Hypothetical
  Essential gene: C elegans homolog=F39B2.6; Phenotype=Lva,Ste
YALPKLYHKLHYCVSCAIHSKVVRNRSREARKDRNPPPRFGQRSAVDRPQRPGGAAPG

SEQ ID NO: 120186 - protein, 275 aa, Heterodera glycines
  misc_feature (10)..(10): Xaa can be any naturally occurring amino acid
  Coding regions on vcDNA: vcDNA=SeqID_46609; Strand=-; Position=1 -135,197-387,430-546,599-756,907-1035
  Homolog annotation: Hit_ID=XP_395639.1; Match level="QueryCoverage =94%, HitCoverage=15%, E-value=1e-64, Identity=48%"; Hit description =similar to ENSANGP00000003310 [Apis mellifera]
  Essential gene: C elegans homolog=W04A8.7; Phenotype=Bmd,Emb,Lva
LFVMRELHNXGRDGTLVAMEYIEEFPPLLNQTGMASKIRNYYKKKLTKEEEKRKLTKEEEKREFEFGETAFSHTSPFLGNLSPNESLQAIENNMYRATIFQHHPMGTDFLLIRNKYGLFIRQFPVLFVLFIRQFPVLFVVGQQMPLYEVPTPNSKRAKDFNKDFMMVYIFRLFWQSDDLPKRYIFRLFWQSDDLPKRIRMDEMKQMYPGEGLIRKNLKQCAELRRMEGHEYWWVLREDYRLPNREEVSSMVTPEMYCAYASMLAAEQRLVAFRFK

SEQ ID NO: 120187 - protein, 77 aa, Heterodera glycines
  Coding regions on vcDNA: vcDNA=SeqID_46610; Strand=-; Position=1 -21,266-328,382-531
  Homolog annotation: Hit_ID=AAH50601.1; Match level="QueryCoverage =77%, HitCoverage=24%, E-value=4e-13, Identity=65%"; Hit description =Tyrosine 3/tryptophan 5 -monooxygenase activation protein, theta polypeptide [Homo sapiens] ref|NP_006817.
  Essential gene: C elegans homolog=M117.2; Phenotype=Emb
MVDAVKKGFKSYREELESELLVNCRGVLEFLDSTLIPNATTNLEAKVFYLKMKGDYSRYISEIALGEDRTSREFVLM

SEQ ID NO: 120188 - protein, 238 aa, Heterodera glycines
  Coding regions on vcDNA: vcDNA=SeqID_46611; Strand=+; Position=1 -114,159-270,434-926
  Homolog annotation: Hit_ID=NP_496480.1; Match level="QueryCoverage =66%, HitCoverage=20%, E-value=8e-45, Identity=62%"; Hit description =aminotransferase (81.1 kD) (2L884) [Caenorhabditis elegans] emb|CAA91315.1| Hypothetical protein F07A11.2
  Essential gene: C elegans homolog=F07A11.2a; Phenotype=Ste
RRGPVSLVLDESCTTAMETPNKLNASDMFASFSAPFNDTINSTARKIECSDSTRSVRPCDSANFEVEYFVASDASAVIEHTRQVIFLEDDDVAFVEDGALSIHRIKRSDDTAALTEQTREVQRLTMELQQIMRGDFKTFMQKEIFEQPDSVVNTMRGRVHEDGRIVLGGIKVSGDGERRVNNAHHRCQGVHERPSPLPSSDHDRLRHFVPFGIGLSSADGGTDRAAGGGRVGQRLHRS

SEQ ID NO: 120189 - protein, 60 aa, Heterodera glycines
  Coding regions on vcDNA: vcDNA=SeqID_46612; Strand=+; Position=1 -54,414-513,727-755
  Homolog annotation: Hit_ID=NP_508153.1; Match level="QueryCoverage =83%, HitCoverage=16%, E-value=5e-13, Identity=64%"; Hit description =HAH-P like (34.3 kD) (XB393) [Caenorhabditis elegans] gb|AAA82460.1| Hypothetical protein T04G9.4 [Caenor
  Essential gene: C elegans homolog=T04G9.4; Phenotype=Gro,Prz,Unc
MRGQPTEQMKMTVFYRYWCLKEAIMKATGHGLVNDLSRFDFIIDPNERYKQESSSRGLYV

SEQ ID NO: 120190 - protein, 156 aa, Heterodera glycines
  Coding regions on vcDNA: vcDNA=SeqID_46613; Strand=-; Position=1 -182,237-338,391-476,536-633
  Homolog annotation: Hit_ID=NP_508412.1; Match level="QueryCoverage =89%, HitCoverage=29%, E-value=5e-61, Identity=77%"; Hit description =vacuolar atp synthase (54.2 kD) (XC857) [Caenorhabditis elegans] gb|AAA91266.1| Vacuolar h atpase protein
  Essential gene: C elegans homolog=T14F9.1; Phenotype=Emb
VDDIEFLSERLHASVQDLSSFDEYCAEVRSGRLQWSPVHKLEKFWRENAQRFNEKNFELIKILIKILETSSDPLPLSVAAHDIGEYVRHYHRGKTIVEQYQGKQAVMKLLSAEDPNVRYHALLAIQKLMVHNWEYLGKQIEGLEGAKGSAGEEAKE

SEQ ID NO: 120191 - protein, 349 aa, Heterodera glycines
  misc_feature (1)..(1): Xaa can be any naturally occurring amino acid
  Coding regions on vcDNA: vcDNA=SeqID_46614; Strand=-; Position=1 -205,246-405,451-607,665-828,877-1060
  Homolog annotation: Hit_ID=NP_495722.1; Match level="QueryCoverage =97%, HitCoverage=50%, E-value=3e-98, Identity=59%"; Hit description =chaperonin Containing TCP-1, T Complex Protein (58.8 kD) (cct-1) [Caenorhabditis elegans] emb|CAA91308.1|
  Essential gene: C elegans homolog=T05C12.7; Phenotype=Emb,Lva,Ste
XMILRINPLRELDITKRRVEKIIKSGANVVLTTGGIDDLCLKEFVEAGAIGVRRCKKADLKRIAKATGATLTASLATLEGDEQFDASLTLTASLATLEGDEQFDASLLGSADEVVQTRISDDELILIKGTKLKSAASIILRGANDMMLEEMEGANDMMLEEMERSVHDVLSVVKRVLEGKKLVVGGGAVETALNVYLENFALNLTSREQLAVAAFADSLLVIPKTSREQLAVAAFADSLLVIPKTLATNAAQDAISLLAKLRAFHNRSQTDKKFEHMKWSGLDLEEGASGLDLEEGAVAQNRDAGVFEPLISKVKSLKFATEAAITILRIDDLIKLDKIEKKPHDEDEC

SEQ ID NO: 120192 - protein, 380 aa, Heterodera glycines
  misc_feature (10)..(10): Xaa can be any naturally occurring amino acid
  Coding regions on vcDNA: vcDNA=SeqID_46615; Strand=+; Position=1 -59,102-163,219-292,350-527,575-725,781-952,1004-1263
  Homolog annotation: Hit_ID=NP_500082.1; Match level="QueryCoverage =91%, HitCoverage=38%, E-value=2e-96, Identity=55%"; Hit description =CaLPain family member (86.3 kD) (clp-7) [Caenorhabditis elegans] gb|AAF36080.1| Calpain family protein 7
  Essential gene: C elegans homolog=Y77E11A.11; Phenotype=Ced
DGTMPGNAGXLFAIFLFFQVLDFHSERDRCLRLDFHSERDRCLRERRLFEDPEFPATDRSIFFSKSFPATDRSIFFSKSPPEGLQWKRPGELTSDPQLIAELTSDPQLIASSSGASRFDVVQGQLGDCWLLAAAAVLTLREELFFRVVPPDQSFTENYAGIFHFQFWRYGQWVDIFHFQFWRYGQWVDVVIDDRLPTKDGHLLFMNSAKHHSFWSALLEKAYAKLYGSYELYGSYEALKGGSTSEALEDFTGGLIEHFELAEMSREQLLAVLVRGFQMGSFFGCSIDADPSKMEAKLDNADPSKMEAKLDNGLVMGHAYSITAIQSLHDDVVLLRVRNPWGQHEWNGRWSDGPEWDQLTESQRRAGGLERDGFWMSLDDF

SEQ ID NO: 120193 - protein, 167 aa, Heterodera glycines
  Coding regions on vcDNA: vcDNA=SeqID_46616; Strand=+; Position=1 -372,417-548
  Homolog annotation: Hit_ID=AAQ89579.1; Match level="QueryCoverage =98%, HitCoverage=25%, E-value=5e-90, Identity=100%"; Hit description= heat shock protein 70-C [Heterodera glycines] gb|AAM93256.1| heat shock protein 70-C [Heterodera glycines
  Essential gene: C elegans homolog=C15H9.6; Phenotype=Dpy,Lva
MKKSFVSFLFFTALLVIVCSKEEEGGAKEKKYGTIIGIDLGTTYSCVGVYKNGRVEIIANDQGNRITPSYVAFTPDSGERLIGDAAKNQLTLNPENTIFDAKRLIGREFTDKTVQDDMKLWPFKIYNKANKPHVQVKVGNEDKQFAAEEVSAMVLTKMKEIAESYPR

SEQ ID NO: 120194 - protein, 360 aa, Heterodera glycines
  misc_feature (357)..(357): Xaa can be any naturally occurring amino acid
  Coding regions on vcDNA: vcDNA=SeqID_46617; Strand=+; Position=1 -134,437-537,578-611,803-917,971-1150,1198-1322,1512-1644,1870-1985
  Homolog annotation: Hit_ID=NP_502337.1; Match level="QueryCoverage =93%, HitCoverage=92%, E-value=4e-71, Identity=46%"; Hit description =carrier family (34.6 kD) (4N47) [Caenorhabditis elegans] gb|AAL02464.1| Hypothetical protein C42C1.10 [Ca
  Essential gene: C elegans homolog=C42C1.10; Phenotype=Emb
KINLFRSSLSIQLFLIKYVQAGFFTGVATRAIIQPFDVLKIRLQLQEEPLRGKSRGKYSGIFQSAKLIYHEEGIAAFWRGHIPAQGLSIRGHIPAQGLSISFGLVQFCTFELLTKQAGDGFHNFSKSVDFVCGASAGCLATTCAMPFDVVRTRMVAQLATTCAMPFDVVRTRMVAQGAHRTYRNMAHAFIKTWRYEGPAGYFRGLVPSLVQIAPFTGLQFTFYNLVNVYWDSSDRESTGLQFTFYNLVNVYWDSSDRESVGRIVSGWVAGMAAKTITYPFDLVRHRLQVNRHIRKDTFGQTTSDGGMLRTFVGIVKRETVFGLFKGLSPAVLKAAVQSSLSFFFYELICDFLRTVAXSSC

SEQ ID NO: 120195 - protein, 158 aa, Heterodera glycines
  Coding regions on vcDNA: vcDNA=SeqID_46618; Strand=-; Position=1 -302,474-543,610-711
  Homolog annotation: Hit_ID=CAE67177.1; Match level="QueryCoverage =98%, HitCoverage=22%, E-value=9e-47, Identity=51%"; Hit description =Hypothetical protein CBG12609 [Caenorhabditis briggsae]
  Essential gene: C elegans homolog=ZC308.1a; Phenotype=Emb
MVVKEWAKRHGINDSACSSFTSYSLVLMVIHYLQCGAQPPVLPNLQQMYPKRFSVRADVRTLNVSLPFEPIPTAMGWQFKDDATLSELLLGFLRYYAFQFDFDADAISIRMGKKVNRAQVAQNQSPFNTLSQWHCICIEEPFTLSNAAHSVYDERIFP

SEQ ID NO: 120196 - protein, 233 aa, Heterodera glycines
  Coding regions on vcDNA: vcDNA=SeqID_46619; Strand=+; Position=1 -74,146-216,387-509,3280-3378,4268-4332,4396-4665
  Homolog annotation: Hit_ID=NP_741190.1; Match level="QueryCoverage =30%, HitCoverage=8%, E-value=1e-09, Identity=41%"; Hit description=A kinase anchor protein 1 (96.4 kD) (3H455) [Caenorhabditis elegans] gb|AAM22053.1| Hypothetical protein C
  Essential gene: C elegans homolog=C56G2.1a; Phenotype=Emb
SVVDSKFTRIDIHEFWLQSHVPLKGTTKIPQYVFPVNQVMANNNELQSFLLSLCCNWQIVTLAPGLPTPVRQAAELAKRGRANFNELKRHIEEESRSDEQQRHEKTAAPMLTTAPAMAAALPTDFVTLPLQGIECYLANVQPADGSLHWSDKANELFQQLCVSKIIQAALVGYCKTDGIPCVELFVMDSANKKVGIRGQLLFIAQRMSPLLLKNPGDSRAKTLDSSKSLVLMD

SEQ ID NO: 120197 - protein, 85 aa, Heterodera glycines
  Coding regions on vcDNA: vcDNA=SeqID_46620; Strand=+; Position=1 -240,586-603
  Homolog annotation: Hit_ID=NP_503737.1; Match level="QueryCoverage =81%, HitCoverage=19%, E-value=2e-12, Identity=42%"; Hit description =putative protein family member, with at least 5 transmembrane domains (5D194) [Caenorhabditis elegans] pi
  Essential gene: C elegans homolog=R08F11.2; Phenotype=Unclassified
MWCCETVMEMTLAFNRCVELSSARWARLLFQGKRIYLWMLFPTLYGFYYFWYTQPLIFSGIFFSWFFNPHVGYIDDFGKTLNFCL

SEQ ID NO: 120198 - protein, 208 aa, Heterodera glycines
  misc_feature (201)..(201): Xaa can be any naturally occurring amino acid
  Coding regions on vcDNA: vcDNA=SeqID_46621; Strand=+; Position=1 -107,164-249,675-767,1480-1629,1888-2023,2224-2267
  Homolog annotation: Hit_ID=NP_510453.1; Match level="QueryCoverage =93%, HitCoverage=38%, E-value=5e-57, Identity=55%"; Hit description =UNCoordinated locomotion UNC-3, Olf-1/EBF transcription factor (55.0 kD) (unc-3) [Caenorhabditis elegans]
  Essential gene: C elegans homolog=Y16B4A.1; Phenotype=Unc
RCCEKKSCGNRNETPSDPVIIDKYFLKFFLKCNQNCLKNAGNPLKNAGNPRDMRRFQVVLCATPRVDVDVLAMSDNMFVHNNSKHGRRGKRGSSEPSMAEGESSSAGGTMPSIKMIFPGEVWCQSGGTAMIIGEQFHEGMQVMVGGTVTWPEIIKMVTAHAIKVNVPARASPGAVEVVCSPKGQPKVRSNAIRFSLGSIPXPLGFFFW

SEQ ID NO: 120199 - protein, 132 aa, Heterodera glycines
  Coding regions on vcDNA: vcDNA=SeqID_46622; Strand=+; Position=1 -144,407-658
  Homolog annotation: Hit_ID=CAE58987.1; Match level="QueryCoverage =100%, HitCoverage=42%, E-value=2e-58, Identity=84%"; Hit description= Hypothetical protein CBG02260 [Caenorhabditis briggsae]
  Essential gene: C elegans homolog=F25H2.10; Phenotype=Emb,Lva,Ste
MIRKAIRGNLQKFPLLEKLLPYIVGNVGFVFTNEDLGDVRKKLLENKRGAPAKAGAIAPCDVRLPPQNSGMGPEKTSFFQALQIPTKISRGTIEILNEVHLIKTGEKVGASESALLNMLGIQPFSYGLVVEQ

SEQ ID NO: 120200 - protein, 122 aa, Heterodera glycines
  Coding regions on vcDNA: vcDNA=SeqID_46623; Strand=+; Position=1 -106,331-422,471-641
  Homolog annotation: Hit_ID=NP_498923.1; Match level="QueryCoverage =100%, HitCoverage=84%, E-value=2e-28, Identity=43%"; Hit description= ribosomal protein L11 and Ribosomal protein L11 (3J807) [Caenorhabditis elegans] gb|AAA27905.1| Hypothet
  Essential gene: C elegans homolog=B0303.15; Phenotype=Lva
MASAAPPLGPSLGQRGVNVANFCKEFNNLTSTIRFGEIVGMISVKHVYEIAKVKSQDKSLIGVPLKKICQLVIERADSIGIKVQNEDLDPEEYRKFLEHRQEVVQRQLEEIAKQEEAKLART

SEQ ID NO: 120201 - protein, 231 aa, Heterodera glycines
  Coding regions on vcDNA: vcDNA=SeqID_46624; Strand=-; Position=1 -210,264-538,806-1016
  Homolog annotation: Hit_ID=NP_505098.1; Match level="QueryCoverage =68%, HitCoverage=28%, E-value=1e-18, Identity=30%"; Hit description =suppressor of PResenilin defect SPR-1, suppressor of presenilin defect, CoREST homolog (63.8 kD) (spr-1)
  Essential gene: C elegans homolog=D1014.8; Phenotype=Unclassified
MNSYKSKQIIIGSGYQVMLPECNKKIRKDDKIDEERDECLWSKNQGKLGDTEIVEFCRDALNHYGIGPDRALYILLKSDHNLKRAKSELALRNSVKKRFSVEDEFAFREAHKCFGKNFAKIHQMLSHKNLSELVEHYYLTKKQQNYKSFMDNECGKNGTSERATNKHRVCAQPIEEKKRIPICPPEMKNIAEQFEEMARVVMGEQFDDISDGLDEVQVEQNNETICEQKIK

SEQ ID NO: 120202 - protein, 155 aa, Heterodera glycines
  Coding regions on vcDNA: vcDNA=SeqID_46625; Strand=-; Position=1 -45,161-433,600-757
  Homolog annotation: Hit_ID=CAE57536.1; Match level="QueryCoverage =85%, HitCoverage=34%, E-value=3e-31, Identity=47%"; Hit description =Hypothetical protein CBG00513 [Caenorhabditis briggsae]
  Essential gene: C elegans homolog=D2085.6; Phenotype=Him
IFRKYYLLFAKIIIISVLISVQFLIGGDGPKRVDIEEMRERCRLHERVKTLGTIPILSDQIFLCFFILNLLLCSLHVVSTRVGGIPEVLPPEFISLVDPNPKAIAVGLLDAIRRRENGELPCPVKKHRQVAEMYNWADIAQWTERVYGNSMEEPE

SEQ ID NO: 120203 - protein, 250 aa, Heterodera glycines
  misc_feature (226)..(226): Xaa can be any naturally occurring amino acid
  Coding regions on vcDNA: vcDNA=SeqID_46626; Strand=-; Position=1 -190,232-367,418-600,703-872
  Homolog annotation: Hit_ID=NP_497231.1; Match level="QueryCoverage =76%, HitCoverage=56%, E-value=6e-67, Identity=68%"; Hit description =CAP-binding protein complex interacting 2 like (32.0 kD) (3B271) [Caenorhabditis elegans] gb|AAA64507.1|
  Essential gene: C elegans homolog=C09F5.2; Phenotype=Ste
GFPTSSLPCTSLDQSCGSALKNVFPSRHRGELSIHEKYRYDLSRAQLKASSRTSALLAGFAMIALVELQYQESTPKIALVELQYQESTPKPLLIMLGVVTSLLVSVHLLALMMSTCLLPYIEANGCTQDSPHIKANGCTQDSPHIKLRFYIELSWLFSTCIGLLLFLLEIGVIFFVKFNSIGYTFAAYITTGMLVPVVIVFIIISYLIHRNRYKNNLGKQPKSLIXKSESLPKNLNKKEFNLKNKSKLFI

SEQ ID NO: 120204 - protein, 289 aa, Heterodera glycines
  Coding regions on vcDNA: vcDNA=SeqID_46627; Strand=-; Position=1 -228,297-384,562-714,839-955,1003-1194
  Homolog annotation: Hit_ID=ZP_00193853.1; Match level="QueryCoverage =98%, HitCoverage=73%, E-value=3e-63, Identity=49%"; Hit description =COG2017: Galactose mutarotase and related enzymes [Mesorhizobium sp. BNC1]
  Essential gene: C elegans homolog=C01B4.6; Phenotype=Bmd,Lva
SFQQDVFECKLRSESGVVVKVISFGAIIRDWLVPTPQDQLRSVVLGFDSLENYVEHSPFFGAIVGRVANRIGRARFTVDGKEFLLTPNFTVDGKEFLLTPNEGKNQLHGGTETFGRKVWKMEPLCDNAAAKWPSGVRLSLESADGEGTFPGNLRVSVTYRLTANKLRMDIEATSDLPCPVNIVQHNYFNLSGHGDIREHSLKLAADWFTPTSSDQIPTGEILTVSFTPTSSDQIPTGEILTVSGTEFDFREEKKLQTKDGKPIELDHNFVLTKGKGTDAQIAAVLRAPD

SEQ ID NO: 120205 - protein, 150 aa, Heterodera glycines
  Coding regions on vcDNA: vcDNA=SeqID_46628; Strand=-; Position=1 -141,198-245,397-658
  Homolog annotation: Hit_ID=CAE56125.1; Match level="QueryCoverage =88%, HitCoverage=16%, E-value=5e-25, Identity=41%"; Hit description =Hypothetical protein CBG23734 [Caenorhabditis briggsae]
  Essential gene: C elegans homolog=R11A5.1a; Phenotype=Unclassified
MISENREGKMCSARQICVQLARYDRSYDIRDRCRFLRNFWLDKDQNSLKFPLDIFLQERPAPAKCNGYTELPDFPSEQPDPTIRRSAYPLPSDGIVQGTEIAMDEAEEEEDDSLDEEESEEEDEEEDEEEDEDEEEEEEEEESEGEKVPD

SEQ ID NO: 120206 - protein, 481 aa, Heterodera glycines
  Coding regions on vcDNA: vcDNA=SeqID_46629; Strand=+; Position=1 -54,117-224,290-355,400-510,596-791,846-1030,1134-1213,1261-1462,1504- 1647,1835-1902
  Homolog annotation: Hit_ID=NP_501283.1; Match level="QueryCoverage =99%, HitCoverage=61%, E-value=3e-91, Identity=44%"; Hit description =component of rsec6 8 secretory complex p71 (4I544) [Caenorhabditis elegans] gb|AAA82266.1| Hypothetical p
  Essential gene: C elegans homolog=C33H5.9; Phenotype =Gro,Rup,Sma,Stp,Unc
NKFEEEIGSLQLLSDQFQSKLNTLESKLNTLEQQQNKDKTDYLDSLQRLHDKNGDSLDQLKQLDLTMQTVQLDLTMQTVAARVVHLGDQLESVHEPRARAFEALVHEPRARAFEALQLMRHFDEFLADQPLNSALFTDPDRLLESAEVLLESAEVIAKLASIAQELDKTKFAAVQLRIAHKYDEIEQLLIEEFVRSDRKRMREIAMILSEFKGFSFSRCVDAFVERIQSVGPRSPNVFEDIQNLCDRAKPIIMEIFLSSQFVVSKLLLNVFHGKLQEAVVEAVVATLEENKGNPEQYLANLHELYLKTHKLLGLLQEKFRTNSLDPTHKLLGLLQEKFRTNSLDPQFLPTLTQSVFGPYLVTYAKIEHKFIADKCTFTLRKFYESKGHQKRSIGHHFEFRLQELKSRLLTAGHHFEFRLQELKSRLLTAEDFGGETFLSEIIAINILQEFKNAFARCSSLCKKTESLELNTVLFDMLLKFL

SEQ ID NO: 120207 - protein, 309 aa, Heterodera glycines
  misc_feature (213)..(213): Xaa can be any naturally occurring amino acid
  misc_feature (225)..(225): Xaa can be any naturally occurring amino acid
  Coding regions on vcDNA: vcDNA=SeqID_46630; Strand=-; Position=1 -84,276-392,487-627,668-790,843-884,930-964,999-1217
  Homolog annotation: Hit_ID=NP_741207.1; Match level="QueryCoverage =99%, HitCoverage=71%, E-value=2e-49, Identity=37%"; Hit description =leucine rich repeat interacting protein (3I14) [Caenorhabditis elegans] gb|AAM48538.1| Hypothetical prote
  Essential gene: C elegans homolog=F57B9.7a; Phenotype=Emb
MSSYSSSRRRAPASSFMEEHVLDRISREAEERSNKKRQARDEARQIRMDCLEKSIKAGDQKDYHLLAKVTELENKYQRAMLLYTQLDNEKSALLYEIDLLKDEMEEKDVTVFQVSKENREISEELKLLRKTVEVSKENREISEELKLLRKTVEALQLQHQQMKSEISQRDRLIHENGFVIAEQDPNDDHENGFVIAEQDPNDDGSQSTNNAPXVVGSQSTNNAPXVVKFDPILLSHVKFDPILLSHVTLSAIEKALPGTSSVDQKVQRLVESNRKLRNQIDETEKALYNHRRRQNEKHNATGSTSSGIS

SEQ ID NO: 120208 - protein, 213 aa, Heterodera glycines
  Coding regions on vcDNA: vcDNA=SeqID_46631; Strand=-; Position=1 -246,314-493,548-763
  Homolog annotation: Hit_ID=AAP94888.1; Match level="QueryCoverage =84%, HitCoverage=56%, E-value=8e-35, Identity=41%"; Hit description =P34 [Ascaris suum]
  Essential gene: C elegans homolog=B0218.5; Phenotype=Unclassified
MSLTGRGLYSLLKKAGGMFSPGTAIGVSIQLLHALKTLHSIGYLHLDIKPENAAIGRRETNERQRIFLIDFGLARRFISSKTGKHRRQRKKTHFRGTPMYASISAHARSDYCRGDDIESWFYMLVDMYTGSLPWSRVRSEHRTGKMKRRRLSHKSEVRRKALSDLLQGCPAQLGPILEHIVGYSHTLIRLCPLQFPPLFRTAWIFTTDPTTNG

SEQ ID NO: 120209 - protein, 89 aa, Heterodera glycines
  Coding regions on vcDNA: vcDNA=SeqID_46632; Strand=-; Position=1 -182,224-279,332-400
  Homolog annotation: Hit_ID=NP_498946.1; Match level="QueryCoverage =61%, HitCoverage=35%, E-value=2e-09, Identity=47%"; Hit description =putative protein of eukaryotic origin (3J896) [Caenorhabditis elegans] gb|AAK26132.2| Hypothetical protei
  Essential gene: C elegans homolog=F54F2.7; Phenotype=Gro
MRDQCKNIAQVLWDMSLAKTSSVKSNESKGRKRGVDRSKLEPSGKGKKGGLPMSPQTRICIIRDSDGVDYVIRAGIRATLLEVNEDMVD

SEQ ID NO: 120210 - protein, 176 aa, Heterodera glycines
  Coding regions on vcDNA: vcDNA=SeqID_46633; Strand=+; Position=1 -364,906-1072
  Homolog annotation: Hit_ID=NP_498735.1; Match level="QueryCoverage =70%, HitCoverage=30%, E-value=3e-14, Identity=34%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MDGLALDIARKLEVKPARYAVRKTMMKSLFISQGRFEFNANLFMDQIPRRITLGLVANSDYVGDPRRSPFNFQPFNVREISIVANGRAFPQAPYSLDYPRGKYVRAFNDMNEAVGFSNTTEDLNAPVSIFPGIQLCKDMPAADNYMRHIFCWAVFALYAMMHVSLIIYPLRSILSG

SEQ ID NO: 120211 - protein, 154 aa, Heterodera glycines
  Coding regions on vcDNA: vcDNA=SeqID_46634; Strand=+; Position=1 -231,282-388,443-569
  Homolog annotation: Hit_ID=NP_498582.1; Match level="QueryCoverage =91%, HitCoverage=92%, E-value=3e-24, Identity=41%"; Hit description =protein similar to prefoldin chaperone subunit 5 and c-myc binding protein MM1 (17.2 kD) (3I288) [Caenorh
  Essential gene: C elegans homolog=R151.9; Phenotype=Emb
MSVPATSAKPMVIDISSLSIDELSVLQQQFDAELAFFNDSLNELRNVAAKFGRCQATLDSISPKELNKSALVPLSESVYVRAKMTDPDKYLVEIGTGYFVEMNRQQSSEYFKRKYAFLESQVETISRKIIPEKQQARQTIVAALQKKVQLATSK

SEQ ID NO: 120212 - protein, 744 aa, Heterodera glycines
  misc_feature (671)..(671): Xaa can be any naturally occurring amino acid
  misc_feature (681)..(681): Xaa can be any naturally occurring amino acid
  Coding regions on vcDNA: vcDNA=SeqID_46635; Strand=-; Position=1 -58,107-288,339-501,558-789,859-1007,1166-1324,1469-1508,1555 -1682,1806-2026,2075-2369,2398-2588,2904-2960,3011-3092
  Homolog annotation: Hit_ID=NP_491552.2; Match level="QueryCoverage =96%, HitCoverage=23%, E-value=1e-133, Identity=39%"; Hit description= lethal protein 363, LEThal LET-363 (305.8 kD) (let-363) [Caenorhabditis elegans] gb|AAN84886.1| Lethal p
  Essential gene: C elegans homolog=B0261.2a; Phenotype=Lva
GPREAVRTCLECTECLRVRLSRLAINLDLSRLAINLDQLRRFWTVQPLLSREDWLQWVGTLRNQFIRQSPSSALRACAVLAEMCESLSKELFNAAFMSVWTELFNAAFMSVWTELPEREQNELTNQLIDVLRHCPPEPIQTILNLAEFMDHSEKGPLPIKHRMLSESAEKTRAGPLPIKHRMLSESAEKTRAYAKALRYKEMEILSTRGNGEPNDDCQTMIMLFNKLNLEEGAAGIVQYAKRHNMEISVKGRWYEKLGEWGRWYEKLGEWEKALEMYQNDMTKQLSWKSISSHSEPQLLPTNREESSRSDLLLHQMRCLEALGQWSQLDRSETALAEEESNQYNPNFNIATEKQQPQKIATIGARGCWAVGNFKKMEDYVDKINENNRDNFKKMEDYVDKINENNRDGAFLRAVLAVHNNDFDKAYSCINKVRDMFDSELTAMAAESYERAYGAMVLLQELTELEEAIEYKMIPEREMRIALLWSRRLQGCRRNVEHWRRILMVRSIVFSSIVFSQTELRPLWIKFAALCRYEGRQVTVSRNVIRSLLEVPPDTPLEKVPIPLPLEKTQLALALCKQLWVDSHRRTALVQLEQLTQAKTDDFFFISSIRNRTMLTREQLEPHARLTRNRTMLTREQLEPHARLTAKCYLKLGEWHDQSPPSNRRWVSDQHXFPNHKTKNCXQPKTRACKLILQCYINATNFDPNWYKAWHRLATTYAWHRLATTYYNMIMADRQQRSVTISPAK

SEQ ID NO: 120213 - protein, 245 aa, Heterodera glycines
  misc_feature (2)..(2): Xaa can be any naturally occurring amino acid
  misc_feature (235)..(235): Xaa can be any naturally occurring amino acid
  Coding regions on vcDNA: vcDNA=SeqID_46636; Strand=-; Position=1 -218,264-406,700-887,1000-1192
  Homolog annotation: Hit_ID=AAR16088.1; Match level="QueryCoverage =96%, HitCoverage=29%, E-value=4e-72, Identity=63%"; Hit description =phosphofructokinase [Ascaris suum]
  Essential gene: C elegans homolog=Y71H10A.1a; Phenotype=Emb
KXINIYFRHLGSDTAINAICMVDTINQANGSKRFLIETMGGHCYLATVSIATGADNAYIFEEKFTVDDIKEDVIKEDVKVISQKMQKGVQRYLIVQSEGASHNYDTTFVQKLFSEEGKGESTRINILGHPQQGGKPTPFDRNMGTKLGARALNHLITQINANFDKTTERCNADKPDTATLLGLIGREVVFSPLEELAAETDFEHRLPLKQWWLKFRPLLRILAKHRASYVQEATXKPAENEKEAN

SEQ ID NO: 120214 - protein, 166 aa, Heterodera glycines
  Coding regions on vcDNA: vcDNA=SeqID_46637; Strand=+; Position=1 -276,335-561
  Homolog annotation: Hit_ID=CAE75463.1; Match level="QueryCoverage =99%, HitCoverage=54%, E-value=6e-93, Identity=87%"; Hit description =Hypothetical protein CBG23461 [Caenorhabditis briggsae]
  Essential gene: C elegans homolog=F23H12.4; Phenotype =Bmd,Dpy,Emb,Lva,Unc
NAPCEPTTPPPCKPCPQGPPGPPGPPGSPGDPGEAGTPGRPGTDASPGSPGPRGPPGPPGEPGPQGPPGEPGVPAQSEPLVPGEPGEQGDQGPPGPPGPPGSPGADGPPGPPGPKGEPGPDGLPGQDGQPGPSGPPGPSGTPGEKGICPKYCAIDGGVFFEDGTRR

SEQ ID NO: 120215 - protein, 200 aa, Heterodera glycines
  misc_feature (7)..(7): Xaa can be any naturally occurring amino acid
  misc_feature (190)..(190): Xaa can be any naturally occurring amino acid
  Coding regions on vcDNA: vcDNA=SeqID_46638; Strand=-; Position=1 -182,284-477,531-634,1654-1743,2650-2670
  Homolog annotation: Hit_ID=NP_492266.2; Match level="QueryCoverage =84%, HitCoverage=17%, E-value=1e-49, Identity=59%"; Hit description =synaptojanin, N-terminal (1I917) [Caenorhabditis elegans] emb|CAB05701.2| Hypothetical protein C34B7.2 [C
  Essential gene: C elegans homolog=F30A10.6; Phenotype=Gro,Sma
DSLTFCXPNVLRASKKSKKTFLISLPKFRARMLLQHGVVRSNCVDCDRTNVVQFGIGKVALGKVALGWQLYSMGFLALPWSLQLHSEVCRVFEEMFDEHGNTLAWQYAGSQLVHSIKTYKRTAVFQERSERSRDVFQTISRYYSNTFGDFEKQDGLNLFLGIFRKEIGTFHNVWTVRGERAIFFPFVLKXKTDYLGWKMK

SEQ ID NO: 120216 - protein, 695 aa, Heterodera glycines
  misc_feature (240)..(240): Xaa can be any naturally occurring amino acid
  Coding regions on vcDNA: vcDNA=SeqID_46639; Strand=-; Position=1 -160,215-277,344-438,500-637,685-867,915-957,1119-1229,1287-1615,1663- 1816,1894-2052,2154-2347,2401-2508
  Homolog annotation: Hit_ID=CAE60466.1; Match level="QueryCoverage =100%, HitCoverage=63%, E-value=1e-147, Identity=43%"; Hit description=Hypothetical protein CBG04077 [Caenorhabditis briggsae]
  Essential gene: C elegans homolog=F30A10.6; Phenotype=Gro,Sma
MSDRMCSLSVYETAAHFYIIGSDPKGKRFRTLKIDRVTDKEFIAAEPDQDYTQADIGELLATVSSSDIGELLATVSSSSSDFFDFESSCAGGGGLLSCAGGGGLLRTVEKAWGIIGAVRFMEGFYLLIVSRAKMVVSIGVHSIYIVSRAKMVVSIGVHSIYKIEDVSMIYIPATGAATHPDETKYSKLFLSVDFTADFYFSYTYQLSVDFTADFYFSYTYQLSRTLQENCLAGFAHKWEXNNYGKTIGPEKKFVWNEYLMEPLYRAGVNRKWTLELMRGFVAVNRKWTLELMRGFVAHQLLELPCAKLDLILIARRSSAFAGTRFLKRGVNCEGAVANDVETEQVVWDAVANDVETEQVVWDTSSPLSFRSGKFSSFVQRRGSVPLFWSQDPTHRGSPMVVGKPPILIDRVEPHALTTAKHFRELGRKYGHPLVVLNLVKREEHRHNENLLHKIFLKTVRYLNDFRRTVRYLNDFRRVGECIDYISFDVSRCNKSGRVLQRLEEIGQRVAMSGGWFQVDQMSSAAQMSSAAPPKIEENISHFTAQTSPDARMLLQHGVVRSNCVDCLDRTNVVQFGIGKVALGWQLYSMGFLALPWSLQLHSEVCRVFEEMFDEHGNTLAWQYAGSQLVHSIKTYKRTAVFQERSRDVFQTISRYYSNTFERSRDVFQTISRYYSNTFGDFEKQDGLNLFLGIFR

SEQ ID NO: 120217 - protein, 193 aa, Heterodera glycines
  Coding regions on vcDNA: vcDNA=SeqID_46640; Strand=-; Position=1 -208,418-525,628-890
  Homolog annotation: Hit_ID=AAH56852.1; Match level="QueryCoverage =64%, HitCoverage=23%, E-value=5e-16, Identity=36%"; Hit description =MGC64432 protein [Xenopus laevis]
  Essential gene: C elegans homolog=C06G3.6; Phenotype=Emb
MADHQHNDIELAEDASATEHGTKQNVSVAVKWFFHGNWRRFQCSEWTYSALQAEIRTIEPNFSGQLFYRDADGDAIVFTTDAEMRVMLDHFQKKMNKDTVTLETMGGEGTVKTGVVKTGCPYINKIGKMRDVTNGNGDKSLHPHIMCDLCDGGVVGIRYKCMVCPDFDLCEQCEKTGVHAEHAMCRLATTNTP

SEQ ID NO: 120218 - protein, 195 aa, Heterodera glycines
  misc_feature (17)..(17): Xaa can be any naturally occurring amino acid
  Coding regions on vcDNA: vcDNA=SeqID_46641; Strand=-; Position=1 -79,297-354,1032-1123,1475-1532,1634-1697,1764-1843,2027-2155
  Homolog annotation: Hit_ID=CAE64129.1; Match level="QueryCoverage =100%, HitCoverage=53%, E-value=3e-59, Identity=57%"; Hit description= Hypothetical protein CBG08745 [Caenorhabditis briggsae]
  Essential gene: C elegans homolog=Y105E8A.6; Phenotype=Unc
LVYDVNAPAEVARRGSXSAKSPKVTSKLKQEIEYRLRLTPAPDEAISIRTDLEPEDEFTVEHVKKDYDVDLMDESQSSLKRRARSATPRRTLNIEPAGPMGPIPVCAYCQEEIDGPVLTALAPNATLTALAPNATKAQKFHPYHFMCCYCQKALNLHGTFREHERRPYCHDCFYKLWNGLMYEPDNNQRKIEKLI

SEQ ID NO: 120219 - protein, 496 aa, Heterodera glycines
  misc_feature (362)..(362): Xaa can be any naturally occurring amino acid
  misc_feature (365)..(365): Xaa can be any naturally occurring amino acid
  misc_feature (450)..(450): Xaa can be any naturally occurring amino acid
  Coding regions on vcDNA: vcDNA=SeqID_46642; Strand=-; Position=1 -118,534-603,955-1052,1153-1208,1397-1499,1557-1632,1868-2000,2056 -2180,2229-2523,2767-2889,3307-3499
  Homolog annotation: Hit_ID=CAE75506.1; Match level="QueryCoverage =99%, HitCoverage=99%, E-value=1e-84, Identity=36%"; Hit description =Hypothetical protein CBG23516 [Caenorhabditis briggsae]
  Essential gene: C elegans homolog=T28H10.3; Phenotype=Emb
TKLILYIPNLLLKISKFRDGEYFKRKTLTLKREKQFMYTEDGNIWAVLVATSNGWENYRHQADVSHAYHTLINHGVEKKRIITMMVDDIANNTENPQPGKIFNVPDGEDVYKRVKIDYRGHEVNPQNFMAILLGDEKRTKGKPVLKSTGKDKVFVYTSGHGDFTGKDKVFVYTSGHGDFGFLIFPHSELTVKQLTRTLKTMHEKKMYAEMTLYIEACKAGSMFFETLKKEWKIYAVTASNPYYAVTASNPYEFSYATFCDPDFLNGECLGDLFSANWMKDSAKANLGKETLRVQFANLGKETLRVQFEIVRKKTNESHVMKYGDLTIQSENVAEFMGKKQAQKRNERHHPAVMFENFQLNDXEFXGIFAAQISDDSITCCFSVDEASERVPTRRNVVEQQIKQIVNKLVQNANDSRILTKHPKRIDLDCHDEVVHTFGNSCFNFSDVILXLNIYKILLNILIIESLCLEYAYVLANLCEQSELDTERIKKVLMEQC

SEQ ID NO: 120220 - protein, 150 aa, Heterodera glycines
  Coding regions on vcDNA: vcDNA=SeqID_46643; Strand=-; Position=1 -42,154-348,468-683
  Homolog annotation: Hit_ID=AAH71025.1; Match level="QueryCoverage =90%, HitCoverage=30%, E-value=1e-45, Identity=65%"; Hit description =LOC432342 protein [Xenopus laevis] sp|Q6IR75|CSN2_XENLA COP9 signalosome complex subunit 2 (Signalosome su
  Essential gene: C elegans homolog=B0025.2; Phenotype=Egl,Emb
MSDFEMDDGEDYGLQYSDDSGSEPDVALENQYYAAKTLKSDGDQRGALDAFRRVLELETEKGDWGFKALKQMMKLNYAMGNFEEMLRHYRNLLTYIRSSVTKNYAEKSINSILDYVSLSKNTALLQQFYKITLEALKVVAQISRQFFFGF

SEQ ID NO: 120221 - protein, 92 aa, Heterodera glycines
  Coding regions on vcDNA: vcDNA=SeqID_46644; Strand=+; Position=1 -3,282-361,425-512,626-733
  Homolog annotation: Hit_ID=CAE68672.1; Match level="QueryCoverage =96%, HitCoverage=28%, E-value=2e-34, Identity=68%"; Hit description =Hypothetical protein CBG14576 [Caenorhabditis briggsae]
  Essential gene: C elegans homolog=M03F4.7a; Phenotype=Lva,Lvl,Unc
MNNDVERTWKNYKEEQLKNGLLDWQDYRNLIYGKPQEGQEISPEYVKMIERDERRWKVADYNSDGKMDRTEYGCFMHPEDCDHMRDIVVQVD

SEQ ID NO: 120222 - protein, 375 aa, Heterodera glycines
  Coding regions on vcDNA: vcDNA=SeqID_46645; Strand=+; Position=1 -380,574-719,801-911,1130-1244,1413-1479,1527-1703,3222-3353
  Homolog annotation: Hit_ID=CAE71360.1; Match level="QueryCoverage =36%, HitCoverage=20%, E-value=3e-11, Identity=31%"; Hit description =Hypothetical protein CBG18263 [Caenorhabditis briggsae]
  Essential gene: C elegans homolog=K08E3.6; Phenotype=Emb
MTENKELKTKLSQQHSQSQQFYPRTPKKRKSQFPYADDNDEDAYCSRMGGDASAVRRSVSMPPPETPLGIIGTTAAGQSVVRAGITTAAARQALTVNASGGIKRRRALVPALVKNSRISQSHGDLTGRNNSDEAVDDLLPSVCESPWLFADQMVHGFQKRRNLLKHSCTRCEKTIEVFHESCRHFAPLPCVRRHNTPKVAGNGNKSAGRPRLGDFCPDARPMVPPLVIFCTYFLDHCKTYMPYRDLYQIEGNPAEVEAVTKQFLVPNKSYPKLDAFPPAVISACVNKFLMQIRDPLIPYSYGKEICALLDRCLAIDGPILEGFAGIVEDLPVSASAQVAIVINRHDNDGQRHNDEQKREHIGVLDGPFFAICYGK

SEQ ID NO: 120223 - protein, 162 aa, Heterodera glycines
  Coding regions on vcDNA: vcDNA=SeqID_46646; Strand=+; Position=1 -161,220-549
  Homolog annotation: Hit_ID=CAG90281.1; Match level="QueryCoverage =64%, HitCoverage=68%, E-value=5e-27, Identity=54%"; Hit description =unnamed protein product [Debaryomyces hansenii CBS767] ref|XP _461820.1| unnamed protein product [Debaryomy
  Essential gene: C elegans homolog=M7.1; Phenotype=Emb
QNYLRLSSSSLHCAITTTLQKRPHRRFSSFIRPSVLHINSLAVFAMARRRIQKEMAELHQELVTTGYTAAPMDDGRDLYHWKASIKGPPESPYEGGTFHLDIVFRRDYPFTPPNVKFDTIIYHPNVGERGDICLDILKQMWAPSMTISKGEGDHKTATRYLT

SEQ ID NO: 120224 - protein, 73 aa, Heterodera glycines
  Coding regions on vcDNA: vcDNA=SeqID_46647; Strand=-; Position=1 -129,537-628
  Homolog annotation: Hit_ID=NP_502786.1; Match level="QueryCoverage =87%, HitCoverage=11%, E-value=2e-11, Identity=53%"; Hit description =RNA-binding region RNP-1 (63.6 kD) (4P555) [Caenorhabditis elegans] emb|CAB54457.1| Hypothetical protein
  Essential gene: C elegans homolog=Y57G11C.9a; Phenotype=Emb
DFLEKEDFGTCSFDFVKVNPDRTKLYVAVRFESKSCAREAMERFGPEGEMLGYKVELSWFRDIRRYLAHCAKQ

SEQ ID NO: 120225 - protein, 325 aa, Heterodera glycines
  misc_feature (6)..(6): Xaa can be any naturally occurring amino acid
  Coding regions on vcDNA: vcDNA=SeqID_46648; Strand=-; Position=1 -168,228-401,453-546,598-766,920-946,1001-1155,1205-1247,1369-1387
  Homolog annotation: Hit_ID=AAR30208.1; Match level="QueryCoverage =85%, HitCoverage=38%, E-value=7e-73, Identity=52%"; Hit description =Na/h exchanger protein 3, isoform b [Caenorhabditis elegans] pir||T31869 hypothetical protein C54F6.13 - C
  Essential gene: C elegans homolog=B0495.4; Phenotype=Lva
KLSKLXMGQLECHSSSKLAYLPYPSFAQIVSLNWHHVETPYTVSVWILLASIAKILFHVNKKFHVNKKFGEAIPDSALLIVVGLVLGYGLHQLHVSMYNLKSTIFFLYLLPPIIFDAGYFMPSRQLFENYFMPSRQLFENWDSVMLFAIVGTIWNTLSIGFTLFTLHVLGHFNLFSVPFSPFEILLFASLISAVDPVAVIAVFEEIHVNEFLFINVFGEALFNDGVSVVLYQMFRKFVLYQMFRKFTLIGVDQLSLADYLAGVGSFVVISFGGALTGLFFAFFVSILTRFTGRVKILAPVSDFLTRFTGRVKILAPVSDFLLPKV

SEQ ID NO: 120226 - protein, 218 aa, Heterodera glycines
  Coding regions on vcDNA: vcDNA=SeqID_46649; Strand=-; Position=1 -24,131-253,450-566,668-782,864-1138
  Homolog annotation: Hit_ID=NP_509620.2; Match level="QueryCoverage =61%, HitCoverage=11%, E-value=2e-18, Identity=39%"; Hit description =ankyrin (XK235) [Caenorhabditis elegans] emb|CAB02658.2| Hypothetical protein C11E4.6 [Caenorhabditis ele
  Essential gene: C elegans homolog=C11E4.6; Phenotype=Ste
MPLTMHERHHADARLRNARMETALDIAVRTDKANLCRLLMLNCPELNLMCASDCCSSTLTTTTTPVSKSHSPPYPLHSAARLGHTDCMEALLEHGFDPNYLGPDGTALHVAIRQGQCSALRILLDYGGALDICDSNGQTVSDWLSTGLSSSTHESDDGMDQRLRDCKKLVDEAVEQHRKAPQPAAERRHGQLFQMREGIWKSAVPEPKFKQFNGTNNG

SEQ ID NO: 120227 - protein, 104 aa, Heterodera glycines
  Coding regions on vcDNA: vcDNA=SeqID_46650; Strand=-; Position=1 -120,334-528
  Homolog annotation: Hit_ID=AAG47838.2; Match level="QueryCoverage =99%, HitCoverage=28%, E-value=7e-54, Identity=100%"; Hit description= aldolase [Heterodera glycines]
  Essential gene: C elegans homolog=F01F1.12a; Phenotype=Gro,Unc
MENANVLARYASICQQNGLVPIVEPEVLCDGEHSLERCQKVTELTLAYTYKALADHHIYLEGTLLKPNMVTPGQSHSPKATPDQIGLATVTALRRSVPIAVPGA

SEQ ID NO: 120228 - protein, 43 aa, Heterodera glycines
  Coding regions on vcDNA: vcDNA=SeqID_46651; Strand=-; Position=1 -77,124-265
  Homolog annotation: Hit_ID=CAE57827.1; Match level="QueryCoverage =97%, HitCoverage=34%, E-value=3e-11, Identity=78%"; Hit description =Hypothetical protein CBG00852 [Caenorhabditis briggsae]
  Essential gene: C elegans homolog=ZK970.4; Phenotype=Emb
VDQHVASIPAVLEIPSKEMPYDASKDSILNRARGLVNTDDLKS

SEQ ID NO: 120229 - protein, 115 aa, Heterodera glycines
  misc_feature (17)..(17): Xaa can be any naturally occurring amino acid
  Coding regions on vcDNA: vcDNA=SeqID_46652; Strand=-; Position=1 -61,715-891,979-1162
  Homolog annotation: Hit_ID=CAE59767.1; Match level="QueryCoverage =98%, HitCoverage=47%, E-value=8e-26, Identity=53%"; Hit description =Hypothetical protein CBG03219 [Caenorhabditis briggsae]
  Essential gene: C elegans homolog=C18E9.10; Phenotype=Lva
PPTRKFAALNTLATPLXIVSFGFLWGPLAYCQFLFSEPRRVVTAVYLLSVLATLYTSLWLQSSLLTVITAALQTFGLIWFLLSYVPGGENGLKWMGRMAKVAFCARQSSTLVLPI

SEQ ID NO: 120230 - protein, 126 aa, Heterodera glycines
  Coding regions on vcDNA: vcDNA=SeqID_46653; Strand=+; Position=1 -136,544-665,1188-1307
  Homolog annotation: Hit_ID=AAH61444.1; Match level="QueryCoverage =99%, HitCoverage=45%, E-value=3e-46, Identity=66%"; Hit description =Polymerase (RNA) II (DNA directed) polypeptide C [Xenopus tropicalis] ref|NP_989124.1| polymerase (RNA) II
  Essential gene: C elegans homolog=C36B1.3; Phenotype=Emb
MPYANQPQVTILQLSNEFVQFVLEDTDLSVANALRRVFIAEVPTLAIDWVQIEQNTSVLHDEFVAHRMGMIPLSSDNIVDRMQYARDCTCTEFCDKCAVLFLLNVRCEEEATKAVTSDDLESNNVE

SEQ ID NO: 120231 - protein, 145 aa, Heterodera glycines
  Coding regions on vcDNA: vcDNA=SeqID_46654; Strand=-; Position=1 -147,1514-1804
  Homolog annotation: Hit_ID=XP_224930.2; Match level="QueryCoverage =77%, HitCoverage=37%, E-value=3e-21, Identity=50%"; Hit description =similar to 2600016B03Rik protein [Rattus norvegicus]
  Essential gene: C elegans homolog=C16A3.6; Phenotype=Emb
MRSDGSVIFGRCDEPREIIQLPVDLRTLSDDERRMRIAERKPIAKKVVERKIERRERRREEKALAAAKLDNAIERELLQRLKKGTYGSMYKFSDKTIDKAMERVDESEQSEEEEVEYETETTREKQRQFVEDFDESEEGEDIEDY

SEQ ID NO: 120232 - protein, 149 aa, Heterodera glycines
  Coding regions on vcDNA: vcDNA=SeqID_46655; Strand=+; Position=1 -105,1087-1431
  Homolog annotation: Hit_ID=CAE67562.1; Match level="QueryCoverage =61%, HitCoverage=40%, E-value=1e-18, Identity=42%"; Hit description =Hypothetical protein CBG13089 [Caenorhabditis briggsae]
  Essential gene: C elegans homolog=E04F6.3; Phenotype=Unclassified
MDPEKARQHIPEPAIFTYASKDAILYALGSEQLRKSDWPGIQFDLSRVLHGEQYIELYAPFPADGARLRSEIRVADLLDKGANAVIISEGTTTKTKCAGDHQSSLILSEKNDQIAGLTDGFGPKILPGWDPIYIIAAYDLLSLNCGGLI

SEQ ID NO: 120233 - protein, 363 aa, Heterodera glycines
  misc_feature (357)..(357): Xaa can be any naturally occurring amino acid
  Coding regions on vcDNA: vcDNA=SeqID_46656; Strand=+; Position=1 -171,221-349,393-461,522-685,770-861,948-1261
  Homolog annotation: Hit_ID=NP_504659.1; Match level="QueryCoverage =95%, HitCoverage=47%, E-value=1e-104, Identity=54%"; Hit description= long-chain-fatty-acid-CoA ligase (70.5 kD) (5H11) [Caenorhabditis elegans] gb|AAD14712.1| Hypothetical p
  Essential gene: C elegans homolog=F46E10.1; Phenotype=Emb
LAFPSSQSYVHGCSVQPLLFETIAERLRTAASKWPNREFVIFKREGIRKSYAEVLADSERLAAGLIHLGMEKGDRLGIWADSERLAAGLIHLGMEKGDRLGIWSPNKYEWITAQFASALAGFVLVNVNPMYHSEDLCYAVEKVGIKTLVNVNPMYHSEDLCYAVEKVGIKTLILIAPPTFKRTDYYGILRELIPELEEAPRGDGRLCTDTFPKLRNLIIFDAEKRTFNGAWAYDTVMGMGTAESRRKLAQYEASTQPDDPCNIQYTSGTTGKPKGATLTHHNILNNAFFVGLRAGYANHRTVICIPNPLYHCFGCVMGSLAALVHFQTCVFPAPSFEPLAALQAIHEERSAFSGRSXSFVMGN

SEQ ID NO: 120234 - protein, 389 aa, Heterodera glycines
  Coding regions on vcDNA: vcDNA=SeqID_46657; Strand=-; Position=1 -252,387-676,728-880,996-1158,1212-1282,1404-1484,1535-1594,2016-2055
  Homolog annotation: Hit_ID=XP_417590.1; Match level="QueryCoverage =92%, HitCoverage=59%, E-value=1e-61, Identity=39%"; Hit description =PREDICTED: similar to Hypothetical protein MGC63553 [Gallus gallus]
  Essential gene: C elegans homolog=F59G1.5; Phenotype=Emb
YLVRPSESNPEDYTIPIHQGSRVTHVKIPLNASNVYRFPSGQEFRSLEEIGKALSNGPDILTDEVFTSLSSPLYPSVKRWFHISTSGQEAEALLRLKHEGTFLLRESTSSEGEFALSVKSTDAVIHVRVHRGARSVPPFSYFPFLLKHGRFGIVPKDNFRGFADLLDNYVRMPMVQNDGSAVKLVNDGSAVKLVAALPTTRFTAATIDDRIDCLLQSQRKTGAKDGFVEEFEVLKTEDAQMFISCKEGGKTENIRKNRYRNVVPFDHTRIKLKSVRENDYINANYIKVLLRDTDTRNGEFRRSYISTQGCLEETVNFFWQMIWQEETRLIVMVTKEVERGRVKCFRYWPDLDERKNVKCFRYWPDLDERKNYGTTNVSKVNLFETEPFY

SEQ ID NO: 120235 - protein, 266 aa, Heterodera glycines
  Coding regions on vcDNA: vcDNA=SeqID_46658; Strand=+; Position=1 -79,124-238,302-450,566-621,681-827,877-950
  Homolog annotation: Hit_ID=CAE71286.1; Match level="QueryCoverage =97%, HitCoverage=54%, E-value=1e-72, Identity=55%"; Hit description =Hypothetical protein CBG18174 [Caenorhabditis briggsae]
  Essential gene: C elegans homolog=Y79H2A.6; Phenotype=Emb
QSDSPVPNWLLNIGPISCHAWNKDKTQLAVSPSNNEIHIFARLETVWNPLTQLAVSPSNNEIHIFARLETVWNPLHVLREHDLLITGLDWAPNTAPNTNRIVSCSHDKNAFVWTWEAEKNSWKPEMVVVRINRAATCVKWSPNENKFAVGTGARLVAICYYERENDWWVAKQIKKLIRSTRENDWWVAKQIKKLIRSTVTSLNWHPNNILLAVGACDFKTRVFSAYVKEIDEKPTPNPWGTKIDEKPTPNPWGTKMPFGRIAQGVP

SEQ ID NO: 120236 - protein, 125 aa, Heterodera glycines
  Coding regions on vcDNA: vcDNA=SeqID_46659; Strand=+; Position=1 -139,198-436
  Homolog annotation: Hit_ID=NP_741157.1; Match level="QueryCoverage =98%, HitCoverage=99%, E-value=3e-62, Identity=99%"; Hit description =ribosomal Protein, Large subunit, ubiquitin (94.0 kD) (ubq-1) [Caenorhabditis elegans] gb|AAC46525.1| Ubi
  Essential gene: C elegans homolog=F25B5.4a; Phenotype=Emb
MQIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGTI

SEQ ID NO: 120237 - protein, 291 aa, Heterodera glycines
  Coding regions on vcDNA: vcDNA=SeqID_46660; Strand=-; Position=1 -193,239-390,436-518,808-1023,1068-1299
  Homolog annotation: Hit_ID=CAE62694.1; Match level="QueryCoverage =89%, HitCoverage=44%, E-value=3e-66, Identity=51%"; Hit description =Hypothetical protein CBG06842 [Caenorhabditis briggsae]
  Essential gene: C elegans homolog=R08D7.3; Phenotype=Emb
MSLPQFDLPECVSNSNGWGPGSVSDSQVLSEFVGLPYQHFNKCDRIGRIVDWLGVDRFFKKGETRDRYNERVYGSSATAGVQFDYIHDNEESNFQLVDSSRPQKPQRPFRRQIPFRKLAQREQERREYEKYNVSTKMKRSILKEQQKAYKVFLRRGGGTRGTAQRPTGRRFNDRQAGKGRQPSVQVRPDWAVLKELDFVQLNKLYLPNIEPGKDIPGETYGTLHFYDKALMDKLSVKNPLHLEKFHASFYSLTTTEDPVFRKVVVFTSLLNFAWLSCPATMSAMYSPQISF

SEQ ID NO: 120238 - protein, 331 aa, Heterodera glycines
  Coding regions on vcDNA: vcDNA=SeqID_46661; Strand=-; Position=1 -171,228-473,528-592,655-779,835-1073,1125-1274
  Homolog annotation: Hit_ID=NP_491237.1; Match level="QueryCoverage =83%, HitCoverage=90%, E-value=7e-81, Identity=50%"; Hit description =protein phosphatase 1A (34.6 kD) (1E406) [Caenorhabditis elegans] gb|AAB42233.1| Yeast glc seven-like pho
  Essential gene: C elegans homolog=W09C3.6; Phenotype=Ste
MAREDYCFDATAAAAAEQSRPSATTSTLVQGDGLSSSFVDAIIRKVRHSPVQRFTDEITDEELKQLCMAATDIFRMQPTLVRIQPPVVVVGDIHGQFTDLQRIFHTHGNPPEQQYVFLGDYVDRGPQSLETIVLLFCYKVKYPANFMLLRGNHECANINRVYGFFDEVNRRYQRPGPRRLYDLFNQTFAWMPYVGLIGDKILCMHGGLSDQINSLEQLSHLNRPQIDPPLRTLEIDLLWADPARGVRGVIPNTRGAGIAFGEDVVERVCDMLCLDYIIRAHQVVMNGVEYFAGRRLITLFSSARYNGRNNTGATLTIAANLSHSITRFPPA

SEQ ID NO: 120239 - protein, 212 aa, Heterodera glycines
  Coding regions on vcDNA: vcDNA=SeqID_46662; Strand=-; Position=1 -40,407-1005
  Homolog annotation: Hit_ID=NP_504330.1; Match level="QueryCoverage =86%, HitCoverage=83%, E-value=3e-19, Identity=32%"; Hit description =predicted CDS, putative protein family member (5F423) [Caenorhabditis elegans] pir||T31857 hypothetical p
  Essential gene: C elegans homolog=ZK250.3; Phenotype=Clr,Lvl,Sck
MNKENYNLLLLKKESDNVRDLGIIIDSKLHFSEHINKIVRNAYLRVFQILRVLKTREIKTLTTACKTFVRPQLEYATEVWNPNLKKDIDKIERVQKFFTRKAFRKCGFVYKKYMERLKITDLHKLEERRKINDLTTAFKIIKGFTSLEAEQNFFFSERPRRPLLLRVKRHTHKTQNNFFHRIVRNWNNLPVVAVQINKAKEFRGLLKAMSSE

SEQ ID NO: 120240 - protein, 105 aa, Heterodera glycines
  Coding regions on vcDNA: vcDNA=SeqID_46663; Strand=+; Position=1 -112,404-609
  Homolog annotation: Hit_ID=CAE71228.1; Match level="QueryCoverage =98%, HitCoverage=26%, E-value=4e-14, Identity=42%"; Hit description =Hypothetical protein CBG18096 [Caenorhabditis briggsae]
  Essential gene: C elegans homolog=H38K22.2a; Phenotype=Emb
MACDMFYQNPSYTNQQAGATGGADSRKICHLFNKYATDPKDKSQKIGPDRIGPNGMVRFLRDLNIEPTSRAVMVLAWKMGAQKQCEFTLQEFGDGISTLMFVSLF

SEQ ID NO: 120241 - protein, 361 aa, Heterodera glycines
  Coding regions on vcDNA: vcDNA=SeqID_46664; Strand=+; Position=1 -47,145-199,269-373,630-692,792-831,932-978,1028-1077,1221-1333,1493 -1575,1627-1668,1718-1776,2037-2193,2653-2748
  Homolog annotation: Hit_ID=CAE59544.1; Match level="QueryCoverage =98%, HitCoverage=66%, E-value=1e-116, Identity=46%"; Hit description= Hypothetical protein CBG02940 [Caenorhabditis briggsae]
  Essential gene: C elegans homolog=F09F3.5; Phenotype=Emb,Lva,Sck,Stp
MALQGTRDCRWALSLPRFPCFVAGDERNSHQPGLTALHTIPGLTALHTIFLREHNRIAEALGRINPHWTDERIYQETRRIVVAQQQHIVFNEFLPKVIGLDLLHEYDLVTQRSDYYTGYDANCDPAISHPFATAAFRFGHTAISHPFATAAFRFGHTLIRRMFPRMNSDYHNMSEPVDLARHFGFVEPLYNRTAGGLDSMLLGMLGTPSMAFDRHITTAVRDMLFARRDEPTSGMDLLFARRDEPTSGMDLVAINMLVAINMLRARDHGVQPYNAFRPLCGLSRAESFTDLRDVMEPNAIAALQSVYESVDDIDLFPGLTSERPRKGALLGHTMSCLLAEQFRRLKKCDRFYYENDNSAAR

SEQ ID NO: 120242 - protein, 135 aa, Heterodera glycines
  Coding regions on vcDNA: vcDNA=SeqID_46665; Strand=+; Position=1 -27,90-347,399-455,2488-2519
  Homolog annotation: Hit_ID=CAG11938.1; Match level="QueryCoverage =97%, HitCoverage=15%, E-value=3e-25, Identity=49%"; Hit description =unnamed protein product [Tetraodon nigroviridis]
  Essential gene: C elegans homolog=F09E5.2; Phenotype=Lva
HVIFALSPSDFAKIWLDFAKIWLLKHALLVVYTPDREHFGIVPIEAMFMRCAVLAVNSGGPLESVENGSSGFLRDSNAEEFGKVMKLAVNRPQLMQQMGEAGRIRVRIRVEKHFSFGAFANKIDGSGSAMSLLLA

SEQ ID NO: 120243 - protein, 351 aa, Heterodera glycines
  Coding regions on vcDNA: vcDNA=SeqID_46666; Strand=-; Position=1 -245,336-387,575-785,1359-1476,2248-2325,2416-2628,2684-2822
  Homolog annotation: Hit_ID=NP_495786.1; Match level="QueryCoverage =40%, HitCoverage=69%, E-value=9e-45, Identity=66%"; Hit description =TU37B2 (21.3 kD) (2I757) [Caenorhabditis elegans] emb|CAA90361.1| Hypothetical protein F22B5.10 [Caenorha
  Essential gene: C elegans homolog=F22B5.9; Phenotype=Emb,Lva
SESSHLREYLHIIRDKPLYPVILDADGVICSMPPIINSEHSKITLNTRNIFIEVTGTDLVKLEIVLDMLVTMFSQYCTEQFNVEPVQIVQPNGTFSLFPKLDYRDHLVDVLSLAAKIGISDIGADKAVQLLSKMALECVPIKDEEQPQTVDIGKALELLKLTMSGEEKRSGPQFPAARHFEDHRQQQGHGTATTSLRSAGRGVHRREQSDALLIIFIAFFTALLGEGLTWVLVYRSDEYKRLKFSMERKSKKLERKKDAIGAGGDAAGGAGAANAASKTTKRKIEREEERLKSTNRDLSMFRMKSMLAIGFVFAALLSTFSSIFEGRVVAKLPFEPITWVQGLSHRNLVGQ

SEQ ID NO: 120244 - protein, 750 aa, Heterodera glycines
  misc_feature (594)..(594): Xaa can be any naturally occurring amino acid
  misc_feature (614)..(614): Xaa can be any naturally occurring amino acid
  misc_feature (623)..(623): Xaa can be any naturally occurring amino acid
  misc_feature (668)..(668): Xaa can be any naturally occurring amino acid
  Coding regions on vcDNA: vcDNA=SeqID_46667; Strand=+; Position=1 -119,263-356,612-847,1046-1161,1202-1307,1351-1614,1662-1861,1998 -2154,2472-2615,2724-2870,2907-3289,3555-3639
  Homolog annotation: Hit_ID=NP_491765.2; Match level="QueryCoverage =99%, HitCoverage=86%, E-value=1e-107, Identity=35%"; Hit description= ubiquitin specific protease (88.8 kD) (1G689) [Caenorhabditis elegans] gb|AAB42297.2| Hypothetical prote
  Essential gene: C elegans homolog=T27A3.2; Phenotype=Gro,Pvl,Slu,Stp
RENIFKDLFNIHPHRALSEEPKQSLPLVFSLIFQQFRSLSAELQQRLNSGISEWDGEERMVAKAAEDLVQDDGPPISYSEWECQCGLKENLWLNLTDGAIMCGRFSQLAGIKGNGHAKAHFESTGFPLVVKLGTIENGDGDIYSYNEDAPVCDPWLGQHLARFGLDIKKFRKTEKTTLEIELDANLKHEFSAIQEEGLHEFSAIQEEGLELVNVSGPGYTGLINLGSSCYINSALQVLLIVPDFVRAFTEELYINSALQVLLIVPDFVRAFTEELLLRKQPPEINEDFAAQLAKIFVAMKSGDYSREDNKHGAEKEKGIRPTTFRRIVGRNHPEFSTAKQQDVEEYVRFLFEKVDACSDEYVRFLFEKVDACSDLSSENPVAAFRFRLVTRFLDELSDCVRYSFRTDNILSVAIPMDLCKEVNINSRRKSVTLEQCLAATFEEEIIDDYFSPVLKMKGRAKQQQRMGSFPDFLLLQLRRFAFDWILGTQHKLDVDVHVSDELDINAFFSTGELQPNEKAQLEKPWKPPRQAVIITFVILIIYNQLLSMGFTENAAKKAALFTKNESAESAINWILQNKIRKGTKCCFLKKFKAXEFNKIRKGTKCCFLKKFKAXEFHPNVYEXFIFSILTTLMNDPHPMLTKQSTPPLTSNQGKQTRGTHGQIKSNKXGVSINGLIAFLGQNASQKRHGKGHYRLRAFISHIGSTPNSGHYVAHVKADNGQWHIFNDEKVAKSQHPPKTLGYLYLFQRAT

SEQ ID NO: 120245 - protein, 57 aa, Heterodera glycines
  Coding regions on vcDNA: vcDNA=SeqID_46668; Strand=+; Position=1-171
  Homolog annotation: Hit_ID=NP_497919.1; Match level="QueryCoverage =100%, HitCoverage=25%, E-value=8e-16, Identity=61%"; Hit description= mitochondrial ribosomal protein S34 (26.3 kD) (3F630) [Caenorhabditis elegans] emb|CAA84334.2| Hypotheti
  Essential gene: C elegans homolog=M88.2; Phenotype=Lva
ADWTFRGKHLGVYEFGTDLNRSDWVLIHKHEEKKFTENRQQMGTLNIPSTFPVPPLQ

SEQ ID NO: 120246 - protein, 320 aa, Heterodera glycines
  Coding regions on vcDNA: vcDNA=SeqID_46669; Strand=+; Position=1 -171,264-551,991-1109,1169-1364,1706-1894
  Homolog annotation: Hit_ID=NP_493761.1; Match level="QueryCoverage =99%, HitCoverage=98%, E-value=2e-79, Identity=45%"; Hit description =cdc37 (42.7 kD) (2A868) [Caenorhabditis elegans] gb|AAC71172.1| Hypothetical protein W08F4.8 [Caenorhabdi
  Essential gene: C elegans homolog=W08F4.8; Phenotype =Emb,Gro,Pvl,Rup,Stp,Unc
MPIDYSAWSNIEVSDDEDDTHPNVDTASLFRWRHQARVEREAEMKQAKKEVKEEQSNEIEEKLKSAKLEEKERISLELELNTIRTQEEEFRKKEKELEEKEKHQPWNVDTIAKEAWSKTIVNKPKEGKEQPKKGTTSKSEEDEEINRMQKYFKEINMGRVAENYIMIQYELELAKSLHAMATNTNVIKNFFKKIRIAEQNYMKMFTDEVEAFKDRLRKRARDKREAMLSETEVEEKKKRVAQSPGGLDPQEVFDSLPAEMQEAFETQSMSKIFEVAKSMDSEVFKYHLDRCTASGLWIPNAKEAEGHGQEEEEKKETEEK

SEQ ID NO: 120247 - protein, 66 aa, Heterodera glycines
  Coding regions on vcDNA: vcDNA=SeqID_46670; Strand=+; Position=1-201
  Homolog annotation: Hit_ID=NP_491593.1; Match level="QueryCoverage =84%, HitCoverage=27%, E-value=2e-11, Identity=55%"; Hit description =ATP synthase mitochondrial (22.4 kD) (1F996) [Caenorhabditis elegans] gb|AAB37654.1| Hypothetical protein
  Essential gene: C elegans homolog=F27C1.7a; Phenotype=Emb,Lva
PLDKKHEQSLNDALQKFATRGQKLNLTFTVKPDLVGGLVVNIGDKYIDLSMATRLKKMDAVVKGSI

SEQ ID NO: 120248 - protein, 341 aa, Heterodera glycines
  misc_feature (337)..(337): Xaa can be any naturally occurring amino acid
  Coding regions on vcDNA: vcDNA=SeqID_46671; Strand=+; Position=1 -87,346-398,1085-1207,1615-1718,1872-1942,2095-2126,2184-2242,2302 -2389,2814-3035,3092-3120,3571-3652,4154-4189
  Homolog annotation: Hit_ID=NP_503126.2; Match level="QueryCoverage =98%, HitCoverage=22%, E-value=1e-149, Identity=79%"; Hit description= EGg Laying defective EGL-8, Posterior BOdy contraction defect in defecation PBO-2, phospholipase C beta
  Essential gene: C elegans homolog=B0348.4a; Phenotype=Gro
TYRYPGATINIHPLLSSLVNYTHPIKFSGFDVAEQNDLHFHMSSFSESTGLGLLKQSALEFVNYNKRQLSRIYPKGARVDSSNFLPQIFWNAGCQMVALNFQTPDVCMQLNQGKFEYNGQCGYLLKPDFMRRPDRTFDPFSESPVDGVIAAHCSVRIISGQIISGQFLCERKTGTYVEVEMYGLPTDYGLPTDTIRKEHRTKLVPANGLNPIYNEEPFVFRKVILPELAVLRFAVYDENGKQLGQRILPLDGLQSGYRHISLRTEHNQASTLPTLFVHLQLKTYVPDELSGLGLVDALADPRAYLSAQEKREEALQQMCVDELDIVDDVNIQNDTIXHYST

SEQ ID NO: 120249 - protein, 160 aa, Heterodera glycines
  misc_feature (1)..(1): Xaa can be any naturally occurring amino acid
  Coding regions on vcDNA: vcDNA=SeqID_46672; Strand=-; Position=1 -376,771-876
  Homolog annotation: Hit_ID=NP_499264.1; Match level="QueryCoverage =61%, HitCoverage=21%, E-value=1e-42, Identity=77%"; Hit description =citrate synthase (51.5 kD) (3L304) [Caenorhabditis elegans] emb|CAA83004.1| Hypothetical protein T20G5.2
  Essential gene: C elegans homolog=T20G5.2; Phenotype=Emb
XKIIMVFYLKKILQNKRVLPVVSKTATFRLAPIYSMFPFHYNSKKPIFRFRFIKISFFHPQIYGGMRSMKGMVTETSVLDPEEGIRFRGYSIPECQQKLPKAEGGEEPLPEGIWWLLCTGEIPDQKQVNAISKEWASRADLPAHVAQLLENIPPNLHPMS

SEQ ID NO: 120250 - protein, 204 aa, Heterodera glycines
  Coding regions on vcDNA: vcDNA=SeqID_46673; Strand=+; Position=1 -135,258-443,551-841
  Homolog annotation: Hit_ID=CAH68894.1; Match level="QueryCoverage =86%, HitCoverage=16%, E-value=2e-32, Identity=45%"; Hit description =novel protein [Danio rerio]
  Essential gene: C elegans homolog=R12E2.2; Phenotype=Gro,Rup
VLYWNAEAENRGAILNDPERDDYMRNPCERAQNKFLIIELCETIQPTALEIANFELFSSSPRQFRVWGSERYPTQEWALIGEFEALDNREVQLFNVLEHTSYAKFVKLELLTHYGSEHYCTLSTFRMYGTSMVDEYEAETVVAVDAMQQQQHQQQMDSVFGRTFSTLPSTNSAAVNEAVVATGGEEENRQNNGTITEKTPLTTV

SEQ ID NO: 120251 - protein, 47 aa, Heterodera glycines
  Coding regions on vcDNA: vcDNA=SeqID_46674; Strand=+; Position=1 -48,296-392
  Homolog annotation: Hit_ID=CAE67774.1; Match level="QueryCoverage =100%, HitCoverage=12%, E-value=2e-15, Identity=80%"; Hit description= Hypothetical protein CBG13349 [Caenorhabditis briggsae]
  Essential gene: C elegans homolog=C08B11.5; Phenotype=Emb
ATIYVGGLDEKVTEAILWELFVNAGPVTNVNMPKDRITGKRQGFGFV

SEQ ID NO: 120252 - protein, 109 aa, Heterodera glycines
  Coding regions on vcDNA: vcDNA=SeqID_46675; Strand=-; Position=1 -122,676-803,1283-1400
  Homolog annotation: Hit_ID=AAQ83895.1; Match level="QueryCoverage =91%, HitCoverage=24%, E-value=1e-23, Identity=47%"; Hit description =actin-related protein 6 [Branchiostoma belcheri tsingtaunese]
  Essential gene: C elegans homolog=C08B11.6; Phenotype=Emb
MLSSQPTLIMDNGAYSIKAGYSTDQSARIFPNTVFKSKGERKRIFVADELDQCTDRSALFFVLPFERGYLVNWDTQLQIWNRVFGTEGAGLGVDCQQCRLVLTDPHEVA

SEQ ID NO: 120253 - protein, 730 aa, Heterodera glycines
  Coding regions on vcDNA: vcDNA=SeqID_46676; Strand=+; Position=1 -87,135-488,533-697,742-828,870-1094,1163-1588,1638-1766,1814 -2002,2070-2150,2194-2640
  Homolog annotation: Hit_ID=CAE70196.1; Match level="QueryCoverage =100%, HitCoverage=31%, E-value=0.0, Identity=95%"; Hit description =Hypothetical protein CBG16670 [Caenorhabditis briggsae]
  Essential gene: C elegans homolog=C50C3.6; Phenotype=Emb
TDAGGITHFRSGMTHDEDQIIPNLYRYIQPWEAEFVDSQRVWAEYALKRQEANAQNRRLTLEDLDDSWDRGIPRINTLFQKDRNTLAYDKGWRVRTEFKAYQILKQNPFWWTHQRHDGKLWNLNNYRTDMIQALGGVEGILEHTLFRGTYFPTWEGLFWERASGFEESMKFKKLTNAQRSGLNQIPNRRFTLWWSPTINRANVYVGFQVQLDLTGIFMHGKIPTLKISLIQIFRAHLWQKIHESVVMDLCQVFDLELDALEIQTVQKETIHPRKSYKMNSSCADILLFAQYKWHISRPSLLADTKDVMDNTTTQKYWLDVQLRWGDYDSHDIERYSRAKFLDYTTDNMSIYPSPNGVLIAIDLAYNLYSAYGNWFPGMKVLLRQAMAKIIKANPAFYVLRERIRKGLQLYSSEPTEPYLTSQNYGELFSNQIIWFVDDTNVYRVTIHKTFEGNLTTKPMNGAIFIFNPRTGQLFLKIIHTSVWAGQKRLSQLAKWKTAEEVAALIRSLPVEEQPRQIIVTRKAMLDPLEVHLLDFPNIVIKGSELMLPFQAIMRIEKFGDLILKATEPQMVLFNLYDDWLKTISSYTAFSRVILIMRGMHINPDKTKVILKPDRTTVTEPHHIWPTLSDEEWIKVELALKDMILNDYGKKNNVNVASLTQSEVRDIILGMEISAPSQQRQQIAEIEKQTKEQSQVTATTTKSVNKHGDEIISATTSNYETTTFSSRTEWR

SEQ ID NO: 120254 - protein, 278 aa, Heterodera glycines
  Coding regions on vcDNA: vcDNA=SeqID_46677; Strand=+; Position=1 -552,617-724,800-914,1158-1216
  Homolog annotation: Hit_ID=NP_509851.1; Match level="QueryCoverage =92%, HitCoverage=38%, E-value=3e-38, Identity=40%"; Hit description =putative protein family member (60.5 kD) (XL681) [Caenorhabditis elegans] emb|CAA92024.1| Hypothetical pr
  Essential gene: C elegans homolog=W04G3.2; Phenotype=Lva,Lvl,Unc
YGGLSDDSPAPGGLIGQFGFCSAPPRTVNQHPTLVESEGRLAIVWAVAIRHCPANNSSTMCRLFTHSFANAMPFLQVLYKTLTSGSVLPSSASANASADPLNATSALGLPFPQSVSLPPVLAALFPDLNTSTPITLTAAQQEAIGENLEMIQNLIVQPSSPLCSPKPVAVAEFNLDAFMGQWYQVMYSPPLVQSACSVVSYRKLADINSGGIGSIFEVFEYTTDGTPYSKPKITSGYAIIKQMGELIFRTTAHQEDVNKVRNGGATASGTEGRRQWYQ

SEQ ID NO: 120255 - protein, 249 aa, Heterodera glycines
  Coding regions on vcDNA: vcDNA=SeqID_46678; Strand=+; Position=1 -55,133-194,248-407,562-711,797-856,904-1059
  Homolog annotation: Hit_ID=CAE72599.1; Match level="QueryCoverage =98%, HitCoverage=20%, E-value=4e-55, Identity=47%"; Hit description =Hypothetical protein CBG19789 [Caenorhabditis briggsae]
  Essential gene: C elegans homolog=Y105E8A.23; Phenotype=Gro,Stp
KQLIAIGIDRDKGVPSITFAPYLTHCAFESLTQAFTNSMALMEWFKRCAHQTLKLGRPALMEWFKRCAHQTLKLGRPMEWVTPLGLPVVQPYVTVDKEGTGLVFRPVPHKQVNAFPPNFVHSLDSSHMMLTALCCYRHGITYASVHDCFWTHACDVDEMNRICRDQFIALHEQPITEQLSRFFTSTFLPPELRQLMSVDEFFTSTFLPPELRQLMSVDELNKIVEEFKLNIPPGNLDITKVRESKYFFS

SEQ ID NO: 120256 - protein, 257 aa, Heterodera glycines
  Coding regions on vcDNA: vcDNA=SeqID_46679; Strand=-; Position=1 -204,256-463,511-825,1174-1221
  Homolog annotation: Hit_ID=NP_498895.1; Match level="QueryCoverage =94%, HitCoverage=21%, E-value=3e-61, Identity=50%"; Hit description =kurz (3J700) [Caenorhabditis elegans] gb|AAA27928.2| Hypothetical protein C06E1.10 [Caenorhabditis elegan
  Essential gene: C elegans homolog=C06E1.10; Phenotype=Lva
VCVVSTNVAETSLTIPNVRYVIDSGREKKREYDPITGVSRFVVGWCSKASADQRSGRAGRVQSGYAFRLYSSAVYEDMRDHSTPEILNKPIDQLILMLKAMNFTKIDNFPFPTPPRLDQIKSSELRLSHIGALRVQEGLYTITQLGQSLAQLPLTPSFAKVVISSIRGGLLPFAVTLVSALSVREPLLFISSTKEDGTEERRKRMSEVIKQRFLWCAVGEARLFGDLTVILNTVGAADYEEENGCTLPRTTEEIKVE

SEQ ID NO: 120257 - protein, 301 aa, Heterodera glycines
  misc_feature (257)..(257): Xaa can be any naturally occurring amino acid
  misc_feature (293)..(293): Xaa can be any naturally occurring amino acid
  Coding regions on vcDNA: vcDNA=SeqID_46680; Strand=+; Position=1 -168,293-379,426-622,748-1156
  Homolog annotation: Hit_ID=CAE60587.1; Match level="QueryCoverage =76%, HitCoverage=17%, E-value=4e-82, Identity=66%"; Hit description =Hypothetical protein CBG04223 [Caenorhabditis briggsae]
  Essential gene: C elegans homolog=Y71F9AL.17; Phenotype=Gro,Ste
LKSYIYHQLVKVEYTGAVDDIFYAGTGLLLLKNADSVQMYDLQQKRVLASVKATKVKYVIWSKNMECAALLSKHTVTLVTKRLEVLGTVQESTRVKSGAWDAVLGTVQESTRVKSGAWDADEAFLYTTSNHIKYALTTGGDHGIIRTMDIPLYILAVRGSRLYCLSREASPVELSIDLTEFRFKLALTHRRYDEVLNMVRNANLLGQSIIAFLQKKGYPEVALHFVKDEKTRFGLALECGNLQVGLRVENSTLDGFXHKLISTNFLMTSFKLQGLEILHKALSFFIFWYVMEXNALILTKS

SEQ ID NO: 120258 - protein, 255 aa, Heterodera glycines
  Coding regions on vcDNA: vcDNA=SeqID_46681; Strand=+; Position=1 -51,790-955,1008-1235,1314-1363,1751-2023
  Homolog annotation: Hit_ID=NP_490728.1; Match level="QueryCoverage =78%, HitCoverage=41%, E-value=1e-15, Identity=26%"; Hit description =TBP-Associated transcription Factor family member (taf-4) [Caenorhabditis elegans] gb|AAC16427.1| Taf (tb
  Essential gene: C elegans homolog=R119.6; Phenotype=Emb,Lva,Lvl
MSAEEFSAKLREVTGSQLLSPQQQQLSDNGVDEAVTAQRQLQVSRSVPPPSLQQQQIQPAQIVNVVRPLSVQNSLNALYPATTASTTFVVERKPPTPQQQPLQKQTPIASASPAQQVQAVAQQPQQLQTNRPPSTSSSMATTNVHESSASTTTLAQAQMAPESLQAAEARLRNVLAQLASLADHRQRPLRIDPNYALVDEPRKQMRFMEDIERRAHESRETAEKEAMMRTAKSKGGKDRDVVEKAKMVGHWAGGN

SEQ ID NO: 120259 - protein, 79 aa, Heterodera glycines
  Coding regions on vcDNA: vcDNA=SeqID_46682; Strand=-; Position=1 -116,194-317
  Homolog annotation: Hit_ID=CAE74050.1; Match level="QueryCoverage =98%, HitCoverage=82%, E-value=4e-29, Identity=71%"; Hit description =Hypothetical protein CBG21702 [Caenorhabditis briggsae]
  Essential gene: C elegans homolog=F49C12.12; Phenotype=Emb,Lvl
MIISVWGIVFLGLLGVFFYMHAVTLFPDLHLEEEAKLERQMVEEKYEEKAKQCWIAAGMYVVTLIAVFWQNRFNTTQIL

SEQ ID NO: 120260 - protein, 515 aa, Heterodera glycines
  Coding regions on vcDNA: vcDNA=SeqID_46683; Strand=+; Position=1 -121,178-384,429-586,631-801,859-1081,1147-1336,1387-1673
  Homolog annotation: Hit_ID=NP_741382.1; Match level="QueryCoverage =92%, HitCoverage=94%, E-value=3e-77, Identity=39%"; Hit description =tYrosinyl tRNA Synthetase (50.1 kD) (yrs-1) [Caenorhabditis elegans] gb|AAB09162.2| Tyrosinyl trna synthe
  Essential gene: C elegans homolog=K08F11.4a; Phenotype=Lva
QFQIMLYQNLKIVPSADSQPLSSFIHDLLRRKLLSCTHPVKYFTDITAYSSTKYFTDITAYSSTLPNVLYAGVDPTADSLHLGNLLVLNSLIRASFFGCSPILLIGEATASVGDPSGHKRDRKLLLHEFIRKLLLHEFIYANSKALQRQVEKIKANVSSLYGEDISLEIRNNAEWYKEVSLADFFESTKRFRMSDMLKSGPIKSSLADFFESTKRFRMSDMLKSGPIKSRLDDSLSYAEFSYQTLQAIDWLKLYEERGCLCQIGGTDQIGGTDQFGNMRAGFEHIRATERLSIALCMPLLTDKNGRKLGKSSDQNGGTAPLWLDQLKTSAFAFYQHLRQLHDDAAEHFLVDAAEHFLVSFSLRITEVEDVLEEHRNNLGKWVAQHLAEEMTAIVHGKAALERAKKCSKILFGASSSELENASSSELENLNPDEITEMFGSASTFEIVCGSIKTMGDLAAMTKQDGINLMRAGALKINGTKATDPEEKIDLERILINGRFTIVCWGRRKFSLIKWS

SEQ ID NO: 120261 - protein, 79 aa, Heterodera glycines
  Coding regions on vcDNA: vcDNA=SeqID_46684; Strand=+; Position=1 -94,183-328
  Homolog annotation: Hit_ID=CAE74051.1; Match level="QueryCoverage =98%, HitCoverage=90%, E-value=2e-27, Identity=67%"; Hit description =Hypothetical protein CBG21703 [Caenorhabditis briggsae]
  Essential gene: C elegans homolog=F49C12.13; Phenotype=Emb,Lva,Lvl
MSALIPFIIVTLFWAVIGAGGPFLVPSGMNRGIIQTMIVLTAVCCYMFWLIVYLHQLNPLIGPQLPVKTIWWIHNTWGI

SEQ ID NO: 120262 - protein, 180 aa, Heterodera glycines
  Coding regions on vcDNA: vcDNA=SeqID_46685; Strand=+; Position=1 -29,98-107,225-551,869-1045
  Homolog annotation: Hit_ID=CAE58658.1; Match level="QueryCoverage =74%, HitCoverage=37%, E-value=4e-40, Identity=57%"; Hit description =Hypothetical protein CBG01827 [Caenorhabditis briggsae]
  Essential gene: C elegans homolog=C39E9.13; Phenotype =Emb,Gro,Pvl,Stp,Unc
MCEWRKFPFRCPATWLYYDCFPSSVTHFSDVGIYDRVIVQEVVKTMAQVEQLNRSTQKAFKVVVLMEAENLSREAQHSLRRTMEKYAGTCKIILCCESASRIIDPLRSRCMLIRVAAPNDAQMRECIESVCAKERVNLSEFWMKMLIEKAGGNVRRAICLLEEECSTKVKEIMSQFNGNM

SEQ ID NO: 120263 - protein, 140 aa, Heterodera glycines
  misc_feature (1)..(1): Xaa can be any naturally occurring amino acid
  Coding regions on vcDNA: vcDNA=SeqID_46686; Strand=-; Position=1 -41,103-130,229-256,309-404,590-692,939-993,1266-1285
  Homolog annotation: Hit_ID=CAE69508.1; Match level="QueryCoverage =99%, HitCoverage=20%, E-value=5e-45, Identity=64%"; Hit description =Hypothetical protein CBG15716 [Caenorhabditis briggsae]
  Essential gene: C elegans homolog=Y50D7A.7; Phenotype=Lva
XGYRLTFVIAYLRDMAMDYAVIGDMAMDYAVIGESFETSVPWSRVLDVCSRVLDVCRNVRTLLVHEARRHGIKYPVLATCRVTQVYDAGACIYFYFGFNCRGLEKDPLHVYEQIETAARNEIITCGGSISHHHGIGKIRK

SEQ ID NO: 120264 - protein, 148 aa, Heterodera glycines
  Coding regions on vcDNA: vcDNA=SeqID_46687; Strand=-; Position=1 -208,400-636
  Homolog annotation: Hit_ID=NP_872075.1; Match level="QueryCoverage =58%, HitCoverage=7%, E-value=1e-22, Identity=50%"; Hit description =protein kinase family member (wnk-1) [Caenorhabditis elegans]
  Essential gene: C elegans homolog=C46C2.1a; Phenotype=Egl,Gro
MSPEPTPPFLPVASAHAKVEEEVPIPSTALKPQTSLELDEVKKEAESRRESAEDYDEDYDEEKPIDKSPGVAVAWCELQEQKLNKAERQRFREEAEMLKGLQHPNIVKFYDYWERTDGKRKLVGFPFYFVWGRRFKNAICRYIVLITE

SEQ ID NO: 120265 - protein, 139 aa, Heterodera glycines
  Coding regions on vcDNA: vcDNA=SeqID_46688; Strand=-; Position=1 -111,161-351,415-532
  Homolog annotation: Hit_ID=AAK94490.1; Match level="QueryCoverage =64%, HitCoverage=8%, E-value=2e-16, Identity=47%"; Hit description =PAZ/Piwi domain protein [Heterodera glycines]
  Essential gene: C elegans homolog=M03D4.6; Phenotype=Ste
MVHDGTVVNLTPGSVINEKMVRPDIPEFFMQSHYPKKGTGKPVEYSVLVDEIGMTQDELQGFLNALCYSHQIISFAISLPEPIWQADELAKRGRNNYLTMKRFFPKDIPRLPNGVVDTKRLTEGLCYRNGRLSATRFTA

SEQ ID NO: 120266 - protein, 111 aa, Heterodera glycines
  Coding regions on vcDNA: vcDNA=SeqID_46689; Strand=-; Position=1 -109,170-396
  Homolog annotation: Hit_ID=CAE59075.1; Match level="QueryCoverage =98%, HitCoverage=19%, E-value=1e-23, Identity=48%"; Hit description =Hypothetical protein CBG02363 [Caenorhabditis briggsae]
  Essential gene: C elegans homolog=ZK622.3a; Phenotype=Lva,Unc
MYLADQEAVQFVANALQWLRPDGYLHLRESCSEPSTKKSADHSTTTTTTSTSSSSSSSLHNNSKPNPTRYRFSSAYIQLLRSLRHTDVQSGTQWRFDVQWACSVGVYIEVW

SEQ ID NO: 120267 - protein, 164 aa, Heterodera glycines
  Coding regions on vcDNA: vcDNA=SeqID_46690; Strand=-; Position=1 -195,3257-3409,4255-4308,4369-4461
  Homolog annotation: Hit_ID=AAK50003.1; Match level="QueryCoverage =31%, HitCoverage=24%, E-value=4e-17, Identity=81%"; Hit description =protein kinase Ck2-beta [Ciona intestinalis]
  Essential gene: C elegans homolog=T01G9.6a; Phenotype=Gro,Unc
MPTYSAMDSRRKNDGGNGAVTEVKEYNAKWADEYGIGQDRLPKNVAKTGEEEEDKADEEKLVVITVDEEYIQDRFNLTGLSEQVPHFRQALDMILDLEPDDDYEEGQSDLVEQAAEYYQSQSPVSGVQGTSQQQAVTPQQTTQSVAQTQLLNNGGRQSMDAFDD

SEQ ID NO: 120268 - protein, 142 aa, Heterodera glycines
  Coding regions on vcDNA: vcDNA=SeqID_46691; Strand=-; Position=1 -42,267-380,433-528,765-938
  Homolog annotation: Hit_ID=NP_495729.1; Match level="QueryCoverage =94%, HitCoverage=12%, E-value=7e-17, Identity=34%"; Hit description =initiation factor (129.3 kD) (2I511) [Caenorhabditis elegans] emb|CAA90261.1| Hypothetical protein M110.4
  Essential gene: C elegans homolog=M110.4a; Phenotype=Lva
MNAPERNDEEVKYEKLCKEMRGLLNKVTPSTYKDLSEEFIKYKIHEDPKLLEMIIDLIFDKAVEEPHFCPLYSDLCKKQVEEEKKCQKTFTVSNHFDDKIAELRKKIDDLEEGDEKGRAQVEEEIEGRRSKEKRRLLGIISW

SEQ ID NO: 120269 - protein, 94 aa, Heterodera glycines
  Coding regions on vcDNA: vcDNA=SeqID_46692; Strand=+; Position=1 -107,166-231,749-935
  Homolog annotation: Hit_ID=NP_499523.1; Match level="QueryCoverage =94%, HitCoverage=33%, E-value=6e-10, Identity=39%"; Hit description =mitochondrial membrane (3M869) [Caenorhabditis elegans] pir||T19428 hypothetical protein C24H11.6 - Caeno
  Essential gene: C elegans homolog=C24H11.9; Phenotype=Gro
ELKNEPNCRLFAQQIARTAKDIEILIDSLPADEQSLSVEEHEKALLELDDERARAAKELEQAVEKAEKLTDQLGELLSRIARLQMESRPMAFST

SEQ ID NO: 120270 - protein, 222 aa, Heterodera glycines
  Coding regions on vcDNA: vcDNA=SeqID_46693; Strand=-; Position=1 -28,266-466,630-883,1127-1313
  Homolog annotation: Hit_ID=CAE72955.1; Match level="QueryCoverage =96%, HitCoverage=30%, E-value=1e-62, Identity=55%"; Hit description =Hypothetical protein CBG20288 [Caenorhabditis briggsae]
  Essential gene: C elegans homolog=F56F4.5; Phenotype=Him
GRFRVILGSLVYVFGHVLLSVGAIPVLDSLVRKTLDYSGLAVIALATGGIKPCVSAFAADQFGDDQQRQRTQFFSFFYFAINAGSLLAMGITPRLRTVQCLGADHCFPLAFAIPGLLMLVAFLTFLFGWRNYKITPANKGNILWKVVRCIFFALRRKIRNRSHRRSPDHWLDYARPKYDEHLIAGVKSMLAIIVLYIPIVFFWALYDQQVGKAVLTLFMTLS

SEQ ID NO: 120271 - protein, 59 aa, Heterodera glycines
  Coding regions on vcDNA: vcDNA=SeqID_46694; Strand=-; Position=1-177
  Homolog annotation: Hit_ID=CAE65730.1; Match level="QueryCoverage =98%, HitCoverage=23%, E-value=1e-19, Identity=81%"; Hit description =Hypothetical protein CBG10813 [Caenorhabditis briggsae]
  Essential gene: C elegans homolog=Y110A7A.14; Phenotype=Emb
MARRYDTRTTIFSPEGRLYQVEYAMEAIGQAGTCLGIRAPDGIFIAAQKLTANKLLDDR

SEQ ID NO: 120272 - protein, 361 aa, Heterodera glycines
  misc_feature (22)..(22): Xaa can be any naturally occurring amino acid
  misc_feature (356)..(356): Xaa can be any naturally occurring amino acid
  Coding regions on vcDNA: vcDNA=SeqID_46695; Strand=-; Position=1 -145,199-355,396-592,634-807,864-1111
  Homolog annotation: Hit_ID=CAE70156.1; Match level="QueryCoverage =97%, HitCoverage=75%, E-value=1e-108, Identity=64%"; Hit description= Hypothetical protein CBG16623 [Caenorhabditis briggsae]
  Essential gene: C elegans homolog=R151.2d; Phenotype=Emb
AKALKKFSNKVGLETESYRHKXLLLKETNVEIIESVRGEDVYIIQSGCGEINDCGEINDHLMELLIMISACKIASACRVTAVIPCFPYARQDKKDKSRAPITAKLVANMLSISGADHIITMDLHAVANMLSISGADHIITMDLHASQIQGFFDIPVDNLYAEPAILKYIRETIPHWQESVIVSPDAGGAKRVTSIADRLNAAFALIHKERNNAGGAKRVTSIADRLNAAFALIHKERNNPNEVEKMTLVGNVQDKVAILVDDMADTCGTIVLAAEKLFEALFEAGARKIYAICVHGIFSGPAIDRLNKSRFEAVVVTNTIPQEENMKRCNKIQVFLAGHGLLKSIANLPMVSHLFXKKYFL

SEQ ID NO: 120273 - protein, 274 aa, Heterodera glycines
  Coding regions on vcDNA: vcDNA=SeqID_46696; Strand=+; Position=1 -505,555-685,735-923
  Homolog annotation: Hit_ID=CAE71922.1; Match level="QueryCoverage =77%, HitCoverage=47%, E-value=4e-25, Identity=32%"; Hit description =Hypothetical protein CBG18985 [Caenorhabditis briggsae]
  Essential gene: C elegans homolog=T10H9.3; Phenotype=Lva,Unc
MYGARIEQTQKEEEEKALKLVRMLEELKENEKCQWRKEETREEDKENVMLKKGPRKTAVVDGWEEAQIEEEELIEKSTERKVPSDGWEEAQFDDEQMHLKRNEQHSNSVDGWEETEIWTDEANEERFKSKDVFEEAQTKEEIVIKVKERLKPLDVWENGKSEEREQSKAEQSQLLEENRKLFERFTTTNAELSRIETQMSEIQRLQGIFAEKISEQEQEIDVIHSRTVYTLDNLETANEFIREAIKNQANRRVILIFCLLVLTFTLIFLDWYNP

SEQ ID NO: 120274 - protein, 169 aa, Heterodera glycines
  Coding regions on vcDNA: vcDNA=SeqID_46697; Strand=+; Position=1 -54,100-287,350-615
  Homolog annotation: Hit_ID=NP_491527.1; Match level="QueryCoverage =52%, HitCoverage=17%, E-value=5e-19, Identity=53%"; Hit description =prp31 (55.6 kD) (1F697) [Caenorhabditis elegans] gb|AAF60425.1| Hypothetical protein Y110A7A.8 [Caenorhab
  Essential gene: C elegans homolog=Y110A7A.8; Phenotype=Emb
VVSVTASTSQGKPLEQNELDVIIEACSMAEELYDLRMKMHLFVELRMALIAPNLCRIVGAGTAAMLISQAGGLVPLAKMPAKTEEDFGRLQLLRDPSQHRLHLPPPNRPNSAARPSQKSGAIGRCKMHIGFPSGFNSFFVGRTNWGAIVSRNQREIGKNARATAGQKCQ

SEQ ID NO: 120275 - protein, 189 aa, Heterodera glycines
  Coding regions on vcDNA: vcDNA=SeqID_46698; Strand=-; Position=1 -250,483-607,688-789,840-926
  Homolog annotation: Hit_ID=NP_571789.2; Match level="QueryCoverage =93%, HitCoverage=38%, E-value=6e-48, Identity=56%"; Hit description =C-terminal binding protein 1 [Danio rerio] gb|AAH45280.1| C-terminal binding protein 1 [Danio rerio]
  Essential gene: C elegans homolog=C31C9.2; Phenotype=Emb
PAFALDFLLSYPSLSNRMKLKICFIFPFFQIPRKVLNEATAALLYHSISLGREDLVKFKALKVVVRIGSGVHNVDMQAATDLGIAICHSPAECVEETADSTMSLILNMFRRTFWAARTVQAGKQPGSVEQLRDLMSGSARINGSVLGLIGLGRVGTAVALRALRKAFGFRVLFYDPHLPNGTSYIINSN

SEQ ID NO: 120276 - protein, 268 aa, Heterodera glycines
  Coding regions on vcDNA: vcDNA=SeqID_46699; Strand=+; Position=1 -155,469-801,845-1084
  Homolog annotation: Hit_ID=AAQ89579.1; Match level="QueryCoverage =100%, HitCoverage=36%, E-value=1e-127, Identity=88%"; Hit description=heat shock protein 70-C [Heterodera glycines] gb|AAM93256.1| heat shock protein 70-C [Heterodera glycine
  Essential gene: C elegans homolog=C15H9.6; Phenotype=Dpy,Lva
IVPSDVNPLTTGIETVGGVMTKPITRNTVIPTKKSQIFSTAADNQPTVTIQVFEGERPMTKDNHLLGKFDLTGIPPAPRGVPQIEVTFEIDVNGILHVTAEDKGTGNKNKITITNDHNRLSPEEIERMINDAEKFAEEDKKTKEVVEARNEFESYAYSLKNQLGDSEKLGGKLSAEDKTTIEGAVKNQLGDSEKLGGKLSAEDKTTIEGAVDEAISWLDSNKDAPPEELKERKKDLEAKVQPIISKLYAGQSPPPGSETPPTEEKDEL

SEQ ID NO: 120277 - protein, 144 aa, Heterodera glycines
  Coding regions on vcDNA: vcDNA=SeqID_46700; Strand=-; Position=1 -91,178-353,427-594
  Homolog annotation: Hit_ID=AAH46078.1; Match level="QueryCoverage =72%, HitCoverage=73%, E-value=7e-12, Identity=36%"; Hit description =Similar to H2A histone family, member X [Danio rerio] ref|NP _957367.1| similar to H2A histone family, memb
  Essential gene: C elegans homolog=T23D8.6; Phenotype=Emb
MDKGKADIGQSKGMGQPMDNETMQNWRDSGGPYAKRLANGVPVYMTAVLEHITGELLKKIGEITQAEGMKRLSAFHIRTAARDNDELRKLFSGVSLAEVCVLPELESDVEQSSEGSGESDSDEESTEGSASGSQEGGGAAAAQQ

SEQ ID NO: 120278 - protein, 302 aa, Heterodera glycines
  Coding regions on vcDNA: vcDNA=SeqID_46701; Strand=-; Position=1 -320,577-840,1524-1664,2129-2262,2422-2471
  Homolog annotation: Hit_ID=NP_510479.1; Match level="QueryCoverage =31%, HitCoverage=6%, E-value=1e-25, Identity=56%"; Hit description =multidrug Resistance Protein (158.6 kD) (mrp-5) [Caenorhabditis elegans] emb|CAB54250.1| Hypothetical prot
  Essential gene: C elegans homolog=F14F4.3a; Phenotype=Bli,Gro,Slu
MKNLKNLLFSPREYIRAGGGPLLCSLVIAAFILNVGANIFGTVWLKNWMVRLKNLFYLLTVIKKKKLQNLIMSHISVPHTAITVPLMELVGVWPTVHPFTSTFMVGGFHFACVVYQRTAQGIGVCQGVKFHKKKSLNKMILVFYSYKICPIVYAYCRHTVAQSDVAPCTVRHCRLFPPYTVRAHFEPVQQRHGRNLKRVENVTRSPVFEHLTTSLDALPTIHAFGQTQRFVEQLKQHLDENSGALFLYHSAMRWQAVWLDLLVVGLTFFVSLFIVLLTGRIDPAEADLLNVIKLLRQFDDAN

SEQ ID NO: 120279 - protein, 122 aa, Heterodera glycines
  Coding regions on vcDNA: vcDNA=SeqID_46702; Strand=+; Position=1 -45,220-543
  Homolog annotation: Hit_ID=NP_507243.2; Match level="QueryCoverage =97%, HitCoverage=22%, E-value=3e-19, Identity=38%"; Hit description =predicted CDS, CTP synthase (5R277) [Caenorhabditis elegans] emb|CAD21649.1| Hypothetical protein W06H3.3
  Essential gene: C elegans homolog=W06H3.3; Phenotype=Emb,Lva,Unc
LGGTIGDIEGMPYTMSGEIKTKPAQNGLRSLRETGLYPDLLLCRSQKPLTQALRSKIASFAQLDINEIIDVYDCHDIHSVPLLLLQQQMKELLISQLQLPDMRTKEDFSAFYRWQQLSEKQV

SEQ ID NO: 120280 - protein, 174 aa, Heterodera glycines
  Coding regions on vcDNA: vcDNA=SeqID_46703; Strand=-; Position=1 -135,181-491,690-766
  Homolog annotation: Hit_ID=NP_501440.1; Match level="QueryCoverage =100%, HitCoverage=90%, E-value=8e-80, Identity=55%"; Hit description= ADP ATP carrier protein family member (4J224) [Caenorhabditis elegans] gb|AAB38001.1| Hypothetical prote
  Essential gene: C elegans homolog=T27E9.1a; Phenotype=Emb
VDKEKQFLKFFAMNLASGGAAGATSLCFVYPLDFARTRLAADVGKADAREFKGLADCIMKILKSDGPIGLYRGFFVSVQGIIIYRAAYFGCFDTAKMLFSPEGKQMNFFVNWAIAQVVTVSSGVLSYPWDTVRRRMMMQSGRKDIMYKNTLDCAIKIIKKEGLFTGMYKGALSN

SEQ ID NO: 120281 - protein, 333 aa, Heterodera glycines
  Coding regions on vcDNA: vcDNA=SeqID_46704; Strand=-; Position=1 -192,279-603,663-901,945-1190
  Homolog annotation: Hit_ID=CAE62968.1; Match level="QueryCoverage =90%, HitCoverage=38%, E-value=5e-68, Identity=45%"; Hit description =Hypothetical protein CBG07185 [Caenorhabditis briggsae]
  Essential gene: C elegans homolog=Y51H7C.6a; Phenotype=Unclassified
MDDLTTTELKWRPAERANDDSLPLKPLTDIERQMNEIRTELFMARQEEEAIISRIKDEFRQTQKRLFDQSVARINAEFERVGSNARQLANSLDSVSALAQNISCRVVALDLGKSRVVECLQRVNDLKDLGTCAFGVQEALRAEKYEEAAQHIHRFLTLDTAVFKMGDHRESKDAGYSVKNSYEILRNATSELKRIIEQRFDEAQSSGDVASMERFFKLFPLINEHNSGLQRFGTHLCGQIEALGDQNFRIMQAGGTDDKRKNVLYADTLTMLFEGVARIIELHQPIIENFYGPEKLLLLIELIQPECDKQCVRVLNTFIQRRHFEEKAQQVFF

SEQ ID NO: 120282 - protein, 226 aa, Heterodera glycines
  Coding regions on vcDNA: vcDNA=SeqID_46705; Strand=-; Position=1 -149,257-506,596-870
  Homolog annotation: Hit_ID=CAE74905.1; Match level="QueryCoverage =99%, HitCoverage=53%, E-value=3e-42, Identity=42%"; Hit description =Hypothetical protein CBG22774 [Caenorhabditis briggsae]
  Essential gene: C elegans homolog=F27C8.6; Phenotype=Emb
SAWLSWLFLFIFILLLLVALHRPLPARIADRRKIALFEFLMRLFNEYLGSLVEIAAGHSARNKLSRALSLLTFPVFPVGFSVGSSPPIGAVRDESIAGVPCRLYVPKGDKRRHNGAVVFIHGGGWCIGKPRYYDGAYYDGALLCLSWKVGIPIISIDYSLSPEAKFPTALLQCERVIAELNKVPFSTYGIDPTKIALMGDSAGANLCAVICQRYRRPRRDRRSGQG

SEQ ID NO: 120283 - protein, 665 aa, Heterodera glycines
  Coding regions on vcDNA: vcDNA=SeqID_46706; Strand=-; Position=1 -98,356-648,704-805,848-892,944-1070,1179-1226,1282-1445,1486 -1549,1594-1667,1725-1751,1798-1915,1968-1999,2059-2137,2196 -2276,2324-2404,2538-2671
  Homolog annotation: Hit_ID=NP_509748.2; Match level="QueryCoverage =99%, HitCoverage=83%, E-value=1e-163, Identity=51%"; Hit description= abnormal cell MIGration MIG-15, serine threonine protein kinase involved in cell migration and signal tr
  Essential gene: C elegans homolog=ZC504.4a; Phenotype=Unclassified
ERFQRFPDKPLPPTPTHCESAHFDNGNNNNNGTGYNGSTFGGDFPFLVQQRSPLRSDDFDSSSDESEGTGVEMDPITGGNGRPGTAKSLCPKSVATAHRQLRTHRRKSKSFRKSGGPSHFERRAKGGGLRNAEGLRNAEGRSEEQCQVRPKEREKSFIGYFAGGGTALSGTVNRPGRMPNPNQSGTVNRPGRMPNPNQVQVNVNVQVNVNPNSAASDGDAPEIRKYKKRFNGEILCAALWGVNLLIGTDTGLMLLDRSGQGKVYHLITRRRFDQYHLITRRRFDQMSVMEGQNILVTISGKKRRVRVYYLSWLKQKILRTEGVGRPKETEKRNGWTNVGEFQCATHFKIVPKETEKRNGWTNVGEFQCATHFKIVRYERIKFRYERIKFLVIGIEDSISIYAWAPKPYNKPYNKFMAFKSFGQLSHAPVIVDLTIEENSFGQLSHAPVIVDLTIEENARLKVLYGSLAGFHAIDLDSASIYDIYSPQQASIYDIYSPQQMCQGMCPHCIVIMCQGMCPHCIVILPNTNGMQLLLCYDNEGVYVNEGVYVNTYGKIVKNVQLQWSEIPSSVAYISTNQIMGWGNKAIEIRNVETGAYISTNQIMGWGNKAIEIRNVETGHLDGVFMHKKAQKLKFLCERNDKVFFSSAKGSSSQIYFMSLNKLNNW

SEQ ID NO: 120284 - protein, 313 aa, Heterodera glycines
  Coding regions on vcDNA: vcDNA=SeqID_46707; Strand=-; Position=1 -98,166-224,272-393,460-495,549-773,821-861,916-982,1027-1146
  Homolog annotation: Hit_ID=NP_508390.1; Match level="QueryCoverage =96%, HitCoverage=72%, E-value=1e-88, Identity=56%"; Hit description =dTDP-glucose (XC730) [Caenorhabditis elegans] gb|AAB52650.1| Hypothetical protein F53B1.4 [Caenorhabditis
  Essential gene: C elegans homolog=F53B1.4; Phenotype=Slu
IDTVIHFAAITHVDESYTDRIGTIQENVIATTTLLLLEAINFYGRVRRLVHISTDEVYGEVYGDSMDDTTPKCEDSPLNPTNPYAASKAACEVIVRSYHHHSYKLPYVMVRMNNVYGPRQAYSKNNVYGPRQAYSKLIPKFTRLALEGKPYPLMGDGMHSRSWMYVDDCAEAIRRITERGRIGQTYNIGTEFEKCNLHLTEMLQEKVQKLMDRLHLTEMLQEKVQKLMDRDPSQISFEPDPSQISFEPIADRPYHDRRYYINFTKIREELGWENFTKIREELGWECTVPFAQGLADTLDYYVKEYRKTHNAML

SEQ ID NO: 120285 - protein, 245 aa, Heterodera glycines
  misc_feature (245)..(245): Xaa can be any naturally occurring amino acid
  Coding regions on vcDNA: vcDNA=SeqID_46708; Strand=-; Position=1-762
  Homolog annotation: Hit_ID=NP_509377.1; Match level="QueryCoverage =99%, HitCoverage=47%, E-value=5e-35, Identity=35%"; Hit description =predicted CDS, reverse transcriptase like family member (XI784) [Caenorhabditis elegans] gb|AAB37984.1| H
  Essential gene: C elegans homolog=ZK250.3; Phenotype=Clr,Lvl,Sck
FLIFINDLPSVITNEAASVGIKMYADDVKLYYAHENDDHSNQLDKAIEALEKWSKINGLEISTEKCFVLYLGKNNMKKEYFINSKKISESDNVRDLGIIIDSKLNFSEHISKIIRNAYLRSFQILRVLKSREIKTLTAAYKTFVRPQLEYATEVWNPNLKKDIDKIERVQKFFTRKAFRNVDVYKKYMERLKITDLHKLEERRKINDLTTPFKIIKGFTSLEAQEAFTFTSNTRPKLKIIFSIGX

SEQ ID NO: 120286 - protein, 163 aa, Heterodera glycines
  Coding regions on vcDNA: vcDNA=SeqID_46709; Strand=+; Position=1 -226,468-547,1103-1286
  Homolog annotation: Hit_ID=CAE73571.1; Match level="QueryCoverage =34%, HitCoverage=12%, E-value=2e-14, Identity=61%"; Hit description =Hypothetical protein CBG21042 [Caenorhabditis briggsae]
  Essential gene: C elegans homolog=Y55H10A.1; Phenotype=Ste
FQPFDAAYTAGGKEADRLKFGWKVNDCQGLFSIGTWMGLVVATLLIGVLFFGFLMLNSVQTMDRFDDPKQKQLIIMQGKGMCTAWHRRSSAFCGCSDGPLFEVERAGVSHIAVHARTVSQRSEPPDYAAVALLKQCLQVPIFANGGCKTFEDSLEISQATGAD

SEQ ID NO: 120287 - protein, 120 aa, Heterodera glycines
  Coding regions on vcDNA: vcDNA=SeqID_46710; Strand=-; Position=1 -167,217-343,388-559
  Homolog annotation: Hit_ID=NP_492247.1; Match level="QueryCoverage =97%, HitCoverage=17%, E-value=5e-20, Identity=41%"; Hit description =serpentine receptor Sre, putative G protein-coupled chemoreceptor (1I830) [Caenorhabditis elegans] emb|CA
  Essential gene: C elegans homolog=ZK265.5; Phenotype=Lva
FDISGHAFLLIYSILIICEESTSFQNWPSKPRVTIHHVPSRKEFELFQRNTKIIQWLFVSLMLLHLLWDLQLLITSLYYHEFWQKLIGASIGVFSWFVTYRFWFVVGFPFLPIRRHIKSF

SEQ ID NO: 120288 - protein, 128 aa, Heterodera glycines
  Coding regions on vcDNA: vcDNA=SeqID_46711; Strand=-; Position=1 -119,161-386,559-600
  Homolog annotation: Hit_ID=CAE66683.1; Match level="QueryCoverage =97%, HitCoverage=15%, E-value=1e-29, Identity=49%"; Hit description =Hypothetical protein CBG12022 [Caenorhabditis briggsae]
  Essential gene: C elegans homolog=H26D21.2; Phenotype=Mut
MMDCSTILECATEHSLILIDELGRGTSTYDGFGLAYAISEDIISRIGCFAMFATHFHEISRLQSKYPGKVKNYRMDTICENGELTILFRVVSGVADRSFGLNIAKVVGFADEIIKDAEVILNQLEAGE

SEQ ID NO: 120289 - protein, 152 aa, Heterodera glycines
  Coding regions on vcDNA: vcDNA=SeqID_46712; Strand=-; Position=1 -100,189-220,273-307,381-469,522-546,611-687
  Homolog annotation: Hit_ID=NP_502917.1; Match level="QueryCoverage =98%, HitCoverage=29%, E-value=5e-48, Identity=66%"; Hit description =glutamine synthetase (43.6 kD) (4Q934) [Caenorhabditis elegans] emb|CAB60321.1| Hypothetical protein Y105
  Essential gene: C elegans homolog=C28D4.3; Phenotype=Emb
HAWFGMEQEYTLLDVDQHPFGWPKAPFGFPGPQGPYYCGAPYYCGAGANKAYGRDIVDSHYRAYGRDIVDSHYRACACLYAGILISGTNAEVMPGQWEFQVGPCEGIQMGDQLWIQMGDQLWMARFLMARFLLHRVAEEDGVIVSFDPKPSQ

SEQ ID NO: 120290 - protein, 235 aa, Heterodera glycines
  Coding regions on vcDNA: vcDNA=SeqID_46713; Strand=-; Position=1 -60,577-745,1412-1455,2076-2212,2793-3087
  Homolog annotation: Hit_ID=AAH75402.1; Match level="QueryCoverage =87%, HitCoverage=78%, E-value=2e-31, Identity=45%"; Hit description =Protein phosphatase 2, regulatory subunit B, delta isoform [Xenopus tropicalis] ref|NP_001006697.1| protei
  Essential gene: C elegans homolog=F26E4.1; Phenotype=Egl,Emb,Rup,Unc
MDVPASSSATPPPFCGTAFEGVFLNGVRTSEYNVYSTFQSHEPEFDYLKSLEIEEKINQIKWMKKKNAANFIISTNDIVDIKPANMEELTEVWDLNMESRPVESYHVHDYLRSKLCTLYENDSIFDKFECCWSGDDRHVITGSYNNYFRTFKRNTSVESTYEASLDLCKPYRMGGYGGRPLLHHERMELAAAMASGGSSPGGNKKQQHGSSSTNMPPGKKRREEISADYLDFNKK

SEQ ID NO: 120291 - protein, 107 aa, Heterodera glycines
  Coding regions on vcDNA: vcDNA=SeqID_46714; Strand=+; Position=1 -210,289-401
  Homolog annotation: Hit_ID=NP_499915.1; Match level="QueryCoverage =100%, HitCoverage=32%, E-value=3e-36, Identity=64%"; Hit description= ribosomal Protein, Small subunit (rps-24) [Caenorhabditis elegans] gb|AAK39283.2| Ribosomal protein, sma
  Essential gene: C elegans homolog=T07A9.11; Phenotype=Lva
VVDILHPNRASVPKSEVRERLAKLYKTTQDVVVAYGFRCQFGGGRSTGFANVYDSLDYAKRFEAKYRLLRQGVGQKVEKGGRKQRKERKNRQKKVRGVKKVKVQAGK

SEQ ID NO: 120292 - protein, 200 aa, Heterodera glycines
  Coding regions on vcDNA: vcDNA=SeqID_46715; Strand=-; Position=1 -111,251-390,456-660,711-855
  Homolog annotation: Hit_ID=NP_495750.1; Match level="QueryCoverage =100%, HitCoverage=37%, E-value=2e-86, Identity=79%"; Hit description= chaperonin Containing TCP-1 (58.4 kD) (cct-4) [Caenorhabditis elegans] emb|CAA88861.1| Hypothetical prot
  Essential gene: C elegans homolog=K01C8.10; Phenotype=Emb,Lva,Ste
MKGALIDQKSMGHGGPARVEKAKIGLIQFQISPPKPNMENQVVISDYAQMDRALKEERNYILELCKQIKKAGCNVLLIQKSILRDAINEMALHFFAKMKIMVIKDIERDDIEFYAKILGCRPVASVDHFVPESLGTADLVEEIETADGKVLKVTGLKQSGCAVSILVRGSSKLVLDEAERSLHDALCVIRCLVKKRALLP

SEQ ID NO: 120293 - protein, 227 aa, Heterodera glycines
  misc_feature (19)..(19): Xaa can be any naturally occurring amino acid
  Coding regions on vcDNA: vcDNA=SeqID_46716; Strand=+; Position=1 -653,904-945
  Homolog annotation: Hit_ID=NP_510671.1; Match level="QueryCoverage =99%, HitCoverage=23%, E-value=2e-27, Identity=29%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
DDVKIYISHDNDTKSSVGXLSKWSKDNGIAIAHEKCAALYLGKNNSRHEYKIGEKVILSVDCVRDLGVLVDQKLSFNNHISKILKAAYFKAYQILKILKTRNINTLILAYKSYIRPHLEYASEIWNISSKEQSKRIEKVQKYFTRIVYKKCGLKAIPYEKRLEICKLEKLSTRRSLTDMNMTFKIIRGLTHLDPKKYFEFSTRSQRKTFRIQNCNYVALGFVQINKI

SEQ ID NO: 120294 - protein, 201 aa, Heterodera glycines
  Coding regions on vcDNA: vcDNA=SeqID_46717; Strand=+; Position=1 -34,108-325,367-450,490-674,768-793
  Homolog annotation: Hit_ID=CAE74521.1; Match level="QueryCoverage =97%, HitCoverage=36%, E-value=9e-46, Identity=49%"; Hit description =Hypothetical protein CBG22275 [Caenorhabditis briggsae]
  Essential gene: C elegans homolog=D1007.5a; Phenotype=Unclassified
VPAKKRSPKQHPNFKFSRLDVSASVDSSVAFSIHKTWPDLQLNQSHLFFECTLFLYSVLALFLQYLNLYRTLWWLPKSHWPNSLKYHLINPYILKYHLINPYILSCIGLLLGLRVTKCFWDTITDRISFFSITDRISFFSAGQDGWKFICWKVFENAIVKTPLTTVVLSSFLFSFTRIYFEFGIKSFLCFTCPFLLKLCNF

SEQ ID NO: 120295 - protein, 582 aa, Heterodera glycines
  Coding regions on vcDNA: vcDNA=SeqID_46718; Strand=-; Position=1 -61,113-249,306-452,499-550,592-675,775-805,850-885,964-1090,1203 -1271,1316-1376,1422-1461,1506-1550,1655-1777,1831-1984,2050-2153
  Homolog annotation: Hit_ID=NP_493174.1; Match level="QueryCoverage =93%, HitCoverage=95%, E-value=1e-143, Identity=53%"; Hit description= UNCoordinated locomotion UNC-101, adaptor (48.2 kD) (unc-101) [Caenorhabditis elegans] emb|CAB05557.3| H
  Essential gene: C elegans homolog=K11D2.3; Phenotype=Unc
RKSFSFFVFSLFVLISRNYRGDVDTVVIEKFVPLLVDLEEEYRGDVDTVVIEKFVPLLVDLEEEGQLAPVVDVESGTHMIWIRFNNIYVVAVSRCNTNVSLVQTFLVAVSRCNTNVSLVQTFLYKLVAVFAEYFKDVEEESIRDNFVIIYELLDEMMDFGYPQITEGMMDFGYPQITEGRILREYITQEGHKLEAAQQPRPPMAVTRILREYITQEGHKLEAAQQPRPPMAVTNAVSWREGVRHRKNEVFLDVIESLNLLVFLDVIESLNLLASGAGTVLQSEIVGSVKMRVFLTGMPELRLGLNDKVFLLIQFRGRIKAVELKDIKFHQCVRLSRFENDRTISFIPPDGEFELMSYRLSRFENDRTISFIPPDGEFELMSYRLSTIVLSTIVKPLIWVEAVIEKFSHSRVEYMVKVIEKFSHSRVEYMVKAKSQFKRRSTANNVEIVVPAPSYSDSPRFKTAIGNCRYQPEDNSFVWNIKDNSFVWNIKNFPGGKEYLMRAHFKLPSVLSEEVEAKRPIKVRFEIPYFTTSGIQVRYLKIIEKSGYQIQVRYLKIIEKSGYQALPWVRYITQSGDYSLRLN

SEQ ID NO: 120296 - protein, 198 aa, Heterodera glycines
  Coding regions on vcDNA: vcDNA=SeqID_46719; Strand=+; Position=1 -30,129-331,405-550,597-814
  Homolog annotation: Hit_ID=CAE75035.1; Match level="QueryCoverage =98%, HitCoverage=25%, E-value=4e-78, Identity=72%"; Hit description =Hypothetical protein CBG22943 [Caenorhabditis briggsae]
  Essential gene: C elegans homolog=F54H12.1a; Phenotype=Emb
MSRAASIARQASKHGLKVKSIFTVTPGSEQVRATIARDGFIKDFENIGGVVLANACGPCIGQWDRKDVKKGEKNTIVSSYNRNFTGRNDANPATHAFVTSPELTIALALAGTLDFDPRHDTLTGSDGKKFKLEEPKGECLPAKGFDPGEDLYQPARFQGDVVVDPKSDRLQLLEPFDAWDGKDLTDMVILIKVMGQGV

SEQ ID NO: 120297 - protein, 222 aa, Heterodera glycines
  Coding regions on vcDNA: vcDNA=SeqID_46720; Strand=+; Position=1 -111,170-411,467-755
  Homolog annotation: Hit_ID=CAE72510.1; Match level="QueryCoverage =99%, HitCoverage=65%, E-value=4e-69, Identity=61%"; Hit description =Hypothetical protein CBG19689 [Caenorhabditis briggsae]
  Essential gene: C elegans homolog=C16A3.6; Phenotype=Emb
TKAKKFCRNEFNLTGLCNRASCPLANSQYATVREENGVCFVCFLFMKVAERSHFPGKLWEKVKLHRNLAKAVEQISTHLLHWSEYVRKKCKARLMRHHQCLNRMRKMELRGRTAKVIPLQRKIERRKIERRERRREEKALAAAKLDNAIERELLQRLKKGTYGSMYKFSDKTIDKAMERVDESEQSEEEEVEYETETTREKQRQFVEDFDESEEGEDIEDYS

SEQ ID NO: 120298 - protein, 222 aa, Heterodera glycines
  Coding regions on vcDNA: vcDNA=SeqID_46721; Strand=-; Position=1 -186,237-428,548-838
  Homolog annotation: Hit_ID=NP_501793.1; Match level="QueryCoverage =89%, HitCoverage=41%, E-value=6e-28, Identity=36%"; Hit description =SH2 motif and protein kinase family member (kin-5) [Caenorhabditis elegans] emb|CAA93289.1| Hypothetical
  Essential gene: C elegans homolog=T04B2.2; Phenotype=Unclassified
MTEETSGTERVFALSVNVGGLVNHVIFRRHNGMYTLDNCDKGFRTIERFVDHYLRTGASVTTKQHVALIRAVPRAHWELSHTSIILNNELGRGTFGIVKSGVYVDQQGTRATVAIKEVSQTSTKEQFYGVAVGQEPLMIVMELASDGSLTNYLKQQRRSARVKLYMCLGAAGGLDHIHSKGIIHCDVAARNCLYTNGVVGEKHQKKIFFVMKLLNLFIFPHR

SEQ ID NO: 120299 - protein, 242 aa, Heterodera glycines
  misc_feature (30)..(30): Xaa can be any naturally occurring amino acid
  Coding regions on vcDNA: vcDNA=SeqID_46722; Strand=-; Position=1 -258,304-420,489-615,871-1015
  Homolog annotation: Hit_ID=NP_510425.1; Match level="QueryCoverage =87%, HitCoverage=24%, E-value=2e-36, Identity=42%"; Hit description =insulin-like growth factor binding protein acid labile family member, SYnthetic lethal with Mec SYM-5 (sy
  Essential gene: C elegans homolog=C44H4.2; Phenotype=Gro,Prz,Unc
LRSSQAHLGLLKVHSFFFVVFTFYLLLLLXVLTIHSTPIKTLSNNFFAGLYIRRLELINCEIELLEKGAFGGLENVLQELAINGNRIKEMIPETIAGFHSLVRLDLSNNSRIKEMIPETIAGFHSLVRLDLSNNSIEELKVEHSLPRLPKLTLTDIDLSYNRISAVHKTFFDGVKGTVQTINLGHNVIEEVPASAIRGFRMLMALHLHNNLLNGILPALSFMNLPVLSLLNLAGNQLSAMHR

SEQ ID NO: 120300 - protein, 159 aa, Heterodera glycines
  Coding regions on vcDNA: vcDNA=SeqID_46723; Strand=-; Position=1-479
  Homolog annotation: Hit_ID=NP_508605.1; Match level="QueryCoverage =99%, HitCoverage=58%, E-value=5e-25, Identity=37%"; Hit description =predicted CDS, RNA-directed DNA polymerase family member (XE132) [Caenorhabditis elegans] gb|AAA96082.1|
  Essential gene: C elegans homolog=ZK250.3; Phenotype=Clr,Lvl,Sck
EISTEKCFVLYLGKNNKKKEYYINSKKISESESVRDLGIIIDSKLNFSEHISKIIRNAYLRSFQILRVLKSREIKTLTAAYKTFVRPQLEYDTEVWNPNLKKDIDKIERVQKFFTRKVFRKCGFVYKKYVERLKIAGLHKLEERRKINDLTTAFKIIKG

SEQ ID NO: 120301 - protein, 473 aa, Heterodera glycines
  Coding regions on vcDNA: vcDNA=SeqID_46724; Strand=+; Position=1 -126,390-533,597-707,795-986,1048-1280,1338-1493,1599-1762,1819 -1878,1943-2177
  Homolog annotation: Hit_ID=CAE75373.1; Match level="QueryCoverage =99%, HitCoverage=45%, E-value=1e-171, Identity=63%"; Hit description= Hypothetical protein CBG23360 [Caenorhabditis briggsae]
  Essential gene: C elegans homolog=F10C2.4; Phenotype=Emb
MVKVEGQREEFVRNCFVVGGCESVVGSDIVECRDEKELLEASIDKTVCLLSRIRGSMCRQRDAAMQSKQMGNRVNKFVSMDGRIIFDVLQLVLREYKLRSYTLNNVSYFFLGEQKEDVSYTFIPQLQNGSNMDRRRLALYCMKDAFLPLRLLDKLMLVINYIEMARVTGCPLNFLVSRGQQVKILSMLLRKTREHFLFLPVVEMGEGAGGDEVGYEGATVIEPLRAFYKDPIATLDFASLYPSIMIAHNLCYTTLLPKGAVAKKAIPSDWREGEDYIVTPSGDMFVKATHRQGLLPKVLEELLSARKRAKAELKKEKDPFRQMVLNGRQLALKISANSVYGFTGASRGKLPCLEISQSVTAFGRQMIEATKQMVEESYIAGAVDGLCPANAKVIYGDTDSVMVKFGVKSVGEAMELGRHAAREISRRFPPPIQLEFEKVYFPYLLINKKRYAGLYWTNEERHDKMDCKGVMEE

SEQ ID NO: 120302 - protein, 180 aa, Heterodera glycines
  misc_feature (175)..(175): Xaa can be any naturally occurring amino acid
  Coding regions on vcDNA: vcDNA=SeqID_46725; Strand=-; Position=1 -93,138-239,365-479,658-812
  Homolog annotation: Hit_ID=AAC26138.1; Match level="QueryCoverage =88%, HitCoverage=85%, E-value=2e-67, Identity=81%"; Hit description =cleavage stimulation factor [Heterodera glycines]
  Essential gene: C elegans homolog=F28C6.3; Phenotype=Emb,Lva
ESVLLSGSNDFTLKMFDYSKTAVKRAMKTITEVEPITAVSFHPSGEFFLCATRHPITEVEPITAVSFHPSGEFFLCATRHPTLRLYSAETQQCFVSPIPKDQHSDSITDVCYSENARMFVTGSRDGNVKVWDGVSNRCIETFTRAHDGAPICSAQFTRNGKVLLHYAIFPEINYXSVIAV

SEQ ID NO: 120303 - protein, 170 aa, Heterodera glycines
  Coding regions on vcDNA: vcDNA=SeqID_46726; Strand=+; Position=1 -130,187-296,349-471,573-645
  Homolog annotation: Hit_ID=NP_740880.1; Match level="QueryCoverage =99%, HitCoverage=44%, E-value=2e-48, Identity=58%"; Hit description =quaking related 5 (33.2 kD) (1H379C) [Caenorhabditis elegans] gb|AAM81088.1| Hypothetical protein E02D9.1
  Essential gene: C elegans homolog=E02D9.1b; Phenotype=Gro,Pvl,Unc
DIPSPLDAEIQIVLREIQSEVHQLENSGEYGEQLKNARRLLATEATKLENNIDPEWLEVDINKATKLENNIDPEWLEVDINKPIKVSKKVLIPSFRHPKFNFVGKFNFVGKVLGPKGTTLQNIAKSYKCHVYILGRGSTRDRTKEQEMLSSGDPQYAHYGGPLHVKVETT

SEQ ID NO: 120304 - protein, 298 aa, Heterodera glycines
  misc_feature (14)..(14): Xaa can be any naturally occurring amino acid
  Coding regions on vcDNA: vcDNA=SeqID_46727; Strand=-; Position=1 -43,88-208,315-484,543-637,680-803,853-960
  Homolog annotation: Hit_ID=NP_499913.1; Match level="QueryCoverage =88%, HitCoverage=37%, E-value=7e-47, Identity=42%"; Hit description =sphingosine-1-phosphate lyase (61.1 kD) (4B134) [Caenorhabditis elegans] gb|AAC69001.1| Sphingosine phosp
  Essential gene: C elegans homolog=Y66H1B.4; Phenotype=Gro
PFLGVTSISCDTHXYGYAPKGTSVILYRSHDLLYGYAPKGTSVILYRSHDLLHQQYFCSTEWPGGLYATPTLSGSRSRPGLNIALTWATLQHFGEKEYARRAHLILQKTTQLADAVAKVPGICLVGTPEVSVVAFSSHRVAFSSHRFNIHALGDCLSKMGWNLNFLQKPDALHFCITYNQTADGVLNAFLVDQKPDALHFCITYNQTADGVLNAFLVDLKKACEEVAALPDRGANSKTAAIYGMAAKIPDKGLVEEVAHLYIAAIYGMAAKIPDKGLVEEVAHLYIDACYSMPSFTSS

SEQ ID NO: 120305 - protein, 221 aa, Heterodera glycines
  misc_feature (12)..(12): Xaa can be any naturally occurring amino acid
  misc_feature (171)..(171): Xaa can be any naturally occurring amino acid
  Coding regions on vcDNA: vcDNA=SeqID_46728; Strand=+; Position=1 -179,287-361,443-528,930-1199,1270-1313
  Homolog annotation: Hit_ID=NP_494704.1; Match level="QueryCoverage =95%, HitCoverage=98%, E-value=6e-55, Identity=49%"; Hit description =abnormal cell LINeage LIN-31, forkhead box B1.1 (26.9 kD) (lin-31) [Caenorhabditis elegans] gb|AAB66096.1
  Essential gene: C elegans homolog=K10G6.1; Phenotype=Muv
ISRPISGSFAYXKPPFSYIWLTYMAIQNSEDKMLPLTDIYNFIMNRFPFYRQNTRRWQNSLRHNLSFNDCFIKVPRRSDKPGKGSCGSCWAIHPKAIKMFENGSCLRRQKRFKVRAPSLPRPPIALPFPLALCPPIPSLLPLFALFPPPPAVSDSPLLLNLALLFHLRRCXAPSRSSPTVGPFPAVPKGPSSASPSPSSDSSSSSTFSSSSTFSITSLLAQ

SEQ ID NO: 120306 - protein, 119 aa, Heterodera glycines
  misc_feature (105)..(106): Xaa can be any naturally occurring amino acid
  Coding regions on vcDNA: vcDNA=SeqID_46729; Strand=-; Position=1 -108,280-323,546-635,781-839,999-1060
  Homolog annotation: Hit_ID=CAE64966.1; Match level="QueryCoverage =86%, HitCoverage=21%, E-value=6e-35, Identity=66%"; Hit description =Hypothetical protein CBG09800 [Caenorhabditis briggsae]
  Essential gene: C elegans homolog=T20G5.6; Phenotype=Egl,Unc
NCLPGMFIVGLPFAVKIGGWCAILALTGVAWICYRTGLILIECLYEDCPTEKFSYREVAEAVRPGLGKFVLIAQLTELASTCILYIVLAGDLLQGCFPSVDKPDXXCPVKTKGENCSPE

SEQ ID NO: 120307 - protein, 123 aa, Heterodera glycines
  Coding regions on vcDNA: vcDNA=SeqID_46730; Strand=-; Position=1 -48,545-674,728-824,893-951
  Homolog annotation: Hit_ID=CAE69824.1; Match level="QueryCoverage =100%, HitCoverage=25%, E-value=1e-29, Identity=52%"; Hit description= Hypothetical protein CBG16145 [Caenorhabditis briggsae]
  Essential gene: C elegans homolog=C23F12.2; Phenotype=Unc
GLNEPCSVNSLVEVVVGGSSGVAPGEVSIFATSPAGLKQKCEVIRRENAFTSTFTPDRIGNWLIGILYEGEHNWLIGILYEGEHIKGSPFPCQVFDASLVNVYGLDVGLIGQELTFTVDASRA

SEQ ID NO: 120308 - protein, 790 aa, Heterodera glycines
  misc_feature (186)..(186): Xaa can be any naturally occurring amino acid
  misc_feature (423)..(423): Xaa can be any naturally occurring amino acid
  misc_feature (438)..(438): Xaa can be any naturally occurring amino acid
  Coding regions on vcDNA: vcDNA=SeqID_46731; Strand=+; Position=1 -193,237-320,375-527,765-985,1033-1105,1150-1227,1279-1324,1371 -1471,1520-1927,2222-2394,2848-3012,3055-3338
  Homolog annotation: Hit_ID=CAE59607.1; Match level="QueryCoverage =96%, HitCoverage=64%, E-value=2e-82, Identity=28%"; Hit description =Hypothetical protein CBG03015 [Caenorhabditis briggsae]
  Essential gene: C elegans homolog=R06F6.2; Phenotype=Emb,Gro,Sma
ADPRQDRFISPKWVQLRESTNPAKDGQLAGVVIGEVNFTLVSCITDKTVHSYILNSEGNLLKTIVHDVKGCERKCWHYSKTTNQLIVATIVHDVKGCERKCWHYSKTTNQLIVASREMVYFYDINDCLEMGGENGMVYFYDINDCLEMGGENGRCHALGRGSEKVQLLEKDGQIALVTEQETQIQXRSDNNKMNVLYLFDIESRYISFFCSMPSPCHIFTLGGEIYLRNSEGVLSKLVEESVETKLDILLKKNLFDLAISIARRGKSEELLKSIFMKIARRGKSEELLKSIFMKYGDYLYKKGDFDNSIKQYTNTFGFVEKGDFDNSIKQYTNTFGFVEPSNVIKKFLGGARISQLCQYLEAFLGGARISQLCQYLEALHANLHANNLATGHHTTLLISAYVKLHNVRKLEEWLKKAPKSKRXKAKEYIFKAPKSKRXKAKEYIFKLLRSAELFHLASKLAAKSDRPFTFLDILCQDTREWGKAVKFISERPLSVSCELLETYGPILLEHVEEQTLALIGRLIWSEGEKVLNPVLWIKFVSKSEGWWVLMGTFLCSQSTFFQCNFLHLDAILPNGHFHSEPFEGTVAELVSLVDSASPHHSLLLAYQYNCSPLVIHILRLLNRIEELFRYLLTEGDVVAAIELCEGKSLEDMWVELISFGTKSKSATKKEDLIALLRKISESDSLNPLIVLEILSRISESDSLNPLIVLEILSRDESLQVGDIREFIIGWLERQNESLKDNEHRIAEQERQLQKMSKEIADLENKLLFGVKGGRERKGCQFSMTIRHRRC

SEQ ID NO: 120309 - protein, 66 aa, Heterodera glycines
  Coding regions on vcDNA: vcDNA=SeqID_46732; Strand=+; Position=1-9,63- 254
  Homolog annotation: Hit_ID=CAE73689.1; Match level="QueryCoverage =84%, HitCoverage=74%, E-value=4e-09, Identity=48%"; Hit description =Hypothetical protein CBG21200 [Caenorhabditis briggsae]
  Essential gene: C elegans homolog=T27E9.2; Phenotype=Gro
MPKEEVPEGVDQLTYFREQCEHKVAHLKSILEECNERVRSKPKTTEICHMVRFKYYHYKKNRLATF

SEQ ID NO: 120310 - protein, 238 aa, Heterodera glycines
  Coding regions on vcDNA: vcDNA=SeqID_46733; Strand=-; Position=1 -300,357-494,643-850,896-966
  Homolog annotation: Hit_ID=CAE56899.1; Match level="QueryCoverage =98%, HitCoverage=60%, E-value=2e-77, Identity=58%"; Hit description =Hypothetical protein CBG24740 [Caenorhabditis briggsae]
  Essential gene: C elegans homolog=T02G5.7; Phenotype=Bmd,Unc
MLGQPMGVCAEKTVAEFGFTREQQDAYALASYARATRAWAGGAFGAEIVPVKVKQRKGTELMVAEDEEYRRLMPDKVPSLQPAFVKDGTGTITAANASSLNDGAASLVIASGQVEGAKPLAKVIAYAEAGRAPVDFTVAPVDAVKTLLQSVNISIDQIARWEVNEAFSVTALAFIRQLDLDPARVNALGGAVALGHPIGCSGARIVVTLVHQLESGEFGIAAICNGGGEATAILVQRI

SEQ ID NO: 120311 - protein, 203 aa, Heterodera glycines
  Coding regions on vcDNA: vcDNA=SeqID_46734; Strand=-; Position=1 -25,213-250,304-417,468-674,840-949
  Homolog annotation: Hit_ID=NP_493035.1; Match level="QueryCoverage =98%, HitCoverage=17%, E-value=3e-37, Identity=41%"; Hit description =t-cell activation Rho GTPase-activating protein like (100.6 kD) (1M577) [Caenorhabditis elegans] emb|CAA2
  Essential gene: C elegans homolog=Y53C10A.4; Phenotype=Emb
AKRSSDESLFGRQLRGTMPPQPVLTMIDHLLLYGSEPVLTMIDHLLLYGSETEGIFRKSPKQQTVRILRQQLDQGQVPDFHQFNVHVTASLLKEYLDQGQVPDFHQFNVHVTASLLKEYLRCIPGQLLISGNYRLWMEANGDGLSDEQRICRCRKLLTMLPPAHTVLLRSVLRLLRRVAANEEHTKMGTNALAVCVAPSLLEK

SEQ ID NO: 120312 - protein, 265 aa, Heterodera glycines
  Coding regions on vcDNA: vcDNA=SeqID_46735; Strand=+; Position=1-798
  Homolog annotation: Hit_ID=NP_502969.1; Match level="QueryCoverage =90%, HitCoverage=67%, E-value=9e-30, Identity=33%"; Hit description =reverse transcriptase SjR1 family member (4R582) [Caenorhabditis elegans]
  Essential gene: C elegans homolog=ZK250.3; Phenotype=Clr,Lvl,Sck
MYADDVKLYYAHENDDKTNHLDKANEALEKWSKINGLEISNGKCVFLYLGKNNMKKDYLINSKKISESDNVRDLGIIIDSKLHFSEHINKIVRNAYLRVFQILRVLKTREIKTLTTAYKTFVRPQLEYATEVWNPNLKKDIDKIERVQKFFTRKAFRKCGFLYKKYKERLKITDLHKLEERRKINDLTTAFKIIKGFTSLDAEKSFFFSERPRRPLLLRVKRHTAKTQNNFFNRIVKSWNNLPVVAVQINKAKEFRGLLKAMSSE

SEQ ID NO: 120313 - protein, 325 aa, Heterodera glycines
  Coding regions on vcDNA: vcDNA=SeqID_46736; Strand=+; Position=1 -129,643-765,1007-1244,1615-2101
  Homolog annotation: Hit_ID=CAE69591.1; Match level="QueryCoverage =45%, HitCoverage=11%, E-value=2e-49, Identity=63%"; Hit description =Hypothetical protein CBG15813 [Caenorhabditis briggsae]
  Essential gene: C elegans homolog=ZK1151.1b; Phenotype=Bmd,Lva,Lvl,Unc
MQNQWDWILNLNKCLEGHLRDACNAKAFVEESEQVEQQMQKQLASFPSVVFGIPPPDPRLASFLSRLHNQFEKLRKLWDRTHHLVRYNMVLNTMRTVRAWDLDTFLCILSDQRDEIIKTLNEDVNKLLSEMDPNDPLAKRLKDELRMTNEHFYDLLARAQKEPEPDYSNQFDAACAELLCKFKEGGKQLNHRVQKRMATNVRRFSFRRSCAILLFLFLLVCKFPHTNSREITIEYGMCWIERNTETRTGMCPSTPTPTTSDSTTPTTSDSTTTTTTMTTTPPTTTQKKQPDDGKKPKKSDFWTVNKIISIGVPLCILVLLALSAP

SEQ ID NO: 120314 - protein, 51 aa, Heterodera glycines
  Coding regions on vcDNA: vcDNA=SeqID_46737; Strand=+; Position=1-155
  Homolog annotation: Hit_ID=ZP_00041090.1; Match level="QueryCoverage =100%, HitCoverage=8%, E-value=2e-22, Identity=94%"; Hit description =COG1053: Succinate dehydrogenase/fumarate reductase, flavoprotein subunit [Xylella fastidiosa Ann-1]
  Essential gene: C elegans homolog=C03G5.1; Phenotype=Unclassified
ATSAHTCTGDGGGLAMRAGIAMQDMEFVQFHPTGIYGAGCLITEGVRGEGG

SEQ ID NO: 120315 - protein, 398 aa, Heterodera glycines
  Coding regions on vcDNA: vcDNA=SeqID_46738; Strand=-; Position=1 -118,180-335,383-472,526-730,774-918,969-1239
  Homolog annotation: Hit_ID=CAE70206.1; Match level="QueryCoverage =92%, HitCoverage=78%, E-value=3e-94, Identity=43%"; Hit description =Hypothetical protein CBG16681 [Caenorhabditis briggsae]
  Essential gene: C elegans homolog=C14B9.2; Phenotype=Gro
FAARRERTRGDFAVGSLDGSIAHLFGAKFGEVVLFWPEIFHSEYEPKRKIFHSEYEPKRKIFPRETATSEELVSFWRDNAIPLVGQMTRANSATRYHRRPLVAVYYNVDFSLAYRDGTQFWQKKLVAVYYNVDFSLAYRDGTQFWQKKVLAIAKKYSKQNYHFAVADEEEFYSKQNYHFAVADEEEFSTELNAVGLGTSGLEQNVIVFGVDGKKYPMDPEKYDENLEENLANFLEDIGKGKVKPFVKSQPVPKVKPFVKSQPVPKGDKKGAPVRILVAENFAKIVNDEANDALVEFYAPWCGHCKAFECGHCKAFEPKYKQFATKHSKEEPNLIVAKFDASENDVPEGYAVEGFPTIYFVPSGKKDKPIKYGGNRDLEDLAKFVKKHAVASFKKQENR

SEQ ID NO: 120316 - protein, 534 aa, Heterodera glycines
  Coding regions on vcDNA: vcDNA=SeqID_46739; Strand=+; Position=1 -65,110-340,381-569,627-708,754-834,882-1021,1080-1185,1242-1436,1893- 2056,2119-2470
  Homolog annotation: Hit_ID=NP_495815.1; Match level="QueryCoverage =87%, HitCoverage=82%, E-value=2e-59, Identity=28%"; Hit description =krr1 (87.1 kD) (2I871) [Caenorhabditis elegans] emb|CAA90257.1| Hypothetical protein F54C9.9 [Caenorhabdi
  Essential gene: C elegans homolog=F54C9.9; Phenotype=Unclassified
MPPDITPPPTLEDNLDDKFQMKLEDRTKVSGGETSEDEIADFSGNEISSRSSEDPMFWTADDECNFFKTLSALKERDPKIYEQNANFFDEENQNTKTYSDAFQDIEAKKGRKTQQKMTLRDYERKLVVERGGEFSESDEEMNMPGPSSSPSYFDQQQQLKKAFKSALADSDDSGTEELLRKREKSEQEKVKEREDFYEWLRNEGAEESGAIIDKDLVKLKKRWSASGGNQLDEEEKFLRDYLLNRNYENDEEEEEEEGIGGERVPTYEQIIQEEEDEEMADQFERKYNFRFEDPDQEFLKQYPRTVRESLRTNESKRKRRRERQKEQRKEEEQQQRGVKVEEVDIPFRYRTVLPNSFGLSTEEIMNTDDRRLNAWAPIKKLNQYQSEEEEHKQLMFFQRKSQHIEKKRKLLEEIDFALPKKAQKSKAKTEEQKEDNAKREEATESKDEEEKASKRKIKQKKTKVEKKTKKRGRVEEDGTVDIAELGMDRLRAYGVSTKKLKRAHFSKKKAAAAERNQGEKQQKKSERTYQNGTD

SEQ ID NO: 120317 - protein, 137 aa, Heterodera glycines
  Coding regions on vcDNA: vcDNA=SeqID_46740; Strand=+; Position=1 -184,439-566,665-766
  Homolog annotation: Hit_ID=EAA00415.3; Match level="QueryCoverage =64%, HitCoverage=41%, E-value=5e-17, Identity=44%"; Hit description =ENSANGP00000020181 [Anopheles gambiae str. PEST]
  Essential gene: C elegans homolog=D2013.6; Phenotype=Gro,Stp
MPFGCIRNVKLEQPIFGANYLAGELVAQPDGNWEGEVNWKLTFNRGGCIEFGQALLKTSEMAESVFMYEQPPPYAGIGPIRGQNPVPYPSNTPMYPPQQQVQSEWQWHRQFCSLPGCSIAVVQPGNRIATETKGRVK

SEQ ID NO: 120318 - protein, 145 aa, Heterodera glycines
  Coding regions on vcDNA: vcDNA=SeqID_46741; Strand=+; Position=1 -45,320-712
  Homolog annotation: Hit_ID=CAE68535.1; Match level="QueryCoverage =90%, HitCoverage=22%, E-value=3e-48, Identity=78%"; Hit description =Hypothetical protein CBG14362 [Caenorhabditis briggsae]
  Essential gene: C elegans homolog=F20B6.2; Phenotype=Emb,Lva
MGQVLEVTKDKAVVQPINPWSRIYPEEMIQTGISAIDVMNSIARGQKIPIFSAAGLPHNEVTKWCRPVQFFPHCQIAAQIVRQGGLVKQPNRKKENEVEGDDDFAIVFAAMGVNMETARFFKQDFEENGSMENVCLFLNLANDPT

SEQ ID NO: 120319 - protein, 221 aa, Heterodera glycines
  Coding regions on vcDNA: vcDNA=SeqID_46742; Strand=+; Position=1 -186,243-440,500-781
  Homolog annotation: Hit_ID=CAE74489.1; Match level="QueryCoverage =99%, HitCoverage=55%, E-value=1e-43, Identity=43%"; Hit description =Hypothetical protein CBG22240 [Caenorhabditis briggsae]
  Essential gene: C elegans homolog=C44E4.4; Phenotype=Emb,Lva
MLKFNRLAALSTDLDQITSALKDSHLIDVSDDNVKIRRNPEEPLPENTLEYWQEIKRRTVYLKGFPQESTLDEIAKFVGKFGEVKNILMRKTRGSKETPKVFKGSVFATFVDQEQAKKLASVKDLKFKDEYAMVNKMQEDYWAEKNNERRQQRELKKQMRKETIDKQNQSHFVKGLVLKLSGLPMQSGETKKEVSVHKLKEFFEPYGQPAYAVIEGSEVTD

SEQ ID NO: 120320 - protein, 252 aa, Heterodera glycines
  Coding regions on vcDNA: vcDNA=SeqID_46743; Strand=+; Position=1 -152,197-242,1227-1421,1515-1559,2440-2604,2747-2902
  Homolog annotation: Hit_ID=NP_498119.1; Match level="QueryCoverage =34%, HitCoverage=20%, E-value=7e-15, Identity=45%"; Hit description =bacterial surface antigen, Gro-1 OPeron gene GOP-3 (47.1 kD) (gop-3) [Caenorhabditis elegans] gb|AAA19063
  Essential gene: C elegans homolog=C34E10.1; Phenotype=Emb
MEDSLLDAETFLYKCSHHNVAADSIEFHGVKTTRTDALKKEVAELFRANNLHQLIQNSGKAAIHMMTAAPLPGGLFCGASFRLGVVHPVANRGIHLLDRLYLGGPFDVRGYELNSIGATKESGALGGSTLLSTAVHLYAPLIPKDMIAPLDIDLPELQGDPADITKAKCAKAVDATGGTLKVIVEDTALCFNALDGLPGPYLATTTSQLILCALWPIQREKTSPSIFLLGQQMDKLLSREGRASSDGTHASK

SEQ ID NO: 120321 - protein, 114 aa, Heterodera glycines
  misc_feature (109)..(109): Xaa can be any naturally occurring amino acid
  Coding regions on vcDNA: vcDNA=SeqID_46744; Strand=+; Position=1 -37,81-154,196-323
  Homolog annotation: Hit_ID=NP_502543.1; Match level="QueryCoverage =92%, HitCoverage=60%, E-value=3e-25, Identity=61%"; Hit description =ribosomal Protein, Large subunit (12.9 kD) (rpl-12) [Caenorhabditis elegans]
  Essential gene: C elegans homolog=JC8.3a; Phenotype=Ste
MPPKFDPTEIKIVYLRCVGGEIGATSALAYLRCVGGEIGATSALAPKVGPLGLSPKKIGEDIAKATQDWKGLSPKKIGEDIAKATQDWKGLKVTCKLTIQSKTMPIQFXLSYRR

SEQ ID NO: 120322 - protein, 122 aa, Heterodera glycines
  Coding regions on vcDNA: vcDNA=SeqID_46745; Strand=+; Position=1 -162,500-706
  Homolog annotation: Hit_ID=CAA58318.1; Match level="QueryCoverage =98%, HitCoverage=25%, E-value=4e-19, Identity=48%"; Hit description =glutathione synthetase [Arabidopsis thaliana]
  Essential gene: C elegans homolog=M176.2; Phenotype=Emb,Lva
HAIANPSLYVLKPQNEGGGHNYFDDELKQKLLQFTREERAAHTLMQRIWPVTAKNFMVRPMEEAVLDDTIVELGMFGYLLGDKRDRSIVRNKQRGYLVRTKPASSAEGGISAGGVYDSLNLF

SEQ ID NO: 120323 - protein, 437 aa, Heterodera glycines
  misc_feature (433)..(433): Xaa can be any naturally occurring amino acid
  Coding regions on vcDNA: vcDNA=SeqID_46746; Strand=+; Position=1 -104,155-475,545-753,805-932,1140-1206,1268-1385,1439-1608
  Homolog annotation: Hit_ID=NP_498468.2; Match level="QueryCoverage =98%, HitCoverage=35%, E-value=1e-144, Identity=61%"; Hit description= yeast Imitation SWI homolog (116.7 kD) (isw-1) [Caenorhabditis elegans] gb|AAA50636.2| Yeast isw (imitat
  Essential gene: C elegans homolog=F37A4.8; Phenotype=Gro,Pvl,Rup,Stp
FKRWCPSITTCCIGDQEARTKIIQEQILHKFEALVTSYEALVTSYEMVLKTTSVLKKFMWRYLVIDEAHRIKNEKSKLSEMVRLLKSKNRLLITGTPLQNNLHELWALLNFLLPEKFSDAEHFDSMFTEDHVLGQQNLDLVARLHQILKPFLLRRLKSDVEKSILKPFLLRRLKSDVEKSLLPKKELKVYVGMSKMQREWYTKILMKDLEILNASGKLEKARLMNILMHLRKCSNHPYLFDGASNHPYLFDGAEPGPPYTTDKHLVENCGKMILLDKLLSRLKEQGSRVLIFSSMARMLDVLEDYCWWRSFHYCRLDGNTPHERSFHYCRLDGNTPHEERQKSIDEFNAPNSEKFVFMLTTRAGGLGINLATADVVIIYDSAGGLGINLATADVVIIYDSDWNPQVDLQAMDRAHRIGQTKQVRIFRFITEKXAKCT

SEQ ID NO: 120324 - protein, 127 aa, Heterodera glycines
  Coding regions on vcDNA: vcDNA=SeqID_46747; Strand=-; Position=1-384
  Homolog annotation: Hit_ID=NP_735966.1; Match level="QueryCoverage =84%, HitCoverage=46%, E-value=1e-15, Identity=42%"; Hit description =hypothetical protein gbs1529 [Streptococcus agalactiae NEM316] emb|CAD47188.1| Unknown [Streptococcus aga
  Essential gene: C elegans homolog=ZK945.9; Phenotype=Gro
MTRFALLLACALDKLGHRTLKKGQALSASAAATAATAAATTAPTATTTAAATTAGASATDTKRDASASTSTTATASATTASSTASAAAATSSTASAPATASSTATSPAATSARTSSASTSSTTGSCA

SEQ ID NO: 120325 - protein, 314 aa, Heterodera glycines
  Coding regions on vcDNA: vcDNA=SeqID_46748; Strand=+; Position=1 -228,282-322,394-541,587-656,842-943,1185-1291,1397-1645
  Homolog annotation: Hit_ID=NP_502696.1; Match level="QueryCoverage =97%, HitCoverage=28%, E-value=2e-42, Identity=30%"; Hit description =DNA-binding SAP containing protein (4O841) [Caenorhabditis elegans] emb|CAB05201.1| Hypothetical protein
  Essential gene: C elegans homolog=Y37A1B.1a; Phenotype=Gro,Unc
MFDRANAFVIYHTVSTALEREVEKKRRNEALSEACKDEEIVLLEGSTSKEEKAEASKSPNNTELRSNFKALVHNFEPFIAFAHFDINICGYIIDKDLEDIIFSIGLDVSRWDVQRLVKKLLSKERINYRDLTDKWVDKEGKVRYVPLPSYENIFQSFSEHAKGSLINIKQSIERQYALEKERQETVDQNEKLTLQLNNINEQREHLEKKKRRLEDDVDRYKKKLYDSEKLLKKEQEDNSSMKTSLLDCKRYGERMVAVVEKVLPPPSKKEEKEKSSGSDKNGTSGKEKDNEVANLNTEDGVEKGDEQQQKVALA

SEQ ID NO: 120326 - protein, 483 aa, Heterodera glycines
  Coding regions on vcDNA: vcDNA=SeqID_46749; Strand=+; Position=1 -102,143-360,419-565,619-762,824-977,1025-1179,1228-1513
  Homolog annotation: Hit_ID=NP_505392.1; Match level="QueryCoverage =80%, HitCoverage=29%, E-value=1e-46, Identity=30%"; Hit description =hect domain RLD 3 (5J716) [Caenorhabditis elegans] gb|AAG24027.1| Hypothetical protein F07C3.4 [Caenorhab
  Essential gene: C elegans homolog=F07C3.4; Phenotype=Unclassified
AAACGTEHVLLLTDDGRLFSWGINRFGQCGNGTETEFENCQEIIGKWGRIVSICAGGNGTETEFENCQEIIGKWGRIVSICAGHYHSGFISEKDEIYLWGWGLYGQLGNGRTANLKRPAKSRPFSALNCVKKLCLGYSHSLALLLGYSHSLALLADGRVFGCGAFSHGQLGIDPQIWKGAQRRPWPPSNCHFRGLVGLVLEYFHGIALGVDHLRRKVLFEWGDSPQSLKMNAFLQKRLKLKQKMKMDGQENPPTAERKKMDGQENPPTAERKGEAKVATIAIDELERVHFNIRTVCEWNGAAVKALSAGFNHSALLTFNHSALLTSDGQLFTWGKSLEMQLGHQNRKEKGTPTKVDVPETVRWSEVVCARNFTTAISVEGKVFVWGRNDRNFTTAISVEGKVFVWGRNDKFQLGLGKTTKKGTACQIRTIALKSDKGNAQRSVELPVDNCVESPTIYTDCGHLWKAKRNVKGSADEGLKTLMV

SEQ ID NO: 120327 - protein, 125 aa, Heterodera glycines
  Coding regions on vcDNA: vcDNA=SeqID_46750; Strand=-; Position=1 -93,154-438
  Homolog annotation: Hit_ID=P53021; Match level="QueryCoverage=96%, HitCoverage=96%, E-value=8e-40, Identity=62%"; Hit description=Major sperm protein 1 gb|AAA29146.1| major sperm protein
  Essential gene: C elegans homolog=ZK546.6; Phenotype=Emb
MGQHPEDIATIPARELHLNAPFNIRTIYNFRLINTGSKRIGFAFKTTKPKRIFLNPPCGTVGVGDTVNVIITVATFDPNNEDIKNDRVIVEWCNTPGPSDTVFKLEWFGEDGMVRRKNLPVIYNL

SEQ ID NO: 120328 - protein, 246 aa, Heterodera glycines
  Coding regions on vcDNA: vcDNA=SeqID_46751; Strand=-; Position=1 -366,412-786
  Homolog annotation: Hit_ID=NP_508269.1; Match level="QueryCoverage =97%, HitCoverage=36%, E-value=2e-29, Identity=32%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MISNVEIDIELALQSDDFMIHQEAANRDKYTLEVVDCRLIVKTVDLMDGLSLDIAKKLDLEPARYGIRNTLMKSLFITGGRYDFSANLFTEEVPRRVIIGLVPNQNYIGHNQKNPFYFNHHNVRDIELTASGRTYPQFPYNLDYKNNRYARAYHDTQEHLGMACTTESNGISYSMFKTAYCLYVFQMTNAQEDSPGFELIKEGCTAVNIRFSEAVPNEGVTLIAYAEADGLILIDRNRSITSDLTV

SEQ ID NO: 120329 - protein, 104 aa, Heterodera glycines
  Coding regions on vcDNA: vcDNA=SeqID_46752; Strand=+; Position=1 -99,147-215,339-428
  Homolog annotation: Hit_ID=NP_081291.1; Match level="QueryCoverage =98%, HitCoverage=100%, E-value=1e-33, Identity=67%"; Hit description= ribosomal protein S27 [Mus musculus] gb|AAH48352.1| Ribosomal protein S27 [Mus musculus] ref|NP_001021.1
  Essential gene: C elegans homolog=F56E10.4; Phenotype=Lva
NEMPLAEDLLYPDPQKERQKHKLKRLVQHPNSFFMDVKCPGCYKITTVFSHFMDVKCPGCYKITTVFSHAQTVVVCVGCSTVLCQPTGGKARLVEGCSFRTEGH

SEQ ID NO: 120330 - protein, 243 aa, Heterodera glycines
  Coding regions on vcDNA: vcDNA=SeqID_46753; Strand=-; Position=1 -212,483-697,998-1302
  Homolog annotation: Hit_ID=CAE70148.1; Match level="QueryCoverage =92%, HitCoverage=70%, E-value=7e-78, Identity=60%"; Hit description =Hypothetical protein CBG16611 [Caenorhabditis briggsae]
  Essential gene: C elegans homolog=F37C12.1; Phenotype=Emb
KYYPPDFDPAKIPKAKQPRNRQFIQRVMTPFNMRCNTCNEYIYKGKKFNMRRETAEGENYLGLKIFRFYFRCPNCLAEITFKTDIENVDYQAEHGATRLFDAFKFYQEQERREEVKEEEEKADAMKMLEKRTKMSKIEMEALGHIEELQESNRRYEKIDAIAYINETEQQRAMSFADQIRVQEEEDEREVERLVGRANGGKIERRLNDDEAVEQEKAENCPTTSSRKNRQAAILSGIILKKKK

SEQ ID NO: 120331 - protein, 736 aa, Heterodera glycines
  Coding regions on vcDNA: vcDNA=SeqID_46754; Strand=-; Position=1 -1110,1845-2135,2965-3774
  Homolog annotation: Hit_ID=NP_508269.1; Match level="QueryCoverage =48%, HitCoverage=51%, E-value=4e-34, Identity=28%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MPPISSNSFYVVVPSNTNVDGNRTNSFRVRLPRKLQFNAEWDVGLATIIYPHSWPSLGTTEEQFIELEWQTENIVRIPVPSSNIIRPYELSKSLYSLLDISSEHLSNQVHDAQQSYKEAMNAARKLAQKEYVKMKSDDKKRRPKRKIIDQNEALPLLSALLIAIDTIDDALISNEDGTINPEMVAGALLDREKRAATSNVPLREESDSEEEYQRKLDNFFLKMRDSDDLLLFQNLIAKHLEVELNKLSKDEQSLNKSIKDLGMEAWIQAYKKVSSVVQFIFDVRHNRFTLAINTKFIKRVKLSEQLAYILGFAPQTQFKKDKNPAKFMPDMSGGVSTLHVYIPDLIEPMMIGNVIAPILRITIIRGNPDEVEWSSFPLNNSASSLELSSALNQWGGGVGSYNIFRGQPYQRGNGIGAVFRSLMRYLVPIGREIGSTIGRQGLESGNRVLSNVLEGKDLKESLISEGKGGKKAQFLSRLDFDLGNQELYLLNNLDLLFSIYKAKDNFLIQTLKANDTQEYRLRVHDVKIYAKMVEVQPSLNLNIYKMLEKQPATYAVRKTEVKSTFISAGRYEVEYNAFSATIPRRLTIGMVENGAFNGNSKLDPFNFKHFDIRDIAVHAGGFIYPMVPYKLAFKKDAFVRAYVDFYEALGMANSDRSCDITRQQFKNGWTLFVIPLTSTLDDSVGYELLRSGTTTIRATFNSAIPAGGVEMIVLGEFDQMIMIDYNRHIVSDSKLG

SEQ ID NO: 120332 - protein, 283 aa, Heterodera glycines
  Coding regions on vcDNA: vcDNA=SeqID_46755; Strand=-; Position=1 -135,182-251,662-778,1039-1172,1223-1298,1354-1433,1619-1858
  Homolog annotation: Hit_ID=NP_505399.1; Match level="QueryCoverage =70%, HitCoverage=43%, E-value=5e-36, Identity=38%"; Hit description =membrane glycoprotein HP59 family member (55.3 kD) (5J744) [Caenorhabditis elegans] gb|AAA82415.1| Hypoth
  Essential gene: C elegans homolog=ZK682.2; Phenotype=Unclassified
MAAQNDHSNAIFGNASFSFPSPVHLAECAHLTELTNGTKLGDPKIFEGGDLIISKKMQSLIFTSFYLGAIAISTTGNQISVVLAMFVTAELCVVRWIGGWTASFYIYGLIGVAFCAVWMLLVRDYPSQSKYIRSDELRLIELNGGHANVSQKISPNEVPWRRILCSMVVWSTGFSSFSQNFMNVGIVVYLPTYYHNVLGMDLTSDRRLMSSTSVTKLFNLIASFGSGLCFVLLSLCDCRTPYLAISLAVCAIGISSGFIPGYNTSVVRKTRWRWHNHELPAQD

SEQ ID NO: 120333 - protein, 372 aa, Heterodera glycines
  Coding regions on vcDNA: vcDNA=SeqID_46756; Strand=-; Position=1 -170,214-303,614-752,794-916,1347-1456,1525-1707,2381-2527,2569-2725
  Homolog annotation: Hit_ID=NP_999498.1; Match level="QueryCoverage =45%, HitCoverage=29%, E-value=1e-51, Identity=51%"; Hit description =ribophorin I [Sus scrofa] emb|CAC04096.1| ribophorin I [Sus scrofa]
  Essential gene: C elegans homolog=T22D1.4; Phenotype=Unclassified
TILPAASNDIYYRDEIGNISTSNVYPRADRVEVELRPRFPLYGGWRTNYILGYNVPSTSFLRHSGSNFAIKMKLMDRLYDNAVVEKLNIKLVTPYSVKRLPDEVHKTYLDTFGRPVIVLEKENLINNHIQPFTLYYEFDRFSMLYEPLLIVVAFGALFLAAVILFRLDFSIAGKTKTSLLVGPAVRLLLGHYDIKTSVLRASGPKKNILKSDVLSHINDKKLSPIKAFSAKPPSKMSLENEVISASSHPIIPLKSSGRSEPTHRHVHVDIQFLTIGALRRHFEPDETTKKPKLVTKFGATLCYDARTIEGQTARRFLDSFKTALISPESLFAELDYLIEDEVDISEMDDGSAIEEKIDIGKEDEELAKLLLR

SEQ ID NO: 120334 - protein, 109 aa, Heterodera glycines
  Coding regions on vcDNA: vcDNA=SeqID_46757; Strand=+; Position=1 -186,237-380
  Homolog annotation: Hit_ID=NP_492601.1; Match level="QueryCoverage =88%, HitCoverage=73%, E-value=1e-24, Identity=50%"; Hit description =cytochrome C Oxidase, subunit Vb, LiPid Depleted LPD-4 (lpd-4) [Caenorhabditis elegans] emb|CAB03002.1| H
  Essential gene: C elegans homolog=F26E4.9; Phenotype=Lpd
MNMNQLLVGRSLFPKIIRPFSHTKPLAKSEADPDDYGYFPDPIEHSWGLERKMLIARLKGDDRYEPKVYFRAEHTTRDYPNLVPVHLQDKVVGCLCKTDLRRNFFITHY

SEQ ID NO: 120335 - protein, 432 aa, Heterodera glycines
  Coding regions on vcDNA: vcDNA=SeqID_46758; Strand=-; Position=1 -156,202-969,1015-1389
  Homolog annotation: Hit_ID=NP_508269.1; Match level="QueryCoverage =99%, HitCoverage=66%, E-value=5e-43, Identity=28%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MLYKKVDVSSAEVANAGLDFFTIPPTSCAVSNSSYREYLTLNPISSRPFHFKIHPITSYVDLSKVFVCTEFKLKKVADDGVVVDVPANAAVGLIQMPGATFIRNLKVHINQREVYDSNQLYSYKVFLDTELSYPVTAKDSYFGVAGYFRDSDPTKVNDRRKKAVEESKGFQAISKLSADIFNQDLYMISNVEIDIELALQSDDFMIHQEAANRDKYTLEIIDCRLIVKTVDLMDGLSLDIAKKLDLEPARYGIRKTLMKSLFITGGRYDFSANLFTEEVPRRVIIGLVPNQNYIGHNQKNPFYFNHHNVRDIELTASGRTYPQFPYNLDYKNNRYARAYHDTQEHLGMACTTESNGISYSMFKTAYCLYVFQMTNAQEDSPGFELIKEGCTAVNIRFAEAVPNEGVTLIAYAEADGLILIDRNRSITSDLTV

SEQ ID NO: 120336 - protein, 194 aa, Heterodera glycines
  Coding regions on vcDNA: vcDNA=SeqID_46759; Strand=-; Position=1 -305,357-492,740-880
  Homolog annotation: Hit_ID=CAE67724.1; Match level="QueryCoverage =47%, HitCoverage=32%, E-value=4e-21, Identity=53%"; Hit description =Hypothetical protein CBG13299 [Caenorhabditis briggsae]
  Essential gene: C elegans homolog=C18D11.4; Phenotype=Lva
MTKQSNQTINHLANQLINHNNQSIGRSNPHKSADQSKLFNSIKANCVVARGNRQKSKKGSQTMMKKRERKEKEEVVFSQPVVWVKQKKRNFLCKIMGLPGRRRSRSRDLPSSRGGGGGGGYYGSRRFHDGRDNPNPNPCLGVFGMSLHTTERDLKHLFGRYGEVDSVQIVYDRLSGRSRGFGFVYFTHTKDAAR

SEQ ID NO: 120337 - protein, 311 aa, Heterodera glycines
  misc_feature (128)..(128): Xaa can be any naturally occurring amino acid
  misc_feature (290)..(290): Xaa can be any naturally occurring amino acid
  Coding regions on vcDNA: vcDNA=SeqID_46760; Strand=-; Position=1 -133,369-502,722-805,1329-1475,1782-2047,2172-2340
  Homolog annotation: Hit_ID=CAE71139.1; Match level="QueryCoverage =72%, HitCoverage=80%, E-value=3e-85, Identity=67%"; Hit description =Hypothetical protein CBG17994 [Caenorhabditis briggsae]
  Essential gene: C elegans homolog=B0393.1; Phenotype=Emb,Ste
MSSSLDVFKLTDDDAMKFLVCESHIGTKKMDFQMEHYLWKRRSDGIHIINIRKTWEKLLFAARAIAAIENPSDVVVVSAQPYAQRAVLKFAAHIGATPIVGRFTPGSLTNQIQKNFKEPRLLVVSDPXLDHQAVREASYVNTPVIAVANTDSPLKFVDIAIPANNKQKHSVGLIWWLLAREVLLLRGKISRQTGFVVDDKLIMPDLYFFRDPQEQEKEGTEGEAEADITVKEGGWGATGGMETIGGDFPSCSDFMPRSSVALTTVSDEQRRLQANPNTAQNTAAEPDGPXTMSSLGGSIRSVTRLFTKNWS

SEQ ID NO: 120338 - protein, 255 aa, Heterodera glycines
  misc_feature (1)..(1): Xaa can be any naturally occurring amino acid
  Coding regions on vcDNA: vcDNA=SeqID_46761; Strand=+; Position=1 -365,727-879,959-1077,1128-1223
  Homolog annotation: Hit_ID=CAE59290.1; Match level="QueryCoverage =75%, HitCoverage=22%, E-value=3e-52, Identity=55%"; Hit description =Hypothetical protein CBG02625 [Caenorhabditis briggsae]
  Essential gene: C elegans homolog=C32D5.3; Phenotype=Ste
XNNNCLSLCSRIRVPTRDSKYTLDHQAFISSVLGLRFFTIIKPFLLGPNFVRLLIFLILPIVRLLLPLQLQVTVDAMERLLKSCHGSPSLNQFIEGYLLMVQRLLETNNAHMEKLATDLFERFSTIEEDSPSYHRQYDFFISKFSAMCHAQNDVYVSSQRYNGLRGLRGVIWKSASDDLQANIWEKQHMNKIVPSILFNFQHDDESGGMSMLHIPSFASSFSLPMSMLHIPSFASSFSLPIKKNQAVSSKKIENF

SEQ ID NO: 120339 - protein, 238 aa, Heterodera glycines
  Coding regions on vcDNA: vcDNA=SeqID_46762; Strand=-; Position=1 -102,192-289,734-833,878-985,1314-1405,1665-1754,2417-2543
  Homolog annotation: Hit_ID=CAE70301.1; Match level="QueryCoverage =88%, HitCoverage=83%, E-value=5e-49, Identity=42%"; Hit description =Hypothetical protein CBG16822 [Caenorhabditis briggsae]
  Essential gene: C elegans homolog=Y38F2AL.1; Phenotype=Dpy,Unc
MPELVRKTVIFCSVVFTLIGMGLSIAAILTPSWQVVNLQEYNSVHEHGLWLDCIRHIRDGGGVLLRRYSGTFDVEDDNSPVGEVNRHRFYGWHSATLIMLALALITSFCSICLGACGCCYASMSLVFTATALLTSDLSFLLLPKACSSSSPIVPTIVSSRALLALMSFAFTRKGVALDRERYSLQTSSKTNMTNVGRPMDRMPLLDQLQPPPSFHSSSQSADRIDRGFLRTDLPFLNF

SEQ ID NO: 120340 - protein, 93 aa, Heterodera glycines
  Coding regions on vcDNA: vcDNA=SeqID_46763; Strand=-; Position=1 -72,599-806
  Essential gene: C elegans homolog=M18.5; Phenotype=Gro,Stp,Unc
MADEIFAALHANGKNYLILLNSVHPQKCISPSPLRSSEANHVPLNSEFYLDCLAVSDGENLVIGTIDDIRKLHFRTVPLGESASISAGIESDC

SEQ ID NO: 120341 - protein, 104 aa, Heterodera glycines
  Coding regions on vcDNA: vcDNA=SeqID_46764; Strand=-; Position=1 -93,147-233,329-421,486-527
  Homolog annotation: Hit_ID=NP_490842.1; Match level="QueryCoverage =83%, HitCoverage=95%, E-value=1e-35, Identity=82%"; Hit description =SUMO, small ubiquitin-like modifier, SUMO, small ubiquitin-like modifier SMO-1 (10.2 kD) (smo-1) [Caenorh
  Essential gene: C elegans homolog=K12C11.2; Phenotype =Dpy,Emb,Gro,Pvl,Stp
MADESGTNAGGTGAAGGAQPAEYIKLKVVGQDSNEVHFRVKYGTSMGKLKKAYAERTGVQVTSLRFLFDGRRVNDDDTPKSLEMEEDDVIEVYQEQLGGYIVEE

SEQ ID NO: 120342 - protein, 453 aa, Heterodera glycines
  Coding regions on vcDNA: vcDNA=SeqID_46765; Strand=+; Position=1 -152,206-338,383-556,613-684,734-794,926-1073,1125-1243,1289 -1361,1404-1518
  Homolog annotation: Hit_ID=EAA13221.3; Match level="QueryCoverage =98%, HitCoverage=46%, E-value=1e-88, Identity=43%"; Hit description =ENSANGP00000010668 [Anopheles gambiae str. PEST]
  Essential gene: C elegans homolog=Y55F3BR.1; Phenotype=Gro,Stp,Unc
HKGRTRDRRGSQARKPNAPMCLIEPTKELAQQTYDQIERFRKYLDKPKIRSVLAVSGIPMGQQVAAINAGIRSVLAVSGIPMGQQVAAINAGVDILTCTPGRIRGLVQEGQVELDQIRFFVLDEADSLLGGQSDSAQIELDQIRFFVLDEADSLLGGQSDSAQIVHELHSRIPKYSEFGERFQMIVCSATLHNMAVQRLATQYMYTQYMYFPQWIDLKGQDSIPETVHQVVCMVVVCMVDPCEDKSWIRLRSKPETDSVHARDQLRPGSDNPETLSEAVKVLKGEYLVKAIEEHKMDQAIIFCRTKLDCDNMEKFLAPTKLDCDNMEKFLAPRGYKCVCLHGDRSADERTRNLLSFKEKIVRFLICTDVAARGLEKIVRFLICTDVAARGLDIKGVPYVVNVTLPPAEEKANYVHRIVNVTLPPAEEKANYVHRIGRVGQAERSFEAFQCFFD

SEQ ID NO: 120343 - protein, 863 aa, Heterodera glycines
  Coding regions on vcDNA: vcDNA=SeqID_46766; Strand=-; Position=1 -1219,1274-1740,1844-2108,2286-2422,2472-2711,2771-2861,3064-3236
  Homolog annotation: Hit_ID=CAE66724.1; Match level="QueryCoverage =99%, HitCoverage=86%, E-value=1e-131, Identity=27%"; Hit description= Hypothetical protein CBG12070 [Caenorhabditis briggsae]
  Essential gene: C elegans homolog=C09D1.1a; Phenotype=Unc
MSVVVEDGKPEPKIDWFKDGHPLHIDGQHIMRRDEPDGRHSLTINNARAEDAGTYTCKAFNKAGQSVSEANFGVQQRVEEPAQQQAEPMFLVPLEPQTVREGETAEMCCKVNAEESKPDIRWYHDEKLVVPGQQPNVVIEHLADGTLNLRVQSATKSDIGMYRCEAVNAAGRAQTSAPLKYAEEMEVDHKFELAEPMFVRPLEPRTVREGEPAEMSCKVNVAESQPDIRWYRDDKPILPGQEPNVVIEQLADGTQKLRVLHASASDLGVYRCEAINPTGRAQTQAPLRYAEERLIEQPEEEHAPLLSWRRTLRDQQMSKGTRGVVFECQLEPSSLSAVKRVDWLKDGSILANKMELYSLRVEQLQDGTQRLLFDREAHFDHIGVYRCVATDASGNQIWTEARLGVIAPRDAEEMAPGPPEFVELLKSCTTTIGGTAVLRCKVKGNPRPTIAWSRQGYGPLSESDRISTEYHEDGTIILTLTNADMDDTGEYRWGTGQQQQAVAGTHGDEQCGHLSLHRCDAENDYGTAWTEGPIIVAAEGSLPTEGEAPDFIEPVRPITVKVGDTGILEGRITGLPFPEVKWYKGEQLITPGLNPRYRLENLPDGTQRLIITNAQMGDMDDYRCEATNKYGDVWSDVTLTVQGGQWGRGYEPEPEEEPSSPYFVRGLQEVRVTEGEQADLECVVKGWPTPEVKWYKDDDEIRPEDVNFRATQSPDGTCHLTLPAARITDAGVFRCSATNPSGTAHTEAPLRVLLEEEAPMPAEVAPEFVQGLKPVQATEGDEAMFECQVSGVPQPQVKWYKDDVPLAIEAKPAVVEERPKEEEAKPMEDEKPLEEETKMEWEEAKPKEEEAVKPFEEAKPMGL

SEQ ID NO: 120344 - protein, 243 aa, Heterodera glycines
  Coding regions on vcDNA: vcDNA=SeqID_46767; Strand=+; Position=1 -293,339-474,522-591,671-812,868-994
  Homolog annotation: Hit_ID=CAE57015.1; Match level="QueryCoverage =96%, HitCoverage=56%, E-value=2e-41, Identity=39%"; Hit description =Hypothetical protein CBG24890 [Caenorhabditis briggsae]
  Essential gene: C elegans homolog=Y44F5A.1; Phenotype=Gro,Pvl,Stp
MERLFNTPISSLSTNTSNCTRNTICLGFLDGSIQCFSFDTQRGITPSMESSVKLGGMWRKRMKRSVRAMQISEDGTSLYATSSNRAVCLYDVETGKRVRCIREGHKSRPSAMALLPGERRHFATGAENGEIKAWDFGQPKPNVHTFGEQADIINALHIWRNNLLAASGDGTLAVYDTHKGKVRIQSETMHSELLSLAVTERFTYVGAADGHIEVFSNGQFGNIRERMETPFLMGVEQMVVLRN

SEQ ID NO: 120345 - protein, 159 aa, Heterodera glycines
  Coding regions on vcDNA: vcDNA=SeqID_46768; Strand=+; Position=1 -53,105-301,419-575,695-727
  Homolog annotation: Hit_ID=NP_112594.1; Match level="QueryCoverage =98%, HitCoverage=91%, E-value=7e-40, Identity=49%"; Hit description =hypothetical protein MGC4293 [Homo sapiens] gb|AAH02817.1| Hypothetical protein MGC4293 [Homo sapiens] gb
  Essential gene: C elegans homolog=C14A4.1; Phenotype=Unclassified
FVPEKRVDEAGHILNDPSKSLADRFRALFLLRSVKKSLADRFRALFLLRSVKSDRAVHWICKCFSDPSALLKHELAYCLGQMQNPAAIQKLIFVLQDTEQEPMVRHEAAEALGAIGDPSISKLFEQYSGDAVREVAETCLLALRRTQWVQQHGGKGAAE

SEQ ID NO: 120346 - protein, 165 aa, Heterodera glycines
  Coding regions on vcDNA: vcDNA=SeqID_46769; Strand=+; Position=1 -150,294-410,466-693
  Homolog annotation: Hit_ID=NP_501804.1; Match level="QueryCoverage =92%, HitCoverage=32%, E-value=1e-56, Identity=68%"; Hit description =seryl tRNA Synthetase (55.2 kD) (srs-2) [Caenorhabditis elegans] emb|CAA93105.1| Hypothetical protein C47
  Essential gene: C elegans homolog=C47E12.1; Phenotype=Emb,Lva,Ste,Unc
VTTAKKTDAANEDGSPDEKYLIATSEQPITAFHRTFLSIYSAPLNFAICKVGSHGRDTRGIFRVHQFEKMEQFVICSPFDNESWKHMDEMIDNAEEFCKVLGLPYRIVAIVSAELNNAAAKKLDLEAWFPGSGAFRELVSCSNCTDYQSRRLRIRYGQTKKMDGK

SEQ ID NO: 120347 - protein, 190 aa, Heterodera glycines
  Coding regions on vcDNA: vcDNA=SeqID_46770; Strand=-; Position=1 -265,315-430,584-675,728-827
  Homolog annotation: Hit_ID=AAK55116.1; Match level="QueryCoverage =94%, HitCoverage=86%, E-value=4e-44, Identity=47%"; Hit description =venom allergen-like protein [Heterodera glycines]
  Essential gene: C elegans homolog=F49E11.9; Phenotype=Unclassified
MGFATPMSAEDKVTIVQCHNNYRSQLALGKVANKTGQTMPTAANMAKMVWDDGLGKSAQDWASKCQIQHSGTDFGENLYFSSWRDFPNKEVLEKSCNAWWSELAEFGINKDMWLDDDNLSKVGHWTQMAWFNSVQIGCAVANCDGDWQTYVVCHYNPGGNYVWMSTYKSGPICSECEAPRKCNNSSGLCE

SEQ ID NO: 120348 - protein, 366 aa, Heterodera glycines
  Coding regions on vcDNA: vcDNA=SeqID_46771; Strand=+; Position=1 -102,181-351,740-979,1280-1354,1404-1656,1731-1791,2038-2139
  Homolog annotation: Hit_ID=NP_499734.1; Match level="QueryCoverage =96%, HitCoverage=94%, E-value=2e-70, Identity=43%"; Hit description =cleavage and Polyadenylation Factor (cpf-2) [Caenorhabditis elegans] emb|CAB05746.1| Hypothetical protein
  Essential gene: C elegans homolog=F56A8.6; Phenotype=Emb
MQNQQNMDNSARSIFVGNISYDVSEDELRKLLSACGQIVSCGQIVSFRLVHDRETGRPKGFGFCEFADVPQAEAAIRNFNGFEFRGRPLRVDSATGNMQHFQMTLTRPQNPTDELSPYGPELEPGKAPEVIARTVASMPPEKMFELMRSMKETVNNNPQMARQLLMENPQLSYALLQAQVVMRVVDPKIAYQMLHREHAQPLNPLNCLPNSTSPPSVPSHNPLNCLPNSTSPPSVPSHQFQMQPPPLVPGQFHHGFPSMGMAPPSLLQQQQQQTPFTQQKPTPIAPLAVPPAATAPQQQQVVDSQQAQQSNSQQAQQSNSDNLDEEQQAQMLIRVLQLTDEQIRMLPPTERAQVIELRNQLRSADA

SEQ ID NO: 120349 - protein, 191 aa, Heterodera glycines
  Coding regions on vcDNA: vcDNA=SeqID_46772; Strand=-; Position=1-579
  Homolog annotation: Hit_ID=NP_510671.1; Match level="QueryCoverage =93%, HitCoverage=18%, E-value=2e-32, Identity=39%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
KNWYKGAKFLWGIKGFLSNRTFRVKIGDSLSSSKVTSGVPQGSVGPLLFLIYINDLPDALPSGVKIKLYADDVKIYICYKARSDTEIMHKALHNLFEWANKWQIKVSIQKTFVLYLGSKNPKETYKFDGNTINAVDTIRDLGINIDNKFQFSGHVNQITRNAYLRMRSLFRIIKSKSSKIWITLYKTYIRP

SEQ ID NO: 120350 - protein, 337 aa, Heterodera glycines
  Coding regions on vcDNA: vcDNA=SeqID_46773; Strand=+; Position=1-1014
  Homolog annotation: Hit_ID=NP_498735.1; Match level="QueryCoverage =99%, HitCoverage=78%, E-value=1e-40, Identity=31%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MSINGREVFNSNSLMAYKTYFSHELSYSNTAKDSHLNAAGYYRDIGGSLETGDGCIARRNLFARSRTAQFIAKIDADLFNQPLYLINFCELDIEILPNDNEFVLITTPIVAQGAAAAPRYRFEVVGLKMYVKKVSLMDGLALDIARKLEVKPARYAVRKTLMKSMFISHGRFEFTANLFMDQIPRRITMGLVANSDYIGTISRSPFNFQPFNVREISIIANGRSFPQAPYDLDYPNWKYVRPFNDMNEAVGFANSLESNGISYEQFGKTHCIYVFNLTNSGDDQAALFDLIKNGTTAVSIKFNQAVPAGGIMLVVMGECDSLVMLDKNRSISTDITI

SEQ ID NO: 120351 - protein, 114 aa, Heterodera glycines
  Coding regions on vcDNA: vcDNA=SeqID_46774; Strand=-; Position=1 -169,587-759
  Homolog annotation: Hit_ID=NP_498982.1; Match level="QueryCoverage =100%, HitCoverage=24%, E-value=1e-28, Identity=55%"; Hit description= putative nuclear protein, with 2 coiled coil domains, of ancient origin (52.8 kD) (3K56) [Caenorhabditis
  Essential gene: C elegans homolog=R08D7.1; Phenotype=Emb
RDAKLQEMGKVLDEGFARYADDEAMNARLKEQLHEEDPMAEYFRVKSHKVQMRTGVAVYPSYKGQFPPNRFSIAPGYRWDGVNRSNGFESKLQLEKNKRKARETDTYRSIAECE

SEQ ID NO: 120352 - protein, 243 aa, Heterodera glycines
  misc_feature (125)..(125): Xaa can be any naturally occurring amino acid
  Coding regions on vcDNA: vcDNA=SeqID_46775; Strand=-; Position=1-736
  Homolog annotation: Hit_ID=NP_504179.1; Match level="QueryCoverage =99%, HitCoverage=23%, E-value=3e-50, Identity=43%"; Hit description =predicted CDS, protein of unknown function DUF32 and RNA-directed DNA polymerase family member (5E747) [C
  Essential gene: C elegans homolog=ZK250.3; Phenotype=Clr,Lvl,Sck
STTSQLNSCRSFYEAIINGKSVDCIYIDFQKAFDSVPHNLLLYKLEKIGIKGKLLLWIKDFLSNRTFRVKIGDSLSSSKVGSGVPQGSVLGPLLFLIYINDLPDALPSGVRIKLYADDVKLYMLXSKSRTETMHKALHNLFEWANKSFNSKNFYIIHIGSKNPKETYKFDGNTINAVDTIRDLGVNIDNKLQFSVHVNQITRNAYLRMRSLFRIIKSKSSKIWITLYKTYIRPLLEYAPEVWI

SEQ ID NO: 120353 - protein, 187 aa, Heterodera glycines
  Coding regions on vcDNA: vcDNA=SeqID_46776; Strand=-; Position=1 -18,332-508,838-1003,1374-1576
  Homolog annotation: Hit_ID=CAE66669.1; Match level="QueryCoverage =72%, HitCoverage=35%, E-value=5e-28, Identity=39%"; Hit description =Hypothetical protein CBG12008 [Caenorhabditis briggsae]
  Essential gene: C elegans homolog=C32E8.10a; Phenotype=Emb,Stp
MDTIFLVSSSELNNGVINCSFILLFRDLIRLFACYNDGMINLLEKFFDMNKKQCREALDQYKAFLMVSQQINSARQEQLFQSNSSVDEMAKQRYLEEEKERLRQFEEQRRRQIQQQPGGGVPTSSVPSPSSIPPPSTNPFALASDLICFDTPPKDGNSVAVGQIEPTNPFAIVAELNNRPSQQGNFS

SEQ ID NO: 120354 - protein, 229 aa, Heterodera glycines
  Coding regions on vcDNA: vcDNA=SeqID_46777; Strand=-; Position=1 -240,331-596,646-826
  Homolog annotation: Hit_ID=NP_872124.1; Match level="QueryCoverage =91%, HitCoverage=30%, E-value=7e-46, Identity=40%"; Hit description =EGl-27 Related, metastasis associated 1-like (egr-1) [Caenorhabditis elegans] gb|AAO25984.1| Egl-27 relat
  Essential gene: C elegans homolog=T27C4.4a; Phenotype =Gro,Muv,Pvl,Stp,Unc
MESGGGSSTDAENSRRENDETADDGRAESVGFAGLPAGAERLDAAELSRLRQHELFLSRIVETLPATQIRGKCSVVILNEDSFFYSLVYDPTNQTLLADKGRIEIGERYQAQIPELTVSQEEVNKVKREGEEETTGRTEVRCTDKEFVVYHPHHRLSDRDIDQFLIIARAVGIFSRALDGSSSTKLTTLHQTASAASRDITLLHAMALLHQADYSLGQVFCRVQLLFCK

SEQ ID NO: 120355 - protein, 183 aa, Heterodera glycines
  Coding regions on vcDNA: vcDNA=SeqID_46778; Strand=-; Position=1 -412,469-551,593-648
  Homolog annotation: Hit_ID=NP_505412.2; Match level="QueryCoverage =42%, HitCoverage=15%, E-value=8e-18, Identity=57%"; Hit description =putative endoplasmic reticulum protein of fungal and metazoan origin (48.7 kD) (5J808) [Caenorhabditis el
  Essential gene: C elegans homolog=K07B1.5a; Phenotype=Emb
MWLQAFIAYWGYTADYDGNPSIVAILERSFPLVYEYGEDIRKYGEKDRVLVIVNHQSTADVPTLFTVLQTKGVATRKVIGSAESSNGAQYSDDLVDGCDVSLDTFWDYRTNAWRLFHSAGQSDARQRTDQTEGTPPKGVLGQRPTLGHSFPGGRLLLQKKRNQPKICQGEQLSPLGALHFAAN

SEQ ID NO: 120356 - protein, 164 aa, Heterodera glycines
  misc_feature (136)..(136): Xaa can be any naturally occurring amino acid
  Coding regions on vcDNA: vcDNA=SeqID_46779; Strand=+; Position=1 -100,156-368,436-715
  Homolog annotation: Hit_ID=NP_505412.2; Match level="QueryCoverage =96%, HitCoverage=40%, E-value=5e-63, Identity=68%"; Hit description =putative endoplasmic reticulum protein of fungal and metazoan origin (48.7 kD) (5J808) [Caenorhabditis el
  Essential gene: C elegans homolog=K07B1.5a; Phenotype=Emb
PRFYWFYEGKLYMWLQAFIAYWGYTADYDVYEYGEDIRKYGEKDRVLVIVNHQSTADVPTLFTVLQTKGVATRKVIGSAFGIIGRMHGDYFIQQGKATRDKELIRLKGHLQKVFWDRDRRWVILFPEGGFYFCFQXYAKENNFPHLEHCTLPRMGEQQINYKII

SEQ ID NO: 120357 - protein, 115 aa, Heterodera glycines
  Coding regions on vcDNA: vcDNA=SeqID_46780; Strand=+; Position=1 -171,306-479
  Homolog annotation: Hit_ID=CAG06081.1; Match level="QueryCoverage =100%, HitCoverage=12%, E-value=7e-27, Identity=51%"; Hit description= unnamed protein product [Tetraodon nigroviridis]
  Essential gene: C elegans homolog=F40F12.7; Phenotype=Emb
MRGGGITQQQQAIGNHPQQMLCAGSGGGQPQESVKRKLIQQQLVLLLHAHKCQQIERSELRQNRAPCTLPYCSVMKAVLEHMVGCSAGRQCQYAHCASSREIIAHWKDCHKDDCP

SEQ ID NO: 120358 - protein, 69 aa, Heterodera glycines
  misc_feature (20)..(20): Xaa can be any naturally occurring amino acid
  Coding regions on vcDNA: vcDNA=SeqID_46781; Strand=-; Position=1 -61,112-235,299-472
  Homolog annotation: Hit_ID=NP_502083.1; Match level="QueryCoverage =95%, HitCoverage=25%, E-value=6e-19, Identity=68%"; Hit description =Alcohol/Ribitol Dehydrogenase (27.1 kD) (ard-1) [Caenorhabditis elegans] emb|CAA92764.1| Hypothetical pro
  Essential gene: C elegans homolog=F01G4.2; Phenotype=Pvl,Stp,Unc
RDGIAPGLMDTPLLSSLPPXVKKFLSGTVPFPNRLGKPEEFAALVEHIIDNHYLNGEIIRLDGGIRMNA

SEQ ID NO: 120359 - protein, 150 aa, Heterodera glycines
  Coding regions on vcDNA: vcDNA=SeqID_46782; Strand=+; Position=1 -119,197-361,494-664
  Homolog annotation: Hit_ID=NP_499554.1; Match level="QueryCoverage =93%, HitCoverage=84%, E-value=3e-35, Identity=50%"; Hit description =signal sequence receptor delta (17.4 kD) (3N11) [Caenorhabditis elegans] emb|CAB60502.1| Hypothetical pro
  Essential gene: C elegans homolog=Y56A3A.21; Phenotype=Unc
AACESPKYSANGYSTQDGFFHYKTSYIVEFAIQCSNNYKDAPFYALVGEKTLQLAVSEETNKYQVSWQLEHADSGAQTFDIRVYDEDKFAEHKKADESGSSSVQPLFTVQHYHGGTSHKTWISSESVFLLLGVVALYFTMNLRQLLAKRD

SEQ ID NO: 120360 - protein, 476 aa, Heterodera glycines
  Coding regions on vcDNA: vcDNA=SeqID_46783; Strand=+; Position=1 -447,803-1786
  Homolog annotation: Hit_ID=NP_508269.1; Match level="QueryCoverage =67%, HitCoverage=48%, E-value=7e-44, Identity=30%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MVHQIFDPNSVDFDDFMLVEQVGSGETYNYFRGIPPYQRGYGRQRGGGVGDILRLLWRTILPKLKSAGTVLGREALDTGTRVLDTIEKSEAPNKPSIIAEVKKGVDNILEKGGVGRQFGTGRRRKSIKRNAIIGKTVPKTVINKRKRSDGREIYDSNSLYAYKAYLDTELSYSKNVKESDMQASGYYVDSENQDGTDLSQPGFELRRKLFSQSQTAQFITKLDADVFNQDRYMVNGVEIDIQLTPNDNEFMIMAASNDKYRIEITACKLYVKNLEVVDGLALDIQKILENKEAKYAHRKTLIKSIFISENRTEYNGTLFTGQLPKRVILGMVENSAYVGNQKKSPFNFRPFDVRSVTLTANGKQWPAAPFELNFSKNLYTRAFHEMNEALGMASSTDSNGITLEKYRKGWTIFAFNMTNSMEENECIDLITEGTTTVSILFRSPVPAGGISLIAMSEMDSILILDKNRTVMTDTTV

SEQ ID NO: 120361 - protein, 85 aa, Heterodera glycines
  Coding regions on vcDNA: vcDNA=SeqID_46784; Strand=-; Position=1-259
  Homolog annotation: Hit_ID=CAB88203.1; Match level="QueryCoverage =96%, HitCoverage=69%, E-value=1e-39, Identity=58%"; Hit description =putative cuticular collagen [Globodera pallida]
  Essential gene: C elegans homolog=C15A11.6; Phenotype=Emb
PGPKGSPGAPGQPGNPGSQGQPGQPGGQGPPGPQGAPGQPGLPGNSGQPGQPGAPGQPGKDSGYCPCPPRSSVLAVKKKMAAAVV

SEQ ID NO: 120362 - protein, 186 aa, Heterodera glycines
  Coding regions on vcDNA: vcDNA=SeqID_46785; Strand=-; Position=1 -130,267-389,445-574,781-924
  Homolog annotation: Hit_ID=NP_491655.1; Match level="QueryCoverage =95%, HitCoverage=37%, E-value=3e-37, Identity=43%"; Hit description =WD repeat domain 12 (49.0 kD) (1G224C) [Caenorhabditis elegans] gb|AAB37809.1| Hypothetical protein F55F8
  Essential gene: C elegans homolog=F55F8.5; Phenotype=Lva
TPMVTLESHREPVVGCAWHPSNLSQAITASWDHQLMLWDLQLAGPISTLTSNKAFSALSVCPANGLVLTSSVDSLVRLWDFRSRDGSMVKASFHGHGSMVKASFHGHVGVVSDVCWHSTDQHLFVSASFDNTVKMWDVRSPRAALYDLMGHSDRVLCVDWTVPSRICSGSVDSTVKVFSHGTKENI

SEQ ID NO: 120363 - protein, 276 aa, Heterodera glycines
  Coding regions on vcDNA: vcDNA=SeqID_46786; Strand=+; Position=1 -162,232-369,554-718,772-915,983-1204
  Homolog annotation: Hit_ID=CAE59841.1; Match level="QueryCoverage =98%, HitCoverage=85%, E-value=8e-50, Identity=42%"; Hit description =Hypothetical protein CBG03313 [Caenorhabditis briggsae]
  Essential gene: C elegans homolog=F19B6.2a; Phenotype=Emb,Lva,Lvl,Unc
ILLPNSCLDNLMRRNIQYPMLFKLTNVGPALQRGTHAGVLEFLAEEGRCYLPSWMMAQLALREGDLITVEYKALPNATYAKFKPMSTDFYNISNPRAMLEYNEQVYEFQVKALKPENAVTIVECDINIEFDAAEGYVEPNRTHQQRNEMVAAEEEQQSHPPNVFKPFSGSGFRVDGKKPRSVSTSSQQEATSSSSSSASSGRQPSSGIASTASTARDALEAIAVDENYIPGELRFVRRPYKSKAQRDKEAREKDNGGTMKPFGGEGNTIRPTRGGQ

SEQ ID NO: 120364 - protein, 142 aa, Heterodera glycines
  Coding regions on vcDNA: vcDNA=SeqID_46787; Strand=+; Position=1 -153,454-660,1276-1341
  Homolog annotation: Hit_ID=NP_509648.1; Match level="QueryCoverage =97%, HitCoverage=61%, E-value=7e-25, Identity=47%"; Hit description =msh homeodomain protein, Variable ABnormal morphology VAB-15 (25.2 kD) (vab-15) [Caenorhabditis elegans]
  Essential gene: C elegans homolog=R07B1.1; Phenotype=Unc
NSAPGHLLQHSPSISSPDESKASTSAVETRRSKPTRKNGGEQFMGNKNLNFAISSCMLRKHKNNRKPRTPFSTQQLMALERKFVDKKYLSIADRAEFSSKLKLTEQQVKIWFQVGLANGKKYNNNKFISHHHHQAVAAAAAA

SEQ ID NO: 120365 - protein, 170 aa, Heterodera glycines
  Coding regions on vcDNA: vcDNA=SeqID_46788; Strand=+; Position=1 -159,1245-1495,1573-1654
  Homolog annotation: Hit_ID=NP_741950.1; Match level="QueryCoverage =66%, HitCoverage=60%, E-value=1e-25, Identity=52%"; Hit description =neuralized, possibly N-myristoylated (XR998) [Caenorhabditis elegans] gb|AAM54201.1| Hypothetical protein
  Essential gene: C elegans homolog=F10D7.5a; Phenotype=Emb,Sck,Ste
HTTFPPKPSFSTPPESPQNECTGLQTNSCDFLRKLLKHNKIIPLIKLKINTAGETLSDYDENIINRGTIGRPKPLLKFHSVCGTNIQLLREGRVARRKESFCKGLAFSNRPISINEIVCIRLSEIGTNWSGVMRFGVTNVDPASFGVTNVDPASFRDIELPVLGFFKTKT

SEQ ID NO: 120366 - protein, 276 aa, Heterodera glycines
  Coding regions on vcDNA: vcDNA=SeqID_46789; Strand=-; Position=1 -115,156-277,334-461,832-1006,1050-1109,1154-1221
  Homolog annotation: Hit_ID=CAE70368.1; Match level="QueryCoverage =92%, HitCoverage=88%, E-value=2e-82, Identity=60%"; Hit description =Hypothetical protein CBG16927 [Caenorhabditis briggsae]
  Essential gene: C elegans homolog=C34E7.4; Phenotype=Sma
MLPTALLLCASIVFMTNPSVDAEISIKIERHFPCSAASGPKKENLIIKFPPKKENLIIKFPSYKSTGVAFKEEKDDAGHKCFQMGGGKVEVYAPGLDGNKKYYVYAPGLDGNKKYYVHVETRIGIHGKPERCVNPDKEGCGGIGSCVHCDICQTIGGRQFIQIFKGDKPAECSAKGLPPGTYDNLSLKVCLPSKDELLPFLDQNSSRAEQLWDVFVNSSRAEQLWDVFVSSRARSGEIPLVIAARNVDRPINKLEIPLVIAARNVDRPINKLSIKN

SEQ ID NO: 120367 - protein, 475 aa, Heterodera glycines
  Coding regions on vcDNA: vcDNA=SeqID_46790; Strand=+; Position=1 -304,587-703,761-1767
  Homolog annotation: Hit_ID=NP_508269.1; Match level="QueryCoverage =66%, HitCoverage=46%, E-value=2e-37, Identity=31%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTHVFFDPESVDWSSFITPQHGRGQKQYFVGSKYQRGFGFLGNVARFLTPIARNIASSAGHEGLAAGQRVLSDIAQGRDLRDAVREHSRQGLTNLTDKLQQYNQFCDLNKTFLYLSTSIERKDKSNWIPITKDSEADQHVGVESYDSGIYYAFRAYMMNELGFSEDVKKGLCEASCYYVDDVDQDDYTNSGFKNRASRFADGAKCETMVKLNFDLARQPNLLLNNSDVIFSIHRNTDDFLIMAPPYVSGNAVIANPHTYRINIHDIRIYVKTVDITQSLNNVISNQLQTTPAKYPVRKIEIRSLFIPRGTSDLSHNVFTSIVPRRLIVGFVSTGAYTGNPKESPFVFEHAKIRSISVEANGNIFPGSPYSLNFDRNKYIRAFVDMYTGLGMDDGERTMSINIQKFVNGWCFFVIPMTSTLEDTPGFELIRNGTTSIKVQFNEPIKDGGYEMIVLGEFDSILSINANRVLSSDGSI

SEQ ID NO: 120368 - protein, 515 aa, Heterodera glycines
  Coding regions on vcDNA: vcDNA=SeqID_46791; Strand=-; Position=1 -101,146-226,314-565,660-778,837-940,989-1268,1307-1408,1468 -1569,1630-1842
  Homolog annotation: Hit_ID=NP_502057.1; Match level="QueryCoverage =100%, HitCoverage=32%, E-value=8e-86, Identity=38%"; Hit description= kinase D-interacting substance of 220 kDa like (4L811) [Caenorhabditis elegans] emb|CAA92996.1| Hypothet
  Essential gene: C elegans homolog=F36H1.2; Phenotype=Dpy,Gro,Stp
DQENGNPILPTIFGPIGSDVGMKSLFGFDSYSDVLADVVCDPNLPLVLADVVCDPNLPLPLTIGLYAKWGSGKSLLLPRIRDSMSAFSRTWLDGVELYWSWSLVLSVLLSSVSLSLFISALSALILQNSHFLISLGVGVGIFLLFLLLYGFIYYGSEKKFWNGSIATARLIGRSIARFKLMLNVLFLNAPVRREKSRNSPSPVSFLFADDHRLSFIGGEHSLANIIQSFFTAAEEHFGTLAVHLFTHFGTLAVHLFTTLRSSSPSLLADRSSKLKSYCGVPVLVLTLAFPCSLVSASLLFIQTRHWLASVFLALALVSGAFILYIFSARIFQFGWGSGPKRRITRISDRLHLMPFERMPKRRITRISDRLHLMPFERMIQKLQKEVDLLVSLVFALDEFVFALDEFTSSQTRLVIMVDGLDSCESNKMVQMLDALSLFFCSRQNAPALSLFFCSRQNAPFIVLLAIDPNIVVSTIQQNLHAGPEGGGITGRDYLKNIVTMYVSALSQFFELLGQK

SEQ ID NO: 120369 - protein, 183 aa, Heterodera glycines
  Coding regions on vcDNA: vcDNA=SeqID_46792; Strand=+; Position=1 -98,147-230,271-405,456-531,578-736
  Homolog annotation: Hit_ID=NP_502531.1; Match level="QueryCoverage =93%, HitCoverage=12%, E-value=8e-37, Identity=41%"; Hit description =MutS Homolog, germline specific DNA mismatch repair protein required for crossing over and chiasma format
  Essential gene: C elegans homolog=F09E8.3; Phenotype=Emb
MSYYKTNRMRLLDENIGDIKMQIVDAETNIVLNLQKRILDSKEAVLSAVELAATLDCLISLSVVARKYNWTRPKFVEESIVAIEQARHPIAEHICKDGKYVPNPVHSSTEVGKVKVLSGPNASGKSIYLKMVGSIVYLACCGSFVPAQRATIGPISRILSRLYTIDSVLDGMSSFANDLKQVL

SEQ ID NO: 120370 - protein, 238 aa, Heterodera glycines
  misc_feature (234)..(234): Xaa can be any naturally occurring amino acid
  Coding regions on vcDNA: vcDNA=SeqID_46793; Strand=+; Position=1 -693,1116-1142
  Homolog annotation: Hit_ID=NP_510671.1; Match level="QueryCoverage =94%, HitCoverage=22%, E-value=1e-38, Identity=36%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
MNFNPMEKIGIRGKLLIGIKGFLSNRPFRVKIGDDLSSSKKVGSGVPQGSVLGPLLFLIYINDLPDALPSGVRIKLYADDVKLYICYKARTETEIMHKALHNLSEWANKWQIRISIKNTFVLHLGNKNPKEIYKIGGNIINVVDTIRDLGINIDNKLQFSNHVTQIIKNAYYERSLFRIIKSKSSRIWIILYKTYVRPLLEYAPEVWNLSIQKNIKKIEKCQKYFTKKIYLIAXNKIT

SEQ ID NO: 120371 - protein, 156 aa, Heterodera glycines
  Coding regions on vcDNA: vcDNA=SeqID_46794; Strand=+; Position=1 -115,174-239,338-516,1046-1156
  Homolog annotation: Hit_ID=NP_499681.1; Match level="QueryCoverage =82%, HitCoverage=73%, E-value=5e-51, Identity=69%"; Hit description =cytochrome c oxidase Va (20.1 kD) (3N995) [Caenorhabditis elegans] emb|CAA21532.1| Hypothetical protein Y
  Essential gene: C elegans homolog=Y37D8A.14; Phenotype=Emb,Lva
MFSIVGKKVFNTTSCNFLSKAFYAHMSKDEIMWHWPAQKFDQHFIDYLNKPDIDGWEIRKALTELGNFDVVPDPKVVEAALRAIRRVNDFALAIRFLEQIKYKCGGPKSRSIVYPYIIQEVKPVMDELGIPTLEELGYDEPEFFTPDPEWYWEKSW

SEQ ID NO: 120372 - protein, 169 aa, Heterodera glycines
  Coding regions on vcDNA: vcDNA=SeqID_46795; Strand=+; Position=1 -110,617-740,823-1029,1183-1251
  Homolog annotation: Hit_ID=NP_497700.1; Match level="QueryCoverage =70%, HitCoverage=69%, E-value=2e-49, Identity=81%"; Hit description =myosin light chain (19.9 kD) (mlc-4) [Caenorhabditis elegans] emb|CAA86772.1| Hypothetical protein C56G7.
  Essential gene: C elegans homolog=C56G7.1; Phenotype=Emb
MGGPVGLLLNAQPMAEILCVWIWGFGVSVRSDRDKHKQITFYCLCYSMAARKTVARRARPQRATSNVFAMFDQPQIQVEFKEAFNMIDQNHDGFIDEHDLKDMFASLGKEVSEKFIENMVNDASGSINFTMFLTLFGEKLTGTDPEEVIKNAFQCFDEDNSGTIAEGWT

SEQ ID NO: 120373 - protein, 229 aa, Heterodera glycines
  misc_feature (1)..(1): Xaa can be any naturally occurring amino acid
  Coding regions on vcDNA: vcDNA=SeqID_46796; Strand=-; Position=1 -212,260-338,395-529,576-686
  Homolog annotation: Hit_ID=AAH88726.1; Match level="QueryCoverage =91%, HitCoverage=29%, E-value=8e-31, Identity=39%"; Hit description =Unknown (protein for MGC:99401) [Xenopus laevis]
  Essential gene: C elegans homolog=C05C8.6; Phenotype=Lva
XDCVASSILFNITNYFIAISSGGEIQHTSQLVEQIASLHLNDEFSDFVLVVDDQRFPVHRVVLAARSSYFKAMLYGGMRESSESEVILHDTAMLYGGMRESSESEVILHDTPVQAFQALLKYIYTGKLQLKSALLKYIYTGKLQLKSFELSFVLDMLALVHKYGFSELEAAIPEYLKTILKVRNVCSIFTVATILKVRNVCSIFTVAHLYSIEGLSAACLDFIDNYASD

SEQ ID NO: 120374 - protein, 359 aa, Heterodera glycines
  Coding regions on vcDNA: vcDNA=SeqID_46797; Strand=-; Position=1 -62,119-160,258-375,558-656,710-910,960-1147,1191-1399
  Homolog annotation: Hit_ID=NP_741237.1; Match level="QueryCoverage =98%, HitCoverage=38%, E-value=1e-118, Identity=62%"; Hit description= CaLPain family member (clp-1) [Caenorhabditis elegans] gb|AAM15551.1| Calpain family protein 1, isoform
  Essential gene: C elegans homolog=C06G4.2a; Phenotype=Ced
IDDRLPCSMEGELLYMHSQELNENEFWSALLEKAYAKLYGSYEALKGGTTSEALEDMTGGLTEFFDLQQPSENLMQMMARGFEMGSLFGCSIEADPQVWEARLPNGLVKGHAYSGHAYSITGMRIVPTPRGEVPLLRIRNPWGNDQEWNGPWSDNSSEWRQLSNELKTDMGLTFAHDGEFWMSFSDFLSNFEKMEICNLGPEFWMSFSDFLSNFEKMEICNLGPEVMEEIYEMTGVKATPHNAWATVAHDGSWRAGRTAGGCRNNLRTFALNPQFRMKLTDSDPNDDDKLCLRTFALNPQFRMKLTDSDPNDDDKLCTVIIAVMQKYRRELKNTGVENLAIGFAVYEATLSRGGGGGET

SEQ ID NO: 120375 - protein, 331 aa, Heterodera glycines
  Coding regions on vcDNA: vcDNA=SeqID_46798; Strand=-; Position=1 -129,183-275,1090-1405,1543-1735,1982-2133,2178-2289
  Homolog annotation: Hit_ID=AAK26378.1; Match level="QueryCoverage =97%, HitCoverage=90%, E-value=1e-163, Identity=87%"; Hit description= putative zinc finger protein [Heterodera glycines]
  Essential gene: C elegans homolog=Y53G8AR.9; Phenotype=Rup
MTNERDFSHDDHINNAIGTNGDSKDAAKRKDICRDFLNNICSRGNRCKFYHPEDSVEKNQNSADEPYQFCIDFQNQGCYRENCRYVHAFREDVDRYKRSGDVTLGLARALAALLKGDTINGIPLCKEFQNGHCARGPQCRYWHINRDEERRKRFGGGRNCGGSPSSLAFGAYPAVPPAGAQLSRRRGDEFVSEDFAPPSKRSFAHNQPFATIPGQMAPTSAPTAPSHPSPQLVIELERRNAELTVNLNPKNCLISLFIGSTEVESLKRELNREKERYDDLMSLFRAAQGQPTVQPKHFFTKRASTTTSAAVSAAVERNVNIATAKLDKIRL

SEQ ID NO: 120376 - protein, 95 aa, Heterodera glycines
  Coding regions on vcDNA: vcDNA=SeqID_46799; Strand=+; Position=1 -218,345-416
  Homolog annotation: Hit_ID=NP_508413.1; Match level="QueryCoverage =90%, HitCoverage=47%, E-value=2e-28, Identity=68%"; Hit description =ribosomal Protein, Large subunit (22.8 kD) (rpl-11.2) [Caenorhabditis elegans] gb|AAA83599.1| Ribosomal p
  Essential gene: C elegans homolog=F07D10.1; Phenotype=Lva
KEYELTARIFGHWHFGFGIQEHIDLGIKYDPSIGIYGMDFYVVLGRAGLRVAKRRRIQGRIGASHRVQKEEAYDGVILPPKPKESRKGGHRGRKR

SEQ ID NO: 120377 - protein, 307 aa, Heterodera glycines
  Coding regions on vcDNA: vcDNA=SeqID_46800; Strand=+; Position=1 -98,164-307,370-415,639-767,816-923,969-1016,1359-1577
  Homolog annotation: Hit_ID=NP_492222.2; Match level="QueryCoverage =97%, HitCoverage=11%, E-value=1e-50, Identity=41%"; Hit description =j-domain containing protein, required for endocytosis, Receptor Mediated Endocytosis RME-8 (259.2 kD) (rm
  Essential gene: C elegans homolog=F18C12.2a; Phenotype=Emb,Lva,Unc
CVCAFSVCTLQTLFKGVIWLLPHLFLDYTQFQGVAHSEKTNHQAVLNRLARNCCEALACLAGFRPDTPDNDGVQKSLRAMLTPFICRQLRAMLTPFICRQMQLCRNDFVLKLLNANTEDPYLIWDNSTRAELLDFVDKQRNSHENVSEMFGAEFKLSIYATELVVGEIFVSEMFGAEFKLSIYATELVVGEIFVRIYNAQPEFRLLEPKRTCMDFLDYLEPKRTCMDFLDYLSKHEADLIDLTTEFVVEEEHPAVDGRFANVNASNPEITTHSSTFGTVNPNGAFRGVAFSPGIGFRMVLEALRIVL

SEQ ID NO: 120378 - protein, 47 aa, Heterodera glycines
  Coding regions on vcDNA: vcDNA=SeqID_46801; Strand=+; Position=1 -81,142-201
  Homolog annotation: Hit_ID=CAE65142.1; Match level="QueryCoverage =100%, HitCoverage=23%, E-value=2e-10, Identity=59%"; Hit description= Hypothetical protein CBG10008 [Caenorhabditis briggsae]
  Essential gene: C elegans homolog=T05G5.10; Phenotype=Emb
LLSTNEDGFISLMDLETCDTKDDLRLPEGEIGDQIKQAYEKDDNGIL

SEQ ID NO: 120379 - protein, 100 aa, Heterodera glycines
  Coding regions on vcDNA: vcDNA=SeqID_46802; Strand=+; Position=1 -87,314-396,1036-1167
  Homolog annotation: Hit_ID=AAP48704.1; Match level="QueryCoverage =61%, HitCoverage=28%, E-value=7e-27, Identity=95%"; Hit description =rab11-2 [Limulus polyphemus]
  Essential gene: C elegans homolog=F53G12.1; Phenotype=Emb,Ste
YYRGAVGALLVYDIAKHLTYENVERWLKELRDHSDQNIVIMLVGNKSDLRHLRAVPTSAARPNGADQQPEQHHAVLHHGQQGEEGVLFLHLIVCDDGRMV

SEQ ID NO: 120380 - protein, 151 aa, Heterodera glycines
  Coding regions on vcDNA: vcDNA=SeqID_46803; Strand=-; Position=1 -105,162-257,315-569
  Homolog annotation: Hit_ID=CAE60248.1; Match level="QueryCoverage =94%, HitCoverage=35%, E-value=9e-20, Identity=41%"; Hit description =Hypothetical protein CBG03822 [Caenorhabditis briggsae]
  Essential gene: C elegans homolog=T23D8.3; Phenotype=Lva
MEIGKGRAEPTEDILVDSAKRSRWDCESILSMHSTLYNHPTEIREPMKGIGRRRGRTTKEKGMANLEEMEVDGDQRDGPPAPSVRTRTSMVSVIRPKGETTEERRIRKIAVKEERRERRKEKKANKQLFRVERLKLDEQQRTNQPKTRQIH

SEQ ID NO: 120381 - protein, 125 aa, Heterodera glycines
  Coding regions on vcDNA: vcDNA=SeqID_46804; Strand=-; Position=1 -88,135-154,322-385,436-572,1530-1598
  Homolog annotation: Hit_ID=NP_510560.1; Match level="QueryCoverage =78%, HitCoverage=28%, E-value=4e-17, Identity=40%"; Hit description =putative cytoplasmic protein family member of ancient origin (XQ115) [Caenorhabditis elegans] emb|CAC7009
  Essential gene: C elegans homolog=H13N06.3a; Phenotype=Gro,Slu
MATLLQDNEYAHFALIGSGVQRKVDRLTLGVQTVSKFLHFAPSNGCEVEVMVHEQGKVWTKAKGMAKIVGTLGESLEKGTVLICGDTHSDLPMVEFGKSKNSTMMTVLLKAKKMAEVDSELGGKN

SEQ ID NO: 120382 - protein, 246 aa, Heterodera glycines
  Coding regions on vcDNA: vcDNA=SeqID_46805; Strand=-; Position=1 -205,364-580,1145-1253,1298-1507
  Homolog annotation: Hit_ID=AAF19802.1; Match level="QueryCoverage =93%, HitCoverage=68%, E-value=1e-25, Identity=29%"; Hit description =N-myristoyl transferase [Brassica oleracea]
  Essential gene: C elegans homolog=T17E9.2a; Phenotype=Emb
MADDDKTLEQKEDETQNDLSDEKPQMNDDEKQQIAKSLAAKGKPKRKNVKNDVEPIQINSDMAAAEFAHTTTTENNYIDPPLDVSTIKKDPYSLLEKFIWSDIDLNADEQLDELYILLTENYVEDDANMFRFDYGKNFLKWYWHRSLNPKKLVESSFSHIGKNMTLPRMIKLYKLPENTESQLTLLNRDSAKSAFELLSGYLTKFDLVPIFTIEEFEHFFLPRDDVIYTYMIQVGKPTDKSRDGGQ

SEQ ID NO: 120383 - protein, 87 aa, Heterodera glycines
  Coding regions on vcDNA: vcDNA=SeqID_46806; Strand=+; Position=1 -85,499-676
  Essential gene: C elegans homolog=T16H5.1a; Phenotype=Sck,Sma
RSVIDADERERVVGAVARTFVEMLDLREIQNRPHPYASSLARFNPIRLMNGHLVCSLYLFTKVCYSVNIMLQFALLNAALTSKDHFL

SEQ ID NO: 120384 - protein, 369 aa, Heterodera glycines
  Coding regions on vcDNA: vcDNA=SeqID_46807; Strand=-; Position=1-1110
  Homolog annotation: Hit_ID=NP_498735.1; Match level="QueryCoverage =94%, HitCoverage=82%, E-value=4e-44, Identity=32%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MRKLTPPNGEWGHLDATDQVVPIQLIRHTFMRDLKIAINGREIFNSNSLMAYKTYLSHELSQSLEAKVSHLTAAGYDREDASNLQNANSEGFKSRRQRYLGGRTAQYIAKIDADLFNVPQYLINHCEIDITIQPHDDNFLLIDTLDPPGQPYSLELVGLKLYCKKVSLMDGLALELAKKLEMKPARYAVRKTMMKALFISPGRYEFNANLFMDQVPRRVTMGLVANSDYVGNIKRSPFNFQHFNVRELSVVANGRSYPQAPYDIDYENWKFVRPYNDTQEALGFANSTYGNGIDYFSFLHTHCIYVFNMTNSGDDHGGLFDLIKKGCTAVNIKFKKPVPDGGITLIVMGEADSIYFLDKNRTIATDTTI

SEQ ID NO: 120385 - protein, 181 aa, Heterodera glycines
  Coding regions on vcDNA: vcDNA=SeqID_46808; Strand=+; Position=1 -169,214-439,483-633
  Homolog annotation: Hit_ID=NP_496338.1; Match level="QueryCoverage =100%, HitCoverage=100%, E-value=2e-60, Identity=61%"; Hit description=i-120 protein (20.8 kD) (2L163) [Caenorhabditis elegans] emb|CAA85416.1| Hypothetical protein F59E10.3
  Essential gene: C elegans homolog=F59E10.3; Phenotype=Emb,Ste
MVDFDTSSLYSVKAILILDQDGKRIMAKYYDKQLFPLEKEQNVFEKNVFQKTHKANADIILLDGLVCLYRYNVDLFFYVVGSANENELILQSVLNCLYEAFSTILRKNVEKKALFEHIDTSFLIMDEICDDGIILETDPQAVVARCAVKADELAFGEQSISQVGMSLLGSAKDQLKWSLLK

SEQ ID NO: 120386 - protein, 118 aa, Heterodera glycines
  Coding regions on vcDNA: vcDNA=SeqID_46809; Strand=+; Position=1 -72,123-217,268-454
  Homolog annotation: Hit_ID=NP_491654.1; Match level="QueryCoverage =100%, HitCoverage=21%, E-value=3e-51, Identity=80%"; Hit description= CBF1 interacting corepressor (65.8 kD) (1G222) [Caenorhabditis elegans] gb|AAB37808.1| Hypothetical prot
  Essential gene: C elegans homolog=F55F8.4; Phenotype=Emb
MGKGFQNFMSKKDFHPSAWWNLKRKWEAEQKNDLEKRRQDELRVQYEKEQEILNNKALLGDEKARLGLSFMYDAPAGINKKKEEGPEPKFEWQRKYNAPREEWAKGNELIQDQPFGIQ

SEQ ID NO: 120387 - protein, 129 aa, Heterodera glycines
  Coding regions on vcDNA: vcDNA=SeqID_46810; Strand=-; Position=1 -176,227-326,897-1010
  Homolog annotation: Hit_ID=NP_499867.1; Match level="QueryCoverage =52%, HitCoverage=80%, E-value=7e-11, Identity=45%"; Hit description =putative Golgi protein (10.2 kD) (4A881) [Caenorhabditis elegans] gb|AAC19190.1| Hypothetical protein F29
  Essential gene: C elegans homolog=F29C4.2; Phenotype=Gro
MSAPAAKLPRPPEHMLRYMAHIRAKSLVFCAMGVSGLIGLSFYFFYVEVRRKAYMEFGKNYNPYQRMREICEYPVKYMHSCPSELAKRLEEKGVLIGDRDYSIPLDDVVPESRKKEFMMANAFERFMNR

SEQ ID NO: 120388 - protein, 239 aa, Heterodera glycines
  Coding regions on vcDNA: vcDNA=SeqID_46811; Strand=+; Position=1 -144,278-357,439-570,616-925,1024-1077
  Homolog annotation: Hit_ID=NP_496497.1; Match level="QueryCoverage =72%, HitCoverage=23%, E-value=4e-76, Identity=73%"; Hit description =threonyl tRNA Synthetase (84.4 kD) (trs-1) [Caenorhabditis elegans] emb|CAA93762.1| Hypothetical protein
  Essential gene: C elegans homolog=C47D12.6a; Phenotype=Emb,Lva
MAHLAGGGGQAGPPQIGPRPGTVHVPPAESGHCLLVPEGDAHLQHTARVISPNIYNAKLWEQSGHWHHYAENMFRFEIEKEQFGLKPMNCPGHCLMFDYKPHAYNELPIRYADFGVLHRNEMSGALSGLTRVRRFQQDDAHIFCRKDQILSEISGCLDFLNFVYVEVFGFSFRLHLSTRPEEGYLGDLATWEAAETQLKQALDNSGLKWELNPGDGAFYGPKSKGWNTFTYISSYTMNN

SEQ ID NO: 120389 - protein, 218 aa, Heterodera glycines
  Coding regions on vcDNA: vcDNA=SeqID_46812; Strand=+; Position=1 -91,140-289,354-589,645-821
  Homolog annotation: Hit_ID=CAE69180.1; Match level="QueryCoverage =100%, HitCoverage=63%, E-value=2e-82, Identity=69%"; Hit description= Hypothetical protein CBG15213 [Caenorhabditis briggsae]
  Essential gene: C elegans homolog=F20H11.3; Phenotype=Emb,Gro
VTLIGASGGIGQPLGLLLKKNPSIAHLALYDLVGTPGVAADLSHINTQAKVTGHLGPDQLVAALEGADVVIIPAGVPRKPGMTRDDLFTTNAGIVRDMAEAAAKTCPKAFMGIITNPVNSTLPIACEVYKNNDCFDPRRIFGVTLLDIVRAQAFVSELKGLDVSQTKVSVVGGHSGVTIVPLLSRCTPKVSLSDSETKALTERIQEAGTEVVKAKAGA

SEQ ID NO: 120390 - protein, 118 aa, Heterodera glycines
  Coding regions on vcDNA: vcDNA=SeqID_46813; Strand=-; Position=1 -54,102-176,394-438,544-658,703-770
  Homolog annotation: Hit_ID=NP_505007.1; Match level="QueryCoverage =99%, HitCoverage=100%, E-value=5e-29, Identity=56%"; Hit description= ribosomal Protein, Small subunit (14.0 kD) (rps-30) [Caenorhabditis elegans] gb|AAB37076.1| Ribosomal pr
  Essential gene: C elegans homolog=C26F1.4; Phenotype=Gro
MQIFVKTLTGKTITLEVEASDTIENVKAKIQDKEGIPPDQQRLKESTLHLVLRLRGGKVHGSLARAGKVRAQTPKVEKQEKKKKKRGRAFRRIQYKRRYVNVAAAGPGRRRGPNSNAA

SEQ ID NO: 120391 - protein, 386 aa, Heterodera glycines
  Coding regions on vcDNA: vcDNA=SeqID_46814; Strand=+; Position=1 -114,163-402,448-572,617-829,876-1020,1065-1136,1437-1687
  Homolog annotation: Hit_ID=XP_395392.1; Match level="QueryCoverage =96%, HitCoverage=39%, E-value=1e-156, Identity=63%"; Hit description= similar to CG13391-PA [Apis mellifera]
  Essential gene: C elegans homolog=F28H1.3; Phenotype=Emb,Lva,Unc
MEQEQQQNVHHSGREVRQMFIDFFVKEKAHKYYHSSSVIPHEDPTLLFTNAGMNQFKPIFQETVDPNSDMAKLKRAVNTQKCIRAGGKHNDLDDVGKDVYHHTFFEMLGNWSFGDYFKREICTWAYQFLTEWLHISSERLYVSFFGGDLANNLLPDEECRQIWLDIGVPSEHILPFGMKDNFWEMGETGPCGPCSEIHYDRIGGRDAAHLVNADDPMVVEIWNLVFIQFNREEGGVLKSLPNKHIDCGLGFERLVAVAQQKTSNYDTDLFTPIFSAIQEGTGAREYTGKVGSEDVDGVDMAYRGDTFPELRKDPSSAMEIINEEEAQFLKTLRRGHVLFEKAVNALPSGNKTFPGSIAWRLYDTYGFPIDLTQLMAEEKGLTVQMD

SEQ ID NO: 120392 - protein, 110 aa, Heterodera glycines
  Coding regions on vcDNA: vcDNA=SeqID_46815; Strand=+; Position=1 -68,543-629,684-845
  Homolog annotation: Hit_ID=CAE70260.1; Match level="QueryCoverage =99%, HitCoverage=26%, E-value=4e-41, Identity=74%"; Hit description =Hypothetical protein CBG16761 [Caenorhabditis briggsae]
  Essential gene: C elegans homolog=C53C9.2; Phenotype=Gro
EYTPWYSGQFASQKGSGGFMKVRDVLPHSQGGKDIPEDDKLKSEGIVRLQSGTNKLSGTNKLASQRGMTGFGTPRNTMSKMGWKKEWVEEYEAAMREFEEQRPPGSASSD

SEQ ID NO: 120393 - protein, 93 aa, Heterodera glycines
  Coding regions on vcDNA: vcDNA=SeqID_46816; Strand=+; Position=1 -23,698-882,1022-1093
  Homolog annotation: Hit_ID=CAE65943.1; Match level="QueryCoverage =97%, HitCoverage=15%, E-value=9e-28, Identity=59%"; Hit description =Hypothetical protein CBG11120 [Caenorhabditis briggsae]
  Essential gene: C elegans homolog=C34C6.4; Phenotype=Ste
VAGQNVADQKLLDFIQKCTKPITLYNKSTWRHPHRMVINGLQWFLTKKGLAATSHLESGGFARSSTEVSHPDLQFHFLPSTVHEDGRQSPNCH

SEQ ID NO: 120394 - protein, 211 aa, Heterodera glycines
  misc_feature (10)..(10): Xaa can be any naturally occurring amino acid
  Coding regions on vcDNA: vcDNA=SeqID_46817; Strand=+; Position=1 -59,1703-1975,2283-2336,2395-2520,2615-2705
  Homolog annotation: Hit_ID=CAE59974.1; Match level="QueryCoverage =91%, HitCoverage=52%, E-value=2e-55, Identity=55%"; Hit description =Hypothetical protein CBG03465 [Caenorhabditis briggsae]
  Essential gene: C elegans homolog=F32B6.3; Phenotype=Gro
GTLFVCTIFXYIVMKIYSLDEFRFCQMMAPLLGSGNDADCDLIRAFLSYILKRWGKELNAREESIKRSATGKMQAGMHKQTVEHLSPLMKSLEKYTVNNDIRLYLTNITKLCVVERNYIVASTAYMEMSIGNAPWPVGVSIGNAPWPVGVTRSGIHQRPGSSKAYVSNVAHVMNDETQRKYSNRFFRIMSKCQEFFPTDPSKCMEFVKNKS

SEQ ID NO: 120395 - protein, 366 aa, Heterodera glycines
  Coding regions on vcDNA: vcDNA=SeqID_46818; Strand=+; Position=1 -177,224-365,434-540,607-784,838-1153,1455-1635
  Homolog annotation: Hit_ID=CAE67776.1; Match level="QueryCoverage =58%, HitCoverage=17%, E-value=2e-22, Identity=32%"; Hit description =Hypothetical protein CBG13351 [Caenorhabditis briggsae]
  Essential gene: C elegans homolog=C08B11.3; Phenotype=Emb
MHFYQIKLVDKLSTVLLNTVQKGLHSDDKCKVMRSMEIVAGLCATPTNESIVCEFFEESQIIPRIFALLSLKDILMCMCAMESVLAISELGRVACEAVARCDRAVQMLVGFLTTDALSFGTVGLAGMHVVEVHGHQTRPYVAPNKKNPPPPLKLQPVQPPVQYAQQRHQTPASSTTTTAPPFGEAMEFAINARTDTLETCPDAFQRRATDGNDSAQFASHQRHPPTRKKVYLKSSRLPFLNHRQQLATDAPPLQNGLSSIAAAVPSSIESVANERDFMCEWLMQSEGDDDWSDEEGTAAGPIEPCARFFASASQMLFHVYNEHLVPLVQQHSDGEPPRIRCRWPICDNTPRTLWSITTHLQVNNDE

SEQ ID NO: 120396 - protein, 138 aa, Heterodera glycines
  Coding regions on vcDNA: vcDNA=SeqID_46819; Strand=-; Position=1 -156,363-449,850-905,954-1071
  Homolog annotation: Hit_ID=1A35; Match level="QueryCoverage=100%, HitCoverage=36%, E-value=5e-32, Identity=44%"; Hit description=Chain A, Human Reconstituted Dna Topoisomerase I In Non-Covalent Complex With A 22 Base Pair Dna Duplex
  Essential gene: C elegans homolog=M01E5.5a; Phenotype=Lva,Unc
MDDLKYVWEFDFSAKDSIRYYNRVPVEKQVFKNLKLFMEEKDPGDDLFDRLDLPIPSTRKCFPTIVKPLVQRHFTYIAYIQDENKQIALGTSKLNYLDPRISVAWCKKNDVPVEKIFSKTQRDKFRWALDMAKEDFIF

SEQ ID NO: 120397 - protein, 128 aa, Heterodera glycines
  Coding regions on vcDNA: vcDNA=SeqID_46820; Strand=+; Position=1 -237,304-453
  Homolog annotation: Hit_ID=AAO85519.1; Match level="QueryCoverage =99%, HitCoverage=40%, E-value=2e-27, Identity=49%"; Hit description =putative serine/threonine phosphatase [Oesophagostomum dentatum] gb|AAO85518.1| putative serine/threonine
  Essential gene: C elegans homolog=W09C3.6; Phenotype=Ste
MHGGISDQIQSLDQLSNLLRPQTDPPLRSLEIDLLWADPSKSITGVAPNSRGAGVMFGADVVESVRNLLGIDYIVRAHQLVMDGVEYFADRHLITLFSAPRYTGKNNTGATLLIAPDLSHTITRFPPA

SEQ ID NO: 120398 - protein, 71 aa, Heterodera glycines
  Coding regions on vcDNA: vcDNA=SeqID_46821; Strand=+; Position=1 -76,117-192,311-374
  Homolog annotation: Hit_ID=XP_317466.1; Match level="QueryCoverage =98%, HitCoverage=51%, E-value=6e-16, Identity=55%"; Hit description =ENSANGP00000012302 [Anopheles gambiae] gb|EAA12435.2| ENSANGP00000012302 [Anopheles gambiae str. PEST]
  Essential gene: C elegans homolog=H06I04.4a; Phenotype=Ste
CQLVDGTLLRTYGVDADSTIHLDLRLLGGGKKRKKKQYTGPKKQKHVRKKIDDNGKIHRQRLECNFASCGA

SEQ ID NO: 120399 - protein, 92 aa, Heterodera glycines
  Coding regions on vcDNA: vcDNA=SeqID_46822; Strand=-; Position=1-278
  Homolog annotation: Hit_ID=NP_498869.1; Match level="QueryCoverage =100%, HitCoverage=17%, E-value=1e-10, Identity=40%"; Hit description= proteasome Regulatory Particle, Non-ATPase-like, S3 (57.5 kD) (rpn-3) [Caenorhabditis elegans] gb|AAA279
  Essential gene: C elegans homolog=C30C11.2; Phenotype=Emb
STEQEAHRELVKAIKEGIVRAQLVAGDPLAGGRHYVKFGTTDDQYRGVEPRREFDARVNELLELYHQAVKALRYPDMRNPEVETIDEQRRRE

SEQ ID NO: 120400 - protein, 191 aa, Heterodera glycines
  Coding regions on vcDNA: vcDNA=SeqID_46823; Strand=-; Position=1 -118,173-399,445-672
  Homolog annotation: Hit_ID=NP_501800.1; Match level="QueryCoverage =99%, HitCoverage=15%, E-value=7e-41, Identity=46%"; Hit description =UBA (human ubiquitin) related, UBiquitin Activating enzme related (124.1 kD) (uba-1) [Caenorhabditis eleg
  Essential gene: C elegans homolog=C47E12.5; Phenotype=Emb
MTTLEGAFHQLEDGDHVVFTDFEHAELNELPPVPVTLKGSKVFNIGNALAAFSGAVQGPVSRGRVQQVKVPKKMSFKPLSRALAEPDFMIWDFAKFDEPAQLHALWQALYSFEEMKNYSPLPRSDADAKLLKEMLPKDAPEMPDSLLFNFSYQVPCATFNFEFLPVFKACGNLQPIASLIGGLVAQEAMKA

SEQ ID NO: 120401 - protein, 336 aa, Heterodera glycines
  Coding regions on vcDNA: vcDNA=SeqID_46824; Strand=-; Position=1-1011
  Homolog annotation: Hit_ID=NP_498735.1; Match level="QueryCoverage =99%, HitCoverage=79%, E-value=4e-45, Identity=32%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MIGQTFIRNIKMSINGREVFNSNSLMAYKTYFSHELSYSTTAKDSHLNAAGYYRDTGGTLETGDGCIARRNLFAGSRTAQFIAKIDADLFNQPLYLINFCELDIEVLPNDNNFLLITTLAAAPRYHFEVVGLKMYVKKISLMDGLALDIARKLEVKPARYAVRKTLMKSMFISPGRFEFTANLFMDQIPRRITMGLVANSDYIGTISRSPFNFQPFNVREISIVANGRSFPQAPYDLDYPNLKYVRPFNDMNEAVGFANSLESNGISYEQFGKTHCIYVFNLTNSGDDQAALFDLIKNGTTAVSIKFKQPVPAGGIMLVVMGECDSLVMLDKNRSN

SEQ ID NO: 120402 - protein, 519 aa, Heterodera glycines
  Coding regions on vcDNA: vcDNA=SeqID_46825; Strand=+; Position=1 -285,577-1770,2163-2243
  Homolog annotation: Hit_ID=NP_498735.1; Match level="QueryCoverage =75%, HitCoverage=93%, E-value=1e-51, Identity=32%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MVHIVFDPSNAGYDEYVQYGSGVEIEDYFKGSSPFQRGYGAQHGAGVGDVFRGIWRFFLPILRRVGTTVGSEALSTGQRVLDRVGNEGLPIKEALLLPSNPLADTPYHFKLHSSQNFIDLSKCYLLTEFRIRKENENGQLVNITAADEEVAPIQMLGHTFIKNMRMSINGREIFNSNSLMAYKTYFSHELSYSTAAKDSHLNAAGYYKDTSLVLETNSGCALRRNLFTESKTAQFVAKIDADLFNQPMYLINFCELDVEILPNDTNFLLISPTYAGTRFHLELVGLKMYVKKVSLMDGLALDIARKLEAKPARYAVRKTLMKSMFISPGRFEFNANLFMDQIPRRITMGLVGNADYVGNIMRSPFNFQPFNVREISIIANGRSFPQAPYDLDYPNGKYVRAFNDMNEAVGFSNSNESNGITFAQFGKTHCIYVFNMTNSGDDQAALFDLIKNGTTAVSIKFNEAVPVGGVMLVVMGECDSLVMLDKNRSISTDRNGQQTNYEDFDGKSIHRTGLSGVLR

SEQ ID NO: 120403 - protein, 385 aa, Heterodera glycines
  misc_feature (8)..(8): Xaa can be any naturally occurring amino acid
  misc_feature (13)..(13): Xaa can be any naturally occurring amino acid
  Coding regions on vcDNA: vcDNA=SeqID_46826; Strand=-; Position=1 -166,216-389,655-747,810-1006,1612-1766,1869-1967,2218-2441
  Homolog annotation: Hit_ID=CAE62148.1; Match level="QueryCoverage =92%, HitCoverage=51%, E-value=1e-108, Identity=55%"; Hit description= Hypothetical protein CBG06194 [Caenorhabditis briggsae]
  Essential gene: C elegans homolog=B0495.4; Phenotype=Lva
YINYIFIXIKKFXNKIELIYFYIKSTFQLLIFDWNEVSTAYSISAWLLLASMSKLFFHVNKFHVNKRIAEALPDSALLIALGFVLGFILRLCQIDHRIYMLQSPIFFLYLLPPIIFDAGFFMPNRQLFENFDSILLFAFVGTIWNTIAIGYSLNWMGYSLNWMGQVGFFSVPFTTFQILLFASLISSVDPVAVIGIFEEIRVNEFLFINVFGEALFNDGAAVTLYKMFQEFTNIGPYNLHAMDYIEGILSFFVISIGGCILGLFFAALTCIATKYTHVRLIAPIFVFVVPYMSYLTAEMFGISSILAITACTIAMKQFVKGNLSHDAYSSVKYFTKMLAQCSETVIFLFLGFSLVSREYTWDWTFVCSTIAFCLIHRTVGKIMPL

SEQ ID NO: 120404 - protein, 58 aa, Heterodera glycines
  Coding regions on vcDNA: vcDNA=SeqID_46827; Strand=-; Position=1 -165,335-346
  Homolog annotation: Hit_ID=CAE65135.1; Match level="QueryCoverage =94%, HitCoverage=33%, E-value=5e-20, Identity=81%"; Hit description =Hypothetical protein CBG10001 [Caenorhabditis briggsae]
  Essential gene: C elegans homolog=R10E11.8; Phenotype=Ste
MAGIVAIYGLVVAVIISGRLEAAGPGYTIDRGFSQFAAGLVCGLCGLGAGYAIGVVYI

SEQ ID NO: 120405 - protein, 238 aa, Heterodera glycines
  misc_feature (229)..(229): Xaa can be any naturally occurring amino acid
  Coding regions on vcDNA: vcDNA=SeqID_46828; Strand=+; Position=1 -126,612-660,725-844,1104-1201,1266-1386,3081-3228,3890-3909
  Homolog annotation: Hit_ID=CAE68338.1; Match level="QueryCoverage =87%, HitCoverage=46%, E-value=9e-39, Identity=42%"; Hit description =Hypothetical protein CBG14059 [Caenorhabditis briggsae]
  Essential gene: C elegans homolog=T14F9.4a; Phenotype=Unclassified
HHKIEKPHSPLPPFFASFFFLCRFAALNFKPLASEERHKKIYFHAYNPDLPQIITSFKGNQKLILGGNQKLILGGFRYNIHHIEGVKTWRCVCAKKLTGTRSWCKGRAETWDNDSKGIPKGEHNHSTEHELAELEFFKSQMILASQMILAAISEPTADLSTLIDEAAKFLSEGLNFGNRESMKKSQQNRNEKEGTEKRKVRMKSNEKEKTKIEREREENIIDKREKSNXLINFLFFIN

SEQ ID NO: 120406 - protein, 202 aa, Heterodera glycines
  Coding regions on vcDNA: vcDNA=SeqID_46829; Strand=-; Position=1 -171,545-659,1006-1067,1126-1268,1334-1449
  Homolog annotation: Hit_ID=NP_501365.1; Match level="QueryCoverage =99%, HitCoverage=58%, E-value=8e-84, Identity=70%"; Hit description =p38 Map Kinase (43.9 kD) (pmk-1) [Caenorhabditis elegans] gb|AAB00664.1| P38 map kinase family protein 1
  Essential gene: C elegans homolog=B0218.3; Phenotype=Unclassified
MGADLSNILKIQRLSDEHIQFLVYQILRALKYIHSAGIIHRDLKPSNIAVNEDCELKILDFGLARHADQEMTGYVATRWYRAPEIMLNWMHYTQTDIDQLTRIMSVCGTPNDEFLKKISSEEARNYIRNMPRMERKDFKKFFANATPEAVDFLEKTLNLDPDYRPTAEQAMEHVYFKQYHDPNDEPTADGHIEVDIEQELSI

SEQ ID NO: 120407 - protein, 162 aa, Heterodera glycines
  Coding regions on vcDNA: vcDNA=SeqID_46830; Strand=-; Position=1 -152,812-1011,1458-1589,1776-1781
  Homolog annotation: Hit_ID=AAF17203.1; Match level="QueryCoverage =90%, HitCoverage=33%, E-value=9e-43, Identity=56%"; Hit description =SKD1 protein [Homo sapiens]
  Essential gene: C elegans homolog=Y34D9A.10; Phenotype=Emb,Lva,Lvl,Unc
HLHTLLKNDNRTAKGHELVTKATEEDKTKNYEEALRLYTGSCEYFMHALKYECQADRQKETIRLKITEYMNRAENLKAFLRDGGERTKRARPVKENEKDSSGDEADASDENKKFQKAMSKAIIVEKPNVVWEDIAGLEDAKRALKEAVILPIKFPHIFKGTH

SEQ ID NO: 120408 - protein, 138 aa, Heterodera glycines
  Coding regions on vcDNA: vcDNA=SeqID_46831; Strand=+; Position=1 -271,708-852
  Homolog annotation: Hit_ID=CAE72447.1; Match level="QueryCoverage =87%, HitCoverage=19%, E-value=6e-40, Identity=61%"; Hit description =Hypothetical protein CBG19617 [Caenorhabditis briggsae]
  Essential gene: C elegans homolog=Y110A2AL.14; Phenotype=Emb
ECSPYSYFCNTNFLHHFFSFAIDSVQFSFLLKADGDSFVRLGALLHALRSVAHPFLYWGFLDGRARPQRAVGGKWREEQWRLCDRYLPYQLGGGYVLSHALASFLHLNRERLKLYRNEDVAVGAWLAGLKVRYVHDPR

SEQ ID NO: 120409 - protein, 285 aa, Heterodera glycines
  Coding regions on vcDNA: vcDNA=SeqID_46832; Strand=-; Position=1 -134,474-626,738-816,1106-1243,1391-1552,2084-2272
  Homolog annotation: Hit_ID=CAE67815.1; Match level="QueryCoverage =89%, HitCoverage=58%, E-value=3e-33, Identity=32%"; Hit description =Hypothetical protein CBG13395 [Caenorhabditis briggsae]
  Essential gene: C elegans homolog=M176.2; Phenotype=Emb,Lva
MGGPAIANRTTIIHREMFAKVGYEAANLPDNDAEGIVAKGLYQAWLAFGVNDAIVVVVSGHADRNIEQFQLELRLEQLSGNKIQIVKLSIFECDDQLFLDPEDNSLRYNGHLVAVVYYKTIIALSEPGMLEHFFPEPEYAQMVNDIRKTFAKMWSLEQDDDETMKIISDAIENPGNYVLKPSQEGGGNNFWNEEIAEKLRTFKPNKRAAHILMERLRPLVVKNFMVRPYVKEVPQLSNIVSELSIYGYLLGNASNMRVLRNERDGCMLRSKREDATEGGIHSGGG

SEQ ID NO: 120410 - protein, 239 aa, Heterodera glycines
  Coding regions on vcDNA: vcDNA=SeqID_46833; Strand=-; Position=1 -153,209-664,786-813,864-946
  Homolog annotation: Hit_ID=NP_501968.2; Match level="QueryCoverage =88%, HitCoverage=32%, E-value=2e-44, Identity=45%"; Hit description =flavin-containing monooxygenase (61.2 kD) (fmo-11) [Caenorhabditis elegans] emb|CAA94291.2| Hypothetical
  Essential gene: C elegans homolog=Y39A1A.19; Phenotype=Ste,Stp
MLCTGHHCSERWPNPPFPGQSVFRGQVIHSRAFHTAKPFEDQTVVVVGIGNSGGDIAVELSKVAKKVGPWIKIGRIVSLKVYLSTRTGSWVINRVWEKGHPTDAVLLNRFAFALRAITPRSVQNRQRMALIGPGRALHSSFPSAFRLIERKLNLRFDHERYGLRPSHRFLEAHVTVNDELPNRIASGTVVMKPNIQKLAEKDVTFDDGTTVYAGEWQIDFCAGQQNTFVQIDVSARLIA

SEQ ID NO: 120411 - protein, 377 aa, Heterodera glycines
  Coding regions on vcDNA: vcDNA=SeqID_46834; Strand=-; Position=1 -312,503-631,857-1111,1325-1557,1747-1951
  Homolog annotation: Hit_ID=CAE70949.1; Match level="QueryCoverage =99%, HitCoverage=77%, E-value=5e-57, Identity=34%"; Hit description =Hypothetical protein CBG17759 [Caenorhabditis briggsae]
  Essential gene: C elegans homolog=Y49F6B.4; Phenotype=Unclassified
MNNDDFRKLLAVPASVRSSHSSSDRVSVNSSSVATFTHRQVVSVAASTGNVANKKAPKKRNFANFHREKPVEGKEEDDLFDESQARLNEIMKNYRDRAAERRKGKSKYLGGDMEHTHLVKGLDYSLLNKVRTEILERDVTDKDQEQQDSQANAPLSESSKAANSKLAANICKLLFESKPPKRNELFARGRMAYVVELEDEETDVPSTLLRSVVDCPLDQSSENINADNLLINKLTQVLAYLRTDVKKRRKGAGDGTTEAAKGEAETSIFEGLEEYEPSKERQQETRRGREEGQQKRTTASSYFDTDNRDSRSGRDERDKRGHRETKDRERKREREKDEPTNAANNADTAEEQHLEKLKKRRLEQEDAYAEFYPGTEF

SEQ ID NO: 120412 - protein, 617 aa, Heterodera glycines
  Coding regions on vcDNA: vcDNA=SeqID_46835; Strand=-; Position=1 -195,261-538,750-1062,1319-1540,1594-1833,1893-2230,2278-2386,2430 -2586
  Homolog annotation: Hit_ID=EAL33309.1; Match level="QueryCoverage =94%, HitCoverage=35%, E-value=1e-125, Identity=41%"; Hit description= GA20452-PA [Drosophila pseudoobscura]
  Essential gene: C elegans homolog=Y6B3A.1a; Phenotype=Gro,Unc
MDSATGEGGGNALTLDWENGVKLPKCHKIYNNAIWLNQKVVREVVDSLVYRVSASTEHEKPNQKKDVPPRSRHTSTDERLSVNGLYSPTVPNGSATHSFDQTTAEDDHSSAGMGGGQNTPQQPSKLEFHSLEEKDAFLIFRALCKLSIKQTPDDQDTRINPIFESDPLGTALDWLTISQPFSPAEFSLISPRSHELRSKLLSLDMILLIVRNFNAALPDTHSFVYAIRHFLCVALTHNAVSPNISVFSKALDIFVHLVDKYKIHLKKQIEVFFKEIIISILDSSSSSFEHKWVVLTTIAKICDSPQSVVDIYVNYDCHMTSANIFEELVTHLSKIASGYSADSSSPSHGQIALKERERRMRELALDCLVKVLQCLVYWYEEMNLGKEQSIHGGDETANAAPSACNGNGSDVNVTAQAKQQKGIVESGIELFAKKPKQGLSFLSEKGFVGAEPTDIAKFFHAEERLDKSVIGDYLGDGDEFNQRVMYSYVDNFDFTGVSIVQALRTLLSKFRLPGEAQKIDRIMEKFASRYCACNPQLNHIFASADTAYVLSYSIIMLTTDLHNPQVKRKMTKDEYIRMNRGINDQSDLPDDFLSQIYDDIATNEIKTKPGNLKRPKL

SEQ ID NO: 120413 - protein, 467 aa, Heterodera glycines
  Coding regions on vcDNA: vcDNA=SeqID_46836; Strand=+; Position=1 -174,223-361,455-603,647-962,1141-1398,1447-1614,1661-1860
  Homolog annotation: Hit_ID=A45618; Match level="QueryCoverage=100%, HitCoverage=100%, E-value=0.0, Identity=88%"; Hit description =translation elongation factor eEF-1 alpha chain - nematode (Onchocerca volvulus) sp|P27592|EF1A_ONCVO ELONGATI
  Essential gene: C elegans homolog=R03G5.1a; Phenotype=Emb,Lva,Unc
MGKEKIHINIVVIGHVDSGKSTTTGHLIYKCGGIDKRTIEKFEKEAQEMGKGSFKYAWVLDKLKAERERGITIDIALWKFETSKYYVTIIDAPGHRDFIKNMITGTSQADCAVLVVACGTGEFEAGISKNGQTREHALLAQTLGVKQLIVACNKMDTTEPPFAEARYTEVMTEVSNFIKKIGYNPATVPFVPISGFNGDNMLEPSDRMPWFKGWAIERKDGNASGKTLLEALDSILPPQRPTDKPLRLPLQDVYKNWRSCIGTVPVGRVETGVLKPGMVVTFAPQGISTEVKSVEMHHESLPEALPGDNVGFNVKNISVKDIRRGSVASDSKNDPAKETKSFTAQVIIMNHPGQIAAGYTPVLDCHTAHIACKFAELKEKVDRRSGKKVEDNPKALKTGDAGIVDLIPTKPMCVEAFTDYAPLGRFAVRDMRQTVAVGVIKAVEKTEGGGKVTKSAQKAAAPGGKKK

SEQ ID NO: 120414 - protein, 100 aa, Heterodera glycines
  Coding regions on vcDNA: vcDNA=SeqID_46837; Strand=-; Position=1 -192,780-889
  Homolog annotation: Hit_ID=CAE74232.1; Match level="QueryCoverage =100%, HitCoverage=20%, E-value=3e-31, Identity=60%"; Hit description= Hypothetical protein CBG21917 [Caenorhabditis briggsae]
  Essential gene: C elegans homolog=R06C7.5a; Phenotype=Gro,Pvl,Stp,Unc
ALLWRQLWIWLAESERELGLEAQISAEMVAELKAQKHNINWDKIRANERTMKHEVVAHIHAYGEVCPLAKGIIHLGATSCFVQDNTCLILQREAIDHLLE

SEQ ID NO: 120415 - protein, 129 aa, Heterodera glycines
  Coding regions on vcDNA: vcDNA=SeqID_46838; Strand=+; Position=1 -240,310-459
  Homolog annotation: Hit_ID=CAE71230.1; Match level="QueryCoverage =88%, HitCoverage=36%, E-value=9e-25, Identity=50%"; Hit description =Hypothetical protein CBG18099 [Caenorhabditis briggsae]
  Essential gene: C elegans homolog=W09C3.6; Phenotype=Ste
MHGGISDKIRSLDQLSNLLRSQIDPPLRSLEIDLLWADPSTSITGVRPNVQRKAGVLFGADVVESVRNLLGIDYIVRAHQLVMDGVEYFADRHLITVFSAPRYTGKNNTGATLLIAPDLSHTITRFPPA

SEQ ID NO: 120416 - protein, 116 aa, Heterodera glycines
  Coding regions on vcDNA: vcDNA=SeqID_46839; Strand=+; Position=1 -201,275-424
  Homolog annotation: Hit_ID=AAO85519.1; Match level="QueryCoverage =99%, HitCoverage=40%, E-value=4e-17, Identity=41%"; Hit description =putative serine/threonine phosphatase [Oesophagostomum dentatum] gb|AAO85518.1| putative serine/threonine
  Essential gene: C elegans homolog=W09C3.6; Phenotype=Ste
MHGGISDKIRSLDQLSNLLRPQTEPLLRSLETDLLWADPSTSITGVRPNARRKAGVLFGADVVEKHQLVMDGVEYFADHHLITVFSAPRYTGKNNTGATLLIAPDLSHTITRFPPA

SEQ ID NO: 120417 - protein, 219 aa, Heterodera glycines
  Coding regions on vcDNA: vcDNA=SeqID_46840; Strand=+; Position=1 -211,396-611,670-899
  Homolog annotation: Hit_ID=NP_498234.1; Match level="QueryCoverage =89%, HitCoverage=24%, E-value=8e-14, Identity=33%"; Hit description =cutaneous T-cell lymphoma tumor antigen se70-2 like (79.0 kD) (3G803) [Caenorhabditis elegans] gb|AAK1885
  Essential gene: C elegans homolog=B0336.3; Phenotype=Gro
MERRAANRRASPLAPLRRRVVLTGGNGGGSMRISSSTRLMVDRERERHHRGGTSAGGSGRGTIVGRSRSKKKGFCMRGDNCPFDHGPDPVVVENSALKDIVRDTTIFDTSTTYGVNPPPPGLESTVTPSAICVNKLSGGVTEGYNPEAPSMDNSAAIPQIDFSVPPPPLPQHFLQQQRQILYPPAPTASGIIPTFGAATATTAPTNASGGGVLPLRSAV

SEQ ID NO: 120418 - protein, 133 aa, Heterodera glycines
  Coding regions on vcDNA: vcDNA=SeqID_46841; Strand=-; Position=1 -68,649-982
  Homolog annotation: Hit_ID=BAA81712.3; Match level="QueryCoverage =75%, HitCoverage=20%, E-value=2e-16, Identity=38%"; Hit description =protein tyrosine kinase [Ephydatia fluviatilis]
  Essential gene: C elegans homolog=Y92H12A.1; Phenotype=Emb
MPTRWSAPECFTKNKFTHKSDIWSYGVLLFEIFSFGEIPFDNYTNDNDVIDAVKTGADPGVPKDCQEEIAVIMPKCWDQTPEKRISAENIKCALDCIILADVMQKCWTPEKRISAENVKRELGNIGRMEQEAK

SEQ ID NO: 120419 - protein, 214 aa, Heterodera glycines
  Coding regions on vcDNA: vcDNA=SeqID_46842; Strand=+; Position=1 -132,188-346,424-526,583-623,674-709,767-820
  Homolog annotation: Hit_ID=NP_493394.1; Match level="QueryCoverage =98%, HitCoverage=97%, E-value=2e-36, Identity=43%"; Hit description =cytochrome c oxidase subunit IV (1O250) [Caenorhabditis elegans] emb|CAB63334.1| Hypothetical protein W09
  Essential gene: C elegans homolog=W09C5.8; Phenotype=Age,Gro,Ste
MSILTASKVCTLPRLSSARSMTWWWPEKNNGREVVGPTFHGDEFYQDRLDRWYPSIRFRKNFYQDRLDRWYPSIRFRKNDEVITPIRHKELGDWKKLSIEEKKLIYRYSFRQTLAEFEALTPYGYLTVTLFFSMLGLTILYASFVRTYVNDRLPNDRLPDTFDDEYKESQAERRVVLERESQAERRVVLERGHLYGGHLYGPAYYYDYDKNRWK

SEQ ID NO: 120420 - protein, 127 aa, Heterodera glycines
  Coding regions on vcDNA: vcDNA=SeqID_46843; Strand=+; Position=1 -277,329-435
  Homolog annotation: Hit_ID=NP_493348.1; Match level="QueryCoverage =96%, HitCoverage=76%, E-value=1e-30, Identity=59%"; Hit description =small nuclear ribonucleoprotein, small nuclear ribonucleoprotein SNR- 2 (16.7 kD) (snr-2) [Caenorhabditis
  Essential gene: C elegans homolog=W08E3.1; Phenotype=Emb,Lva
MNIILADCEEMRRIKPKQGAKKSNVEEEKRILGLVLLRGDKIISISVEGPPQKEDSGVQLPKAGGLGGPGQGRGAGRGMPMGVVPPMGAVPPGLQGAVRGIGGPGMGGPMQPGYMQGMPQGMPPRPF

SEQ ID NO: 120421 - protein, 356 aa, Heterodera glycines
  Coding regions on vcDNA: vcDNA=SeqID_46844; Strand=-; Position=1 -123,582-760,931-1020,1062-1272,1395-1807
  Homolog annotation: Hit_ID=NP_510177.1; Match level="QueryCoverage =97%, HitCoverage=64%, E-value=1e-63, Identity=36%"; Hit description =serine active site containing 1 like (57.4 kD) (XN725) [Caenorhabditis elegans] emb|CAA93652.1| Hypotheti
  Essential gene: C elegans homolog=F17H10.1; Phenotype=Emb
LINLVDTYRTLNKPIVLTSLKILANSVASSKELAQTVANSDWIPLLSSMLKNPSHDEERILSHKILSNILFAFGREKNELPAHLYELHKPMSNKMPQIDIVFVHGLRGSAFRTWRQKDRPNERTTLFWPKDWLAVDLKESVRMIAVDYSDWLAVDLKESVRMIAVDYSSRFFQLSKSMETFEARAQLFAEEFKRNGIGERPIVFICHSMGGLLAKQLLLENEQLLSKTVGVLFMATPHLGTPVASQLRPYFIRPSSDVLLLQPKSEQNNKLANRFNKAAEQIPFIATVLECKKTRVFGRVMLVPVESGIMGKGPVYHLDEGHHNVCKPESKESIAYQIVFNFINDVLEYVKPFNGK

SEQ ID NO: 120422 - protein, 869 aa, Heterodera glycines
  misc_feature (754)..(754): Xaa can be any naturally occurring amino acid
  misc_feature (806)..(806): Xaa can be any naturally occurring amino acid
  Coding regions on vcDNA: vcDNA=SeqID_46845; Strand=+; Position=1 -43,264-430,727-886,999-1106,1175-1309,1543-1790,1962-2070,2147 -2200,2245-2310,2408-2626,2896-3063,3149-3287,3445-3648,3751 -3845,3909-4156,4544-4661,5056-5253
  Homolog annotation: Hit_ID=NP_499949.2; Match level="QueryCoverage =99%, HitCoverage=65%, E-value=0.0, Identity=46%"; Hit description =rac effector, Gut on EXterior GEX-2 (145.0 kD) (gex-2) [Caenorhabditis elegans] gb|AAB92078.6| Gut on exter
  Essential gene: C elegans homolog=F56A11.1; Phenotype=Emb,Gro,Pvl,Unc
KYNYTGQEKAAIPLVISMAKGVQSLMVNMDTDFAVAIRQHIYAELQDFVGGPLRDLLAKAVKHKKDILTGPLNKFNSRSSDLSSSMRSLGGGGGKKSKKGGADTGSMPDLRGRRRSVVPSSTQLYLARTMLESLVHEKSSSTGRRIYRKDLDEKYREKMVHFLRQSYFWPALVHFLRQSYFWPALLDLKQSLDESVNLSQLWFREFYLEMAMGNRIQFPIDMSMPWMLTDHILTTLDPSLLECVLHQLDLYNDAAAFALGHFRKQFLYDEVEAEVNLCFDQFVYKLSEAVFAHYKQRAATMLLDKGFKEDCARYGIAIFMPNSVRFETLLRQRHVQLLGRSIDLNLLGRSIDLNRLISQRINAALLRSLDVAISKFEADGALLRSLDVAISKFEADGLNCIMVLVLDNLIEVNRLCHRLLSDHLGSLADFNDLLLEANRQVSAPNGRITLHAFAQLTDDVLVNFCFNTATRRFVRGKQLNYRKPSRGRPPAVAAQYEFGSKSLNSSFSNLSMMYGGFVGVPHFRVVAKLVGYQGISAILFDLLGLAQRLLNDQIKTHFRSLLGLMPKMCKLQRFEYGVEGNLQYFIHQLRDFSAYGPLRRECCQSLRELGNVLAVALLMELGMAQEEMFDVFAAAAFTNQIPKPYAKNLEDQAIKMHKLESKYSRLQIGKIVHQFGTETQQQQAKIALDSAVLTSERLSCGLRIFDMVLIRLHDTLLTDPIWRGPVPTNGVMWVDECHEFHRIWCVFNGRECNXGCQLIMDVVEELFGDGIYWAGCAIVRLLGQHRRFEVLDFSYHLLRVNRASGXQQNVSFPQIVRLIERIRRVQAQHKQVFALLGNFCVHVEEQEQKIRHFAPPVYQPLQNPYANGR

SEQ ID NO: 120423 - protein, 388 aa, Heterodera glycines
  Coding regions on vcDNA: vcDNA=SeqID_46846; Strand=+; Position=1 -104,167-585,674-1317
  Homolog annotation: Hit_ID=NP_508269.1; Match level="QueryCoverage =92%, HitCoverage=58%, E-value=1e-38, Identity=28%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTFHKIDNDSVNSTTNALDFFRIPPTNVSVSSSKVQNYIDLSKCYLLTEFRIRKENANGQLMDLTIDDENIAPIQMIGQTFIRNIKMSIKGREVFNANALMAYKTYFSHELSYSTTAKDSHLNAAGYYRDTGETLETGPGCIQRRDLFAESKTAQFIAKIDTDLFNQPLYLINFCDGTQNVCEEGVINDGLALDIARKLEIKPARYAVRKTMMKSMVISQGRFEFTANLFMDQITRRITMGLVSNADYSGTITRSPFNFQPFNVREIGIIANGRSYPEAPYDLDYPHGKYVRAFNDMNEAVGFANSSESNGITFPQFGKTHCIYVFNMTSSGDDQAALFDLIKNGTTAVSIKFNRAVPVGGLMLVVMGECDSLVMLDKNRSISTDTTI

SEQ ID NO: 120424 - protein, 127 aa, Heterodera glycines
  Coding regions on vcDNA: vcDNA=SeqID_46847; Strand=+; Position=1 -207,537-713
  Homolog annotation: Hit_ID=XP_312456.1; Match level="QueryCoverage =71%, HitCoverage=10%, E-value=9e-17, Identity=54%"; Hit description =ENSANGP00000022086 [Anopheles gambiae]
  Essential gene: C elegans homolog=T22D1.9; Phenotype=Emb
MQMAMMLGRQQIFLELPDGEDGLLGELNANSHLHKHFLALARELDIMTPKSPDDVYKMHLEQARPFTHQAVKTTTTTPFAQFVEVCAYAGTGNVLKVQKMLHICTEHTDKKEVSRPTTIKMEDFNAK

SEQ ID NO: 120425 - protein, 147 aa, Heterodera glycines
  misc_feature (138)..(138): Xaa can be any naturally occurring amino acid
  Coding regions on vcDNA: vcDNA=SeqID_46848; Strand=-; Position=1-539
  Homolog annotation: Hit_ID=AAN78300.1; Match level="QueryCoverage =100%, HitCoverage=22%, E-value=1e-72, Identity=95%"; Hit description= heat shock protein 70 A [Heterodera glycines]
  Essential gene: C elegans homolog=F26D10.3; Phenotype=Lva,Ste
DLLLLDVAPLSLGIETAGGVMTSLIKRNTTIPTKTSQTFTTCSDNQPGVLIQVYEGERAMTKDNNLLGKFKISGIPLAPRGVPQIEVTFDIDANGILNVSAQDKSTGKQNKITITNDRGRLSKEEIERMVQEAEKFSXEDEVQRNRV

SEQ ID NO: 120426 - protein, 214 aa, Heterodera glycines
  Coding regions on vcDNA: vcDNA=SeqID_46849; Strand=+; Position=1 -57,102-200,273-428,487-819
  Homolog annotation: Hit_ID=AAN78300.1; Match level="QueryCoverage =64%, HitCoverage=21%, E-value=1e-68, Identity=95%"; Hit description =heat shock protein 70 A [Heterodera glycines]
  Essential gene: C elegans homolog=F26D10.3; Phenotype=Lva,Ste
MAERFHAPQPPPPGLPEEAVWVPPQGADGGGGEDGAGGGDGGGGGANLFGGEDLLLLDVAPLSLGIETAGGVMTSLIKRNTTIPTKTSQTFTTCSDNQPGVLIQVYEGERAMTKDNNLLGKFKISGIPLAPRGVPQIEVTFDIDANGILNVSAQDKSTGKQNKITITNDRGRLSKEEIERMVQEAEKFSKRTRCNVTVWRRRERFWKFHSDLFI

SEQ ID NO: 120427 - protein, 317 aa, Heterodera glycines
  misc_feature (292)..(292): Xaa can be any naturally occurring amino acid
  Coding regions on vcDNA: vcDNA=SeqID_46850; Strand=+; Position=1 -167,258-406,493-563,1059-1152,1205-1632
  Homolog annotation: Hit_ID=CAE58421.1; Match level="QueryCoverage =98%, HitCoverage=98%, E-value=9e-62, Identity=39%"; Hit description =Hypothetical protein CBG01552 [Caenorhabditis briggsae]
  Essential gene: C elegans homolog=F42G8.5; Phenotype=Unclassified
GGVAGIEQLDPTQWTGNQRIVHFGPMAQRDPFFYFYPKGWDLLYPAQFGFFPYRTNKLGSSAVVCVWAFGIFLFLGGILMIYLGYFIEYKKPFWRWTVEERQNTPPVQIAGPLLAGTGILLLVVGMVYFFQILQFLSDKLRHHHHRDQPASVTVYTTHYSPVPYEVSPYQPLPPPANSPVPYEVSPYQPLPPPANPVYVNPNARTHLLDPNKELKLFPPVYENLGFFFYIKGSNGLIEVVGPHFGIGHLGIKQKIHCLGFKESLISDQEGVCLIERERENGERESWGREREXERIWQREREREALKGKEREREREKE

SEQ ID NO: 120428 - protein, 745 aa, Heterodera glycines
  Coding regions on vcDNA: vcDNA=SeqID_46851; Strand=+; Position=1 -190,237-761,841-917,965-989,1267-1575,1689-1847,1892-1967,2031 -2312,2410-2549,2601-2861,3005-3199
  Homolog annotation: Hit_ID=NP_502161.1; Match level="QueryCoverage =81%, HitCoverage=43%, E-value=1e-142, Identity=47%"; Hit description= serine threonine kinase (kin-4) [Caenorhabditis elegans] emb|CAB05684.1| Hypothetical protein C10C6.1 [C
  Essential gene: C elegans homolog=C10C6.1; Phenotype=Stp
SPLRMFDVPGIDAPVMSLVYKERFPKAKQQLESRILQFLQQNAPLSGFSSQLLQPTIASSTPLRATSPQPGQPPGAISDHSSVCRPQSPLPVRPLSPLVTESATAIGDAVIRSSAHFSSQGLLSPQQQRPFVEEAERIEGLPCHHSIYATQFGTGGERDGRQSSLAKHSSPVCSPSSTTVLTTTDQNILRLISDGATRFLHHQLCEIASDCLQKSKDGMLSCAYFCNMSVRLDETLAEAEVKIGPDSYSYLTRLVKQLLMIVSRAARLLECLEFDPDEFYQLLEEAEGAVRVQLGAGSARVPDLPQYIVSKLGLNKNIHLLMEDDQTAMDLGEEAEETSDKRMTEIMGTNELMKKRAAEVLAQGVPKEEDFETVRLISNGAYGAVYLVKHRRSRLRYALKKMKKQTLLMRNQIEQVYAERDILTFTDNPFVVCFYGSFETKQHLCMLMEYVEGVRRNFAHRIGPPLCGGNGVGHRIFALVWHCAQGFKAGQFANHFHGTHKTDGFRPLQNWAYESDYFGVGRLSATGRHAAVQGQPTLRNARIHRTGRKPVDWWALGVILYEFLVGIVPFMGDTPEALFANIINEDVEYPEGDEALDSDAESLIHLLLEKNPLDRLGTVGGAPQVSAHPFFTPLDFDTILRQKAEFVPQLENDEDTSYFDSRSDRYNHDANESAEDDDAAAAAHAAAIERSGQPLQQQDRIVDDDRVESRRRLLSSATTASSGIGSGPNSAFGPLSSTLLTRKIA

SEQ ID NO: 120429 - protein, 126 aa, Heterodera glycines
  Coding regions on vcDNA: vcDNA=SeqID_46852; Strand=-; Position=1 -3,231-278,777-1106
  Homolog annotation: Hit_ID=CAE64104.1; Match level="QueryCoverage =64%, HitCoverage=24%, E-value=8e-10, Identity=44%"; Hit description =Hypothetical protein CBG08713 [Caenorhabditis briggsae]
  Essential gene: C elegans homolog=T26E3.3; Phenotype=Emb,Gro
MVNGKKLDQVADMMVANAHNLIVTIKPANQRNSLQRKGKADQFAVQSQYHQYFTGDGSSSSAVGKIGTFGSGGGGKVYPTGHGSSLYHLGTDRHHHHQMDEFFDDYAEDEDEDEIVDHTKTALKIH

SEQ ID NO: 120430 - protein, 124 aa, Heterodera glycines
  Coding regions on vcDNA: vcDNA=SeqID_46853; Strand=-; Position=1 -86,492-608,655-826
  Homolog annotation: Hit_ID=CAE59247.1; Match level="QueryCoverage =45%, HitCoverage=12%, E-value=2e-10, Identity=50%"; Hit description =Hypothetical protein CBG02573 [Caenorhabditis briggsae]
  Essential gene: C elegans homolog=F21H12.1; Phenotype=Emb
MAFCLVPGVHLHKKFMPEMLASRIDVHEASSALKVMMNGDFLGKNFALAYPEERECFLDSNGAAATCCKLKRFGTLIAVGSTDGRLFIYDLITKSAVKVGEVVHSLLNFRPCFYYIFFALFSGD

SEQ ID NO: 120431 - protein, 94 aa, Heterodera glycines
  Coding regions on vcDNA: vcDNA=SeqID_46854; Strand=+; Position=1 -65,119-212,287-369,421-462
  Homolog annotation: Hit_ID=CAE68422.1; Match level="QueryCoverage =74%, HitCoverage=11%, E-value=2e-16, Identity=55%"; Hit description =Hypothetical protein CBG14201 [Caenorhabditis briggsae]
  Essential gene: C elegans homolog=C04F6.3; Phenotype=Emb
FLVADNDQWFSYDDVESIRNKLSWIRQNSFGGAFVWTLDFDDFNGQCPGSQLGRYPLIRTIAQELGGIQLSQTPVSALSNSPSPSTGAALPAVT

SEQ ID NO: 120432 - protein, 871 aa, Heterodera glycines
  Coding regions on vcDNA: vcDNA=SeqID_46855; Strand=-; Position=1 -1402,1756-1840,2156-2873,2946-3193,3248-3410
  Homolog annotation: Hit_ID=NP_508269.1; Match level="QueryCoverage =52%, HitCoverage=64%, E-value=2e-38, Identity=25%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MSIIKKIDKDSVEGLEGSLSLFNLPPTNVAINKTSVRELLPLSALNQTGPYLFRLFSDSQYCDLSKTYMYLLTSIERKNAAGEWVPTDDAIEEDKHVGVIQNFGSSFVRSLKVNISGVEVFDSSIYYHYRAYIMQELGYSHEIRKAFHEAGCYYPDENSQDSYSNKGFTSRAQRFSNGKQCETMVKLNFDLARQNTLLLNNQDVVFTIHRNSDPFLLLTPKWKTVTDAVKDAQGNIITAARVTWHDNTAEYRIRLHDIRLYVRTVDVTSSLNIAISRQLESTPAKYALRKVEMRSIFLGMGRTELSHNVFTSTLPRRLICAFVSTDAYSGARHLSPFNFEHANVRSISAEANGLTFPSTPYLFSFGNQKRFVRAFVDMYAGLGLDDSDNKTVSISMARFLSGWAFFVIPMTSTLDDTPGFELIRQGTCTVKVQFEQPIKADGYEMLILGEFDSVLSINADRVLSTDGIARCSGVPYCEVMVNLYRTRTIADLLVKGPVHFESIRKLEPMACFEYNGKSYVFFEDREADEMHLYRGHEQKIVKKFLANANRPMFDYMTERLYISDKYERQISEIELSYLERLWTNKNPTNFTLLKLNFVCMLPQDKTDFIIIDNKVYLIRSDRRIYKYGINDGQINPKFVSNISDTKFNFLLFKEYRDDVINILQASSPTPQIKLLLWSAYTFDVLLVVICAYVIRQIRRTSSSSKTSSEDVGMFDQMELEIFSDNPKDLVYRPTTRAIKYFIDYYALDDIAQLYALFKSEIDSEPSNYFPNPLQSVPCVHLVNEEYENQPVVVEGTLDLIGDLFFSTCYPKKRQGIDWSEPLYVELKDLMVCPGDLRKCLSHFGHRKDQRNLVVDELDWHDEDDDIAEGAW

SEQ ID NO: 120433 - protein, 474 aa, Heterodera glycines
  misc_feature (3)..(3): Xaa can be any naturally occurring amino acid
  misc_feature (454)..(454): Xaa can be any naturally occurring amino acid
  misc_feature (460)..(460): Xaa can be any naturally occurring amino acid
  Coding regions on vcDNA: vcDNA=SeqID_46856; Strand=-; Position=1 -1359,2770-2841
  Homolog annotation: Hit_ID=NP_510671.1; Match level="QueryCoverage =90%, HitCoverage=43%, E-value=1e-75, Identity=37%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
DIXEWAGIIWNIFRRLPRRNSTSPDNVPYILLKNCAEPITKILADIFRLILDYGQIPEIWRTSLVVPIFKKGEKTDPLNYRPVSLTSTVCRVFERILSSKILEFLNSTRFFDKEQFGFLKNRSTTTQILKMMDDIYNSIQKNQQIDIIYIDFVKAFDSVPIDLLLQKIKKIGIEGKIHNFLTNFLKNRSFKVKIGEELSESFRIFSGVPQGSVLGPLLFLIFINDLPSFITNEAASVDIKMYADDVKLYYTHENDDHSNQLDKAIEALEKWSKINGLEISTEKCFVLYLGKNNMKKEYFINSKKISESDNVRDLGIIIDSKLNFSEHISKIIRNAYLRSFQILRVLKSREIKTLTAAYKTFVRPQLEYATEVWNPNLKKDIDKIERVQKFFTIKVFRKGLVYKKYVERLKIAGLHKLEERRKINDLTTAFKIIKGFTSLEAEQNFFFSERHRNXKRKCVXSRKSIKFPNKNAFF

SEQ ID NO: 120434 - protein, 131 aa, Heterodera glycines
  Coding regions on vcDNA: vcDNA=SeqID_46857; Strand=+; Position=1 -84,369-522,1126-1279
  Homolog annotation: Hit_ID=NP_501939.1; Match level="QueryCoverage =100%, HitCoverage=24%, E-value=3e-69, Identity=91%"; Hit description= abnormal ThermoTaXis TAX-6, Chemotaxis to sodium ion NA+ CNA-1, protein phosphatase (60.7 kD) (tax-6) [C
  Essential gene: C elegans homolog=C02F4.2a; Phenotype=Unclassified
VCGDIHGQFYDLMKLFEVGGSPSSTKYLFLGDYVDRGYFSIECVLYLWALKICHPATLFLLRGNHECRHLTEYFTFKQECKIKYSERVYDACMESFDALPLAALMNQQFLCVHGGLSPEIQTLDDIKKASR

SEQ ID NO: 120435 - protein, 56 aa, Heterodera glycines
  Coding regions on vcDNA: vcDNA=SeqID_46858; Strand=-; Position=1 -131,169-208
  Homolog annotation: Hit_ID=NP_508844.1; Match level="QueryCoverage =78%, HitCoverage=14%, E-value=2e-13, Identity=70%"; Hit description =calumenin-like protein precursor (36.1 kD) (XF588) [Caenorhabditis elegans] gb|AAB04578.1| Hypothetical p
  Essential gene: C elegans homolog=M03F4.7a; Phenotype=Lva,Lvl,Unc
MRDWVMPLNFDHADAEAKHLIHIADENKDGKLSPEEILTHYDTFTEFVLMSLMIFA

SEQ ID NO: 120436 - protein, 218 aa, Heterodera glycines
  Coding regions on vcDNA: vcDNA=SeqID_46859; Strand=+; Position=1 -80,135-222,336-434,808-990,1514-1650,1957-2017
  Homolog annotation: Hit_ID=NP_508844.1; Match level="QueryCoverage =100%, HitCoverage=69%, E-value=2e-99, Identity=73%"; Hit description= calumenin-like protein precursor (36.1 kD) (XF588) [Caenorhabditis elegans] gb|AAB04578.1| Hypothetical
  Essential gene: C elegans homolog=M03F4.7a; Phenotype=Lva,Lvl,Unc
NNDVERTWKNYKEEQLKNGLLDWQDYRNLNLIYGKPQEGQEISPEYVKMIERDERRWKVADYNSDGKMDRTEYGCFMHPEDCDHMRDIVVQETVEDIDKDKDGFVDMAEYIGDMYRPDDYPELKGKEPEWVESEREMFREHRDKDKDGKLNKDEMRDWVMPLNFDHADAEAKHLIHIADENKDGKLSPEEILTHYDTFVGSQATDYGEQLQKHDPADL

SEQ ID NO: 120437 - protein, 376 aa, Heterodera glycines
  Coding regions on vcDNA: vcDNA=SeqID_46860; Strand=-; Position=1 -118,580-746,940-1044,1468-1660,1966-2185,2503-2629,2833-3030
  Homolog annotation: Hit_ID=NP_501127.2; Match level="QueryCoverage =100%, HitCoverage=26%, E-value=1e-141, Identity=67%"; Hit description=RNA Polymerase, Class III (C), rna polymerase (rpc-1) [Caenorhabditis elegans] gb|AAA83341.2| Rna polym
  Essential gene: C elegans homolog=C42D4.8; Phenotype=Lva
MNLHLPQTYEAKAEASLLMGLKYNLVSPRAGQPLIAAIQDFITSGYLLTHKDTFLPRSEVQRIAAAVVEANTGAKRIRLPPPALLRPKELWTGKQLIELLIAPYKGTEVCLNLSTKNRMHNPDEGEFTPNDTFVIIRNNQLLCGSLDKALLGSESKCSIFYRLLRDWGEGHAIEAMWRLARISAVYLSNRGFSIGIGDVKPNVNLLQEKSVLLNTGYKICDQLNKSMRLERQKDKPDLGLVEELESKILKELSSIRDQAGKACKQYLSRKNAPLTMAQCGSKGSFINIAQMIALVGQQSISGKRPSDGFENRSLPHFERNDRAPDAKGFVENSFYSGLTPTEFFFHTMGGREGLVDTAVKTAETGYMQRRLVKCLE

SEQ ID NO: 120438 - protein, 89 aa, Heterodera glycines
  Coding regions on vcDNA: vcDNA=SeqID_46861; Strand=-; Position=1 -139,215-345
  Homolog annotation: Hit_ID=P46436; Match level="QueryCoverage=87%, HitCoverage=36%, E-value=2e-15, Identity=56%"; Hit description =Glutathione S-transferase 1 (GST class-sigma) gb|AAB30767.1| glutathione S-transferase, AsGST1 [Ascaris suum,
  Essential gene: C elegans homolog=R05F9.5a; Phenotype=Unclassified
MVQYKLYYFDGRGLGESIRLLLHYVGQPFEDIRIKDMEEWEKTYKPKFFYGKVPVLEVDGKPLGQSATILRYLAEKFGKLIIIINFICF

SEQ ID NO: 120439 - protein, 274 aa, Heterodera glycines
  Coding regions on vcDNA: vcDNA=SeqID_46862; Strand=+; Position=1 -774,1784-1841
  Homolog annotation: Hit_ID=NP_504179.1; Match level="QueryCoverage =94%, HitCoverage=38%, E-value=5e-44, Identity=33%"; Hit description =predicted CDS, protein of unknown function DUF32 and RNA-directed DNA polymerase family member (5E747) [C
  Essential gene: C elegans homolog=ZK250.3; Phenotype=Clr,Lvl,Sck
FIDFQKAFDSLRHNLLLYKLEKIGIRGKLLLWIKDFLSNRTFRVQIGDSLSSSKVGYGVPQGSLGPLLFLIYINDLPDALPSGVRIKLYADDVKMYICYKARSDTEIMHKALHNLFEWANKWQIKVSIQKTFVLYLGSKNPNETYKFDVNTINAVDTISDLGVNIDNKLQFSDHVNQITRNEYLRMRSLFRIIKSKSSKIWITLYKTYIRPLLEYAPEVWLQKNIKKIEKCQKYFTKGYFLNVAFHPIPKSIRIPNFSFLGSAFLKIFGSFLRG

SEQ ID NO: 120440 - protein, 156 aa, Heterodera glycines
  misc_feature (136)..(136): Xaa can be any naturally occurring amino acid
  misc_feature (154)..(154): Xaa can be any naturally occurring amino acid
  Coding regions on vcDNA: vcDNA=SeqID_46863; Strand=-; Position=1 -26,1352-1386,1782-1909,2037-2069,2228-2284,2386-2509,2641-2691
  Homolog annotation: Hit_ID=XP_318375.1; Match level="QueryCoverage =95%, HitCoverage=27%, E-value=2e-36, Identity=52%"; Hit description =ENSANGP00000015911 [Anopheles gambiae]
  Essential gene: C elegans homolog=Y113G7B.17; Phenotype=Gro,Rup
KCLHGKTGLTHSEFDSRTEQGSAVQYFQFYGSLFQQQNMLQDFTRTATYQRAIFDNWHDFRGKVVLDVGAGTGILSFFAAQVGAKRVYAVGLTNFKFFSNFKFFSKELVDANGFSSVIVVLSAKIEEVELPEQVNXLVDSSFYVIYSSRILVKXIS

SEQ ID NO: 120441 - protein, 87 aa, Heterodera glycines
  Coding regions on vcDNA: vcDNA=SeqID_46864; Strand=-; Position=1-263
  Homolog annotation: Hit_ID=P53022; Match level="QueryCoverage=100%, HitCoverage=69%, E-value=2e-30, Identity=68%"; Hit description=Major sperm protein 2 gb|AAA29147.1| major sperm protein
  Essential gene: C elegans homolog=ZK546.6; Phenotype=Emb
RIGYAFKTTKPKRIFLNPPCGTLGVGDAVNVIITVTTFDPNNDDIKNDRVIVEWCNTPDPAATVFKLEWFAEDGMVRRKNLPVIYNL

SEQ ID NO: 120442 - protein, 213 aa, Heterodera glycines
  Coding regions on vcDNA: vcDNA=SeqID_46865; Strand=+; Position=1 -51,100-180,228-392,493-616,668-750,798-932
  Homolog annotation: Hit_ID=CAE64105.1; Match level="QueryCoverage =98%, HitCoverage=92%, E-value=9e-26, Identity=37%"; Hit description =Hypothetical protein CBG08714 [Caenorhabditis briggsae]
  Essential gene: C elegans homolog=T26E3.4; Phenotype=Gro,Sck
MESSNEEQQLQEIEALESMYSNELRVLCRDFPNISVELDVRPDLDEFTELFGKSVISLRATFPSDYPNCFPVIDLPDFDGDDDENTLQKTQFWDECERRITNPTKQEFFVQMADDYLKNRDELERIKADKIEREERAKFEGTRVTVESFKKWNDAFLKSVRVPQEKIKDNQTTKRMTGKQLFLSDKSLNISDLQFIGNAKDENVVEIDQSLFE

SEQ ID NO: 120443 - protein, 124 aa, Heterodera glycines
  Coding regions on vcDNA: vcDNA=SeqID_46866; Strand=-; Position=1 -135,192-230,615-813
  Homolog annotation: Hit_ID=AAP30833.1; Match level="QueryCoverage =73%, HitCoverage=37%, E-value=2e-45, Identity=100%"; Hit description= putative gland protein G8A07; Hg-G8A07 [Heterodera glycines]
  Essential gene: C elegans homolog=T26C5.3a; Phenotype=Emb
MDDDSDSNNNDEELSLGVFETYAVLVKILCLKPMLIMVIVLLTGKIAFAATDGMTDLKLINEGLTTDKIASRSIFLTPLQIILPWVLGKQTAGPKPLNVFLWAYPYRLVMSLALALLVYWTPSF

SEQ ID NO: 120444 - protein, 199 aa, Heterodera glycines
  Coding regions on vcDNA: vcDNA=SeqID_46867; Strand=-; Position=1 -58,1118-1659
  Homolog annotation: Hit_ID=BAA88337.1; Match level="QueryCoverage =71%, HitCoverage=14%, E-value=2e-16, Identity=39%"; Hit description =ORF2 [Platemys spixii]
  Essential gene: C elegans homolog=ZK250.3; Phenotype=Clr,Lvl,Sck
MHSSGCCRSICQQSVPGLQEHISKIIRNAYLRIFQILRVLKSREIKTLTAAYKTFVRPQLEYITEVWNPNLKKDIDKIERVQKFFTRKALRKCGFVYKKYGERLKITGLHKLEERRKINDLTTAFKIIKGFTSLDAGKSFFFSERLRRPLLLRVKRHTAKTQNNFFNRIVKSWNNLPVVAVQINKAKEFRGLLKAMSSE

SEQ ID NO: 120445 - protein, 691 aa, Heterodera glycines
  Coding regions on vcDNA: vcDNA=SeqID_46868; Strand=+; Position=1 -246,300-527,574-745,837-979,1037-1128,1254-1416,1483-1644,1704 -1799,1895-2188,2238-2440,2504-2780
  Homolog annotation: Hit_ID=AAO14563.2; Match level="QueryCoverage =100%, HitCoverage=95%, E-value=0.0, Identity=99%"; Hit description =Hsp90 [Heterodera glycines]
  Essential gene: C elegans homolog=C47E8.5; Phenotype=Emb,Ste
EIFLRELISNSSDALDKIRYQALTDPSQMESGKELFIKIVPNKADKTLTIIDTGIGMTKADLVNNLGTIAKSGTKAFMEALQAGADISMIGQFGVGFYSAFLVADRVTVTSKHNDDDCYQWESSAGGSFIIRNCADPEVTRGTKIVLHLKEDQTDYLEERRVREVVKKHSQFIGYPIKLLVEKERDKEISDDEAEEEKKEDEAKEEEKKPEDDVSDDEAEKRKEEGDKKKKKTKKIKEKYTEDEELNKTKPIWTRNPDDISNEEYAEFYKSLSNDWEDHLAVKHFSVEGQLEFRALLFVPQRAPFDLFENKKSKNAIKLYVRRVFIMENCEELMPEYLNFIKGVVDSEDLPLNISRETLQQSKILKVIRKNLVKKCMDLFEEISEDKDNFKKFYEQFAKNIKLGIHEDSVNRKKLSDFLRYYTSASGEEPCSFKDYVSRMKENQTCIYYITGESKDVVQNSSFVERVKKRGFEVIYMVDPIDEYCVQQLKEYDGKKLVSVTKEGLELPESEEEKKKFEEDKVKFEKLCKVIKDILDKKVQKVSVSNRLVSSPCCIVTGEYGWSANMERIMKAQALRDSSTMGYMASKKNLEINPDHSIIKSLRDRVEKEQDDKTAKDLVVLLYETSLLTSGFSLEDPQQHASRIYRMVKLGLDIPDEEEPAEQQPSTSGEPTIAEKIAGAEEEASRMEEVD

SEQ ID NO: 120446 - protein, 268 aa, Heterodera glycines
  Coding regions on vcDNA: vcDNA=SeqID_46869; Strand=+; Position=1 -159,249-401,779-919,1057-1150,1721-1937,2475-2520
  Homolog annotation: Hit_ID=NP_493755.1; Match level="QueryCoverage =98%, HitCoverage=38%, E-value=8e-76, Identity=55%"; Hit description =endoplasmic reticulum membrane protein family member with at least 5 transmembrane coiled coil domains of
  Essential gene: C elegans homolog=W02B8.3; Phenotype=Emb
KFPSKNAVFYDAIFSMPISKVREMNNTGYALLSKDQLHLLYGPESPYNNSDALQRFVRLSDSEIHAGIERDVHALAELESFKVRQKDVVLSPILFTTFLLVNTFSAKSTILLSPILFSPVILSPNVLGPTILSPWLFVPVILSPRALSPTVLSPFVLDPIILSPFAIHPIILSPGVLNAIILNPFVLSPFILSPQAFTPVILSPIALSPFIMNPSMGSPTILSPFVLTPSILSPQFLSALILSPYALSPVIASPLTAVSVILSPSWLS

SEQ ID NO: 120447 - protein, 424 aa, Heterodera glycines
  Coding regions on vcDNA: vcDNA=SeqID_46870; Strand=-; Position=1 -66,419-550,718-807,937-1050,1346-1468,1579-1728,1775-1907,2351 -2547,2745-2910,2955-2986
  Homolog annotation: Hit_ID=NP_491790.1; Match level="QueryCoverage =97%, HitCoverage=52%, E-value=1e-132, Identity=57%"; Hit description= gastrin-binding protein like (81.5 kD) (1G784) [Caenorhabditis elegans] gb|AAK21464.1| Hypothetical prot
  Essential gene: C elegans homolog=T08B2.7a; Phenotype=Unclassified
IIGAGLTGAGIANVSIDKDIKTILIDTNQETLDGGLKQITSQMEGQIKCKLITAAEKKIFLANLKPLDDYEKLRNADFVVETESEEIESKHEIIKKLEKVVPNHCIIATNTSVLPIHDIVAVAQCPERVIGMNYFSPVDKMQMLEVIIADKTSHETLAVAAKLGLDQKKMIVVVKDGPGFFVARCLSPMLNEVVRLFQEGVSPQQVDKITTQFGFSVGMATLADEIGLDYSEYLTTFLIGLDYSEYLTTFLGKALGPRVQGGSSELLADLTKAGFKGKKSGAGIYTYSADGGKKSKKVPNSKAQEIVARYKLSSSEGASSVEYQQIRVVSRFVNEALICLEEGIISSPSDGDVASVFGLGFPPFWGGPFRFVDLYGAQNLIKQMERYGNIYSTVQFKPCQLLIDYAKSGKKFYSYAKSGKKFYS

SEQ ID NO: 120448 - protein, 92 aa, Heterodera glycines
  Coding regions on vcDNA: vcDNA=SeqID_46871; Strand=-; Position=1 -216,1077-1135
  Homolog annotation: Hit_ID=NP_596732.1; Match level="QueryCoverage =100%, HitCoverage=15%, E-value=2e-31, Identity=73%"; Hit description= putative RNASE L inhibitor [Schizosaccharomyces pombe] emb|CAA19324.1| SPBC14F5.06 [Schizosaccharomyces
  Essential gene: C elegans homolog=Y39E4B.1; Phenotype=Emb
KCPYGAIQIINLPSNLERETTHRYSANSFKLHRLPTPRLGSVLGLVGTNGIGKSTALNILSNRLKPNLGSFKPPPLWHSEAPKNFRKSEFFN

SEQ ID NO: 120449 - protein, 75 aa, Heterodera glycines
  Coding regions on vcDNA: vcDNA=SeqID_46872; Strand=-; Position=1 -78,181-229,579-679
  Homolog annotation: Hit_ID=CAG59639.1; Match level="QueryCoverage =80%, HitCoverage=9%, E-value=3e-21, Identity=75%"; Hit description =unnamed protein product [Candida glabrata CBS138] ref|XP_446712.1| unnamed protein product [Candida glabrat
  Essential gene: C elegans homolog=Y39E4B.1; Phenotype=Emb
MKKSAKPEIQTAQTRIAIVNPDRCKPKNCGQPCKKNCPVVRTGKQCIVVEPTSKIAEISEILCIGCGICVKVCIH

SEQ ID NO: 120450 - protein, 237 aa, Heterodera glycines
  Coding regions on vcDNA: vcDNA=SeqID_46873; Strand=-; Position=1 -57,793-1007,1075-1234,1948-2229
  Homolog annotation: Hit_ID=NP_492114.2; Match level="QueryCoverage =55%, HitCoverage=25%, E-value=4e-36, Identity=53%"; Hit description =chitin synthase (58.6 kD) (chi-1Co) [Caenorhabditis elegans] emb|CAA96689.2| Hypothetical protein T25G3.3
  Essential gene: C elegans homolog=T25G3.3; Phenotype=Emb,Lva
MCDDCRRFEAKDYWRACVQQLVTHDVRSNFYDYKHTFCVDIVPITKDALICLPRTLAQSFANIGQFVLCLRVTDVVSLINPQTLQLYELNATTYWKNPFDILVHPKSLVEFFVVDVEEVDDPYAVLPHGHGSVSTKHRLADVWVEFMDDIEEDPALRERINIYKKGGGKQSVKQTATSANRTAAQQRHHRQRMASAAADSALSEGGEEEHIDGAPTLAEMLDDLELDDVEMREEEEG

SEQ ID NO: 120451 - protein, 404 aa, Heterodera glycines
  Coding regions on vcDNA: vcDNA=SeqID_46874; Strand=+; Position=1 -279,332-623,674-784,843-1375
  Homolog annotation: Hit_ID=NP_498516.1; Match level="QueryCoverage =99%, HitCoverage=15%, E-value=4e-78, Identity=40%"; Hit description =NOT-like, component of CCR4/NOT complex (ntl-1) [Caenorhabditis elegans] gb|AAA21168.1| Not-like (yeast c
  Essential gene: C elegans homolog=F57B9.2; Phenotype=Emb
MKYLLFEAFYKGQQELLYIVPFVVKCITASAKSQLFGPHCGWVYAILKVLAEIHNEPDLKLNLRFEIEVLCKELNVDLRSIEVGSYLKEQRRLPKLVPPSKLGTTAASPTLAQCQLPPIQQPPQIGAGISAQSTADYTPTDMANILTEMSISRKYSPASYTPGGSQQQVPSITAHQTLPTFNYADIALQSGILQIIVIPPHLMLFQVHPQLKATCKIAINHAIKDVYGGVADRAISVAIAATEQICRKDFGLDSAEQNLRRGAHQMMRSMTAAIASITCREPLSQQMNSILKMYLTDAMGNVLPGSDQAKMVEEAATAVTDTNINIATNFVVKNACEKSVADIEKRLEPEYVARKTASDDRPFQVDADMAEMSEKVPEMIRLKEGPISEAMLKVYDDFSSYVKF

SEQ ID NO: 120452 - protein, 408 aa, Heterodera glycines
  Coding regions on vcDNA: vcDNA=SeqID_46875; Strand=+; Position=1 -48,104-349,412-606,673-951,1006-1224,1299-1389,1450-1598
  Homolog annotation: Hit_ID=NP_500846.1; Match level="QueryCoverage =93%, HitCoverage=89%, E-value=5e-76, Identity=41%"; Hit description =fer (fps/fes related) tyrosine protein kinase family member, has SH2 domain (48.8 kD) (4G442) [Caenorhabd
  Essential gene: C elegans homolog=T04B2.2; Phenotype=Unclassified
METDEQMWDMPYYHGLLPREDVNDLLVKEGDFLIRMSEETSGQDRIYVLSVVAGGHKHHLIFRTERGMIAVDFKHERGYRTMRRFIETHLSKKDTVVDQRKVILLKGVGRQKWELAHSTITQGAELGKGAFGVVKRGVFRDPTIGQPVQVAIKEVSQTSTKAQIKEFMNEARIMRHLDHKNVIRFYGVAVGREPLMVLMELASDGSLDTYLKKTKRSPRSKLFMCYGAAAGLDHVHSKGILHCDIAARNCLFSENTVKVADFGLAFKGPSKPVETGKPVPIRWLSPETMRERTFTPKSDTWAYGVLCWEIFSNAQQPYQFISNNDVAPMVLRGSRLRFPNVTPPPFAEFIKANVWTADVARRYAMRDVLAWIEQHIDELIDDTTASRHDTTTATTRNRGSRQGSRTGS

SEQ ID NO: 120453 - protein, 408 aa, Heterodera glycines
  Coding regions on vcDNA: vcDNA=SeqID_46876; Strand=+; Position=1 -48,104-349,412-606,674-952,1007-1225,1299-1389,1450-1598
  Homolog annotation: Hit_ID=NP_500846.1; Match level="QueryCoverage =93%, HitCoverage=89%, E-value=7e-76, Identity=41%"; Hit description =fer (fps/fes related) tyrosine protein kinase family member, has SH2 domain (48.8 kD) (4G442) [Caenorhabd
  Essential gene: C elegans homolog=T04B2.2; Phenotype=Unclassified
METDEQMWDMPYYHGLLPREDVNDLLVKEGDFLIRMSEETSGQDRIYVLSVVAGGHKHHLIFRTERGMIAVDFKHERGYRTMRRFIETHLSKKDTVVDQRKVILLKGVGRQKWELAHSTITQGAELGKGAFGVVKRGVFRDPTIGQPVQVAIKEVSQTSTKAQIKEFMNEARIMRHLDHKNVIRFYGVAVGREPLMVLMELASDGSLDTYLKKTKRSPRSKLFMCYGAAAGLDHVHSKGILHCDIAARNCLFSENTVKVADFGLAFRGPSKPVETGKPVPIRWLSPETMRERTFTPKSDTWAYGVLCWEIFSNAQQPYQFISNNDVAPMVLRGSRLRFPNVTPPPFAEFIKANVWTADVARRYAMRDVLAWIEQHIDELIDDTTASRHDTTTATTRNRGSRQGSRTGS

SEQ ID NO: 120454 - protein, 236 aa, Heterodera glycines
  Coding regions on vcDNA: vcDNA=SeqID_46877; Strand=-; Position=1 -90,166-372,425-545,603-763,829-960
  Homolog annotation: Hit_ID=AAR85527.1; Match level="QueryCoverage =96%, HitCoverage=91%, E-value=7e-54, Identity=47%"; Hit description =14-3-3b protein [Meloidogyne incognita]
  Essential gene: C elegans homolog=M117.2; Phenotype=Emb
MAEQRKDNIQRAKLARQCERYDEMAKEMKQVAEMSVELTEEERTLLSDAYRRAISTRRSAWRVIESHVKKSTMDKQKQGVKELQKKVESEAEEKGREILTLLDNQLIPKAADPEAKVFYMRMKGDFHRYLAEIKPSETKDLRNALKAYQEAYSIAQEKLRPSHPIRLGVALNFSVFYEELLKSTEEARRIAQKAHDDANAVILAESNNKTLKEALDLMIKLSNNLREWNKRKGGAE

SEQ ID NO: 120455 - protein, 97 aa, Heterodera glycines
  Coding regions on vcDNA: vcDNA=SeqID_46878; Strand=-; Position=1 -118,799-971
  Homolog annotation: Hit_ID=NP_498595.1; Match level="QueryCoverage =91%, HitCoverage=41%, E-value=7e-31, Identity=67%"; Hit description =NADH:ubiquinone oxidoreductase complex I, 23.9 kD mitochondrial subunit, Fe3S4/Fe4S4 electron transfer ca
  Essential gene: C elegans homolog=T20H4.5; Phenotype=Emb
MPFCPLCSEYVGETAASDGTLQGDTSAAMASALFHEMIKGAATIVGHTFMEPVTINYPFEKGPLSARFRGEHALRRYPSGEERCIACKLCEAICPAQ

SEQ ID NO: 120456 - protein, 212 aa, Heterodera glycines
  Coding regions on vcDNA: vcDNA=SeqID_46879; Strand=+; Position=1-660
  Homolog annotation: Hit_ID=NP_510671.1; Match level="QueryCoverage =99%, HitCoverage=23%, E-value=6e-41, Identity=38%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
KYFDSVPHNLLLYKLEKIGIRGKLLLWIKCFLNNRTFRVKIGDALSSSKKVTSGVPQGSVLGPLLFLIYINDLPDALPSGVKLKLYADDVKLSRADTEIMHKALHILSEWANKWQVSIQNTFVLYLGSKNQKETYKFDGNTINAVDTIRDLGVNIDNKLQFRMRSLFRVIKSKSSRIWIILYKTYVRPLLEYAPEVWNPSLQKNIKKIEKFK

SEQ ID NO: 120457 - protein, 170 aa, Heterodera glycines
  misc_feature (4)..(4): Xaa can be any naturally occurring amino acid
  misc_feature (158)..(158): Xaa can be any naturally occurring amino acid
  misc_feature (164)..(164): Xaa can be any naturally occurring amino acid
  Coding regions on vcDNA: vcDNA=SeqID_46880; Strand=-; Position=1 -189,752-830,1194-1443
  Homolog annotation: Hit_ID=AAK26376.1; Match level="QueryCoverage =77%, HitCoverage=74%, E-value=9e-63, Identity=65%"; Hit description =beta-transducin repeat-containing protein [Heterodera glycines]
  Essential gene: C elegans homolog=K10B2.1; Phenotype=Emb,Lon,Lva,Pvl
NHRXNFFFRQFRLKLTSFNFLQNRLWDIECGNCLRVLEGHEDLVRCIRFDSKRIVSGASDGKIMIWDLAAALDPMTPPNSICIKTLSQHTGRVFRLQFDEFQIISSSHDDTILIWDFLNTGPSAAVAAGAAAAAAHNQAKEGEAGAGTVPGGGGGCHXKSFINXRSKGAM

SEQ ID NO: 120458 - protein, 159 aa, Heterodera glycines
  Coding regions on vcDNA: vcDNA=SeqID_46881; Strand=-; Position=1 -173,234-340,839-903,1443-1562,1954-1975
  Homolog annotation: Hit_ID=AAK26376.1; Match level="QueryCoverage =88%, HitCoverage=32%, E-value=1e-77, Identity=97%"; Hit description =beta-transducin repeat-containing protein [Heterodera glycines]
  Essential gene: C elegans homolog=K10B2.1; Phenotype=Emb,Lon,Lva,Pvl
FAKMFSNFHISSSLSLTWKKYFFCSKDQATRAISQSWRQPKNGEDALEFQHKFYRELYPKITADIRQIEQNWREGRHRLERINCQSENSKGVYCLQYDDEKIISGLRDNTIKIWSRPSLGCVQTLSGHTGSVLCLQYDNQMIASGSSDATVRFFSKNTK

SEQ ID NO: 120459 - protein, 417 aa, Heterodera glycines
  Coding regions on vcDNA: vcDNA=SeqID_46882; Strand=-; Position=1 -147,282-338,390-473,524-619,697-789,840-896,948-1031,1082-1177,1255 -1347,1390-1431,1517-1729,1788-1979
  Homolog annotation: Hit_ID=CAE58953.1; Match level="QueryCoverage =17%, HitCoverage=6%, E-value=5e-11, Identity=42%"; Hit description =Hypothetical protein CBG02221 [Caenorhabditis briggsae]
  Essential gene: C elegans homolog=F37D6.1; Phenotype=Unc
MSDNIDFQNEIREMLRGINQKIDLCNERIDTLHQDMAVLKSVAALKSEKDLPCTAAVEPLNQEEKKKEESSGPSEVEHAQNMENVPEKYLPETEIKGLTFTVAIEPLDQEEKKDESVTDEREPGVDKEELSGPSEVEHAQNDVENMPENYLPSNETETKDVPCTAAVEPLNQEEKKKEESSGPSEVEHAQNMENVPEKYLPETEIKGLTFTVAIEPLDQEEKKDESVTDEREPRADKEELSGPSEVEHAQNDVENMPENCLLSDDTETKGLTNSHKTPLLAGCQITASGFMGTDRVKIGRLVELHGGVFTGQMSRATCTHLIAAASSGEKYRRAREWGTVKVVTSEWLFKCDEMGYRLREDHFLLDNDGEKRRSSADIEWKTTEGQQRNTTKDERKENMKPATKKMKVDMKLKKNEH

SEQ ID NO: 120460 - protein, 336 aa, Heterodera glycines
  Coding regions on vcDNA: vcDNA=SeqID_46883; Strand=-; Position=1 -372,418-579,628-687,1050-1171,1213-1300,1345-1386,1651-1815
  Homolog annotation: Hit_ID=AAG12473.1; Match level="QueryCoverage =59%, HitCoverage=54%, E-value=1e-79, Identity=71%"; Hit description =transcription factor DP1 [Brugia malayi]
  Essential gene: C elegans homolog=T23G7.1; Phenotype=Emb,Stp,Unc
MPAQLRFQPSNAIGTHQRSIITAQQFQQQPFCVKRARYDYDLYEGQSHHNFQRQRFDQTPPSAIHPMRTFQIRHRSTDKTRGLRHFAQKVCEKVKQKVQTNYNEVAEELVNEYFDNIAEVPSDPEKLQYDTRNIRRRVYDALNVLMAMNIIEKEKKEIRWVGLPTSSLAECRRLEEEKAQRQERIRQKTEQLQELIVQRNRENERVNGRPLDSTILYLPYIIVSTNKKTNVECAVAPDKSEYLFNFDRPFEIHDDIEVLKRLGLAYGIDRGEVDPAYVPHIKFLTSFIIVKATMQVTAHKTIGQITFFKFFYRVQILPRNDFKFVADKIRLAAVSY

SEQ ID NO: 120461 - protein, 153 aa, Heterodera glycines
  Coding regions on vcDNA: vcDNA=SeqID_46884; Strand=+; Position=1 -204,535-672,951-1070
  Homolog annotation: Hit_ID=NP_499549.1; Match level="QueryCoverage =62%, HitCoverage=71%, E-value=2e-26, Identity=57%"; Hit description =acyl carrier protein mitochondrial (15.0 kD) (3N4) [Caenorhabditis elegans] emb|CAB60498.1| Hypothetical
  Essential gene: C elegans homolog=Y56A3A.19; Phenotype=Lva
MNKAFVKTALCSKSRNAFLFKRLVSPVQIGCRPITGGGFGHPMTRQKMQMYSPEMRAVNYQQKRTHMHAILTKKTVEDRVMLNLHLFDKVDNDKLTFDSDFFKDLGIDSLDFVEFIIAIEDEFEFEIPDGDSDRMRTPRDVYNYICDKCDVYD

SEQ ID NO: 120462 - protein, 193 aa, Heterodera glycines
  Coding regions on vcDNA: vcDNA=SeqID_46885; Strand=-; Position=1 -184,538-703,1295-1474,1890-1943
  Homolog annotation: Hit_ID=NP_507972.1; Match level="QueryCoverage =82%, HitCoverage=22%, E-value=3e-44, Identity=54%"; Hit description =eukaryotic membrane protein DUF747 (80.7 kD) (5V59) [Caenorhabditis elegans] emb|CAB62802.1| Hypothetical
  Essential gene: C elegans homolog=F26F2.7; Phenotype=Emb
DQVQQQRVHLDDEGQNGTLELDADQFAHSSSTNTDTDSDEIVNVARKKPTVFEYFCMEVSRRYSLQNEKEQYAEKRRKVYAFLRIPVELEKFIYYGFRQCLDAFCHTFTILPIRVLFNLFACSVRLKRWSAADTCDILKLIIIFCASWFMQFVDTSVVYHIVRGQGIIKLYIFYNMLEVADKLFSSFGQVRAC

SEQ ID NO: 120463 - protein, 429 aa, Heterodera glycines
  Coding regions on vcDNA: vcDNA=SeqID_46886; Strand=-; Position=1 -1189,1779-1879
  Homolog annotation: Hit_ID=NP_508269.1; Match level="QueryCoverage =87%, HitCoverage=57%, E-value=2e-34, Identity=26%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTCPQKISDSSPLAINSGLNIFSVPPTNVSVVRSFFRQVLPLATITQESPYLFRLYSDNLWTDLSRVYLYLELSIEKPGANDKWVAIDDADTSVSAIQGIGQTFVQQLKVTVGNTEVYDSGNLYPFKAYITNELSFPINAKKNFLGSTGYYHTVNQDDSSDDGYKERCKIFKGGKNAQFLSRLDFDLGNQELYLLNNLDLLFTIYKAKDVFLLQTLKANDSTKYRLTVHDVKIYAKMVEVQPSLNMSLYKTLEKQPATYAVRKTEIKSSFISVGRYEFEYNVFSATIPRRVTIALVGNSAFHGDYKLSPFMFEPFDLREISVHAGGVVYPAVPYKLNFSNDHFVSAFVDMYEALGMANSERSFDISMAQFKKGWTFFVIPLTSTLDDSCGFELLRNDSFLFGHRRIEAALLQRAEREAEILRQYAENQQ

SEQ ID NO: 120464 - protein, 272 aa, Heterodera glycines
  Coding regions on vcDNA: vcDNA=SeqID_46887; Strand=-; Position=1 -87,130-283,331-413,454-632,704-833,877-915
  Homolog annotation: Hit_ID=NP_495918.1; Match level="QueryCoverage =95%, HitCoverage=57%, E-value=1e-73, Identity=55%"; Hit description =RNA processing factor 1 (45.2 kD) (2J285) [Caenorhabditis elegans] emb|CAA90124.4| Hypothetical protein F
  Essential gene: C elegans homolog=F44G4.1; Phenotype=Lva
DMENDAMFFGGSAIRKVLITTSPRAKLKTFKLCFELKKVIPNAEKTFKLCFELKKVIPNAEIVSRKNVAIKRVVRQAIERGFSDLMVVHEDRKKPNGIVFCHLPNGGIVFCHLPNGPTAFFKINSLQYSKQIKDVGEATEHYDVGEATEHYPELILTNFNTRLAKTVSRMFACLFPQKADYGGRRVVTFHNQRDYVFFRHHRYEFKKEYEFKKEGQKAALHELGPRMTLRLKWLQKGTFDTRGGEYEFYVKRHDMEKSRRHDMEKSRRRFML

SEQ ID NO: 120465 - protein, 392 aa, Heterodera glycines
  misc_feature (213)..(213): Xaa can be any naturally occurring amino acid
  misc_feature (245)..(245): Xaa can be any naturally occurring amino acid
  Coding regions on vcDNA: vcDNA=SeqID_46888; Strand=+; Position=1 -1154,2294-2323
  Homolog annotation: Hit_ID=NP_510671.1; Match level="QueryCoverage =96%, HitCoverage=41%, E-value=9e-62, Identity=35%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
FNFLKRFHLILTRPLTDLFKLSLKSGKLPKIWKTSIILPLFKNGDKNLASNFRPISITCLRKRSTTLQLISTLEDWYNAILLNKKIDCIYLDIIKAFDKVPHELLIYKIEKIGIKGNLLNWLKDFLTNRTFKVRINQQFSKKFPIKSGVPQGSVLGRILFLIFINDLSPVIPERISLKLFADDTKIYLCYDTEFQRKKLNEALHCVCQWAQMXGLQFSPEKSASLYLSKDNFKVPYQFNGKTIKXTQTIRDLGILIDNKLTFKSHISSILQKAYLRSRTLFQKIKSKSSKTCIKVYKSYIRPLLEYSSENWNPHIKKSNYSLEKFQKFFTKKVFLKCHLPVLQYSDRLKYLNISTLGNRRKYLDLITAFKIIKQETHLNPLKFFSLKNGHTH

SEQ ID NO: 120466 - protein, 201 aa, Heterodera glycines
  misc_feature (11)..(11): Xaa can be any naturally occurring amino acid
  Coding regions on vcDNA: vcDNA=SeqID_46889; Strand=+; Position=1 -71,116-180,404-678,734-929
  Homolog annotation: Hit_ID=CAE59341.1; Match level="QueryCoverage =97%, HitCoverage=11%, E-value=5e-25, Identity=33%"; Hit description =Hypothetical protein CBG02686 [Caenorhabditis briggsae]
  Essential gene: C elegans homolog=C56E6.1; Phenotype=Lva
SIVRPFFDSVXRWADRDFGEDLRNFLEEISYSDLASYAQLIHHKDIIIQCLLRHLADRSLSLPAFCDFCSAIATDLRDDFHTHFWQIFDAISNLVLASKGKEQCSDNELECTFRAMEQIVRINFRFISARLKQLFSRLLPLFAFPSDGRLRFISARTFSFVFLKSPFPHKLAKFLLVKCFSDCGHLRDGLSLFFFDAFLGV

SEQ ID NO: 120467 - protein, 302 aa, Heterodera glycines
  Coding regions on vcDNA: vcDNA=SeqID_46890; Strand=+; Position=1 -132,194-323,400-592,835-1288
  Homolog annotation: Hit_ID=AAH62832.1; Match level="QueryCoverage =85%, HitCoverage=89%, E-value=6e-95, Identity=60%"; Hit description =Unknown (protein for IMAGE:6997127) [Danio rerio]
  Essential gene: C elegans homolog=Y106G6H.2a; Phenotype=Gro,Stp
MAQAVAAVAPAPNANAASAHTTQPQVMAPSYPLASLYVGDLHPDVTEAMLFERFSNAGPVLSIRVCRDAITRRSLGYAYVNFQQPADAERALDTMNFDMILNKPIRIMWSQRDPSIRRSGAGNIFIKNLGKEIDTKAIYDTFSMFGSILSCRFVGKFVPRTAREKQIGDPSSRFTNVYVKNFGEAMDSEKLSEVFSQYGEIISAKVMEDDSGKSKGFGFVAYKDHKSAARAVEKMNEVSVPGSEKVEQKFTVCRAQKKSERQAELKRRYEQYKAERIQRYQGVNLYGFCLVGGNFSQILGFC

SEQ ID NO: 120468 - protein, 98 aa, Heterodera glycines
  Coding regions on vcDNA: vcDNA=SeqID_46891; Strand=+; Position=1 -106,297-485
  Homolog annotation: Hit_ID=AAL78224.1; Match level="QueryCoverage =100%, HitCoverage=41%, E-value=1e-39, Identity=85%"; Hit description= hypothetical protein Hgg-30 [Heterodera glycines]
  Essential gene: C elegans homolog=Y106G6H.2a; Phenotype=Gro,Stp
YVKNLHDTINDETLRSNFESYVTSQVQRFVFNGLLVMCDEHGRSKGFGFVCFEKADEATKAVVEMNNKIIENKPLYVALAQRKEDRKAQLASQYMQRL

SEQ ID NO: 120469 - protein, 200 aa, Heterodera glycines
  Coding regions on vcDNA: vcDNA=SeqID_46892; Strand=-; Position=1 -215,452-632,707-838,892-1006
  Homolog annotation: Hit_ID=CAE70646.1; Match level="QueryCoverage =98%, HitCoverage=55%, E-value=9e-32, Identity=37%"; Hit description =Hypothetical protein CBG17349 [Caenorhabditis briggsae]
  Essential gene: C elegans homolog=F08B12.2; Phenotype=Lva,Unclassified
GRRRLFLRFYPSLKALLFLVTLLFQLAFVFSFSSVPSLSLLLAKCRLEKLTLSDVAQFDAEGQLPFHLRRTNVFARLWRSLVSLPSTLGRLFTYALFLVQFLEYFYSDELGRRFGQFVEGRRNIRIPTHPFNNLPTEQQTLCMEVDKCPICRRIRKNDTVLTVSGYVFCHSCIFNFVRIEHCCPITSLPATSNELVKIYN

SEQ ID NO: 120470 - protein, 436 aa, Heterodera glycines
  Coding regions on vcDNA: vcDNA=SeqID_46893; Strand=+; Position=1 -210,261-427,471-615,969-1130,1177-1622,2134-2314
  Homolog annotation: Hit_ID=NP_496951.1; Match level="QueryCoverage =94%, HitCoverage=81%, E-value=1e-48, Identity=28%"; Hit description =cactin (2O424) [Caenorhabditis elegans] emb|CAB76745.1| Hypothetical protein W03H9.4 [Caenorhabditis eleg
  Essential gene: C elegans homolog=W03H9.4; Phenotype=Emb
MEKWGTTWTKNIAEEDGLLQLQARRKNSTKCLDRKRLEKILREKEEKQRLKEIETPDEKRTRRLAKKLQKEERRRAETINGFPEVIPYTDLNNPFNDTNLTDTFIWKKKWESEGKANVSVKKAEKVNRETIAKNFAEMEQLKRNREARDAAREDMEMITRDQERRQCDWSRTEDVYRLIDGHKNKCYWDDIETVAKNGMKRLLDTRKRTADIGTVHSSVQEEVHKIFKGKTYDELEQLESQITARISNANRGTDVTYWESLLDSLRPFMAKQRLKELHTKMTQLRLKIIRQEQINQMDKSDDRDQVEEETVEKDSGETDEEKPSEDELEMEIEQKAKLERAKYEDKQQTVQQETKTMPFTIEQFIGADDEQREQMNHFWFNRYVKAKDKRMLEIARQGMDQDEAEFSVEEKLEKQNFLWSDKYRPRKPRYFNRVRD

SEQ ID NO: 120471 - protein, 337 aa, Heterodera glycines
  misc_feature (78)..(78): Xaa can be any naturally occurring amino acid
  Coding regions on vcDNA: vcDNA=SeqID_46894; Strand=-; Position=1 -846,1495-1662
  Homolog annotation: Hit_ID=NP_510671.1; Match level="QueryCoverage =96%, HitCoverage=32%, E-value=9e-58, Identity=38%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
YQFGFVRNRSTTFKLITVVEDWYEATINGKNVDCIYIDFQKAFDSVPHNLLLYKLEKIGIKGKLLMCIKGFLSNRTFXVKIGDSLSSSKKVTSGVPQGSVLGPLLFLIYINDLPDALPSGVKIKLYADDVKLYICYKAKADTEIMHNALHNLFEWANKWQIKVSIQKTFIYLGSKNPKETYKFDGNTINAVDTIRDLGVNIDNKLQFSDHINQITRNAYLRMRSLFRIIKSKSSKIWITLYKTYIRPLLEYAPEVWNPSLQKNIKKIEKCQKYFTKRVFFKVREPFLNAAFRQFHTKRLEYLQLPTLENRRKLFDLFMAHKIAYGRTDLKLFSIFNP

SEQ ID NO: 120472 - protein, 306 aa, Heterodera glycines
  Coding regions on vcDNA: vcDNA=SeqID_46895; Strand=+; Position=1-921
  Homolog annotation: Hit_ID=NP_494224.1; Match level="QueryCoverage =79%, HitCoverage=58%, E-value=6e-29, Identity=32%"; Hit description =predicted CDS, putative cytoplasmic protein family member (2C560) [Caenorhabditis elegans] gb|AAB66195.1|
  Essential gene: C elegans homolog=F19G12.2; Phenotype=Unclassified
MRKLTAPNGEWGYLDATDQVVPIQLIGHTFIRDMKIAINGREIFNSNSLMAYKTYLSHELSQSLEAKVSHLTAAGYDREDANNLQNANSEGFKSRRQRYLGGRTAQYIAKIDADLFNVPQYLINHCEIDITIQPHDGNFLLIDTLDPPGQPYSIELVGLKLYCKKVSLMDGLALKLAKKLEMKPARYAVRKTMMEALFISPGRYEFNANLFMDQVPRRVTMGLVANSDYVGNIKRSPFNFQHFNVHELSVVANGRSYPQAPMTLTVKIGNLSAPTMTRKRRLVLPTLHMEMELIIFLFAHSLYLCV

SEQ ID NO: 120473 - protein, 50 aa, Heterodera glycines
  Coding regions on vcDNA: vcDNA=SeqID_46896; Strand=+; Position=1-152
  Homolog annotation: Hit_ID=AAV34853.1; Match level="QueryCoverage =100%, HitCoverage=98%, E-value=8e-19, Identity=84%"; Hit description= ribosomal protein L39 [Bombyx mori] gb|AAK92174.1| ribosomal protein L39 [Spodoptera frugiperda] dbj|BAD2
  Essential gene: C elegans homolog=C26F1.9; Phenotype=Emb,Lva
MAAHKTFIIKRKLAKAAKQNRPLPHWARMKTGNRIRYNAKRRHWRRTKLK

SEQ ID NO: 120474 - protein, 385 aa, Heterodera glycines
  Coding regions on vcDNA: vcDNA=SeqID_46897; Strand=+; Position=1 -144,2371-2577,2641-2826,2869-3035,3090-3372,3428-3597
  Homolog annotation: Hit_ID=CAA65506.1; Match level="QueryCoverage =69%, HitCoverage=77%, E-value=6e-42, Identity=38%"; Hit description =cuticular collagen [Teladorsagia circumcincta]
  Essential gene: C elegans homolog=T07H6.3a; Phenotype=Bmd,Gro,Unc
MYNDEKMVVRPTQLRGFWMHNSFLLESGKRPVKLYTNYSILLHLANEEMADFDKHAAQREAESLRTLAFFGVCLSTVATVIAVLSVPFAYQHFQQIGAQMQNEVDFCKMRSGNMWREVTRTQAYSKVSHDSRHKRQAGGCCGCGVSPPGPPGPPGPSGQPGGDGQPGGSGQPGAPGPQAARQLLARTRQAADACRNVRPPSPDSPARPDPPDPRDRTANPDSRHRPRLLAAPDHRDLLDPMDSPATPESLANPASPANSPRARPSLDRLAHQDPLASPDSPARTDSPASLETPARKDTLATAEAPANPATPEAAASPDSPEHRDPAANATIAHRPAPPPATECDQSTIDNWRRTPTDDPRGCCPFVSHHFPDHFGISKTLIGQFS

SEQ ID NO: 120475 - protein, 146 aa, Heterodera glycines
  Coding regions on vcDNA: vcDNA=SeqID_46898; Strand=-; Position=1 -52,106-178,247-374,562-665,729-788
  Homolog annotation: Hit_ID=NP_504287.1; Match level="QueryCoverage =99%, HitCoverage=78%, E-value=4e-53, Identity=63%"; Hit description =putative secreted or extracellular protein precursor (18.2 kD) (5F281) [Caenorhabditis elegans] gb|AAB658
  Essential gene: C elegans homolog=F46E10.11; Phenotype=Gro,Lvl,Prz
LLRSKRQWGCPSACSPCMNSAQCQRMNSAQCQRYQLATVCVLGCCCPAQNNGNSGACDGDPAVAACLNGLCGQGYFCNARNFCCRCQSGTSPGPCVNNLCPPGYACNTNNFCCSLGSGSVLGPCVNECPVGYACGAGNLCYPVTGS

SEQ ID NO: 120476 - protein, 218 aa, Heterodera glycines
  misc_feature (23)..(23): Xaa can be any naturally occurring amino acid
  Coding regions on vcDNA: vcDNA=SeqID_46899; Strand=-; Position=1 -234,292-334,670-793,847-940,1198-1269,1319-1367
  Homolog annotation: Hit_ID=CAC00543.1; Match level="QueryCoverage =89%, HitCoverage=40%, E-value=1e-55, Identity=58%"; Hit description =necepsin II [Necator americanus]
  Essential gene: C elegans homolog=R12H7.2; Phenotype=Ced
RCRSRVVVYFRTEQFNFFVFLIXHDLFFHLCSVPLRRMDTVRARLALTGSLEQFRKHRTESLRRTVERMNNNYNNNEEVGTEIDEVGTEIDELLRNYMDAQYYGDISIGSPAQNFTVIFDTGSSNLWVPSKKCPIYDIACSLHLHHKYDGAKSTSYQPDGRKVAIQYGTGSMKGFVSKDIVCMANICVQKQEFTEATSEPGLTEPGLTFVAAFDGILG

SEQ ID NO: 120477 - protein, 353 aa, Heterodera glycines
  misc_feature (189)..(189): Xaa can be any naturally occurring amino acid
  Coding regions on vcDNA: vcDNA=SeqID_46900; Strand=+; Position=1 -103,312-385,1771-1950,2577-2786,2988-3141,3189-3315,3442-3581
  Homolog annotation: Hit_ID=AAN78300.1; Match level="QueryCoverage =100%, HitCoverage=50%, E-value=2e-82, Identity=48%"; Hit description= heat shock protein 70 A [Heterodera glycines]
  Essential gene: C elegans homolog=F26D10.3; Phenotype=Lva,Ste
MPRNSHAIGIDLGTSASRVGVFRNGYFASIHNDRGKRMMPSYVAFTDSGPLVGEAAKAQLAINPSNTIFDFFHLIGRKFVDRAVQANINRWPFRVVPGEDGRPKIAVQSNGKQQTFTVETILSMLLAKLKHSAEAFLGHTVADAVLTVPTHFGHSQHQSVKDSAKIAGLNVLRLLSAPTSASIEYGRDXNYWENVNVLIFDLGASNVGVTIVNCEDGIIRVKSCVGDTRVGGDDFTNRMVNHFVAEFMRQHGYMLSWSPEARMVNHFVAEFMRQHGYMLSWSPEALFRVRAACENAKCTLSLYTEDSLGFQPLFFGFHFIITIITLRFSIELDSLLISSREGDEALRSKQLDK

SEQ ID NO: 120478 - protein, 197 aa, Heterodera glycines
  misc_feature (1)..(1): Xaa can be any naturally occurring amino acid
  Coding regions on vcDNA: vcDNA=SeqID_46901; Strand=+; Position=1 -87,129-212,268-336,385-537,802-879
  Homolog annotation: Hit_ID=NP_741810.1; Match level="QueryCoverage =90%, HitCoverage=33%, E-value=8e-47, Identity=54%"; Hit description =aspartate aminotransferase Complex With Alpha-Methyl (45.6 kD) (XG861) [Caenorhabditis elegans] gb|AAA803
  Essential gene: C elegans homolog=T01C8.5; Phenotype=Gro
XAIYPTLYTVKINFSSVWFSNVEMGPPDAILGITEAYKRDTNPQKVNILGITEAYKRDTNPQKVNLGVGAYRDDQGKPFVLPSVRQGKPFVLPSVRQAEQEIIAAKMDKEYAGIAGLPDFTEYAGIAGLPDFTASAIELALGKDSEVLKAKRNATVQAVSGTGALRTGAEFLSKWSHRKVVYQPAPTWGNHVPVFKC

SEQ ID NO: 120479 - protein, 356 aa, Heterodera glycines
  Coding regions on vcDNA: vcDNA=SeqID_46902; Strand=+; Position=1 -129,635-777,835-906,999-1051,1352-1500,1694-1805,1849-1913,1973 -2119,2150-2213
  Homolog annotation: Hit_ID=CAE72504.1; Match level="QueryCoverage =91%, HitCoverage=61%, E-value=1e-102, Identity=61%"; Hit description= Hypothetical protein CBG19683 [Caenorhabditis briggsae]
  Essential gene: C elegans homolog=T26A5.3; Phenotype=Emb,Lva
NMLKPFSHLNSIQCTKHLLVSKRPMHIWMPDAQFMRQYGPSFGQWLNSKTQIDPEDKVGLRKLASMEKISHISWNDFACEFREAQIDSMILNFGPNHPAAILNFGPNHPAAHGVLRLVLKLEQEVCIKASPHIGLLHRGTEKLIEYKTYTQALPYFDRLDYVSMMNNEQAYSLAVEKLLGIDIPPRAKWIRTLFAELTRIQNHIMAITTHALDVGAMTPFFWMFEDREKLMEFYERVSGARMLMEFYERVSGARMHANYVRPGGVAWDLPIGLMDVAWDLPIGLMDDIYDWCTQFPQRIDELEDTLTENRIWKKRLIDVGVGSADLTPNLGWRGGGDLTPNLGWRGGGGGGVGERE

SEQ ID NO: 120480 - protein, 87 aa, Heterodera glycines
  misc_feature (78)..(78): Xaa can be any naturally occurring amino acid
  Coding regions on vcDNA: vcDNA=SeqID_46903; Strand=+; Position=1 -133,259-385
  Homolog annotation: Hit_ID=NP_509231.1; Match level="QueryCoverage =88%, HitCoverage=74%, E-value=4e-35, Identity=96%"; Hit description =histone (his-38) [Caenorhabditis elegans] ref|NP_507034.1| histone (his-1) [Caenorhabditis elegans] ref|N
  Essential gene: C elegans homolog=ZK131.1; Phenotype=Unclassified
IQGITKPAIRRLARRGGVKRISGLIYEETRSVLKVFLENEIRDVVTYCEHAKRKTVTAMDVVYALKRQGRTLYGFGGXAGRKERRRA

SEQ ID NO: 120481 - protein, 519 aa, Heterodera glycines
  Coding regions on vcDNA: vcDNA=SeqID_46904; Strand=+; Position=1 -203,840-957,1030-1246,1317-1407,1568-1721,1762-1810,2041-2393,2681 -2828,2899-3122
  Homolog annotation: Hit_ID=NP_492377.1; Match level="QueryCoverage =93%, HitCoverage=54%, E-value=1e-114, Identity=45%"; Hit description= SUPpressor SUP-17, metalloendopeptidase ADAM 10 (101.6 kD) (sup-17) [Caenorhabditis elegans] emb|CAB0941
  Essential gene: C elegans homolog=ZK154.7; Phenotype=Sck
QPTAAGRPNSGQSKSLDFQQSADHRHHNSRQSPFSSYMKHHQTQQHHSLRHGDNDVEDAIELLSFPQRTREEIVSLLYNHIKAVNSIYENTDFHGINGINFAIQRTTIYTPDTCAGASSANSAATVGNNPFCEENVDVSHYLNSNSQKDHSAFCLAYSLTYRDFLGGTLGLAWVASPSQSTAGGICQRFQRYNEQQRGGVNRSLNTGIITTIFPPIASLPCPTATSSCSPPAPPGTSRTTPRVSKCSVANISEVLYEVLGQSPKNQQFGRKKNCFTDQLKSFCGNQIREDGEECDCGFTKQDCHENQDQCCAPRENNDERTMCRRLAGKKCSPSEGICCRAADCSFVQRNGRVCREESECQHEQKCDGTQAKCPDSRNKPDGKACQESTKASRARWLNLCAPWHARLFPDRGQAGGLVPVGLPNGSGYGQAWVLGIVSYYNVTSGCQAAADIPRLTVYTQEGRKSGHLLLPPGSPCNDYQGYCDIFRKCRSVDSNGPLSRLRTLLFNSEKIQEFKEWVK

SEQ ID NO: 120482 - protein, 122 aa, Heterodera glycines
  Coding regions on vcDNA: vcDNA=SeqID_46905; Strand=+; Position=1 -198,674-810,998-1031
  Homolog annotation: Hit_ID=NP_492330.1; Match level="QueryCoverage =36%, HitCoverage=12%, E-value=2e-13, Identity=88%"; Hit description =isocitrate dehydrogenase 3 alpha (1J182) [Caenorhabditis elegans] pir||T22149 hypothetical protein F43G9.
  Essential gene: C elegans homolog=F43G9.1; Phenotype=Emb,Gro,Pvl
MLKNNLLIRGKSVLFSLPLRAFSLSAQCANGEPIRRVVLIPGDGIGPEISSAVQKIFEAAKTPIDWIVSGVVQSIKLITEQASRRVARFAFEYARQNGRKEVTAVHKANIMSSERPIWTRFV

SEQ ID NO: 120483 - protein, 126 aa, Heterodera glycines
  Coding regions on vcDNA: vcDNA=SeqID_46906; Strand=-; Position=1 -117,257-459,504-564
  Homolog annotation: Hit_ID=NP_496290.2; Match level="QueryCoverage =92%, HitCoverage=57%, E-value=2e-16, Identity=40%"; Hit description =programmed cell death 10 (24.8 kD) (2K896) [Caenorhabditis elegans] emb|CAA90115.2| Hypothetical protein
  Essential gene: C elegans homolog=C14A4.11; Phenotype=Dpy,Emb
MSNNDIIFGNEEGVNYLAPWTYSCLIKTSIDRLKTALSEHLQEVFRQIDRASPSFLYDFSKLLLIESGVAGTNVQESYLRMHANAATEELELPQFAHIAEFQYLSMRAVSLCKVLARIPDEMTDRF

SEQ ID NO: 120484 - protein, 154 aa, Heterodera glycines
  Coding regions on vcDNA: vcDNA=SeqID_46907; Strand=+; Position=1 -153,200-445,501-565
  Homolog annotation: Hit_ID=AAO85519.1; Match level="QueryCoverage =79%, HitCoverage=39%, E-value=6e-33, Identity=53%"; Hit description =putative serine/threonine phosphatase [Oesophagostomum dentatum] gb|AAO85518.1| putative serine/threonine
  Essential gene: C elegans homolog=W09C3.6; Phenotype=Ste
MNEEYCFSTSTVVAQSWAQTNFRPVDEQPNSLVDTLIAKLSCTTFEQFTSEVSAQDIHKLCDVTVGVLQQQSMLIRLQPPVVLCGDIHGQFRDLLRIFKTMGFPPDKKYLFLGDYVDRGTQSLETMVLLFCYKVKYPDSVILLRGNHECSNMNR

SEQ ID NO: 120485 - protein, 167 aa, Heterodera glycines
  Coding regions on vcDNA: vcDNA=SeqID_46908; Strand=-; Position=1 -185,775-870,929-1023,1603-1732
  Homolog annotation: Hit_ID=CAE73991.1; Match level="QueryCoverage =98%, HitCoverage=21%, E-value=4e-29, Identity=52%"; Hit description =Hypothetical protein CBG21624 [Caenorhabditis briggsae]
  Essential gene: C elegans homolog=F15E6.6; Phenotype=Ste
RALAHIDNVYKFGALDVYGYMCKTNLASNTAFRGFGAPQGMFATETIMKHAAEQFGIDVDTAGALVNVYTDGSVLISHGGMEMGQGLHTKILQIASRCLGIDVSTIQIIDTATDKVPNASATAASIHSEPPDFVEGRGSESYSYCVYGVGCAEVEVDCLTGDHRVQF

SEQ ID NO: 120486 - protein, 291 aa, Heterodera glycines
  Coding regions on vcDNA: vcDNA=SeqID_46909; Strand=-; Position=1 -321,392-561,1125-1506
  Homolog annotation: Hit_ID=CAE62086.1; Match level="QueryCoverage =52%, HitCoverage=25%, E-value=6e-25, Identity=39%"; Hit description =Hypothetical protein CBG06109 [Caenorhabditis briggsae]
  Essential gene: C elegans homolog=F58B3.4; Phenotype=Lva
MQLKSSSSCETTDSESDIECDPNVLPEDKVQQIQFDLARGQGNISSSSDDESSDEMFDQKTGENKEGEEEDNWGELDKEVRRVEWASSKLAICNLDWGNVRAADLMLLFNSLKPNEAKIHSVSVYLSDFGAKSIEREKRNGPMLKVKRFNRKANEREEEDKLEDAFIGSDSEEEEKDKQNQRNAKRDMLLAAAREGLLGNSKAQQSKDEEKDDEQHENVEKEKADEKERTRNESDGEDREITDEDSEEEAVDIQRPKRKTKFQLYLERKKQLKQERKQEEAKRRKRRRGDE

SEQ ID NO: 120487 - protein, 267 aa, Heterodera glycines
  Coding regions on vcDNA: vcDNA=SeqID_46910; Strand=-; Position=1 -254,307-856
  Homolog annotation: Hit_ID=XP_319512.1; Match level="QueryCoverage =71%, HitCoverage=47%, E-value=3e-22, Identity=33%"; Hit description =ENSANGP00000002042 [Anopheles gambiae]
  Essential gene: C elegans homolog=F58B3.4; Phenotype=Lva
MNERTKQIDVEDDSRFMDLAKAPMFREMRKKEQKVQIDDRFKKLLVDKDFREDAFQLMDRRGRPTTKTNRDAHLSHIYELYHDEKTAPPSVSGEMQLKSSSSCETTDSESDIECDPNVLPEDKVQQIQFDLARGQGNISSSSDDESSDEMFDQKTGENKEGEEEDNWGELDKEVRRVEWASSKLAICNLDWGNVRAADLMLVGTKNVDSINKEIALVFTNKLDSVIQLTKTERSENSLGFCLFVGFWSGKHRERKAKRTDVESEAIQ

SEQ ID NO: 120488 - protein, 572 aa, Heterodera glycines
  Coding regions on vcDNA: vcDNA=SeqID_46911; Strand=-; Position=1 -57,344-501,560-657,713-1215,1263-1507,1623-1817,2036-2446,2812-2863
  Homolog annotation: Hit_ID=CAE63494.1; Match level="QueryCoverage =87%, HitCoverage=18%, E-value=2e-90, Identity=36%"; Hit description =Hypothetical protein CBG07964 [Caenorhabditis briggsae]
  Essential gene: C elegans homolog=W02B9.1a; Phenotype=Emb
MCKWTTCDNGCRTENRADNSGVVVQANRTVIVGLNASAADVCECPAYSPKSECDRTVCFNGGVCHDTRPGTFCECRNAQLTGFRCQGNTRSFDGRGFAWFKPLPACTSLNISLRFMTKQDGVLLYNGPMGDPHLDALSYNDYLLMYVEKGMLHAMLQFNGKEPVDLFVEQMVADGRFHRATLSQQHKKLRLVLDDCTTMEVGAQQQQQKPNTAFCLTSRDAPDDDERLNIAAPLQLGGLAPLSGAEDYPSAVREHALGNFVGCTRELVVNNDHYDLYRPIHAEQSSPDCSMFWGSSCAGDSASSSADGRANHLTESASVQLASTFCNGHGECFVESMDQQVAKCECEPGWEGERCDRPINWVEFTSRDSFLKYILQVQPAYQESRLRVLFLPGSTGMGQLASAIGQNQPPAYMKLDINRVQLLVDGQYRLLRELVPDKETALFVARTFFAGSQQGQQGFQGCIGKFRYNSFEMGLRLDESTVEGTLNVAAGNELQLNMAPGGGPAAPTRPHREEDSEGRVRRYRPHQHRHRREPPNPGIVRLDTVKGVVQGCSQVHHCHANGCLHEKTKAAI

SEQ ID NO: 120489 - protein, 382 aa, Heterodera glycines
  Coding regions on vcDNA: vcDNA=SeqID_46912; Strand=-; Position=1-1150
  Homolog annotation: Hit_ID=NP_508269.1; Match level="QueryCoverage =100%, HitCoverage=58%, E-value=2e-47, Identity=31%"; Hit description= ribonucleotide reductase R2 family member (XC45) [Caenorhabditis elegans] gb|AAG24065.1| Hypothetical pr
  Essential gene: C elegans homolog=F19G12.2; Phenotype=Unclassified
QNYIDLSKCYLLSEFRIRKENANGQLVDLAADEVAPIQLIGHTFIRNIKMSINGREVFNANSLMAYKSYFSHELSYSTAAKDSHLNAAGYYRDTGGVLEVGDGCTARRNLFVGSRTAQFMAKIDADLFNQPLYLINFCELDIEILPNDNDFVLIAPPGVAAATRYHFEVVGLKMYVKKVSLMDGLALDIARKLELKPARYAVRKTLMKSLFISHGRFEFTSNLFMDQIPRRITMGLVANADYVGTVSRSPFNFQPFNVREISIIANGRSYPQAAYDLDYPNGKYVRPFNDMNEAVGFSNSSESNGITLAQFGTTHCIYVFNLTSSGDDQAALFDLIRNGTTAVSIKFNQAVPVGGIMLVVMGECDSLVMLDKNRSISTDITI

SEQ ID NO: 120490 - protein, 277 aa, Heterodera glycines
  Coding regions on vcDNA: vcDNA=SeqID_46913; Strand=+; Position=1 -96,171-368,413-501,750-796,880-1237
  Homolog annotation: Hit_ID=XP_425005.1; Match level="QueryCoverage =98%, HitCoverage=71%, E-value=5e-56, Identity=44%"; Hit description =PREDICTED: similar to Ribosome biogenesis protein Brix [Gallus gallus]
  Essential gene: C elegans homolog=K12H4.3; Phenotype=Lva
VADHESDIRFDQFRIPDSNKKSKIQNSLMFESLKYPDFWLSNVDGGPSAKFLVSNVHTMSELNMVGNCLKGSRPILSFDPEFDGKSHLRLIKELLVNTFKTPNHHPRSQPFIDTFKTPNHHPRSQPFIDHVINFAVTEDGNIWFRNYQVAENNELMEIGPRFVLQLIRLFDNSFCGAVLYDNPNYQTPNAIRRQIKLQKAAEFKQRQGQREEGKVKERMIKEVEMEDPLGEVFDTEEKMEEEEKTEEKEEKKKRVNAAKALEKRILKKNKKKRKSTG

SEQ ID NO: 120491 - protein, 281 aa, Heterodera glycines
  Coding regions on vcDNA: vcDNA=SeqID_46914; Strand=-; Position=1 -63,382-471,520-678,780-894,1136-1172,1331-1510,1558-1670,1783-1871
  Homolog annotation: Hit_ID=NP_498534.1; Match level="QueryCoverage =91%, HitCoverage=70%, E-value=2e-61, Identity=43%"; Hit description =UBiquitin Activating enzme related, ectopic membrane RuFfLes in embryo RFL-1, CYtoKinesis defect CYK-5 (r
  Essential gene: C elegans homolog=F11H8.1; Phenotype=Emb
MASWTCMKNSGMYPYMDERQGDKSLEFYRKFFIIICGLDSIEARRWLNATVCSLVEFDDGNNPKSNTIVPLIDGGTEGFKGNSRVIIPFMTPCIQCTIDLYTPQVNFPLCTIAHTPRLPEHCVEYVKVVLWEKEKPFGQGENGSCALEALKLASNISCSLNNYLNFANVEGICFNVVALERDPECLVCGQKSVQMYSVREDCTLSGFLDDLKDKYQLQNPSIRAGSTFLYEINTLMPEMETASRKNLCKTLKELHVTEDSELLVADEALTRSIVFRIKYSK

SEQ ID NO: 120492 - protein, 504 aa, Heterodera glycines
  Coding regions on vcDNA: vcDNA=SeqID_46915; Strand=+; Position=1 -103,163-302,383-546,1142-1244,1293-1555,1605-1725,1811-1989,2188 -2266,2360-2459,2735-2909,2963-3047
  Homolog annotation: Hit_ID=AAK28335.1; Match level="QueryCoverage =99%, HitCoverage=85%, E-value=1e-157, Identity=62%"; Hit description= glycogen synthase [Steinernema feltiae]
  Essential gene: C elegans homolog=Y46G5A.31; Phenotype=Bmd,Emb,Lvl,Unc
MNIPTNGDEYLDRGESAKREKRFVFECAWEVVNKGIYTVLRTKAPISTDELGDQYYMMVGGQHQMEGESNQQTLHEPEGFMGPYVEERVRLEVEVLEPETANLKYTLDQMYDWGFRVVYGRWLIDGYPKVLLFDVGIWKLNIATLFTTHATLLGRHLCASGADLYNNLAMFDIDREAGRLQIYHRYCLERAAVNMAHVFTTVSEITGLEAEHLLKRKPDTLTPNGLNVVKFAALHEFQNLHAQNKEKIHDFIRGHFYGHMNFDLDRTLYLFTAGRYEFCNKGGDLFIDSLAKLNYMLKTSEDKRVKGVTVIAFIIYPANANSFNVDSLRGQAVCKQLKETISKVKDSIAARMFDSCLRGRIPDMEELLLPAERVQLKRCILSSKRDTLPPICTHNMVDDANDQVLNAFRRCHLFNEETECTVMGIPSVTTNLSGFGSFIEKQVPDHDNYGLYIVDRKNRSPDESIQQLSSILYSYCALSRRQRVIIRNRAERVSELLDWKTLGG

SEQ ID NO: 120493 - protein, 500 aa, Heterodera glycines
  misc_feature (14)..(14): Xaa can be any naturally occurring amino acid
  Coding regions on vcDNA: vcDNA=SeqID_46916; Strand=+; Position=1 -235,280-370,411-495,542-675,722-845,896-1068,1161-1277,1321 -1492,1599-1709,1763-1804
  Homolog annotation: Hit_ID=CAE60408.1; Match level="QueryCoverage =98%, HitCoverage=82%, E-value=1e-113, Identity=38%"; Hit description= Hypothetical protein CBG04013 [Caenorhabditis briggsae]
  Essential gene: C elegans homolog=C34G6.4; Phenotype=Unclassified
HKFGKSSEFDLTKXRLPSPMLSDGSPSPQALPNYAQFAYSSSVDYALIAFGTVASVLHGAGFPLLSIVLGGMTSVFLRAENSDFVHGQTPRFLRAENSDFVHGQTPRQNATNSSAISPISKEEFQSEVAAFSVYEEFQSEVAAFSVYYLVLGFVMFVTSYIQIACWEAVAERIACWEAVAERVAHRLRHTYLKALLRQEIAWFDTVQSGNLTARLSDDLERVREGLDLERVREGLGDKASLFIQMFSAFVAGFVVGFFYNWQMALVMALFTPAIAFTGAALFTPAIAFTGAWMGRITATRTQVEQEKYAVAGAIAEETFSSMRTIHALNAERQEMERYEKYEKALEDGRRTGLLKYLYMSVGFGATHLITHASYAVAFWFASRLIVWDEFASRLIVWDEQFDRGTVFIVFFSVMSGSTALGAALPNFTSISSAKGAARHVLKVINREPKIDAYSEGGQMLREVKGEICFRNVRFAYPLRRDIEVLKVLKGVSFKVCPGKK

SEQ ID NO: 120494 - protein, 501 aa, Heterodera glycines
  Coding regions on vcDNA: vcDNA=SeqID_46917; Strand=+; Position=1 -33,415-681,908-1031,1079-1172,1250-1324,1864-2016,2095-2221,2286 -2343,2402-2484,3030-3157,3212-3282,3367-3436,3578-3659
  Homolog annotation: Hit_ID=CAC00543.1; Match level="QueryCoverage =99%, HitCoverage=99%, E-value=1e-128, Identity=50%"; Hit description= necepsin II [Necator americanus]
  Essential gene: C elegans homolog=R12H7.2; Phenotype=Ced
LAFLCLLLALLYLKTISLKNFQNHLFKFFFYSVTLRRMDTVRSRLAAAGSLVQFRKHLRQALRQRLDRLYSDKMARADVAFDTDAAAREGIDEVLRNYMDAQYYGDISIGSPPQNFTVIFDTGSSNLWVPSKKCSFFDLACRYHSKYDHKKSSTYQPYHSKYDHKKSSTYQPDGREVAIEYGTGSMKGFVSKDTVCIMDGMCVEGQEFAEATSEPGDTFVNTKADGILGMAYPAISVQKLATVFNNLVEQKEVEEPVFAFWLNRDPSSEFGGQMTVGGMDKRRFVEPINYVPVTRQTYWQFKVRMEQNGKSKIACRNGCQNGKSKIACRNGCQAIADTGTSLITGPQKDVEAITSLITGPQKDVEAIHKHIGATELAQGEYTLPCDSIEQLPHISFNIGGKAYTLTGKDYVWKVNSRGKTSCLSGFMSGFMGMEMSSTADKLWILGDVFIGRYYTVFDAGQNRVGFAQAKDENECTFSEPIEPKVDDNDDADDADDDGMPA

SEQ ID NO: 120495 - protein, 233 aa, Heterodera glycines
  Coding regions on vcDNA: vcDNA=SeqID_46918; Strand=+; Position=1 -162,238-362,429-642,768-917,964-1014
  Homolog annotation: Hit_ID=CAE57582.1; Match level="QueryCoverage =94%, HitCoverage=69%, E-value=2e-67, Identity=61%"; Hit description =Hypothetical protein CBG00561 [Caenorhabditis briggsae]
  Essential gene: C elegans homolog=F54C9.5; Phenotype=Lva,Ste
MLHLKTKPQVGLTNYAAAYATGLLLARRHLNKLKLDSVYKGKENVDGEDFDVEQEGDNPNPFTCVLDTGLARTTTGAKLFGVMKGVADGGIHVPHSLSSLICSLFHSSETRFFGYDPEEKKYSAEAHRDRIFGKHVADYMAHLKEEDEEAYKRQFSQFIKNGIESGTLEEMYKKAHEAIRADPSFTKKEPKKPKEQKHWNKKKYTLTERKHRVANRKAYLLHLKNQQEAALEG

SEQ ID NO: 120496 - protein, 403 aa, Heterodera glycines
  misc_feature (366)..(366): Xaa can be any naturally occurring amino acid
  Coding regions on vcDNA: vcDNA=SeqID_46919; Strand=+; Position=1 -209,269-464,512-641,686-820,1013-1084,1126-1435
  Homolog annotation: Hit_ID=CAE69945.1; Match level="QueryCoverage =99%, HitCoverage=39%, E-value=3e-98, Identity=47%"; Hit description =Hypothetical protein CBG16328 [Caenorhabditis briggsae]
  Essential gene: C elegans homolog=C10E2.3; Phenotype=Lon
VFFGFGTGASLGRTVRFDNRTATMFPSLLKQQLRDLVLRRKSLVEREPEDDTMMNSATGTTTHPGTEKLSRFSWEIVYGIFIFPNSRFSWEIVYGIFIFPNGIAYDPLMARHQCLCAENSNHVEHSGRVQSVWARLVEKGLAAVCERITARKAPLELLRLVHSARKAPLELLRLVHSPTYVTFFAVSPTACLKMDPAELPLKSFVQLPCGGIGVDSDTYFNDLPCGGIGVDSDTYFNDASTQTAAKMAVGSLVELCCQVMEGKLQNGFACIRPPGHHAEREQAMGFCFFNNVAIAARYIQQVAIAARYIQQRFATTCARIAIVDWDVHHGNGTQLCFEADPNCLYLSMHRHDNGNFFPGNFEKMYXFKFANRFHYFVSFIHSIFFQTFSFSLLFPIFLSFCPN

SEQ ID NO: 120497 - protein, 39 aa, Heterodera glycines
  Coding regions on vcDNA: vcDNA=SeqID_46920; Strand=+; Position=1-119
  Homolog annotation: Hit_ID=NP_491548.1; Match level="QueryCoverage =100%, HitCoverage=15%, E-value=1e-09, Identity=71%"; Hit description= mitochondrial ribosomal protein L47 (1F813) [Caenorhabditis elegans] gb|AAB52351.1| Hypothetical protein
  Essential gene: C elegans homolog=B0261.4; Phenotype=Age,Gro,Ste,WT
MERLEAVVHERNDAFLQLETGDSASPPKRTVTSFMGFTY

SEQ ID NO: 120498 - protein, 150 aa, Heterodera glycines
  Coding regions on vcDNA: vcDNA=SeqID_46921; Strand=-; Position=1 -129,371-561,602-734
  Homolog annotation: Hit_ID=CAE67815.1; Match level="QueryCoverage =61%, HitCoverage=18%, E-value=6e-15, Identity=34%"; Hit description =Hypothetical protein CBG13395 [Caenorhabditis briggsae]
  Essential gene: C elegans homolog=M176.2; Phenotype=Emb,Lva
MPSPFPLSLYTKAFEVQETLNELYFRISCDHEFLLETYKDVIKGDPYIKRCVEIAQQIHDEGVHQPLALSVQRADYLSHWDEQKQCIELKQVGKSDRSKKHSFSDQRLIDVMPKYFAAKFESKKLHLISEVIRNGRTEETLGTSLLVRDR

SEQ ID NO: 120499 - protein, 441 aa, Heterodera glycines
  Coding regions on vcDNA: vcDNA=SeqID_46922; Strand=+; Position=1-1326
  Homolog annotation: Hit_ID=NP_498735.1; Match level="QueryCoverage =95%, HitCoverage=100%, E-value=2e-47, Identity=30%"; Hit description= predicted CDS, putative cytoplasmic protein family member (3J53) [Caenorhabditis elegans] gb|AAK84536.1|
  Essential gene: C elegans homolog=F19G12.2; Phenotype=Unclassified
MTFHKIDASSIDSITNAVDFFSIPPTNVTVSSSKVFEILPSNPLTDTPYHFKIHSSQNYIDLSKCYLLTEFRMRKLTPPNGEWGHLDASDQVVPIQLIGHTFMRDLKIAINGREIFNSNSLMAYKTYLSHELSQSLEAKVSHLTAAGYDREDASNLQNANSEGFKSRRQRYLGGRTAQYIAKIDADLFNVPQYLINHCEIDITIQPHDDNFLLIDTLDPPGQPYSLELVGLKLYCKKVSLMDGLALELAKKLEMKPARYAVRKTMMKALFISPGRYEFNANLFMDQVPRRVTMGLVANSDYVGNIKRSPFNFQHFNVRELSVVANGRSYPQAPYDIDYENWKFVRPYNDTQEALGFANSTYGNGIDYFSFLHTHCIYVFNMTNSGDDHGGLFDLIKKVCTAVNIKFKKPVPDGGITLIVMGEADSIYFLDKNRTIATDTTI

SEQ ID NO: 120500 - protein, 668 aa, Heterodera glycines
  Coding regions on vcDNA: vcDNA=SeqID_46923; Strand=+; Position=1 -246,309-500,1198-1371,1425-1672,1723-1954,1998-2342,2385-2723,2783 -3010
  Homolog annotation: Hit_ID=NP_496536.1; Match level="QueryCoverage =99%, HitCoverage=55%, E-value=0.0, Identity=64%"; Hit description =topoisomerase II (2M169) [Caenorhabditis elegans] emb|CAA94177.1| Hypothetical protein K12D12.1 [Caenorhabd
  Essential gene: C elegans homolog=K12D12.1; Phenotype=Emb
MQVKNHMWVFVNSLIENPSFDSQTKETLTLQAKSFGSKCDVSEKFMKEAAKCGVVDLVLNWVTFKENQQKDKTSGRKTAKLKGVAKLEDANEAGTKNSKRCTLILTEGDSAKTLAVAGLGVIGRDYYGVFPLRGKLLNVREASHKQERKQRREQGEHDIYLYNKDTRSVTFAEFINKELVLFSNTDNERSIPSLVDGLKPGQRKVLFTCFKRADKKEVKVAQLAGAVGEMSAYHHGEQSLMSTIVNLAQNFVGSNNINLLLPIGQFGTRLQGGKDSASPRYIFTQLNPVTKALFPSVDENVLRFLYEENQRIEPEWYCPVIPTVLVNGAEGIGTGWSTNVPNYNPRVLVANMRRLIHSEQLEPMIPWYKGFKGRITRMDETRFETRGLINIIDNGSNDLVEITELPIKTWTQSYKERVIEPMYDGSDKKPQLLQDYKEYHTDQNVHFVCKLKQDELREAEQKGIYDVFSLKSSVNTSNMVLFDAAGCLRKFDSPEQICLEFFECRRELYKKRKRYLEGMLQAQSDQLSEKARFIVMKIKNEIHIENKRKSAIVEQLQKHKFRPDPVKRWKDEQKRKELELCGEANVSDDEEDEDEHADQAVDEALEKRCSDYDYLVGMAIWKLSMEDKDKLLAESESKKKELEVLKKKEWSDLYEEDLEAFTKALDTQ

SEQ ID NO: 120501 - protein, 371 aa, Heterodera glycines
  Coding regions on vcDNA: vcDNA=SeqID_46924; Strand=-; Position=1 -147,493-594,657-849,882-949,1163-1394,1511-1804
  Homolog annotation: Hit_ID=CAE58931.1; Match level="QueryCoverage =100%, HitCoverage=27%, E-value=4e-83, Identity=46%"; Hit description= Hypothetical protein CBG02196 [Caenorhabditis briggsae]
  Essential gene: C elegans homolog=F45H11.4; Phenotype=Emb
FFTRLLPPIAFSAIYSALFTKPNRIARILAGSKKRILTKKPRFLSTFSQVVITWSLVGVQCAIVAVSVMEEMPQAGFDPNLMPRRMFLICSISTRAFLAPFVWNFILILFCTLYAFKTRNLPENFNEAKFIGFTMQVYFFVDIHLLIYLRYCTLVTWGAFVVLYVNAVNKHLLIYLRYCTLVTWGAFVVLYVNAVNKALTASFTFSLSASIALCLLFFPKVFIILLRPEKNVRSSYTTTKLIRCHFGNSQALNDSKQFSSSKARNSTQSLSLGSGTASLHVANHNSVAGTPTSGLCPRRDAFAQTELSTIVRSNHHQQARQRHHGTGGFARFTRTFSVMGGTHGGYGDNAAAVQRAGDRLSESRGGGSGSS

SEQ ID NO: 120502 - protein, 168 aa, Heterodera glycines
  Coding regions on vcDNA: vcDNA=SeqID_46925; Strand=+; Position=1 -167,215-319,662-835,1638-1700
  Homolog annotation: Hit_ID=CAE67815.1; Match level="QueryCoverage =74%, HitCoverage=22%, E-value=9e-09, Identity=32%"; Hit description =Hypothetical protein CBG13395 [Caenorhabditis briggsae]
  Essential gene: C elegans homolog=M176.2; Phenotype=Emb,Lva
DTDEGQKQQYCVTEIEHDPKILLERSQDATDWALSNGLIKLVPAMCQNCRIKMQNQSFVAEFIPISLYPSPFPGKLFRQAMEVHKVITLRAMLLLYFRASQDFAFLKETHRQLVESNEDNKIKKMISLLDGLYEEGIKQPVAMFCQRSHLGPILSPGNLDRDQPRLFG

SEQ ID NO: 120503 - protein, 123 aa, Heterodera glycines
  Coding regions on vcDNA: vcDNA=SeqID_46926; Strand=-; Position=1 -84,201-266,315-392,435-536,594-681
  Homolog annotation: Hit_ID=NP_498363.1; Match level="QueryCoverage =91%, HitCoverage=25%, E-value=1e-23, Identity=49%"; Hit description =imidazolonepropionase (3H359) [Caenorhabditis elegans] gb|AAC24449.1| Hypothetical protein T12A2.1 [Caeno
  Essential gene: C elegans homolog=T12A2.1; Phenotype=Unclassified
MKDVLILHNINQIVQVVDDDRTFCLLGDQMGKIKIMESDGHELAILCIEGRIEQIGIFEEISSRFNSKELTDVTRVDCGGGSVLPGMADAHSHPVFSGDRVHEFAMKLAGETYMEVPMEAKKR

SEQ ID NO: 120504 - protein, 101 aa, Heterodera glycines
  Coding regions on vcDNA: vcDNA=SeqID_46927; Strand=-; Position=1 -162,421-563
  Homolog annotation: Hit_ID=CAB58171.1; Match level="QueryCoverage =97%, HitCoverage=77%, E-value=4e-33, Identity=60%"; Hit description =troponin-like protein [Anisakis simplex]
  Essential gene: C elegans homolog=F54C1.7; Phenotype=Emb,Lvl
MFDKNNHGYIMATQIGQIMRAMDQDFEEKKLRKLIRKFDADGSGKLEFEEFCALGNGYLSTDTLKNLLREIEPSLSDKELQSAVEDIDEDGSGKIEFEGGE

SEQ ID NO: 120505 - protein, 125 aa, Heterodera glycines
  Coding regions on vcDNA: vcDNA=SeqID_46928; Strand=+; Position=1 -123,384-539,911-1009
  Homolog annotation: Hit_ID=NP_504565.1; Match level="QueryCoverage =88%, HitCoverage=92%, E-value=3e-10, Identity=30%"; Hit description =cysteine protease inhibitor Cystatin LIke (15.7 kD) (cli-1) [Caenorhabditis elegans] gb|AAC17767.1| Cysta
  Essential gene: C elegans homolog=R01B10.1a; Phenotype=Ste
MFKIFVLFNAFLLIKFAITDEEREIPPGGEVEQDVNSEMIKTLASRAMDKMNQESNNTLMFIPVKVLSATSQPVAGVRYELRILVGKSKCLKKVYKVEVYQRAWENFEEITFEQEKIANMTGCLG

SEQ ID NO: 120506 - protein, 462 aa, Heterodera glycines
  Coding regions on vcDNA: vcDNA=SeqID_46929; Strand=+; Position=1 -190,558-838,886-988,1035-1169,1265-1458,1505-1687,1736-2038
  Homolog annotation: Hit_ID=CAE61463.1; Match level="QueryCoverage =94%, HitCoverage=29%, E-value=1e-165, Identity=74%"; Hit description= Hypothetical protein CBG05355 [Caenorhabditis briggsae]
  Essential gene: C elegans homolog=F36A4.7; Phenotype=Emb
MGIVQDTLTAVRMMTKRDVFIDYARLMDLLMHLPNWDGKIPQPAIIKPKPLWTGKQVFTKIIPGDTIADTSTYRDIQETIRKAKQDVIDVIEKAHNDDLEPTPGNTLRQTFENHVNRILNDARDRTGASAQKSLSDANNFKAMVVAGSKGSKINISQVIACVGQQNVEGKRIPFGFRHRTLPHFIKDDYGPESKGFVENSYLAGLTPAEFFFHAMGGREGLIDTAVKTAETGYIQRRNATNRAVIQLRYGEDGLDGMWVEDQTVPTHKPNNNLFENEFKLDLTDERQLRKLYTENIVKEITNSADALHSVESEWRKLEEDRNILRSIFPRPSTKVYLPCNLNRLIKNAQKIFHVSMNKPVDLSPVRVIEGVTELTKKLVIVSGEDSISIQAQHNATLLMNILLRSTLCAKQMAKYHKLNLEAFEWLLGEIETRFDQAIWCWYSIFMFYRLRLLHNQAKWLAH

SEQ ID NO: 120507 - protein, 204 aa, Heterodera glycines
  Coding regions on vcDNA: vcDNA=SeqID_46930; Strand=+; Position=1 -84,413-454,507-607,726-819,864-987,1048-1216
  Homolog annotation: Hit_ID=XP_319798.1; Match level="QueryCoverage =92%, HitCoverage=39%, E-value=2e-15, Identity=30%"; Hit description =ENSANGP00000005197 [Anopheles gambiae]
  Essential gene: C elegans homolog=B0280.9; Phenotype=Lva
TNIRRQIPSNQTCFGDGQCFWQHFVVRNLLTGKVALVRQPIVLDSLRMRMARLSGDGSLIGMLANSSDIFVFDFKTMEHLHTFRGGENVVDFCFAPFNRQILYSLAVGGAVNTFDLARCTGQDTFFDQGCVRATCLSCSPSGQFIACGSNTGIVNVYDLTKLSPSLAKSNAPRPVRMFDQLTTLVSFVRFNNDSQMLGFGTAVP

SEQ ID NO: 120508 - protein, 371 aa, Heterodera glycines
  Coding regions on vcDNA: vcDNA=SeqID_46931; Strand=-; Position=1 -120,170-332,435-556,643-729,1339-1413,1460-1577,1716-1773,1819 -1884,1929-2020
  Homolog annotation: Hit_ID=XP_316089.1; Match level="QueryCoverage =90%, HitCoverage=56%, E-value=2e-45, Identity=34%"; Hit description =ENSANGP00000005867 [Anopheles gambiae]
  Essential gene: C elegans homolog=Y39H10A.6; Phenotype=Emb,Ste
PPFQTLYLHNAEVWCVKFFPCGNYLASGAKGNQVLIWRVIPTQVHIHQNPTQVHIHQNIHILQEIVGISSLSWSQDSRYLAVTSTEQANGVGVGLSVPSSVSPEEYVHYTGDAFTTVAFFKDGSHKLACAGEKGHFHVYVSESISAKMFEGFRIRCLYACMDGKTVLAADTHNRIRAYDFETMHEQTLIQEASQIITFCVDRKEKYCLVTTKTEGIRVDRKEKYCLVTTKTEGIRLWDLRTNDLVRSFFGSKHNEFVITSSFGGPDELFIASGSEDNTVVIWNTRRTHPVKRLINTVVIWNTRRTHPVKRLIGHTSTVNAVSWNPVDNSMVASGSDDGHTSTVNAVSWNPVDNSMVASGSDDGTIKWGGGR

SEQ ID NO: 120509 - protein, 181 aa, Heterodera glycines
  Coding regions on vcDNA: vcDNA=SeqID_46932; Strand=+; Position=1 -109,222-354,436-663,844-920
  Homolog annotation: Hit_ID=NP_498509.1; Match level="QueryCoverage =76%, HitCoverage=41%, E-value=1e-35, Identity=53%"; Hit description =initiation factor, 4A-like (45.4 kD) (inf-1) [Caenorhabditis elegans] gb|AAA21170.1| Initiation factor pr
  Essential gene: C elegans homolog=F57B9.6; Phenotype=Lva
QKDNVKSEVGDVPNGGTSFTAQLSDDFTIQVNWDWASNTNEVVDSFDNMQLKDTLLRGIYSFGFEKPSAIQQRAIVPCCSGRDVIAQAQSGTGKTATFSISVLQRVDENAPDVQALVMAPTRELAQQAIPPTLPIGTLWTYLSPFDRFFLLCVHLAKTDKIKMFVLDEADEWCLAGQRPNL

SEQ ID NO: 120510 - protein, 348 aa, Heterodera glycines
  Coding regions on vcDNA: vcDNA=SeqID_46933; Strand=-; Position=1 -109,160-254,1105-1231,1981-2061,2848-2931,3018-3113,3232-3311,3361 -3457,3500-3562,3673-3743,3847-3988
  Homolog annotation: Hit_ID=NP_509580.2; Match level="QueryCoverage =95%, HitCoverage=46%, E-value=2e-63, Identity=27%"; Hit description =Filamin/ABP280 repeat family member (XK45) [Caenorhabditis elegans] gb|AAN60531.1| Hypothetical protein C
  Essential gene: C elegans homolog=C23F12.1a; Phenotype=Gro,Unc
MRLVLFPEPLLVEHVAQLKLETTGEGPVDRVKVQIFEPSGNEIAVVSRTYADGTLRAEWQPASEGRHRVLIRDGSRHICGSPLPVSVLDLSAVRLVGLRNANAGVEQNFSCEVHNETAETRCERRVIHSATSRATLFDPQGSPLPVRCYKQQDDSYWVEFTPEICGAHSIEVMFGDQPVPGSPFHCEVVDPRRVQVHVSRKGAGTGPLAVELTDPQNEPIKLDRVLNSSGDESFTFVPTRLGPHKLALKLAGFAVHGSPFSLVVEEQKEPCVYGAALDYAIERGQQASMIFDPNNHSGGLKVDVHDPSGAKVKHNTNRRPDDSTEISFRPHEVGIYTVDVQFNNRTVQ

SEQ ID NO: 120511 - protein, 89 aa, Heterodera glycines
  Coding regions on vcDNA: vcDNA=SeqID_46934; Strand=-; Position=1 -113,159-315
  Homolog annotation: Hit_ID=NP_501726.1; Match level="QueryCoverage =76%, HitCoverage=85%, E-value=3e-27, Identity=79%"; Hit description =putative protein of eukaryotic origin (4K471) [Caenorhabditis elegans] emb|CAA92471.1| Hypothetical prote
  Essential gene: C elegans homolog=K01H12.1; Phenotype=Emb
MEKSVTESLVFHDEVEIEDFEFDDEFQLYHFPCPCGDRFEITREQLESGEDVATCPSCSLMLRVIYDMEQFVKLETLRLEPTNAVEAVK

SEQ ID NO: 120512 - protein, 162 aa, Heterodera glycines
  Coding regions on vcDNA: vcDNA=SeqID_46935; Strand=-; Position=1 -87,149-192,258-411,938-1106,1367-1401
  Homolog annotation: Hit_ID=CAE69357.1; Match level="QueryCoverage =99%, HitCoverage=55%, E-value=1e-34, Identity=52%"; Hit description =Hypothetical protein CBG15446 [Caenorhabditis briggsae]
  Essential gene: C elegans homolog=F42E11.4; Phenotype=Dpy,Egl,Rup,Unc
MYNDLFQQMLKLEEEKYDINFVVSQKDAEISEITISVNDLRGKFVKPTLKKVSKYDNKFRKAALTEGESTAPKEDFRSKLKTVEKKNVMEELESKQKNKAEKPEWTKKVEKDATGRRASQASSKGGGASEAEPTTPKLAKPTPEEAEEEEEPEVGDEEEDEE

SEQ ID NO: 120513 - protein, 70 aa, Heterodera glycines
  Coding regions on vcDNA: vcDNA=SeqID_46936; Strand=+; Position=1 -84,128-163,375-467
  Homolog annotation: Hit_ID=NP_496300.1; Match level="QueryCoverage =92%, HitCoverage=50%, E-value=2e-27, Identity=93%"; Hit description =ribosomal protein L7Ae/L30e/S12e/Gadd45 (14.0 kD) (2K948) [Caenorhabditis elegans] emb|CAA90127.1| Hypoth
  Essential gene: C elegans homolog=M28.5; Phenotype=Emb,Lva
MQNHWEIILHLPLLCEDKNVPYVFVKSKAALGRACGVTRPVIATSIIQNEGSQLKSQIQKIKEDVEKLLI

SEQ ID NO: 120514 - protein, 220 aa, Heterodera glycines
  Coding regions on vcDNA: vcDNA=SeqID_46937; Strand=+; Position=1 -125,277-517,595-891
  Homolog annotation: Hit_ID=CAF97217.1; Match level="QueryCoverage =81%, HitCoverage=32%, E-value=1e-29, Identity=37%"; Hit description =unnamed protein product [Tetraodon nigroviridis]
  Essential gene: C elegans homolog=D1046.1; Phenotype=Slu,Stp
MADINAILDGTDGDEALNLNDLDEKEVLGDDEEDQHQNQHTTKEEVEDLYDEAMAPSGALSEKRESAEVISSLPSSIQHKSSFAMPMMIKSEPGIAGGSQSGKRYCCYIGNMTWWTTDDQLQKLIQTLGVDDMIDVKFYENRNNGQSKGFALAVFASEPSVKAVMEKLPSKKLHEQSLAVLPYTKQSLAKLEEATKRYDQVPSCFCKMLSYGSSAFFAFL

SEQ ID NO: 120515 - protein, 368 aa, Heterodera glycines
  Coding regions on vcDNA: vcDNA=SeqID_46938; Strand=-; Position=1-1107
  Homolog annotation: Hit_ID=NP_508269.1; Match level="QueryCoverage =99%, HitCoverage=54%, E-value=1e-45, Identity=29%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MSIKKLDSDTNKYVNLKVNEQAATINMIGATWIKNLKITVQGREIYDSNSLYAYKAYLDAELSYSKNVKESDLQASGYYVDSENQDGTDITQQGFELRRKLFSQSQTAQFITKLDADIFNQDKYMVNGVEIDIQLTPNDNEFMIMAASDDKYRIEITACKLYVKTLEVVDGLALDIQKKLENKEAKYAHRKTLIKSTFISENRTEYNGTLFTGQLPKRVILGMVENAAYVGNQKKSPFNFKPFDIRSVTLMANGKQWPAAPFELNFNKNLYTRAFHEMNEALGMASSTDSNGISLEKYRKGWTIFAFNMTNSMEDNEGIDLITEGTTTVCIQFRSPVPSGGITLIAMSEMDSILILDKNRTVMTDTTI

SEQ ID NO: 120516 - protein, 596 aa, Heterodera glycines
  Coding regions on vcDNA: vcDNA=SeqID_46939; Strand=-; Position=1 -327,379-421,471-806,1021-1260,1553-1815,1864-1970,2206-2680
  Homolog annotation: Hit_ID=NP_508269.1; Match level="QueryCoverage =25%, HitCoverage=23%, E-value=3e-20, Identity=35%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MGTEAWIQAYREIRLVCQFNYDVHRNRFVLNTDPRYVKKVEISPQLAYILGFNNTEFMQPEIEAQFMPDMSGGVSSFHVYTPDLIEPMMIGDVTAPVLRIVTIRGDPDQEVSEILIEIRTNSGKKCPIFKKMNTLEIDKTLARNNVTRHYYIGCFAADQIPAGAIVKFPHCMVVNLDPSTSRGSHWVCIYCASPLRLEYYDSLGMWPPPSVLIVNHLSRYKQIQYSSIPLQSANSMDWSAFSSSCVQFGGYNIYRGLPYQRGAGVGAVFRSLMRYLLPIGKQIGSAIGRQGMQSGNRVLTNVLEGKDLKESLVSEIPPTNVSVVRSFFRQVLPLATITQESPYLFRLYSDNLWTDLSRIYLYLELSIEKPGANDKWVAIDDADTSVSAIQGIGQTFVQQLKVTAYITNELSFPINAKKNFLGSTGYYHTVNQDDSTDDGATIPRRVTIALVGNSAFHGDYKLSPFMFEPFDLREISVHAGGVVYPAVPYKLIFSNDHFVSAFVDMYEALGMANSERSFDISMAQFKKGWTFFVIPLTSTLDDSCGFELLRSGTTNVRATFNSPIPHGGVEMIVLGEFDQMIMVDYNRHIVTDSKLG

SEQ ID NO: 120517 - protein, 126 aa, Heterodera glycines; identical to SEQ ID NO: 119174
  Coding regions on vcDNA: vcDNA=SeqID_46940; Strand=+; Position=1 -96,154-438
  Homolog annotation: Hit_ID=P53021; Match level="QueryCoverage=100%, HitCoverage=100%, E-value=1e-66, Identity=92%"; Hit description =Major sperm protein 1 gb|AAA29146.1| major sperm protein
  Essential gene: C elegans homolog=C04G2.4; Phenotype=Unclassified

SEQ ID NO: 120518 - protein, 473 aa, Heterodera glycines
  Coding regions on vcDNA: vcDNA=SeqID_46941; Strand=-; Position=1 -92,151-252,322-415,465-674,727-954,991-1055,1098-1414,1727-1826
  Homolog annotation: Hit_ID=CAE66728.1; Match level="QueryCoverage =97%, HitCoverage=28%, E-value=3e-40, Identity=28%"; Hit description =Hypothetical protein CBG12077 [Caenorhabditis briggsae]
  Essential gene: C elegans homolog=F55C7.7a; Phenotype=Pvl,Stp,Unc
NNVFPQCHVPNRAEDIEHVLRERVALLPGVRDREGRPIIFVPADREGRPIIFVPAREVNSHPDHLRNLLTYLYEVTQDDAKTRGFTFVIDMRDDAKTRGFTFVIDMRRGTTWEIVKPILKILQEYFPALIEYFPALINCVYIVKPDKILEKYKISTTKYKFDVQMISLEAMPKYIDFCQIIREGGSLPYDHDEWIELRKDIERILQRMCEILKNLDDIERILQRMCEILKNLDRISTEMDNAEMPIDVQSSQTSIAKHQDLYPIITAVPMDEFTSEIQSLRDRVIISGHKQSNPDLLSVFPNPDLLSVFPQIEMLKQNLDKQRGIVYAKWDYRKKDGIVYAKWDYRKKDLDRYFQLKLFEKDAEEASQFAFNTRHFLTFVQLSKWICSHLNVLSHRFVLIGESETETNRLLKEHKDFADSVNVSSPNDLNVFHFFADIPSHFLKMPSWLPNAGVDPNSIRSEDELPNAMHRHN

SEQ ID NO: 120519 - protein, 118 aa, Heterodera glycines
  misc_feature (12)..(12): Xaa can be any naturally occurring amino acid
  misc_feature (116)..(116): Xaa can be any naturally occurring amino acid
  Coding regions on vcDNA: vcDNA=SeqID_46942; Strand=+; Position=1 -160,214-306,695-751
  Homolog annotation: Hit_ID=XP_317573.1; Match level="QueryCoverage =82%, HitCoverage=78%, E-value=4e-31, Identity=74%"; Hit description =ENSANGP00000010151 [Anopheles gambiae]
  Essential gene: C elegans homolog=F45H11.2; Phenotype=Lon,Pvl
SFYYAYELVLIXSFELAFLCIFIPMLIKVKTLTGKEIELDIEPTDKVDRIKEKVEEKEGIPPPQQRLIVEEKEGIPPPQQRLIFAGKQMLDEKTAQDYKIQGGSVLHLVLALRGGXMF

SEQ ID NO: 120520 - protein, 342 aa, Heterodera glycines
  Coding regions on vcDNA: vcDNA=SeqID_46943; Strand=+; Position=1 -31,2274-2473,2533-2610,2666-2727,2779-2869,2966-3029,3175-3321,3374 -3466,3582-3671
  Homolog annotation: Hit_ID=AAH77424.1; Match level="QueryCoverage =99%, HitCoverage=19%, E-value=2e-68, Identity=44%"; Hit description =Uty-prov protein [Xenopus laevis]
  Essential gene: C elegans homolog=D2021.1; Phenotype=Gro,Pvl,Sma,Unc
TPPPPSPPPSSPVSKDKLLLKTPLLLVENQKDASAIELQQYCYQPIVLIHGLTMALKIDLSQFSTKTLIQTAPEHEVEVEVRTQFKMPSYDVNLDQMGSTWAIRSSKSWSTISRYGQYQARSSKSWSTISRYGQYQAESFRHSLKEETEKLRQANPKLFQHSLKEETEKLRQANPKLFQQQTPSTSDTPPESSPYKIIKFGTNIDLSDERKFYVQLKELNKLPAFCRLHSTSNMLSYLGHTVFGMNTVQLYLKVPGCRTPGHLENNSFASVNVNIGPGECEPGHLENNSFASVNVNIGPGECEWFGVPYEYWPVFNFFHFRRNIDFLRGAWWSVSDLVKSDV

SEQ ID NO: 120521 - protein, 260 aa, Heterodera glycines
  Coding regions on vcDNA: vcDNA=SeqID_46944; Strand=-; Position=1 -98,143-261,643-1206
  Homolog annotation: Hit_ID=XP_393534.1; Match level="QueryCoverage =48%, HitCoverage=24%, E-value=2e-39, Identity=61%"; Hit description =similar to ENSANGP00000003194 [Apis mellifera]
  Essential gene: C elegans homolog=C56A3.8; Phenotype=Let,Ste
HMRDKQKAKAAVITEQHRIPTKVTATEEETENVSCKGSDNDETTALIKEPQTSKVQTFQDRFVYSIWLCFCKEVIGVFKPKNEEPYGSLNPKWVKWAHKLLCPCCFGRSCLVPNQANNLQQSFDLLAIQGYLSEAGASLVDQKLGLDIVPRTAIVALAAPTFYYGRIDRTVTNTKEQIARNYPDLGRHFKRIGLPPKVGMTFSLSSSITQAEIHLAGQFPAVCPWLQRCQILARPMGTVSGKDIAKAKPKRIATPNLRKV

SEQ ID NO: 120522 - protein, 170 aa, Heterodera glycines
  Coding regions on vcDNA: vcDNA=SeqID_46945; Strand=+; Position=1 -51,95-234,318-565,1562-1635
  Homolog annotation: Hit_ID=AAC47533.1; Match level="QueryCoverage =38%, HitCoverage=31%, E-value=2e-14, Identity=62%"; Hit description =calponin homolog MjCAP-1 [Meloidogyne javanica]
  Essential gene: C elegans homolog=F28H1.2; Phenotype=Emb,Lva
MVHRSSSSGLSVAVMGKQANKYNTQEGTLLLEWIKKVTGANCINTDGSADNFVAQLKDGILLCKVKNSVEKLIAQIEAGNEAGAQLNQRGDGQGQLHVPADEQLGAVHPLLPQAGSHHAGVVPRRGPGRGAGPLLGVHDAQLVGPNYRKYRNRPFLEYRYSYRFYLNVDL

SEQ ID NO: 120523 - protein, 177 aa, Heterodera glycines
  Coding regions on vcDNA: vcDNA=SeqID_46946; Strand=-; Position=1 -72,155-616
  Homolog annotation: Hit_ID=CAE58542.1; Match level="QueryCoverage =67%, HitCoverage=62%, E-value=1e-52, Identity=81%"; Hit description =Hypothetical protein CBG01701 [Caenorhabditis briggsae]
  Essential gene: C elegans homolog=ZK180.4; Phenotype=Ste
MSWILDWFSGVLNYLGLTKKSGKLVFLGLDNAGKTTLLHMLKDDRIAQHVPTLHPTSEELSLGGIRFTTFDLGGHVQARRVWKSYFPALDAIVFLVDAADLERIQEAREELWSLLQDEQVRTNALGYFMGFLRLPMLHCSSWVTKLTNRMHSEKISSNTYLGVQQYCTGWPIRKSFQ

SEQ ID NO: 120524 - protein, 85 aa, Heterodera glycines
  Coding regions on vcDNA: vcDNA=SeqID_46947; Strand=+; Position=1 -98,145-304
  Homolog annotation: Hit_ID=NP_001001819.1; Match level="QueryCoverage= 89%, HitCoverage=52%, E-value=4e-20, Identity=64%"; Hit description =ribosomal protein S15 [Danio rerio] gb|AAH81516.1| Ribosomal protein S15 [Danio rerio] gb|AAS66964.1|
  Essential gene: C elegans homolog=F36A2.6; Phenotype=Lva
MADAAAQEQKKKRTFRKFVYRGVDLEQLLEMNEKQFNQMIPARQRRKMNRGLNRKHKSLLVRLRKAKLNCPELMKPECVRLICVI

SEQ ID NO: 120525 - protein, 188 aa, Heterodera glycines
  Coding regions on vcDNA: vcDNA=SeqID_46948; Strand=-; Position=1-567
  Homolog annotation: Hit_ID=NP_498735.1; Match level="QueryCoverage =99%, HitCoverage=45%, E-value=1e-21, Identity=31%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MKPARYAVRKTMMKALFISPGRYEFNANLFMDQVPRLVTMGLVANSDYVGNTKRSPFNFQHFNVRELSVVANGRSYPQAPYDIDYENWKFVRPYNDTQEALGFANSTYGNGIDYFSFLHTHCIYVFNMTNSGDDHGGLFDLIKKECTAVNIKFKKPVPDGGITLIVMGETDSIYFLDKNRTIATDTTI

SEQ ID NO: 120526 - protein, 297 aa, Heterodera glycines
  Coding regions on vcDNA: vcDNA=SeqID_46949; Strand=+; Position=1 -41,168-221,1027-1493,1781-1850,2029-2118,2650-2820
  Homolog annotation: Hit_ID=CAE59821.1; Match level="QueryCoverage =57%, HitCoverage=17%, E-value=4e-13, Identity=34%"; Hit description =Hypothetical protein CBG03288 [Caenorhabditis briggsae]
  Essential gene: C elegans homolog=ZK669.1a; Phenotype=Bmd,Emb,Lvl
HHTVNELSDLIRQCELTTIAATSTLLKSLADLRESDEVSAAAPTDHHAHPYSNHNQLRLLNNGIGTTAANHHNHNHHHHYSHNNRHYSVNNNNSTATALMSNNGGNASLSSSSAASSTVVPMRSAAAASSSGTVTDAGAVPSSSVPSSSVCRVQQRRNALSSTDDAPPAKLMMTPSQHKRKGKAAEMTARLFDMQSSSSSSTPIQPSDAARSHRLARTRQVSRCSQCGQLLIFDAVKCQCCGLLSHKKCLGSVQLWCGEKTAKRLTECGADRRMSIFGVPLSESLRTQHRKVPFILE

SEQ ID NO: 120527 - protein, 396 aa, Heterodera glycines
  Coding regions on vcDNA: vcDNA=SeqID_46950; Strand=-; Position=1 -205,454-580,629-801,1149-1402,1456-1519,1574-1744,1797-1993
  Homolog annotation: Hit_ID=XP_392577.1; Match level="QueryCoverage =67%, HitCoverage=21%, E-value=5e-57, Identity=46%"; Hit description =similar to dishevelled 3; dishevelled 3 (homologous to Drosophila dsh) [Apis mellifera]
  Essential gene: C elegans homolog=T05C12.6a; Phenotype=Mig
MPDLSNELWHRFKVVNFNGQHHFSVTPALQHTPQEEKTEPANSSPTIANFFTFVYDGNFDGIGSDYCDGAVALDGRIEPGDMILQVNDISFENFKNDQAVEVLKRAVNTRGPIKLTVAKSFDANRTNYFSVPSREPVRPIDTHAWVQHTNAVRGMTSTLVNAMNAIPEGSEGTPTPIPSGHFPPTSSSLLHTFAPPTSVPSQRPASSSTSTGSGGGAAQTIVGPGGVILSMQQQHRLDVHSDKRKVIQTLAMPNSGLDIRDRTWLKIPIPRSFLGSALIDWLIGNVDGLDDRKEARKYASGLLKDKFIAHVVNKVTFTEQCYYIFGEQSAGELLNLRASFPEDGTLSNMQNQFQHMEIANPHQQGTVLYSNRAQEQPNFIQPTNLGTGTSMVFLAE

SEQ ID NO: 120528 - protein, 353 aa, Heterodera glycines
  Coding regions on vcDNA: vcDNA=SeqID_46951; Strand=-; Position=1 -155,349-641,697-778,829-1212,1424-1464,1515-1623
  Homolog annotation: Hit_ID=AAS84455.1; Match level="QueryCoverage =100%, HitCoverage=78%, E-value=1e-146, Identity=67%"; Hit description=protein disulfide isomerase [Ancylostoma caninum] gb|AAS84454.1| protein disulfide isomerase [Ancylostom
  Essential gene: C elegans homolog=C07A12.4a; Phenotype =Bmd,Dpy,Lva,Lvl,Unc
KPTEYGGGRDAASIVAWLKKKAGPAAKELKSADELKDYKDSAEVVVVAYFKNKESDAAKAYLEVAGAIDDVPFGIVYEADVAKEAELKKEDSIALFKKFDEGRDEFEGNPTEVDDIKKFVQSNRLPLVSEFSQETASVIFGGEIKSHNLLFVSKESSDFEKLESEFRAAAKEFKGKVLFVYINTDVEDNARIMEFFGLKKEDLPAVRLISLEEDMTKYKPEWSDITTENVVKFTSTYVDGKLKPHLMSEEVPEDWNKQPVKVLVGKNFEQVARDDTKNVLVEFYAPWCGHCKQLAPIWDKLGEKAIDYTGERTLEGFSKFLESGGKDGAGPSEEEKAAKEGEEGGDEEGHTEL

SEQ ID NO: 120529 - protein, 184 aa, Heterodera glycines
  Coding regions on vcDNA: vcDNA=SeqID_46952; Strand=-; Position=1 -173,320-525,625-798
  Homolog annotation: Hit_ID=NP_496194.1; Match level="QueryCoverage =81%, HitCoverage=9%, E-value=3e-23, Identity=38%"; Hit description =HMG-I and HMG-Y DNA-binding domain containing protein (2K469) [Caenorhabditis elegans] emb|CAA88699.1| Hyp
  Essential gene: C elegans homolog=F33H1.4; Phenotype=Lva,Unc
EFPTPMGGKPLSSQDFAVIDADIDATENLQCIWSVWEVSFAVFPFLFGLMLNDFTLLSKELGMHFHEVHPEEVEVPKCNLCMQELLVNARLLEKFGEDFGITLPNEHSFRSIRFKKDLKSEMAMENAISRYLRRISEGADPTLVDIESLDEESGDGEERDEDGPMVGQTVAASCEAFANSRMNC

SEQ ID NO: 120530 - protein, 310 aa, Heterodera glycines
  misc_feature (299)..(299): Xaa can be any naturally occurring amino acid
  Coding regions on vcDNA: vcDNA=SeqID_46953; Strand=+; Position=1 -106,493-621,1020-1098,1154-1216,1420-1575,2111-2220,2478-2580,2644 -2787
  Homolog annotation: Hit_ID=CAE58998.1; Match level="QueryCoverage =92%, HitCoverage=47%, E-value=1e-103, Identity=65%"; Hit description= Hypothetical protein CBG02271 [Caenorhabditis briggsae]
  Essential gene: C elegans homolog=R05F9.1a; Phenotype=Unc
RNQRSMSLGGPAHESLLSKQHSSSPPQTVELSRAEGDCVVLVVENTRFIVNPALLVVKPDTMLGRMFSLRARTGGGTSDLVRPNERNEYDVAEGLSAACFRVVMDFYHRDFYHRGFMHVPQSISVAELREACDYLLVPFNVHNVKCQDLRGLLHELSNEGARAQFVVYLEDIILPQLVISAERGERECHIVVLLDEDVVDWDEEYPPQMGEDVTQVVYSTPLYKFFKYAENRDVAKRVMKDRELKKIRLGIEGYPTHKEKIKYPTHKEKIKRRFNRSEVVYNYVQRPCTFSGRCKNYFXIVALFYWCIFS

SEQ ID NO: 120531 - protein, 250 aa, Heterodera glycines
  Coding regions on vcDNA: vcDNA=SeqID_46954; Strand=-; Position=1 -245,638-767,826-979,1384-1573
  Homolog annotation: Hit_ID=NP_001001475.1; Match level="QueryCoverage= 99%, HitCoverage=66%, E-value=1e-113, Identity=80%"; Hit description =guanine nucleotide-binding protein G(i) alpha subunit [Strongylocentrotus purpuratus] gb|AAS38581.1|
  Essential gene: C elegans homolog=C26C6.2; Phenotype=Egl,Hya,Pvl
TGELPLELASVMKHLWADTGVQECFERSREYQLNDSAAYYLNSLDRVAQPGYVPTQDDVLRTRVKTTGIVETHFTYKDLNFKMFDVGGQRSERKKWIHCFEGVTAIIFCVALSEYDMVLAEDDEMNRMIESMKLFDNRMIESMKLFDSICNNKWFLNTSIILFLNKKDLFEEKIRRSPLTLCFPEYTGSNTYEEAATYIQYQFESLNKRKDGQKEIYTHFTCATDTNIRFVFDAVTDIIVKENLRQCGLL

SEQ ID NO: 120532 - protein, 291 aa, Heterodera glycines
  Coding regions on vcDNA: vcDNA=SeqID_46955; Strand=+; Position=1 -127,175-300,354-447,492-771,828-1077
  Homolog annotation: Hit_ID=NP_501200.1; Match level="QueryCoverage =98%, HitCoverage=14%, E-value=1e-14, Identity=23%"; Hit description =rough Deal protein like (4I249) [Caenorhabditis elegans] gb|AAB00646.1| Rod (drosophila roughdeal) homolo
  Essential gene: C elegans homolog=F55G1.4; Phenotype=Emb,Sck
AFDIFVRFVGEAHPALRLKKLIELKRFDDALAFAKSYNLPADSVYIELLLYYQEQIQNGKDGTYEEETFKELLQTLRMLSDHNTAADHCVAILNFVNRYEHIKTILDFAKALKITDEYTQKEIARFRYELASYRMLFEAHGPSFERDSPWPQFLSSGSHKEFFDAFCEAGQMTQARLLLSRYSNIGQELQDEKSMKRLLTVFKSTLIGIGAISEFVEIELVPLLLTSNNALNTKIICSTFCDFFVDISLLLERLEPKSFPDASLHFAETFDRAISLLRADCRTSEKHVLFV

SEQ ID NO: 120533 - protein, 62 aa, Heterodera glycines
  Coding regions on vcDNA: vcDNA=SeqID_46956; Strand=-; Position=1 -108,200-280
  Homolog annotation: Hit_ID=P30757; Match level="QueryCoverage=100%, HitCoverage=50%, E-value=1e-23, Identity=85%"; Hit description =Histone H2B pir||S16084 histone H2B - sipunculid (Sipunculus nudus)
  Essential gene: C elegans homolog=H02I12.6; Phenotype=Gro,Pvl,Ste
MPPKPSGKGAKKAVKSTKAVRTGDKKRRKARKESYSVYIYRVLKQVHPDTGISSKAMSIMNS

SEQ ID NO: 120534 - protein, 113 aa, Heterodera glycines
  Coding regions on vcDNA: vcDNA=SeqID_46957; Strand=+; Position=1 -63,453-650,2191-2271
  Homolog annotation: Hit_ID=AAL78218.1; Match level="QueryCoverage =68%, HitCoverage=44%, E-value=5e-25, Identity=81%"; Hit description =histone Hgg-28 [Heterodera glycines]
  Essential gene: C elegans homolog=ZK131.1; Phenotype=Unclassified
MTDTANRQQRSRGRGGRRPRAHLRDSAKKITKASILRLARRAGVARINAKVYDEVRAALRSYLETIIRDAPNFLFHQGIEPKRQIKKAEMTDGQASLNAFQSRAPLHIPSKAF

SEQ ID NO: 120535 - protein, 216 aa, Heterodera glycines
  Coding regions on vcDNA: vcDNA=SeqID_46958; Strand=+; Position=1 -191,238-470,786-955,1015-1071
  Homolog annotation: Hit_ID=CAE70060.1; Match level="QueryCoverage =86%, HitCoverage=54%, E-value=2e-56, Identity=64%"; Hit description =Hypothetical protein CBG16494 [Caenorhabditis briggsae]
  Essential gene: C elegans homolog=F31E3.1; Phenotype=Adl,Dpy,Unc
MATVRPINNDEVRNSSIPDPIAFPFSMHRMVGIIQKKFSTIQVQLKQSTCENVMVLRSRFLDARRKRRNFSKQATEVLNEYFYSHLSNPYPSEEVKEELARKCQITVSQVSNWFGNKRIRYKKNIAKAQEEASMYAQKKAQPSPYGVLSGTSAGAVAVAANSMLSPYASMLHAGQNDLQHQVIASGFDLASSGYNPQLFQMGYLPSQQTSTSSPRQ

SEQ ID NO: 120536 - protein, 284 aa, Heterodera glycines
  Coding regions on vcDNA: vcDNA=SeqID_46959; Strand=+; Position=1-855
  Homolog annotation: Hit_ID=NP_500944.1; Match level="QueryCoverage =96%, HitCoverage=89%, E-value=3e-33, Identity=28%"; Hit description =putative cytoplasmic protein family member (4H15) [Caenorhabditis elegans] gb|AAC48087.1| Hypothetical pr
  Essential gene: C elegans homolog=F19G12.2; Phenotype=Unclassified
MIQQTMVQRACKIFKGEKNAQFLSRLDFDLGNQELYLLNNLDLLFTIYKAKDVFLLQTLKANDVTKYRLTVHDVKIYAKMVEVQPSLNMSLYKTLEKQPATYAVRKTEIKSSFISVGRYEFEYNVFSATIPRRVTIALVGNSAFHGDYKLSPFMFEPFDLREISIHSGGVVYPAVPYKLNFSKDHFVSAFVDMYEALGMANSERSFDISMAQFKKGWTFFLIPLTSTLDDSCGFELMRSGTTNVRATFNSPIPLGGVEMIVLGEFDQMIMVDYNRHIVTDSKLG

SEQ ID NO: 120537 - protein, 347 aa, Heterodera glycines
  misc_feature (340)..(340): Xaa can be any naturally occurring amino acid
  Coding regions on vcDNA: vcDNA=SeqID_46960; Strand=-; Position=1 -76,195-327,432-556,600-754,920-1185,1514-1555,1601-1753
  Homolog annotation: Hit_ID=CAE75506.1; Match level="QueryCoverage =96%, HitCoverage=64%, E-value=6e-55, Identity=37%"; Hit description =Hypothetical protein CBG23516 [Caenorhabditis briggsae]
  Essential gene: C elegans homolog=T28H10.3; Phenotype=Emb
TEKDKVFVYFSDHGAVGVIGFPAADLTVKQLTQTLKEMHAKKMYGELTFYLEACESGSMFDHTLAQSLKIYAVTAANGDESSWGCFCDTNLPGNCLGDLFSVNWMQDSDQENLRTETLRKQFGIVREETNKSHVMQENLRTETLRKQFGIVREETNKSHVMHYGDLQIQDEHVSEFMGKEQAQKRNERMSLSRFSTISAWRGKLENAKYIIKFKKNLRKIRLLKFQSHIVSQKRSFLEQTIKQIVHQLVHDMNNRRQILTTYPQQIRDLDCHNEVVHTFSNFCFKFSENPYALKYAYNPYALKYAYVLANLCERPELDAERIKMALIEQCAEVELSGVIXSNLKNAI

SEQ ID NO: 120538 - protein, 371 aa, Heterodera glycines
  Coding regions on vcDNA: vcDNA=SeqID_46961; Strand=+; Position=1 -97,191-357,740-893,994-1202,1495-1656,2287-2613
  Homolog annotation: Hit_ID=CAE72462.1; Match level="QueryCoverage =72%, HitCoverage=37%, E-value=3e-82, Identity=66%"; Hit description =Hypothetical protein CBG19635 [Caenorhabditis briggsae]
  Essential gene: C elegans homolog=Y25C1A.5; Phenotype=Adl,Clr,Sck,Ste
MTSGEQPCFTLIHVANDVEFPSEGQLKDKFEHGDTKTKTDALKKLILMIQAGEKVTSQLMMYVIRFCLPSSDHYLKKLLLIFWEVVPKNIEPFSFAFRFLCKLKEPELLEPLMPSIRKCLEHRHSYVRRNSILAIYTIYKNFDFLIPDAPELIQQLLETEQDASCKRNAFIMLLHVDRQRALDYLSGCIEQVAQFGDILQLVIVELIYKLIVLDRLVGLREIVPNDKVLQELVMDILRVLSTNDYEVRRKILQLALELVSSRNMTKMKLFPLFFLIIILIAKIGSAKNKLQQKSFEEIFGGKWEENLEEKRQIIEKFYKIKEKIKQKGRKHTAKEWSKIERKIVKQLGTNRNYIQKWIKQFVLQKFKLKLE

SEQ ID NO: 120539 - protein, 767 aa, Heterodera glycines
  Coding regions on vcDNA: vcDNA=SeqID_46962; Strand=-; Position=1 -54,105-193,243-272,332-440,492-646,697-743,788-884,928-1219,1327 -1565,1664-1918,2089-2437,2554-2869
  Homolog annotation: Hit_ID=CAE75346.1; Match level="QueryCoverage =97%, HitCoverage=48%, E-value=1e-177, Identity=36%"; Hit description= Hypothetical protein CBG23326 [Caenorhabditis briggsae]
  Essential gene: C elegans homolog=R31.1; Phenotype=Dpy,Egl,Gro,Unc
LEINDCFSDSDGILLMKFLEIISGEKLGKPNFLEIISGEKLGKPNRGRMRVQKIENLNQVLDFLKYKRILDFLKYKRIQLENIGAEDITDGNERLILGLENIGAEDITDGNERLILGLIWTIILRFTIENIEIEQTKESGQTKESGERKHAKEALLLWCQRKTAGYPNVKVDNFSSSWRSGLAFCALIHAHRPELLDFDALNPQETIGPELLDFDALNPQETIGNLNLAFDNLNLAFDVAEKHLDISPLLDAEDVNVSHPDEKSIITYVSLFYHFFAKQKTEMHPDEKSIITYVSLFYHFFAKQKTEMTGARRVAKVIGELVEQDGMQEEYEQLASELISWVRRSISWLSARHFPNNLTELRDELAQFNRFRKEEKPPKYREKGELEALFFAIQTKRNASRRRAYAPPEGFLLHDLEGAWSELEKAEHARQGALIEELQRQERLEHRAQLFHKKADVREAWLREISVVLGQFKCSPNAQSVETGKRMMRNIQTEAAPKKERFQLLKELSAELQAERFHGSAEIAQREREIIGRWNAFLTMLEEHELELDRLEELSLLVEALDTLGEELDSLGAQLKLREKGRHMAEVDELMKGQELAETDLSAKGEMLRKLRRKAELSSKTQPPHREAALEMLQLRLNAIGKQYDQLRRDARERRVALQKTREFFQFVQHFDELSGWLSDRLSACFALLQLRDLSALRDSQRLHKSLETEMQSQWERTKRLISDGEKLSAGGSAMARRHFARVGKGREGKARTDEVVGECDDNAATD

SEQ ID NO: 120540 - protein, 708 aa, Heterodera glycines
  Coding regions on vcDNA: vcDNA=SeqID_46963; Strand=+; Position=1 -247,350-663,709-996,1084-1442,1475-1688,1733-2200,2263-2430,2808-2876
  Homolog annotation: Hit_ID=NP_492457.1; Match level="QueryCoverage =97%, HitCoverage=78%, E-value=0.0, Identity=82%"; Hit description =translation Elongation FacTor (94.8 kD) (eft-2) [Caenorhabditis elegans] emb|CAB02985.1| Hypothetical prote
  Essential gene: C elegans homolog=F25H5.4; Phenotype=Emb,Lva
MLFTSLKNLVLFSMFFELERKDLEFVKGESQADIEQVDGKSQKYNGFLINLIDSPGHVDFSSEVTAALRVTDGALVVVDCVSGVCVQTETVLRQAIAERIKPVLFMNKMDRALLELQLGQEELFQTFQRIVENINVIIATYGDDDGPMGPIQVDPSIGNVGFGSGLHGWAFTLKQFAEMYADKFGVQIDKLMKNLWGDRFFNMKTKKWTNNQEPETKRGFCQFVLDPIFKVFDAVMNIKKDEVAKLVEKLNIKLTLEEKEQEGKPLLKTMMRKWLPAGDTMLQMIVMHLPSPVTAQRYRMEMLYEGPHDDEAAVAMKNCDPNGPLMMYISKMVPTSDKGRFYAFGFTFSQIMNKQFYENSGRVFAGRVATGMKARIQGPNYVVGKKEDLYEKTIQRQATIHFCTILMMGRYIEPIEDIPAGNIAGLVGVDQYLVKGGTITTYKDAHNMRVMKFSVSPVVRVAVEPKNAGDLPKLVEGLKRLAKSDPMVQCIFEESGEHIIAGAGELHLEICLKDLEEDHACIPLKKSDPVVSYRETVTEESEIVCLSKSPNKHNRLFCKARPLPDGLPEAIERGDVNPTDDPKNRAKILTEKFEMDATDSRKIWCFGPEGTGANLLIDVTKGVQYLNEIKDSVVAGFQWATKEGVLCDENMRGVRFDIHDVTLHADAIHRGGGQIIPTARRVFYASQNSDPKMEIYFIEQQNPLLEQY

SEQ ID NO: 120541 - protein, 141 aa, Heterodera glycines
  misc_feature (71)..(71): Xaa can be any naturally occurring amino acid
  Coding regions on vcDNA: vcDNA=SeqID_46964; Strand=-; Position=1 -166,653-857,1040-1095
  Homolog annotation: Hit_ID=NP_501127.2; Match level="QueryCoverage =90%, HitCoverage=9%, E-value=2e-38, Identity=66%"; Hit description =RNA Polymerase, Class III (C), rna polymerase (rpc-1) [Caenorhabditis elegans] gb|AAA83341.2| Rna polymera
  Essential gene: C elegans homolog=C42D4.8; Phenotype=Lva
PSKIGQILCNFFSRKNAPLTMAQCVSKGSFINIAQMIALVGQQSISGKRPSDGFEAMPSPKFYSHYRTFNXWNFVTSPHRSGLTPTEFFFHTMGGREGLVDTAVKTAETGYMQRRLVKCLEVLRFSFKNLVFFCLKDNENF

SEQ ID NO: 120542 - protein, 328 aa, Heterodera glycines
  Coding regions on vcDNA: vcDNA=SeqID_46965; Strand=-; Position=1 -67,415-914,1383-1479,1801-1939,2060-2124,3139-3249,3295-3302
  Homolog annotation: Hit_ID=CAE72540.1; Match level="QueryCoverage =32%, HitCoverage=26%, E-value=2e-19, Identity=66%"; Hit description =Hypothetical protein CBG19722 [Caenorhabditis briggsae]
  Essential gene: C elegans homolog=F33H2.2; Phenotype=Prz
MRKLQFVGPELLLIRMEQPKGDDDFDDHQFASSSFCPPSSSSSYSSSFAAANHQHHHHHYQHMFVLFEWRVGRIVGVFNRSSEALFGAFERHNEQFRNGHIVRTMFPTSMEHCGAERAQHEALKQSSLLTGPYISQSVRHAGPVRKPEVFKKSNICASLGILSHQSICPCTINLMNAHQFSTRFRCSPTAVQSSHQMPSHPAGLSHQCHPNTVLRPCAVPSVRFVKRSQEEYYDSLLSYSQQRMMLYPYHLSDILVRELRITPFTYYTNMIVEVMQAEKSYDSIPNFTAVPTLDGFVMNRVQGDYFETLLYKIFVAIDGQTSVMEVVG

SEQ ID NO: 120543 - protein, 308 aa, Heterodera glycines
  misc_feature (10)..(11): Xaa can be any naturally occurring amino acid
  misc_feature (190)..(190): Xaa can be any naturally occurring amino acid
  Coding regions on vcDNA: vcDNA=SeqID_46966; Strand=-; Position=1 -259,419-612,1046-1305,1405-1508,1694-1776,2484-2527
  Homolog annotation: Hit_ID=NP_492470.1; Match level="QueryCoverage =91%, HitCoverage=28%, E-value=1e-120, Identity=74%"; Hit description= E1-E2 ATPase-associated region and haloacid dehalogenase-like hydrolase family member (1J812) [Caenorhab
  Essential gene: C elegans homolog=F36H2.1a; Phenotype=Emb
VTRRQLILNXXLIHNCPSPSIGLRTLVVAKKVLTAEQLADFEREYHRAKMNVTDRTEHMASVVRRLENDLQLLCLTGVEDRLQDQVTTSLELLRNAGIKIWMLTGDKMETAICIAKSSGLFSKTDNVHVFGQVRDRTEAHNELNALRKKSDVALVMSGSALNMCLQYYEAELAELVCSCTAVVCCCCSPXQKAQIVNVLKRYRRPARVAAVGDGGNDVSMIQAAHAGIGIDANEGKQASLAADFSITQFHHICRLLLVMHRGLIISTMQAIFSCVFYFASVSLYRILMVAFCFFFNVWSLFNKKQSKN

SEQ ID NO: 120544 - protein, 146 aa, Heterodera glycines
  Coding regions on vcDNA: vcDNA=SeqID_46967; Strand=+; Position=1 -224,279-472
  Homolog annotation: Hit_ID=NP_491536.1; Match level="QueryCoverage =80%, HitCoverage=16%, E-value=2e-25, Identity=51%"; Hit description =putative protein of eukaryotic origin (1F732) [Caenorhabditis elegans] gb|AAF60413.1| Hypothetical protei
  Essential gene: C elegans homolog=Y110A7A.19; Phenotype=Lva
LMLNVFLLQFLNQFKFCLFIFLILFFNLRSPTDLLKALAGTVKEDETSVHFGLVDDPIMIPTGFRDKRLYLMSKELGRRTARELGRRTARKIVEEWPTLFMLDRDVPELKAFRPQKPLDPTLVQPNEENLQKMIMDRRVSDAIKLY

SEQ ID NO: 120545 - protein, 128 aa, Heterodera glycines
  Coding regions on vcDNA: vcDNA=SeqID_46968; Strand=+; Position=1 -159,489-574,878-1018
  Homolog annotation: Hit_ID=EAA64300.1; Match level="QueryCoverage =90%, HitCoverage=19%, E-value=4e-27, Identity=45%"; Hit description =hypothetical protein AN1593.2 [Aspergillus nidulans FGSC A4] ref|XP _405730.1| hypothetical protein AN1593.
  Essential gene: C elegans homolog=F08F8.2; Phenotype=Unclassified
VKDACCENVVGFVPLPTGVAGPLYFDGTFVHLPLATTEGALVASVSRGCLSINGNNAFSVHVFRDGMSRAPIIEFPCVRDSIYACLQRIDAHLEGTYLYLRFVASTGDAMGKKMVNLFCQFFFESWDL

SEQ ID NO: 120546 - protein, 668 aa, Heterodera glycines
  misc_feature (83)..(83): Xaa can be any naturally occurring amino acid
  Coding regions on vcDNA: vcDNA=SeqID_46969; Strand=-; Position=1 -356,432-528,580-2077,4934-4972
  Homolog annotation: Hit_ID=NP_500227.1; Match level="QueryCoverage =99%, HitCoverage=65%, E-value=1e-100, Identity=33%"; Hit description= predicted CDS, reverse transcriptase like family member (4D351) [Caenorhabditis elegans] gb|AAK68554.1|
  Essential gene: C elegans homolog=ZK250.3; Phenotype=Clr,Lvl,Sck
EPTRENNILDLVFSQPIIYNVKVGSPFSNSDHNTVWFDINQTIPKKIVKKFLSEIYARKILLNSTKKFFLMGQTPSQLQFQTXMRNTAYLPLNKKRFDKNVPMKLLKTTIKKKHDDKIKYKILCREYKKHIHKLYCENEAKFISNGRNTLIDEQGQITLIDEQGQIIFRNEQKCILLADVFQKSFLYKENNNDLLSHENPNQITDIEFNVYNIWNLLKKLPRRNSTSPDGIPYILLKECALPLAPILTELFRIILDSSKIPEIWKTSIIIPVFKKGDTDNPINYRPISLTCTLCRVMEKIIKLEILKFLNKNQFFSPFQFGFLRQRSTTTQLLSTLNDFYISIENKSCVDVIYIDISKAFDSVPIKLLLQKLKNIGINGKIHKFIKNFLNDRSFRVKISEQYSNSKNIYSGVPQGSVLGPLLFLIFINDLPNNLPKNVGIKMFADDIKIYIEHKNDKNRENLSSALEAINKWSKNNGLKISIEKTMVLYLGENNTKFIYFLDGEPLPETKCVRDLGILIDQKLSFSDHINKILKNSYFSCYQLLRALKTRRLETLILAYKSYIRPQLEYATEIWNPLKKENVHKIEAVQKFFTRKAFKKCGLVPMPYKRLKFCGIKTLEIRRKINDITTTFKIIKKHTHLKPSNFFAVAKRAIRKRLQIVNSLLPLKC

SEQ ID NO: 120547 - protein, 293 aa, Heterodera glycines
  Coding regions on vcDNA: vcDNA=SeqID_46970; Strand=+; Position=1 -135,179-285,393-698,747-786,840-870,925-984,1033-1072
  Homolog annotation: Hit_ID=CAE75137.1; Match level="QueryCoverage =96%, HitCoverage=59%, E-value=3e-63, Identity=50%"; Hit description =Hypothetical protein CBG23066 [Caenorhabditis briggsae]
  Essential gene: C elegans homolog=F17C11.9a; Phenotype=Gro
LTLKQAKNELLAQLSLFDQILLPKTFLVGERLSLADISVAIDLLPAYQYVLGEEARKGLVNVNAYQYVLGEEARKGLVNVNRWFQTVVSQPGIREVLGDLNAAGQPAKKEQKPEKQKGAKEEKPKSAKEEKPKKKAKEEADEEMDAADEAIAAQPKFSDPLAALPPGSFVMDSFKRVYSNEDTATKAIPYFWENFDPTNYSIWFSEYKYIWFSEYKYPEELKLVYMSCNLIGGLVYMSCNLIGGMFQRLEKMKMFQRLEKMKKHAFASVCLFGTHSTISGIWITHSTISGIWI

SEQ ID NO: 120548 - protein, 198 aa, Heterodera glycines
  Coding regions on vcDNA: vcDNA=SeqID_46971; Strand=-; Position=1 -117,172-288,533-733,783-887,931-987
  Homolog annotation: Hit_ID=CAE72892.1; Match level="QueryCoverage =99%, HitCoverage=68%, E-value=2e-79, Identity=62%"; Hit description =Hypothetical protein CBG20205 [Caenorhabditis briggsae]
  Essential gene: C elegans homolog=C03C10.3; Phenotype=Emb
MDEPLLQENPNRFVIFPIKYHDIWQFYKKAVASFWTVEEVDLSKDISDWKSLTDNERFFISRVLAFFAASDGIVNENLFEFIKKKADWALRWIASSDASFAERLVAFAAVEGIFFSGSFAAIFWLKKRGLLPGLTHSNELISRDEGLHRDFACLLYTHLKNTPPKERIYEIISDAVKIEQEYLTDALPVYMIGMNSDL

SEQ ID NO: 120549 - protein, 496 aa, Heterodera glycines
  misc_feature (488)..(488): Xaa can be any naturally occurring amino acid
  misc_feature (491)..(491): Xaa can be any naturally occurring amino acid
  Coding regions on vcDNA: vcDNA=SeqID_46972; Strand=+; Position=1 -275,626-705,781-860,1004-1113,1189-1248,1506-1661,2063-2101,2399 -2441,2503-2570,2905-3123,3747-3813,3882-4108
  Homolog annotation: Hit_ID=AAC25709.1; Match level="QueryCoverage =97%, HitCoverage=51%, E-value=1e-151, Identity=56%"; Hit description= transportin; TRN [Xenopus laevis]
  Essential gene: C elegans homolog=R06A4.4a; Phenotype=Emb,Gro,Unc
RKAKQLCRSLTLLLESYMDKIAPQLSNISEFMLLRTQDNNEETALEACEFWLAFAEKDVCRQVLRPILAQLLPVLVRCMKYTETDIILLKGDVEDDSNVPDRVQDIKPRFHRAKTQGQQNNSEGDEDDEEQQNNSEGDEDDEEEGTDDESATEWNLRKCAAASMDVLSGIFTDEFLVHLLPILNQSLSSDQWEVKESGILTLGAIAEGCVSGMTPHLPWLVPFLIDSLQHPRSLVRSITCWTLSRYCHFVVQQPQSELFAKLVKELLARVLDKNKRVQEAACSAFATFEEEACHELVPYMPEILGTLVEAFHELVPYMPEILGTLVEAFKRYQAKNLLILYDAVGTLADSVGGNLAEPPYAEMIMDPLMSKWAQLRDDDKELFPLLECISSVATALHTAFYPYCEPVFHRCVRLISHTLAISEAAHEFKAQHDQPEKDFLIVALDLLSELAEALRDYIDPLVAQSNIIQLVYICAQDTNGKQRQNALXTAXDCAKM

SEQ ID NO: 120550 - protein, 261 aa, Heterodera glycines
  Coding regions on vcDNA: vcDNA=SeqID_46973; Strand=-; Position=1 -93,141-332,389-667,737-955
  Homolog annotation: Hit_ID=CAE60278.1; Match level="QueryCoverage =95%, HitCoverage=57%, E-value=6e-57, Identity=46%"; Hit description =Hypothetical protein CBG03859 [Caenorhabditis briggsae]
  Essential gene: C elegans homolog=T04B2.2; Phenotype=Unclassified
MFTVDLNSDKGFRTIERFVDNYLRTGVSVTTQQYVALIRAVPRAHWELSHTSIILGNELGRGTFGVVKSGVYVDQQGTRAAVAIKEVSQTSTKEQIKEFMNEARVMRQLRHPNVIQFYGVAVGQEPLMIVMELATDGSLTNYLKQQRRSARVKLYMCLGAAGGLDHIHSKGIIHCDVAARNCLYTDGVVKISDFGMAIKALSKQIERGAKLPVKWMSPDALRDRSFTQKSDTWAFGVLCWEVFNNGETPFAQLSGSEVAAA

SEQ ID NO: 120551 - protein, 78 aa, Heterodera glycines
  Coding regions on vcDNA: vcDNA=SeqID_46974; Strand=-; Position=1 -139,198-295
  Homolog annotation: Hit_ID=CAA27751.1; Match level="QueryCoverage =98%, HitCoverage=89%, E-value=1e-35, Identity=97%"; Hit description =unnamed protein product [Hordeum vulgare subsp. vulgare] pir||A25062 ubiquitin precursor - barley (fragmen
  Essential gene: C elegans homolog=ZK1010.1; Phenotype=Emb
MQIFVKTLTGKTITLEVEASDTIENVKAKIQDKEGIPPDQQRLIFAGKQLEDGRTLADYNIQKESTLHLVLRLRGGKN

SEQ ID NO: 120552 - protein, 366 aa, Heterodera glycines
  Coding regions on vcDNA: vcDNA=SeqID_46975; Strand=-; Position=1 -156,239-499,542-928,978-1029,1088-1329
  Homolog annotation: Hit_ID=NP_741029.1; Match level="QueryCoverage =98%, HitCoverage=48%, E-value=4e-14, Identity=22%"; Hit description =putative protein family member, Epithelial Fusion Failure EFF-1 (74.4 kD) (eff-1) [Caenorhabditis elegans
  Essential gene: C elegans homolog=C26D10.5a; Phenotype=Bmd,Egl,Emb,Pvl
MEPGMYFYKIEDPEADTDSKHRLRDGVPLNWPGESNLEKLGWFRWEKGHGWAHISVEDCKSQRYRATFNAEQFVLRRHSPAEEMPTPKGANGEEEAEGTAEEMGNFDLGNLVEEEPWAGAVRTSEREVVLEHAEGVALTLTLRTESWPRIVHHSSELSDFSGSNCLGQRVQPVSEPHFLCWFGICRKMGNISAQNARGTLIGQIFSSQDSLSVMESIFSIDISKSTQSKAQRAVATSVRSPRLVCFYPMGSIEKRKCHRLDFVRQPLQEKPPMTDHWQRQRSECQGCNERGGYLKKRRRLAIVSFSTSVESFLSSLDPRQWLDGLNSPAELFTCLVELVLCLVLLLLAVLLLTKCVFPLCRCVRFV

SEQ ID NO: 120553 - protein, 289 aa, Heterodera glycines
  Coding regions on vcDNA: vcDNA=SeqID_46976; Strand=+; Position=1 -148,343-575,629-803,862-1014,1062-1094,1141-1268
  Homolog annotation: Hit_ID=CAE64875.1; Match level="QueryCoverage =83%, HitCoverage=33%, E-value=2e-74, Identity=57%"; Hit description =Hypothetical protein CBG09687 [Caenorhabditis briggsae]
  Essential gene: C elegans homolog=ZC302.1; Phenotype=Unclassified
MNTEDGRIAHCASSDRIGHPCRVRGEQRAYQQRFIRNIPRSAQDWGRLEGGDLFHENHPSRETQLKVVRLLRKHCFREGRLGLEFVSDPTVNFQHSNFPVANYLDVNLHVNMPIFTIHGNHDDLSGKGLSALDVLHEAGLINLFGKFCDVDQIEVTPILLTRGNTKIALYGIGSQRDDRLARSFAKGRVKFNRPDGDDPDSWFSILVLHQNRPPRSKLRSTKSHLSFKHIPLFFDLVIWGHEHECLIEPDFKYMDPNDSTKGFYIIQPGSTVATALSVEEAKKKQIGIL

SEQ ID NO: 120554 - protein, 182 aa, Heterodera glycines
  misc_feature (25)..(25): Xaa can be any naturally occurring amino acid
  Coding regions on vcDNA: vcDNA=SeqID_46977; Strand=-; Position=1 -32,1860-2067,2110-2239,2284-2340
  Homolog annotation: Hit_ID=CAE58368.1; Match level="QueryCoverage =89%, HitCoverage=25%, E-value=5e-36, Identity=50%"; Hit description =Hypothetical protein CBG01494 [Caenorhabditis briggsae]
  Essential gene: C elegans homolog=F25G6.6; Phenotype=Gro,Unc
KFSKIFELGPLTRRGRMAPRKLKDXRDAAVLTVRFIPMLQNKITFSLETFHAVVVRCGVAHFLLCKHIAASSEVKVLLSGEGADELFGSYAYMQRAPSAPEGADELFGSYAYMQRAPSAPLLQREIVRRLRLLHQYDVLRCDRCPSCHGIEIRIPILDKKFCDRCPSCHGIEIRIPILDKKF

SEQ ID NO: 120555 - protein, 268 aa, Heterodera glycines
  Coding regions on vcDNA: vcDNA=SeqID_46978; Strand=-; Position=1 -99,235-309,394-529,599-714,766-799,838-956,1002-1085
  Homolog annotation: Hit_ID=CAE58878.1; Match level="QueryCoverage =100%, HitCoverage=32%, E-value=4e-73, Identity=52%"; Hit description= Hypothetical protein CBG02111 [Caenorhabditis briggsae]
  Essential gene: C elegans homolog=C43H6.9; Phenotype=Unclassified
VANWTLEKGIWPLYGHLNVDVQHLNHYRIVTIITKPVFLNTGQRVEGYCIDLLTMLTESLNFTFELYSLNFTFELYLVEDGLFGSFDENGNWDGMIGDLVLGKAELALGPISVLAERENDIDFTVPFYDLVGLGILMKRSDVEYSMFKFLKVLEWPVLEWPVWMCILGAYLFTSTLLWVFDRFSPYSYVWMCILGAYLFTSTLLWVFDRFSPYSYRNNSERYAEDEEKRNFTFKECLWFCECLWFCMTSLTPQGGGEAPKNVAGCLAA

SEQ ID NO: 120556 - protein, 208 aa, Heterodera glycines
  Coding regions on vcDNA: vcDNA=SeqID_46979; Strand=-; Position=1 -126,285-366,410-473,602-723,1315-1547
  Homolog annotation: Hit_ID=NP_493258.1; Match level="QueryCoverage =62%, HitCoverage=98%, E-value=2e-39, Identity=60%"; Hit description =profilin (14.3 kD) (pfn-1) [Caenorhabditis elegans] emb|CAA22318.1| Hypothetical protein Y18D10A.20 [Caen
  Essential gene: C elegans homolog=Y18D10A.20; Phenotype=Emb,Stp,Unc
MSGWDAYIQSLTSSCAEITRVAIIGNSDASVWARTEGENEFKASEPELKKLVGQFDDLSQVPSVGADLEGIHYIVPRTDENLIFGKRDKTGFFAVKTKSAILIAIYKDEESVVGADVRGAVEKMAKYLEDAAILIDRFDPIASVFVQHLNVSLLFFRDHYKIDDEMLRLDTFHVDRKSLTLHANGTLDFGKSAIYSKSWPINSVKCFH

SEQ ID NO: 120557 - protein, 179 aa, Heterodera glycines
  Coding regions on vcDNA: vcDNA=SeqID_46980; Strand=-; Position=1-545
  Homolog annotation: Hit_ID=NP_504179.1; Match level="QueryCoverage =98%, HitCoverage=16%, E-value=3e-37, Identity=46%"; Hit description =predicted CDS, protein of unknown function DUF32 and RNA-directed DNA polymerase family member (5E747) [C
  Essential gene: C elegans homolog=ZK250.3; Phenotype=Clr,Lvl,Sck
CIYIDFQKAFDSVPHNLLLYKLEKIGIKGKLLMWIKGFLSNRTFRVKIGDSLSSSKVTSGVPQGSVLGPLLFLIYINDLPDALPSGVKIKLYADDDKLYICYKARTDTEIMHKALHNLFEWANKWQIKVSMQKTFVLYLGSKTPKETYKFDGNTNAVDTIRDLGVNIDNKLQFSDHINQ

SEQ ID NO: 120558 - protein, 91 aa, Heterodera glycines
  Coding regions on vcDNA: vcDNA=SeqID_46981; Strand=+; Position=1 -190,233-295
  Homolog annotation: Hit_ID=CAE58393.1; Match level="QueryCoverage =100%, HitCoverage=28%, E-value=8e-24, Identity=63%"; Hit description= Hypothetical protein CBG01522 [Caenorhabditis briggsae]
  Essential gene: C elegans homolog=T23B12.2; Phenotype=Emb,Lva
SIRSPHFIRGGFAHGVRGPCTQFYMLPNTVRIHGLRTALTLKHAQDDLVIVDSYDTLNSADPQFLNDLADFLNDLADARNWGYSVLFVDCD

SEQ ID NO: 120559 - protein, 214 aa, Heterodera glycines
  Coding regions on vcDNA: vcDNA=SeqID_46982; Strand=-; Position=1 -110,170-352,598-793,1054-1209
  Homolog annotation: Hit_ID=NP_741684.1; Match level="QueryCoverage =98%, HitCoverage=43%, E-value=9e-53, Identity=45%"; Hit description =putative nuclear protein, with a coiled coil-4 domain, of eukaryotic origin (5T574) [Caenorhabditis elega
  Essential gene: C elegans homolog=Y39B6A.14; Phenotype=Lva
MRFFLGSQRDEKPNEDGQNSSDDEMEGGEEGSRKETKSLKEVLQKFRHAKKTRKRKKNLDQAKKVIVTAQRKKEEKRLPKDMKQCNMEAINAIYDPQKLLQIALCARVIGVHQLQTLGFYSYLHRYIRPKQKEVTRILLYAAQACHPLVPSDVIEQLVTSFLQIRVVAQNFVSDRNTPEAITVGLNTIREIYKGCPEAATEEMVRDLAAVKFSQ

SEQ ID NO: 120560 - protein, 475 aa, Heterodera glycines
  Coding regions on vcDNA: vcDNA=SeqID_46983; Strand=-; Position=1 -304,586-702,760-1766
  Homolog annotation: Hit_ID=NP_508269.1; Match level="QueryCoverage =66%, HitCoverage=46%, E-value=2e-37, Identity=31%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTHVFFDPESVDWSSFITPQHGRGQKQYFVGSKYQRGFGFLGNVARFLTPIARNIASSAGHEGLAAGQRVLSDIAQGRDLRDAVREHSRQGLTNLTDKLQQYNQFCDLNKTFLYLSTSIERKDKSNWIPITKDSEADQHVGVESYDSGIYYAFRAYMMNELGFSEDVKKGLCEASCYYVDDVDQDDYTNSGFKNRASRFADGAKCETMVKLNFDLARQPNLLLNNSDVIFSIHRNTDDFLIMAPPYVSGNAVIANPHTYRINIHDIRIYVKTVDITQSLNNVISNQLQTTPAKYPMRKIEIRSLFIPRGTSDLSHNVFTSIVPRRLIVGFVSTGAYTGNPKESPFVFEHAKIRSIGVEANGNIFPGSPYSLNFDRNKYIRAFVDMYTGLGMDDGERTMSINIQKFVNGWCFFVIPMTSTLEDTPGFELIRNGTTSIKVQFNEPIKDGGYEMIVLGEFDSILSINANRVLSSDGSI

SEQ ID NO: 120561 - protein, 371 aa, Heterodera glycines
  Coding regions on vcDNA: vcDNA=SeqID_46984; Strand=+; Position=1 -153,207-401,444-513,1008-1564,1607-1729,2079-2096
  Homolog annotation: Hit_ID=NP_059990.2; Match level="QueryCoverage =59%, HitCoverage=24%, E-value=1e-13, Identity=28%"; Hit description =M-phase phosphoprotein, mpp8 [Homo sapiens] gb|AAH03542.2| M-phase phosphoprotein, mpp8 [Homo sapiens] em
  Essential gene: C elegans homolog=T09A5.8; Phenotype=Emb
MDLFSNNNNNSAKKAISIFPEENVNEDVINKSSGSSSNSSDGVPTEEDVFEVEKIIAHKVCEGKDYWKVRWVGYGPSDDTWEPRENFLDKKVLKMLKDFETEQHAKKEKRKEISRKSIEYTRSKQEEDDQEDATDEKNERRRNDEIFTSESSAQEVFETNEKGAVAIPEKPKGISQKMPNDKRIKEEVGTHEMKMVFHKRPRLGEEETHNSELGISKSLKPKKLAKLGQKLKLKAASKREDIIHMKKTKEEKNASKKHELSKESVPHKTKDKQLSKLAVVRLEETGLVVPFASEGVNIAAAFERLAVERQTSLSLIDNPFLISQEEFEEMVMDGKVEKVQQLLYGQAANNFSLNRVDEFGKTLLHKIFVHI

SEQ ID NO: 120562 - protein, 218 aa, Heterodera glycines
  Coding regions on vcDNA: vcDNA=SeqID_46985; Strand=+; Position=1 -91,147-296,1330-1408,1466-1503,1567-1618,2004-2066,2401-2465,2914 -2980,3398-3451
  Homolog annotation: Hit_ID=NP_498166.1; Match level="QueryCoverage =39%, HitCoverage=30%, E-value=6e-20, Identity=50%"; Hit description =glioma pathogenesis-related protein, LONg body length LON-1 (35.1 kD) (lon-1) [Caenorhabditis elegans] gb
  Essential gene: C elegans homolog=F48E8.1a; Phenotype=Emb,Sck
WVSHSGPTNALWGHEKLVPEEEVWHEKNDDLLTIRHHTVMVMGTATTTTVAVTVATVADMRRMCTSKTGSPVSTIATDECNGHENGVLESAVGRKCASTCQHLRFSTLSKPGKHGENIWAAPYYNYTDAIGRWYNEVNDPWCGCGTGYKHCCGHYTQLYFVLIDGMGRDKSDRLWICAIFVCHYNPQGNKVMYYFNGGDYAFSLDLAPGLDIPGPGFS

SEQ ID NO: 120563 - protein, 126 aa, Heterodera glycines; identical to SEQ ID NO: 119174
  Coding regions on vcDNA: vcDNA=SeqID_46986; Strand=+; Position=1 -96,151-435
  Homolog annotation: Hit_ID=P53021; Match level="QueryCoverage=100%, HitCoverage=100%, E-value=1e-66, Identity=92%"; Hit description =Major sperm protein 1 gb|AAA29146.1| major sperm protein
  Essential gene: C elegans homolog=C04G2.4; Phenotype=Unclassified

SEQ ID NO: 120564 - protein, 328 aa, Heterodera glycines
  Coding regions on vcDNA: vcDNA=SeqID_46987; Strand=-; Position=1 -116,174-277,484-722,1060-1207,1416-1519,1635-1815,1895-1955
  Homolog annotation: Hit_ID=NP_505071.1; Match level="QueryCoverage =93%, HitCoverage=61%, E-value=2e-65, Identity=42%"; Hit description =mannosyltransferase (57.1 kD) (5I519) [Caenorhabditis elegans] gb|AAC48267.3| Hypothetical protein ZC513.
  Essential gene: C elegans homolog=T27F7.3a; Phenotype=Dpy,Lva
ELLLLFGPAFLFVFVVYWRHISVLKTLLVGFCSLIIVLILSVLLSVLLDSLMWRRWVWPEGEVIHFNVWHNRSSEYGVLPFWWYFFSALPRAMFLSVFLVPFGLLIHQRVQFALVSLCLPAFLFVLLFSFLPHKELRFILYAVPLFNTSVAVFCAWIWKKARDSWFFRFCAFLVALHLLVNAIFSVSFVYASAQNYPGGVALLKLQHKHRFLRDKPIAVHIDQFSAETGISRFLHLYDAWEYNKTENLAQEEFGRFDYILVGNYDGRLRAEIKNNLNETHTKHFIVKAFHKVKKCNWFLWQVPAYSYKPQVPAYSYKPKVMVMKRKDE

SEQ ID NO: 120565 - protein, 104 aa, Heterodera glycines
  Coding regions on vcDNA: vcDNA=SeqID_46988; Strand=-; Position=1 -91,830-1050
  Homolog annotation: Hit_ID=NP_497139.1; Match level="QueryCoverage =70%, HitCoverage=15%, E-value=7e-23, Identity=69%"; Hit description =integrin-linked kinase, Paralysed Arrest at Two-fold PAT-4 (52.3 kD) (pat-4) [Caenorhabditis elegans] gb|
  Essential gene: C elegans homolog=C29F9.7; Phenotype=Pat
MDRIRSRRSNTAATRGKTQKHFVHATRRGHAVVIDHHQAIRFALDLARGMSFLHSLDQPVLRYYLSSKHVLIDEDLSAKISMADTKFSFQEVGRLSRPLGWRPR

SEQ ID NO: 120566 - protein, 402 aa, Heterodera glycines
  misc_feature (358)..(358): Xaa can be any naturally occurring amino acid
  misc_feature (396)..(396): Xaa can be any naturally occurring amino acid
  Coding regions on vcDNA: vcDNA=SeqID_46989; Strand=-; Position=1 -1208,1503-1530
  Homolog annotation: Hit_ID=NP_508294.1; Match level="QueryCoverage =95%, HitCoverage=33%, E-value=9e-71, Identity=37%"; Hit description =predicted CDS, endonuclease/exonuclease/phosphatase family and RNA -directed DNA polymerase (XC178) [Caeno
  Essential gene: C elegans homolog=ZK250.3; Phenotype=Clr,Lvl,Sck
ILSQNIYNFLLKLLKSEYQFGFVRNRSTTSQLITVVEDWYDAIINGKADCIYIDFQKAFDSVPHNLLLYKLEKIGIRGKLLMWIKSFLSNRTFRVKIGDALSSNKKVGSGVPQGSVLGPLLFLIYINDLPDALPSGVKIKLYADDVKLYISDTEIMHKALHNLSEWANKWQIKVSVQKTFVLYLGSKNPKETYKFDGNTINAVDTIRDLGVNIDNKLQFSDHVNKITRNAYLRMRSLFRIIKSKSSKIWITLYKTYIRPLLEYAPEVWNPSLQKNIKKIEKCQKYFTKRVFFKCSLPPIPYQNRLKYLQLPTLENRRKLFDLFMAHKIVYGRTDLKLFSIFKHALTSPFTDLTQNIKXAKNSFPLPGGTKLWNQLDKELIKTNSLNQFKTKLNFIXIHFLFL

SEQ ID NO: 120567 - protein, 147 aa, Heterodera glycines
  Coding regions on vcDNA: vcDNA=SeqID_46990; Strand=+; Position=1 -21,236-349,470-778
  Homolog annotation: Hit_ID=NP_495863.1; Match level="QueryCoverage =97%, HitCoverage=27%, E-value=1e-41, Identity=57%"; Hit description =phenylalanine hydroxylase, Biogenic Amine Synthesis related (52.1 kD) (bas-2) [Caenorhabditis elegans] em
  Essential gene: C elegans homolog=ZK1290.2a; Phenotype=Emb
MVEKLATLYWFTVEFGICIQNGAKKAYGAGLLSSFGELEYALSGQPELAAFNPPETCQTKYPITSYQPKYFVAESFADAKNKLAYCICRARVLSIFNPPRSRSTWSTSIPRQFQVNYNPYTQRIEMLDNESAANKLVRDVKSESQPW

SEQ ID NO: 120568 - protein, 276 aa, Heterodera glycines
  misc_feature (233)..(233): Xaa can be any naturally occurring amino acid
  misc_feature (273)..(273): Xaa can be any naturally occurring amino acid
  Coding regions on vcDNA: vcDNA=SeqID_46991; Strand=-; Position=1 -20,1296-2123
  Homolog annotation: Hit_ID=NP_502721.1; Match level="QueryCoverage =97%, HitCoverage=19%, E-value=1e-35, Identity=33%"; Hit description =endonuclease/exonuclease/phosphatase family and RNA-directed DNA polymerase (4O953) [Caenorhabditis elega
  Essential gene: C elegans homolog=ZK250.3; Phenotype=Clr,Lvl,Sck
AILSYFPSGVNIKLYADDVKISRTETEIMHKALHNLFEWENKWQIKVSIQKTFVLYLGSKNPKETYKFYGNTINAVDTIRDLGVNIDNKLQFSDHVNHITRNAYLRMRSLFRIIKSKSSKIWITLYKTYIRPLLEYAPEVWNPSLQKNIKKIEKCQKYFTKRVFFKCSLPPIPYQNRLEYLQLPTLEKRRKLFDLFLAHKIVYGRTDLDILKIFKPSKRFNVPFYRLTQNINXAKNLFPAGRATKLWNQLDKEIIKINSLNQFKTKIKLLNVXNDR

SEQ ID NO: 120569 - protein, 139 aa, Heterodera glycines
  Coding regions on vcDNA: vcDNA=SeqID_46992; Strand=+; Position=1 -210,317-415,462-572
  Homolog annotation: Hit_ID=NP_503179.1; Match level="QueryCoverage =94%, HitCoverage=28%, E-value=2e-18, Identity=35%"; Hit description =HSPC253 like (53.0 kD) (5A841) [Caenorhabditis elegans] gb|AAM34816.1| Hypothetical protein T22H9.1 [Caen
  Essential gene: C elegans homolog=T22H9.1; Phenotype=Gro
TLRSNAKRPREEKSTKPPPKLRQIKGLEGAAKQRNVRFDPRFSASCGQFDEFRFHQDYSFINELRKTDIQELKKAFRRAKREGNSALSDRIRCNLLRLENQQKAEMERQKMENIRLELRRGNIERMNRGERPIYLNNGQ

SEQ ID NO: 120570 - protein, 261 aa, Heterodera glycines
  Coding regions on vcDNA: vcDNA=SeqID_46993; Strand=-; Position=1 -21,735-866,918-1000,1047-1177,1230-1352,1432-1727
  Homolog annotation: Hit_ID=AAL02515.2; Match level="QueryCoverage =96%, HitCoverage=75%, E-value=6e-53, Identity=48%"; Hit description =Human hnrnp a1 homolog protein 1, isoform b [Caenorhabditis elegans]
  Essential gene: C elegans homolog=F42A6.7a; Phenotype=Gro
MVEVKKEVPREQSAKAESNVSTKRLYVSGVRDEHDEESFMHYFTEFGPVAKVEIIQDKNTNKARGFAFVTFDDYDPVDKCVLLKSHMIGGYRCDVKKALSREEMQKAQQHDRDRMERGMRSRGVPPQYGGRGGGYGPPPPAYAQYGGGYGPPQPGWGPPPPQWGGYGGGYGGYGQGPPAAASWGGAPPQAPAGPLPAAGTAAAEQGQWGAAAQGWGQQGGASWGPQQAGAWGGGGAAGGGPAASGAYGDKPQQDAIGCFFI

SEQ ID NO: 120571 - protein, 210 aa, Heterodera glycines
  Coding regions on vcDNA: vcDNA=SeqID_46994; Strand=+; Position=1 -208,1774-2196
  Homolog annotation: Hit_ID=CAE64196.1; Match level="QueryCoverage =31%, HitCoverage=12%, E-value=1e-09, Identity=43%"; Hit description =Hypothetical protein CBG08825 [Caenorhabditis briggsae]
  Essential gene: C elegans homolog=C37H5.9a; Phenotype=Emb
MNAYSNRSYGIKYDYGSIMQYASTIASSAPGKKTMVAKLKPTENERLMGQREGLSLSDVEAVKKMYCQPSLEPQLIKASLGTDQPVDRGLFLALGLESAEHPVPNDQNTFRILKQQLVQVLFSPTTKVTVDTVCLEREYSLICCWREWQSADIASVVHAVVGRSVEHKAKGAERTEQGSVHPKLEDFGEIAMDEENGRRDEKGLHWKDNG

SEQ ID NO: 120572 - protein, 341 aa, Heterodera glycines
  Coding regions on vcDNA: vcDNA=SeqID_46995; Strand=+; Position=1 -37,89-423,517-1168
  Homolog annotation: Hit_ID=CAG77941.1; Match level="QueryCoverage =76%, HitCoverage=39%, E-value=1e-20, Identity=34%"; Hit description =unnamed protein product [Yarrowia lipolytica CLIB99] ref|XP _505134.1| hypothetical protein [Yarrowia lipol
  Essential gene: C elegans homolog=T13F2.3a; Phenotype=Sma
MCYKKFSNFKCAGGGGGGFFYAHQQLTPPVAPGQHSPGQQRHYAPPPPQMLHPGMMYHHHQQQQQAQQQQQHMASPYHQQQQQYGAVQHQQHQQAMAAAAAAYWARTNGQQQQQQQQMPTPPAQDVGGGAVPGASTSARHTPQPSSVPPPNPSPVASAGPPQQPVVQSSPSVTAATSSAPGTAYDECGMADVGTTDSAQRPRSRQQQQQQQQAVHLQQQQQPPQHHPNAPPQQAMMLTPQAAAAHLRYASAVPPSPGMMMMVGPPGGGPPLSHGLPPQQQQQHAYAPPMGPPPHPSPHMAMPPMHHHHYATAQGMPPPFPGLSSGSFPPQFIGVREGGRGP

SEQ ID NO: 120573 - protein, 231 aa, Heterodera glycines
  misc_feature (220)..(220): Xaa can be any naturally occurring amino acid
  misc_feature (230)..(230): Xaa can be any naturally occurring amino acid
  Coding regions on vcDNA: vcDNA=SeqID_46996; Strand=+; Position=1 -237,742-1051,1127-1269
  Homolog annotation: Hit_ID=CAE66945.1; Match level="QueryCoverage =90%, HitCoverage=12%, E-value=7e-41, Identity=42%"; Hit description =Hypothetical protein CBG12337 [Caenorhabditis briggsae]
  Essential gene: C elegans homolog=C01G8.9a; Phenotype=Emb
MGMKQAQREAVEKLVMQLANTKQPELVHERRLFFEKLVLLNEQQGEVLSGPPQVSKSTVDLFSLYFAVKKKGGFEKTIKDKVWKHMCVEANADMQESSAAGFQLRKHYQKYLLKLECMETGQNAKELVEFAEKQKKKKKEKEPSSGGGGSASAAGPSTPSSAKDEQQQQHGGTGRPRGEPAATTAATTATTQQNAAGGAPPQQQQFSGAPGTAQGKAKQXYQKWGHIVHXT

SEQ ID NO: 120574 - protein, 384 aa, Heterodera glycines
  Coding regions on vcDNA: vcDNA=SeqID_46997; Strand=-; Position=1 -360,415-537,586-764,809-911,962-1348
  Homolog annotation: Hit_ID=NP_499453.1; Match level="QueryCoverage =100%, HitCoverage=30%, E-value=1e-111, Identity=54%"; Hit description=chondroitin sulfate proteoglycan 6 (3M395) [Caenorhabditis elegans]
  Essential gene: C elegans homolog=Y47D3A.26; Phenotype=Gro,Pvl,Stp,Unc
MYIKEVNITGFRSYKELTTVRNFSPKHNVVVGRNGSGKSNFFTAIQFVLSNDFSSLTLQDKNAFLHEGVGSRAPIAKVEIVFDNTDRRIPTDSDEVRIMRQVGQKKDQFFIDNKPVTRTEIVNLMESAGFSRSNPYYIVKQGKITELATASDPYRLKLIKEVAGTRVFDEKKDESTKILHETQTKIEKSVQLLGYINERLKKLEEEKEDLKEYQKWDKMRRAIEYTIYDLEIKEARSKNEKLTSHRERINAQQNEVETKLIQAKMSIQEAEMQIRRLETHYKGVKEERATLLKEQTDLMERKTQLELAIRDLAEDVDRERSGREIAEHSLQQLKRDIAEKEGQLEQLQPQFEQLLEEESQLGSDIRIGEQKCRELYAKQGHREQ

SEQ ID NO: 120575 - protein, 568 aa, Heterodera glycines
  misc_feature (341)..(341): Xaa can be any naturally occurring amino acid
  Coding regions on vcDNA: vcDNA=SeqID_46998; Strand=+; Position=1 -229,332-463,532-583,853-995,1130-1271,1346-1449,1491-1556,1615 -1678,1923-1993,2043-2249,2298-2457,2992-3133
  Homolog annotation: Hit_ID=AAH35974.1; Match level="QueryCoverage =96%, HitCoverage=60%, E-value=1e-119, Identity=43%"; Hit description= DHX15 protein [Homo sapiens] gb|AAF90182.1| dead box protein 15 [Homo sapiens] sp|O43143|DD15_HUMAN Putat
  Essential gene: C elegans homolog=F56D2.6a; Phenotype=Emb,Lva
TKMSVSFPEEIMPPSSSDNPKQNPFTGNNFSSKYWQLLSERTKLPVWRHRDEFISALATHRCILLEAETGSGKTTQIPQWCVQWLRTRDPHNKSMVCCTQPRRLATVCVAQRVAEEMDVMLGEEVGYSILGEEVGYSIRFEEALATVTLLRYCTDGMLLAESSRDELLKSYGVILLDEVHERTMITDVVMGLIKRISEFRPELRVVVMSATLKTGNFEQYFYGCHLMKIRGRSYPVDIIVTMIDGDNYITKSVSKAIEILQKTERGDILIFLSGLEDIEKCCEMDIEKCCEMVENEAEKCGGSGRLIVIPLYIVIPLYGSMQNEQQQILMETQPPFFTNVXGPRRCIVATNVAETSMTIDGVVFVIDSGFCKRKMYNARSMTIDGVVFVIDSGFCKRKMYNARSKLESLLVQRISRASATQRAGRAGRTQPGKCFRLYTEQCFRETMKEIFFAQIKHTNLDSVILRLKFFAQIKHTNLDSVILRLKKCGIDDIYQFHLIDAPSPDSIHHSIRLLTDLGALDHLGRITPLGEHINILPVDPPLARMMLESVKLRCTKEVICICAMLSAP

SEQ ID NO: 120576 - protein, 86 aa, Heterodera glycines
  Coding regions on vcDNA: vcDNA=SeqID_46999; Strand=+; Position=1 -68,272-372,527-616
  Homolog annotation: Hit_ID=AAH88786.1; Match level="QueryCoverage =100%, HitCoverage=38%, E-value=2e-31, Identity=55%"; Hit description= Unknown (protein for MGC:107779) [Xenopus tropicalis] gb|AAH81008.1| Wdr5-b-prov protein [Xenopus laevis]
  Essential gene: C elegans homolog=C14B1.4; Phenotype=Stp
ASADKTVKIWSTVDGKLEKTIQGHKLGISDVCWSYDNRMIVSCSDDKTLKLFDVQQGKTLKTFRGHRNYVFCCNFNPQSTLLVSGS

SEQ ID NO: 120577 - protein, 433 aa, Heterodera glycines
  Coding regions on vcDNA: vcDNA=SeqID_47000; Strand=+; Position=1 -131,178-352,399-548,592-753,814-953,1018-1134,1176-1602
  Homolog annotation: Hit_ID=NP_492524.2; Match level="QueryCoverage =96%, HitCoverage=33%, E-value=6e-83, Identity=38%"; Hit description =ubiquitin thiolesterase, family 2 and ubiquitin interacting motif (144.2 kD) (1K87) [Caenorhabditis elega
  Essential gene: C elegans homolog=F30A10.10; Phenotype=Pvl,Stp
MENDALMEEDGEQNQEDEMTLEDCWNICWLDSERCIAHKPPKRKAQNCKKNPYCIHRLGLEKFDKLLKTQQTSKVLVRREESKQPCGLNNAGNFCYVNSFLQIWFNDLKFRQCVYNWRSSTNWIMPQNAKLNIQTVMNCLQQLFLTMQFTPFEVTDANDFIKLLRLDNQQQDVQEFHTLFFGTIERTLEAHPNGRPVLDVIRQLFQSRISQTISCANCLRTSETVGEYRSLQIGIDGHSTLISAIQAFFAPEPLRDFRCDQCRETNCVTRSSRFTQLPELLIVQLNRYVLASNGNLRKLQNAVHYPRLLTELGGEGIPDYELCAVMIHEGKSTNSGHYYDVIRDPVIDRWFTYNDEVRIVWSYYPILRLCPIQTVNQKRTAPGYLGRLTQKPRASADTTGCYALIYRRVGSGLRGPVQLPPENIVTEAKKRVG

SEQ ID NO: 120578 - protein, 384 aa, Heterodera glycines
  Coding regions on vcDNA: vcDNA=SeqID_47001; Strand=-; Position=1 -147,208-1215
  Homolog annotation: Hit_ID=NP_498735.1; Match level="QueryCoverage =99%, HitCoverage=89%, E-value=6e-40, Identity=29%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MSRVYLFLELSIQKEDGGGRWVPIEAAVAADQLVAPAQCVGQTFVQQLKVQNTELYDSGTLYPYKAYLTNELSFPNSAKGHFMASAGYHPSRKHDDATDAGFLARCARFAGGRKARFLSRLDFDLGNQELYLLNNMDVLFTIYRAKDAFLLQSLAAAAAAAAAAQHYALYLHDIKLYVKMVEVQPSLNLSIYKTLEKQPATYAVRKTEVKSVFLTAGRTEMDHNIFSAAIPRRLTIALVANGAFNGQLALSPFNFKPYAIREISVHAAGHVYPAVPHRMDFSGCAYIRPFVDMYEALGMANSERSMDITLEQFHDGWTIFVVPMTSTLDDSCGFELLRSGTTSIRLAFNEAIPAGGVEMVVLGEFDQLIMIDYNRHIVSDSKIA

SEQ ID NO: 120579 - protein, 399 aa, Heterodera glycines
  Coding regions on vcDNA: vcDNA=SeqID_47002; Strand=+; Position=1 -192,257-361,642-835,1035-1179,1665-1836,1876-1962,2470-2546,2615 -2723,3004-3061
  Homolog annotation: Hit_ID=NP_499704.1; Match level="QueryCoverage =96%, HitCoverage=70%, E-value=2e-60, Identity=36%"; Hit description =cytochrome P450 precursor family member (3O111) [Caenorhabditis elegans] emb|CAB04112.1| Hypothetical pro
  Essential gene: C elegans homolog=T10B9.1; Phenotype=Gro,Sma,Unc
IIFFLKYFEEFAFLSFWLYRATYWKRRGIPCPDGKLFSGNLDKMFWEELRLFQMAKWTEQYGKVYGLLTGFQPVYGLLTGFQPMLVISDPTMVHELLTSKFEYFHSRMVSSLEGDVDKNPRMNLVNARGARWKRLRAIANPAFSISNLKKASLQKESFLFLIKEINQNTFSNISYLIFSFFVEMTYDVIARVAMGQRESRQFQSEDAKLAVHAFQRLQNKFEYLAMLFPWLGPMLRPILLLTVKMRRDPLLLLTLKIREQVAERRRQKQQQQQNAKQQRVPVDFIDQQRVPVDFIDMFLDSVTDEGSIEYRDELGNANIKVDRTNTVDEIEMQLQVFLLAGFDTFDTTANSLGFVSFNLACHPEVQLHLQEEIATVCISEEVGKKNLRSGMRPICHIKK

SEQ ID NO: 120580 - protein, 260 aa, Heterodera glycines
  Coding regions on vcDNA: vcDNA=SeqID_47003; Strand=+; Position=1 -14,655-1337,1477-1562
  Homolog annotation: Hit_ID=NP_510671.1; Match level="QueryCoverage =86%, HitCoverage=22%, E-value=8e-36, Identity=34%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
MHAFWSYQVKIGENFSESFRTYSGVPQGSVLGPLLFLVFINDLTNYIPAAVGIKLYADDVKLYISHDNDTKRDLLSLALANLAKWSKDNGIAIAHEKCAALYLGKNNSRHEYKIGEKVILSVDCVRDLGVFVDQKLSFNNHISKILKAAYYKAYQILKILKTRNINTLILAYKSYIRPHLEYASEVWNISSKEQSKRMETVQKFFTRIVYKKCGLKAASYEKRLEICKLEKLIINLGITFLFVQLIRGIAYPKQLWKSEL

SEQ ID NO: 120581 - protein, 228 aa, Heterodera glycines
  Coding regions on vcDNA: vcDNA=SeqID_47004; Strand=-; Position=1 -40,496-602,829-1167,1391-1591
  Homolog annotation: Hit_ID=NP_495884.2; Match level="QueryCoverage =79%, HitCoverage=15%, E-value=2e-26, Identity=33%"; Hit description =HEAT repeat containing protein (2J132) [Caenorhabditis elegans] emb|CAB03367.2| Hypothetical protein F46C
  Essential gene: C elegans homolog=F46C5.6; Phenotype=Unclassified
MSVISKCRRPQMSASVENGTPPAVAGNAQQQKLQQLCVACRRMCAYNFPCFVAVFGEEADVFSGRLLPILEQFCRDSDDEVRSIIASGFHEIVAQRKIAPMGTKNAKNSSSISASVPLLLGPFVDLLSSGNADIVQQLTANLHRILPMLYAEISASATQKRTHLIFAKLDRILVSCNNLMKGSTGSWRAHEAYLNGIAVLRNLVSTKDLLSNFVPLLKQGVLTAVIAK

SEQ ID NO: 120582 - protein, 145 aa, Heterodera glycines
  Coding regions on vcDNA: vcDNA=SeqID_47005; Strand=+; Position=1 -161,504-780
  Homolog annotation: Hit_ID=BAA09168.1; Match level="QueryCoverage =63%, HitCoverage=30%, E-value=4e-27, Identity=61%"; Hit description =SOX-2 [Gallus gallus]
  Essential gene: C elegans homolog=K08A8.2a; Phenotype=Lva,Unc
MVWSRGKRKRIATENPKMHNSAISRQLGQEWKLLSDVEKRPFIDEAKRLRQLHLLQHPNYKYRPRRKTKHPIAVDNICQPHNNCANLTTKIGTFGMEKQQHHQQHFPPLKIPKMNGEICNKFEIEMPFNFLIIYLIFNRCLIIID

SEQ ID NO: 120583 - protein, 228 aa, Heterodera glycines
  Coding regions on vcDNA: vcDNA=SeqID_47006; Strand=+; Position=1 -156,282-325,587-656,908-1324
  Homolog annotation: Hit_ID=EAA58305.1; Match level="QueryCoverage =29%, HitCoverage=14%, E-value=5e-11, Identity=49%"; Hit description =hypothetical protein AN6906.2 [Aspergillus nidulans FGSC A4] ref|XP _411043.1| hypothetical protein AN6906.
  Essential gene: C elegans homolog=T10F2.4; Phenotype=Emb
MSRFVCAISGNEPEVAVASPVSGEVFEKRLLIKYIEENGTDPITGHKLDTSNLVELKQDPGIRSMQKSITSGGGSFLAFAKLLAEWKWIVILLILQLGLGVIAADMSTASCNWDWKIILSIAAFFLLSWVSVLVFIANSVKGELSAKIDGVKTELRDKLDVVKAELNEKMKEMNDKFNGARVEINGKFEIMKIELRGDMKGLSGEMNAMKSELNGRIDVLKAEMNGKR

SEQ ID NO: 120584 - protein, 84 aa, Heterodera glycines
  Coding regions on vcDNA: vcDNA=SeqID_47007; Strand=-; Position=1 -150,1016-1117
  Homolog annotation: Hit_ID=NP_499349.1; Match level="QueryCoverage =77%, HitCoverage=28%, E-value=8e-16, Identity=60%"; Hit description =gene rich cluster C2f (25.8 kD) (3L739) [Caenorhabditis elegans] emb|CAA21025.1| Hypothetical protein Y39
  Essential gene: C elegans homolog=Y39A1A.14; Phenotype=Lva
MKPKKRPMKHPSAPFSRDSPRSKRLKQSTDGAGGKRLFVVIEDCSLEVAKVGAEHVVLCSDKHANWLRKQNRDPAQFRPDILHQ

SEQ ID NO: 120585 - protein, 332 aa, Heterodera glycines
  Coding regions on vcDNA: vcDNA=SeqID_47008; Strand=+; Position=1 -219,272-475,533-780,850-1030,1080-1224
  Homolog annotation: Hit_ID=NP_660094.1; Match level="QueryCoverage =98%, HitCoverage=18%, E-value=1e-106, Identity=58%"; Hit description= suppressor of Ty 6 homolog [Danio rerio] gb|AAL73392.1| Spt6 [Danio rerio]
  Essential gene: C elegans homolog=T04A8.14; Phenotype=Emb
KEDMKSLIELIARRQPHLVVIGGEDIDALRLTTDVRLSINEAAQQNLKIPLQLSVEIANSDAARVYMNSRMAMQEFPKYPPLLLKAISLARFTLDPLIEICHLCNADDDIMYMKFHPLQNEVPKQELLFALQVECINRVNEVGVDINRCLEFPYTAGLLQFVCGLGPRKASHLLKILKQNENLLESRTKLVTYCRMGPKVFMNAAGFIKIDTTKVADRTDSYVEVLDGSRVHPETYEWARKMAVDALELDEPSDQTIAIEEILKAPERLKELDLDAFAEELGRQGFGNKSITLYDIRAELNYRYKDLRKPHQAPTGEELAQILLKEDCSNLQ

SEQ ID NO: 120586 - protein, 443 aa, Heterodera glycines
  Coding regions on vcDNA: vcDNA=SeqID_47009; Strand=-; Position=1 -140,659-1002,1963-2810
  Homolog annotation: Hit_ID=NP_510671.1; Match level="QueryCoverage =59%, HitCoverage=27%, E-value=9e-53, Identity=39%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
MLTNFPKFCCAPPYLKVISLTVPDSLHCVNLNVKMTHPVIILSMRGIPPNTSANFTKKILNLIGNYFEEDFILMGDFNLNAKDITWTSGTPYAKSEKGNIFCEFFNKYGLFLMTNGPTRGSAWLDLILSSKPDFVNNVLIEDIFSSDHLSTNFSLSFPQNKILEDWYDSIYGKKNIDCIYVDFRKAFDSLPINILINKLHNIGIRGKLLSWLSEFLKDRFYRVKINNKFSNLYPIQSGVPQGSVLGPLLFLIYINDLPQVIPPGVSIKLFADDVKIYVSYKTRDERSKLNVALDNIGKWANAFGLNISQNKTFILFLGKNNSKQQYKFFNNIINEVESISDLGILIDNKLRFSNHYTKIIKAAYLRIRNIAKILKTRSIRIWTKVFKTYIRPLLEYAPEIWNPTYKKDINKLERCQKYFTKIALFKCRLPYIPYEQRLDLFKL

SEQ ID NO: 120587 - protein, 535 aa, Heterodera glycines
  Coding regions on vcDNA: vcDNA=SeqID_47010; Strand=+; Position=1 -316,587-792,852-1229,1281-1712,2049-2324
  Homolog annotation: Hit_ID=XP_346518.1; Match level="QueryCoverage =69%, HitCoverage=25%, E-value=3e-18, Identity=25%"; Hit description =hypothetical protein XP_346517 [Rattus norvegicus]
  Essential gene: C elegans homolog=C43E11.1; Phenotype=Emb
MTEESEEYCLGGRPLSDLKVVELRKELEIRSLPKSGNKKELVERLQNFLRDEKSEQRTGGESHQAQKTAPTMELNQSPSGVSVPNVVAQYLAQQQIQLQAARRSADKIRADTSLDDSAEIMPISSPTEEIQPSLEQQKEEESQDQIKQSSESAPELVNSDVKEPSVEKTEESAELQKGADQHLEVETDKSLEEERTNTEEKEGSGDGSTSEKEREIKKEERTEEKTTEPTKDEEERSSRTEGTQGDQQIEVKAESDEDETEKPVETVNRTETVDTHAEEMSPDKSAKARSSVVEEELDFENEEDDEEEREEPADDGGKRRAHLKQGSPVTMKSFEHKLGPEHMEQKVTDVISTSKTVAVSESEVGPLVGQLTASIKEESSKPPEGQQENTPEGFIRRRPSSPARRANRLMIGFTRSVSDTLRRVGFTSETLSGRSQRRPSLICLLNRRKAEEEQEASANNSALGGGLGLTIVVDNRAWILKLIIHLNYGDLFQGRGPETVPNSGPTVLIQHDKKRQKDAENRKRKGAFCEINGDL

SEQ ID NO: 120588 - protein, 210 aa, Heterodera glycines
  Coding regions on vcDNA: vcDNA=SeqID_47011; Strand=-; Position=1 -30,106-210,379-467,619-689,734-946,1489-1617
  Homolog annotation: Hit_ID=CAE64609.1; Match level="QueryCoverage =90%, HitCoverage=67%, E-value=3e-46, Identity=47%"; Hit description =Hypothetical protein CBG09365 [Caenorhabditis briggsae]
  Essential gene: C elegans homolog=CD4.6; Phenotype=Emb,Lva,Lvl,Unc
KDYAVVVALMRAQNERAQNELSSYQQKVFKLDDHLGLSMSGLISDGRILARFMQSECAEFRWNYHNPISVELLNRKLGLKLQSNTQYYGRRPFGVGLLIIGYDDKGPHVVKAEPSGDVSDKGPHVVKAEPSGDVSEMFAASIGARSQSARTYLEKNLPEFETADRDALIRHAIRSLKETLQADAGSLDENSAVLGPFFLGVARARVWGFV

SEQ ID NO: 120589 - protein, 219 aa, Heterodera glycines
  Coding regions on vcDNA: vcDNA=SeqID_47012; Strand=+; Position=1 -293,338-461,506-640,694-746,1417-1471
  Homolog annotation: Hit_ID=CAE56547.1; Match level="QueryCoverage =66%, HitCoverage=67%, E-value=1e-42, Identity=51%"; Hit description =Hypothetical protein CBG24279 [Caenorhabditis briggsae]
  Essential gene: C elegans homolog=R04A9.4; Phenotype=Unclassified
MAADDSNSEKESNSLSIRTDKLLSVPFNGEETSENTSQQQQQQTPVALPTSSSKILSKQHPLKTKWNFWFLNNKKKDMDWLERLSKVCTVSTVEEFWAFFDNIHPPSGMYGCDYNFFRDGIEPLWEVAQNKDGGRLVIQVDKQRNELLDGWWMEFLLACIGEQFGDDSDQVCGAVCNIRNKGSKISIWTTNASEEDKNRRIGHLFWLQTSSAIPCRFMI

SEQ ID NO: 120590 - protein, 288 aa, Heterodera glycines
  misc_feature (244)..(244): Xaa can be any naturally occurring amino acid
  misc_feature (282)..(282): Xaa can be any naturally occurring amino acid
  Coding regions on vcDNA: vcDNA=SeqID_47013; Strand=-; Position=1-884
  Homolog annotation: Hit_ID=NP_508294.1; Match level="QueryCoverage =96%, HitCoverage=24%, E-value=2e-43, Identity=32%"; Hit description =predicted CDS, endonuclease/exonuclease/phosphatase family and RNA -directed DNA polymerase (XC178) [Caeno
  Essential gene: C elegans homolog=ZK250.3; Phenotype=Clr,Lvl,Sck
LGPLLFLIYINDLPDVIPSGVNIKLYADDVKLYISDTEIMHKALHNLFEWANKWQIKVSIQKTFVLYLGSKNPKETYKFDGNTINAVDTIRDLGVNIDNKLQFSDHINQITRNAYLRMRSLFRIIKSKSSKIWITLYKTYIRPLLEYAPEVWNPSLQKNIKKIEKCQKYFTKRVFFKCNLPPIPYQNRLEYLQLPTLENRRNLFDLFMAHKIVYGRTDLKLFSIFRPSTRFNIPFYRLIQNINXAKNSFPLLGGTKLWNQLDKELIKTNSFNLFKNKIKNSXVMLMIV

SEQ ID NO: 120591 - protein, 286 aa, Heterodera glycines
  Coding regions on vcDNA: vcDNA=SeqID_47014; Strand=+; Position=1 -87,446-653,694-863,1124-1201,1263-1579
  Homolog annotation: Hit_ID=NP_505626.1; Match level="QueryCoverage =95%, HitCoverage=31%, E-value=7e-26, Identity=27%"; Hit description =general transcription factor IIIC polypeptide 3 102kDa (119.0 kD) (5K688) [Caenorhabditis elegans] emb|CA
  Essential gene: C elegans homolog=ZK856.13; Phenotype=Gro
MDEEDIALDLVRDRINIDVESGEFTALDKVVKLAPYHVQTYKELSDLYSELGQKEKSFEFKMLAALLNSKTTAEEWDEIAGTAKSFNRLELAVACLAKAIRCDPENWLYYEKRIQILDASGETDLAMKTRLQAAQSINCQTSKINFAWIDKLIKTDSAKSILAMHNELVKAVDEKGDNAMTVHFTNTDYKLSPFPPPSGSHWVINAKMNSLLLSYLIICWVHLGRLDLVPQLIDCLLERPLGSSDEENAFLDIARSLHSTHQLVLAVEYMQKLRKERPEYNESTDF

SEQ ID NO: 120592 - protein, 106 aa, Heterodera glycines
  Coding regions on vcDNA: vcDNA=SeqID_47015; Strand=+; Position=1-321
  Homolog annotation: Hit_ID=NP_508269.1; Match level="QueryCoverage =100%, HitCoverage=16%, E-value=2e-12, Identity=34%"; Hit description= ribonucleotide reductase R2 family member (XC45) [Caenorhabditis elegans] gb|AAG24065.1| Hypothetical pr
  Essential gene: C elegans homolog=F19G12.2; Phenotype=Unclassified
MDFSRSAYIRPFVDMYEALGMANSERSMDITLDQFRDGWTIFVVPMTSTLDDSCGFELLRSGTTSIRLAFNEEIPAGGVEMVVLGEFDQLIMIDYNRHIVSDSKIA

SEQ ID NO: 120593 - protein, 430 aa, Heterodera glycines
  Coding regions on vcDNA: vcDNA=SeqID_47016; Strand=-; Position=1 -490,963-1067,1368-1495,1663-1845,2090-2215,2371-2438,2498-2689
  Homolog annotation: Hit_ID=CAE62099.1; Match level="QueryCoverage =98%, HitCoverage=39%, E-value=7e-79, Identity=39%"; Hit description =Hypothetical protein CBG06129 [Caenorhabditis briggsae]
  Essential gene: C elegans homolog=F12F6.6; Phenotype=Ste
MPQQQQQAFPPVPQQHQAFPPMPHQQSVPQQQQTFPSVPQHQQQAFPPMPQQQAVPQQQQNFPPMPQQDAFTQMPQQPPTFPPVSQQQQAFPPMPQQQQQAFPPMPQQQQQAFPPMPQQQQQGFPPMPQQQQQQGFPPMPQQPQAFPSMPQQPQAFSVGFYGPMAEDDQSTRSGLFPTGFPQAESPPLVSTEIIAQDQGNANPKFMRSTLYAVPQSQDMVKATQLPLSLAICPFAKLHQSEYPPPVIDLGEIGPVRCQRCKAYMCPFMEFIDGGRKFRCPFCRASTPGMLINTRVHPTIQYFNGTPPKQPAYIFMLDVSYNAVRTGLVELFCRNIKDIAQGVAENFFFGFLMGKSSVRRDKRAALYGENFRAGASSMRIGLATYDQTVHFYNLSQPGRAEMLVVSDIAEVFVPFVDGFLVEFEQAENALT

SEQ ID NO: 120594 - protein, 154 aa, Heterodera glycines
  Coding regions on vcDNA: vcDNA=SeqID_47017; Strand=-; Position=1 -90,532-693,927-1139
  Homolog annotation: Hit_ID=XP_310552.1; Match level="QueryCoverage =87%, HitCoverage=25%, E-value=3e-15, Identity=36%"; Hit description =ENSANGP00000017318 [Anopheles gambiae]
  Essential gene: C elegans homolog=M176.2; Phenotype=Emb,Lva
MLFKVLSTPGIVERFFTGPGEEGMAQAIRKKAMENPQDYVLKANDCGPTGMYFNEDMVKKLKSMAPAERDFYYLTEKLRPTTVKNHFVRPNAKPMLNVNANPELGIFGCLVGNMKTGQVFFFSRIGHMMKSKMDNVDEGGVWRGNSVYDSPYLV

SEQ ID NO: 120595 - protein, 288 aa, Heterodera glycines
  misc_feature (5)..(5): Xaa can be any naturally occurring amino acid
  Coding regions on vcDNA: vcDNA=SeqID_47018; Strand=+; Position=1 -38,643-727,772-895,1116-1210,1572-1851,2260-2474
  Homolog annotation: Hit_ID=CAE59896.1; Match level="QueryCoverage =94%, HitCoverage=39%, E-value=5e-74, Identity=51%"; Hit description =Hypothetical protein CBG03380 [Caenorhabditis briggsae]
  Essential gene: C elegans homolog=T26C12.1; Phenotype=Emb
KYPIXEKVLFLIYSAERPLLLVGSQAMAPPVKADELAQTVESLGVPAYLGGMSLGVPAYLGGMARGLLGAYSAIQMRQERKTALREADLVILAGAVCDFRLSYGRVLSPRCKVFTINRHRDTMLKNHGVFWHSAMAIQADVGSTLVQLHQRMASNSFAVDGHQRWDAWLNALRSRERDTDTRNGAKAAERTADGRLNPLRLLRMLNEVLPDNTILVADGGDFVGTAAYTVLPRGPLQWLDPGAFGTLGCGAGFALGAKAVHPDCPVLILYGAGASGYVSKWGWMDNLG

SEQ ID NO: 120596 - protein, 192 aa, Heterodera glycines
  Coding regions on vcDNA: vcDNA=SeqID_47019; Strand=-; Position=1 -235,304-438,579-788
  Homolog annotation: Hit_ID=CAE75513.1; Match level="QueryCoverage =90%, HitCoverage=40%, E-value=1e-55, Identity=55%"; Hit description =Hypothetical protein CBG23528 [Caenorhabditis briggsae]
  Essential gene: C elegans homolog=E02A10.1; Phenotype=Emb,Lva
FVGIKDLHAKVRGSTTNYIALTYAFVAGLLNQETHQQLAERTRLHVVELSPNRQFFPRIVASPLTAPVKADDEVDTKERMKLDEYYGEGRFPLKKAEPLPFYANSPGHLHAEWRKHPYRNMEKKIIRLLADGVVNRWTRKERYKWSQRSVEMVASGRKPIPLGLGLSDVNPPEGEKALIGGGRTANEATEAD

SEQ ID NO: 120597 - protein, 387 aa, Heterodera glycines
  Coding regions on vcDNA: vcDNA=SeqID_47020; Strand=-; Position=1 -342,526-1347
  Homolog annotation: Hit_ID=XP_320901.1; Match level="QueryCoverage =80%, HitCoverage=73%, E-value=1e-46, Identity=35%"; Hit description =ENSANGP00000017731 [Anopheles gambiae]
  Essential gene: C elegans homolog=K01A6.4; Phenotype=Emb,Gro,Unc
RVKNGAFRRCTFGKDFQKKLKKLRKPLSDLSSITTKCASRRHPITKRWRHFLIFRFDSEFEFLLKYYRRKRSTEQNTATEYGKSAGEYGANSDYGTSGGYGKTDSEVNYPRKPKTYKPYQYGGAYGTENGGYGGKDEYEKSEYSRKDGYDKKGCGGYEQSGYGEKDGYDKKGCGGHEQSGYGGKEGYGGYGGKQGYEKSEYSRKDGYDKKGCGGYEQSGYGEKDGYDKKGCGGHEQSGYGGNEKSGYGGKDGYEQSGYGGYAQSGYEKSGYGGKDGYEQSGYGGYAQSGYEKSGYGEKDGYEKSGYGGSDGYEKSGYGGRDGYEQSGYGGSDGYEKSGYGGRDGYEQSGYGGYAQRGYGEKDGYEKSGYGGKDGYQNEYHDYYKNNR

SEQ ID NO: 120598 - protein, 92 aa, Heterodera glycines
  Coding regions on vcDNA: vcDNA=SeqID_47021; Strand=+; Position=1 -29,85-209,266-519
  Homolog annotation: Hit_ID=CAE71388.1; Match level="QueryCoverage =95%, HitCoverage=21%, E-value=2e-14, Identity=43%"; Hit description =Hypothetical protein CBG18295 [Caenorhabditis briggsae]
  Essential gene: C elegans homolog=C44B9.2; Phenotype=Gro
MLFTLNINGFLIRQRLNGDVEIFCRPRQIICSPELSTVHLRTANVEMEVQTDKKAYVKYGSKRVHVSRSGMVVSNENCSASMDHIGRIVSAS

SEQ ID NO: 120599 - protein, 975 aa, Heterodera glycines
  Coding regions on vcDNA: vcDNA=SeqID_47022; Strand=-; Position=1 -1198,1339-1392,1823-2242,2420-3675
  Homolog annotation: Hit_ID=NP_508269.1; Match level="QueryCoverage =44%, HitCoverage=66%, E-value=1e-44, Identity=28%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MPSSNSFYVIVPSNTNVEGNRTNSFRVRLPRKLQFNSEWDVGLGVIIYPHSWPSLGTSEDQFVQIEWKIGENVQIPIPSSNVTNPVELWKRLYKLLEEGNKPFAVKVEGVQKKFTEAANTARQLGRAEYINKQQQQQQRDKRNVNDDDDDDDDENEEQLLNALLAGVDTLLDLYGATSGGLLEREKRAATSKVPLRNWDDTEEEYQEKLDKYFLRLRGRNLERLEGLITEKLNAEIALMDDEERKILDQTKELGMTAWIKVFQSAYSACFLHFDSATNRFSLKLDDRYVQKIKISDQLAYILGFNSTDFTEKETIAKFMPDMSGGVASFHVYAPDLIEPMMIGDVIAPVLRIVTIRGKPDEIIEEQFLSVQYHRVLVKEISEIFIEIRTSGGSLMPFQYAVAATPAPYSMVINVDPSEVVVQYGGYNVFRGVPYQRGSGIGSVFRSLLRYLIPIGKEIGTAIGRQGLESGNRVLSNVLEGRDLKESLVSEGKTGLKNLLEKAANNINAQKGQGFDFKRYTKRNDAREGGAFGKAKKGINKLQSRLGPHDFLPANTPAVPSTNVSVVRSYFREVLPLVTITQESPYLFRLYSDNLWTDLSRIYLFLDLSIEKPDVDGNWVSIAATDAQVGTIQGIGQTFVQQLKVSVGNTEIYDSGNLYPYKVYITNTLSFPMNVKKSFLASTGHYATRTHDSVADEGFKARCKIFEGGKRAQFLSRLDFDLGNQELYLLNNLDLLFTIYKARDTFIMQTLKANDTTRYRVRVHDVKLYAKMIDVQSSLNLSIYKTLEKQPATYAVRKTEIKSCFISEGRFEIDYNVFSATIPRRMTIALVANGAFNGNYALSPFNFKPFDIRDIAVYAGGMIYPIVPYKLDFAKDIFVRPFVDMYEALGMANSERSFDITKEQFKSGWTFFVIPLTSTLDDSTGYELLRSGTTSIRATFNSAIPEGGVEMIVLGEFDQMIMIDYNRHIVSDSKLS

SEQ ID NO: 120600 - protein, 290 aa, Heterodera glycines
  Coding regions on vcDNA: vcDNA=SeqID_47023; Strand=-; Position=1 -55,98-222,339-544,647-1133
  Homolog annotation: Hit_ID=CAE61960.1; Match level="QueryCoverage =94%, HitCoverage=19%, E-value=1e-15, Identity=26%"; Hit description =Hypothetical protein CBG05960 [Caenorhabditis briggsae]
  Essential gene: C elegans homolog=ZK593.5; Phenotype=Clr,Emb,Rup,Sck
MAKNMNSSGHSNLPTSVEAVEVEFLAFTDRLSATLTECEGLTIRALNRIPAENDLILGPELSDRILSAIAALEKCMCCLNECCAMAVSQLSAVDSEGLPAQQLLEFLRGEVEKFAGRLDNQQQVAFHIFDERERGLELVRTVLDELSVALENSSMELPPSAKDGDPTRNGSPLTINGNPFVPLNERAYGRKKEAVEADGIRWQLAKKDEELLNLQKALKERDSEIGTMKVGEFSKMSSQIAFICSASGGNGKDSVGRNDGERRHFRGDGIASAAMHRLRERLEETEGVRF

SEQ ID NO: 120601 - protein, 290 aa, Heterodera glycines
  misc_feature (265)..(265): Xaa can be any naturally occurring amino acid
  misc_feature (279)..(279): Xaa can be any naturally occurring amino acid
  Coding regions on vcDNA: vcDNA=SeqID_47024; Strand=+; Position=1 -50,95-133,400-502,570-643,810-968,1020-1103,1150-1312,1340-1381
  Homolog annotation: Hit_ID=NP_505050.1; Match level="QueryCoverage =95%, HitCoverage=42%, E-value=4e-82, Identity=59%"; Hit description =innexin, putative gap junction protein, OPUs gap junctional protein (inx-4) [Caenorhabditis elegans] gb|A
  Essential gene: C elegans homolog=F26D11.10; Phenotype=Unclassified
CFNLRYYESYVTGMYLATKVFYVGNVLTNYLATKVFYVGNVLTNLLLVNKFLETNNYSIYGLGVLYDLLLLGKSWTQSGNFPRVNFPRVTLCDFEVRVLGNIQRHSVQCVLVINIFNEKIFILLWLWFCVLFFITLFDALYWFSVSLFHRDRFRFVLRHLELTSDPDRPELFRKEKLTSDPDRPELFRKEKRKQVEHFLRTYLKVGGVLVLRFALVGGVLVLRFALRAGVFCPVVPAALWLRFLSRPVSLLVVASFLFPQGVHRXLIDSSSAPNPSHRXLIDSSSAPNPS

SEQ ID NO: 120602 - protein, 446 aa, Heterodera glycines
  Coding regions on vcDNA: vcDNA=SeqID_47025; Strand=-; Position=1 -39,89-342,475-597,989-1166,1261-1368,1426-1560,1664-1862,2305 -2463,2542-2687
  Homolog annotation: Hit_ID=CAE67510.1; Match level="QueryCoverage =71%, HitCoverage=46%, E-value=4e-38, Identity=32%"; Hit description =Hypothetical protein CBG13026 [Caenorhabditis briggsae] emb|CAA10310.1| F18A1.5 protein [Caenorhabditis br
  Essential gene: C elegans homolog=F18A1.5; Phenotype=Emb
MEDQPQLSQGFFQTFLDEKVPADFQPILQVLETRTIGSSSAMGGYPPQGQQMRARLSDSLYSYSGCVIPQTVTRRFQDDGLSTHNGIIQVTSWKRVDGGKLCFFQVLDYTLYSLDFPVIGNPQPHSGNPAEFRRVVQVAWRICGVVSGKDASIKDLTSPRGSFRVFSFNVTDSKGVAIRIAAFGEQADKFFPIVENANAYFISGAGGPRSVRAANKRFNSTGHDYELVLDRDSEVVYCEEQIEVPEVKLKPISLKDLPNHVNECVDVQAIVDRVGEIAQVTSRKDMRQLDKRDIFLLDSTGTEVCLTLWNEEAVAFHATTGTVLFSILSFLGMCPEAMKFAFLRPSGFSVSTTSSTSLLFNPEGKKSENLCLWYREYRPDANIKSLSIGSASDTQANFERDFRMIGIIRRDGVSRDNDKGEYFSIKAMVVTVKSDQAIYQVRPNNK

SEQ ID NO: 120603 - protein, 68 aa, Heterodera glycines
  Coding regions on vcDNA: vcDNA=SeqID_47026; Strand=+; Position=1 -86,505-625
  Homolog annotation: Hit_ID=CAE63699.1; Match level="QueryCoverage =98%, HitCoverage=21%, E-value=1e-15, Identity=62%"; Hit description =Hypothetical protein CBG08214 [Caenorhabditis briggsae]
  Essential gene: C elegans homolog=K04G2.1; Phenotype=Lva
GSIDGNQCLIVKGKFQQKHFENVLRGYIKLFDNPLPLLSDEYVRCHTCRSSDTELTKDVSRLFFIQCK

SEQ ID NO: 120604 - protein, 422 aa, Heterodera glycines
  misc_feature (404)..(404): Xaa can be any naturally occurring amino acid
  Coding regions on vcDNA: vcDNA=SeqID_47027; Strand=+; Position=1 -82,480-586,861-928,972-1180,1225-1335,1389-1535,1615-1782,1830-1991
  Homolog annotation: Hit_ID=NP_957381.1; Match level="QueryCoverage =88%, HitCoverage=34%, E-value=3e-44, Identity=32%"; Hit description =similar to transportin-SR [Danio rerio] gb|AAH45332.1| Similar to transportin-SR [Danio rerio]
  Essential gene: C elegans homolog=F53G2.6; Phenotype=Emb
ERSVITRILFSISVLRVFILKFLLFQDSWAKLKTDPVLWLDRIADVWRTLRPWQQNSPINRCFRSVQMRWNVLTTLQRHQSQQRVVEHACVVEHACRTIRFLIRSMGAQSVVFIEPVASQIMLTFSQFPHSCLLYLSSIMVDEYGSMAHLQPGMLQLLDNLANRSLSLLATDSENGLRDHPLLDNLANRSLSLLATDSENGLRDHPDTVDDLYRLAIRFIQRSPSTLFSRSPSTLFSHPIVVQLFQGAIHGLVLNHQDANRSVTKFVMEIIAAAKGKRSQSLSKEQTERVSQSLSKEQTERVRQMLAENGPQLMLACVSAALFHLSNSLCKEMAEIVHALLKTDKMKAEQWLHFVCVQLPHDGGTDKMKAEQWLHFVCVQLPHDGGHSATPQQLNDFRMKILEXPSFDRVIVLMHVFRSVRP

SEQ ID NO: 120605 - protein, 109 aa, Heterodera glycines
  Coding regions on vcDNA: vcDNA=SeqID_47028; Strand=-; Position=1 -142,427-532,578-656
  Homolog annotation: Hit_ID=CAE67168.1; Match level="QueryCoverage =94%, HitCoverage=22%, E-value=2e-17, Identity=33%"; Hit description =Hypothetical protein CBG12598 [Caenorhabditis briggsae]
  Essential gene: C elegans homolog=F10C5.1; Phenotype=Mei,Ste
MHEQAQEFLKRAIKLCPTNASIWVLLGHEYLETKNHQLASTAYKKATGVIFSKIDRKSDAEKCFKKAFQIGDVEGNALTHLAKLYEEQENQQNAAKAYEAYLTLYTEEL

SEQ ID NO: 120606 - protein, 187 aa, Heterodera glycines
  Coding regions on vcDNA: vcDNA=SeqID_47029; Strand=-; Position=1-564
  Homolog annotation: Hit_ID=NP_508269.1; Match level="QueryCoverage =93%, HitCoverage=27%, E-value=8e-16, Identity=34%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MAFHKIYNDSVNSITNALDFFRIPPTNISVSSSKVFELLPSNPLTDTPYHFKLHSSQNYIDLSKCYLLSEFRIRKENANGQLVDLAADEVAPIQLIGHTFIRNIKMSINGREVFNANSLMAYKSYFSHELSIPRPRDSHLNAAGYYRDTGGVLEVGDGCTARRNLFVGSRTAQFIAKIDADLFNQPR

SEQ ID NO: 120607 - protein, 382 aa, Heterodera glycines
  misc_feature (11)..(11): Xaa can be any naturally occurring amino acid
  misc_feature (25)..(25): Xaa can be any naturally occurring amino acid
  misc_feature (41)..(41): Xaa can be any naturally occurring amino acid
  misc_feature (203)..(203): Xaa can be any naturally occurring amino acid
  misc_feature (358)..(358): Xaa can be any naturally occurring amino acid
  Coding regions on vcDNA: vcDNA=SeqID_47030; Strand=-; Position=1 -308,380-532,657-732,877-1026,1519-1683,1725-1963
  Homolog annotation: Hit_ID=NP_505237.1; Match level="QueryCoverage =95%, HitCoverage=82%, E-value=1e-55, Identity=34%"; Hit description =human neuronal Ceroid LipofusciNosis related (46.9 kD) (cln-3.3) [Caenorhabditis elegans] gb|AAC26960.2|
  Essential gene: C elegans homolog=C01G8.2; Phenotype=Emb
FTSFMNRIPRXKIIIISNILSNNLXILFKQFYIYIFDFFLXSFRHFLACSLQAISFLLIGFSTTMSMALVGVAFGSAAAGFGEICFLALSSFYDRSTVSAWCFSTVSAWCFGTGGSGIVSATAYAALTEPKLLGMSPQNAILTMLIVPTVYFLTWFVLVHSPRMHKAQLLRPSSWIVPANYFMIPIGLKKQTDFKIRKQINIXLVQPLLRYMLPISSVYVLDFLINSGLLQHVKFDCARSFGLSLASQFRWLQTFHVIGLFLARLSAIFVEMPSLILYSLPILMLANLAIFFGQALFSFVPHILLANLAIFFGQALFSFVPHILFVFAIIFFEGMLFGSGYTFFGKIHRKVIFTFYLXKSALAQTVGVRVFSRDRWTCNRPG

SEQ ID NO: 120608 - protein, 133 aa, Heterodera glycines
  misc_feature (103)..(103): Xaa can be any naturally occurring amino acid
  Coding regions on vcDNA: vcDNA=SeqID_47031; Strand=-; Position=1 -96,385-435,469-591,832-917
  Homolog annotation: Hit_ID=CAG32633.1; Match level="QueryCoverage =100%, HitCoverage=42%, E-value=5e-34, Identity=57%"; Hit description= hypothetical protein [Gallus gallus]
  Essential gene: C elegans homolog=C27F2.4; Phenotype=Gro
MASSRPEYSGPPEQYYDNTEARKYTANSRIQKIQRELAQRAYELLELPARSPALLLDIGCGSGLRSPALLLDIGCGSGLSGAVLAEHGHHWVGLDISRAMLSXFVDTESNGQLLLADMGAGLPFRPACFDGAI

SEQ ID NO: 120609 - protein, 144 aa, Heterodera glycines
  Coding regions on vcDNA: vcDNA=SeqID_47032; Strand=-; Position=1 -63,461-568,733-843,1421-1573
  Homolog annotation: Hit_ID=NP_014368.1; Match level="QueryCoverage =54%, HitCoverage=75%, E-value=1e-15, Identity=56%"; Hit description =Hhf2p [Saccharomyces cerevisiae] ref|NP_009563.1| Hhf1p [Saccharomyces cerevisiae] gb|AAT92979.1| YBR009C
  Essential gene: C elegans homolog=ZK131.1; Phenotype=Unclassified
MSGCGKGGKGLGKGGAKRYRKTGLHNIQCITKPVIRRLARCGGLKRIPGLDYEEISMAHHDNIQGITKNDFARNEGVKGTSGGINEIWPNDFRMDNESNTIVENFQIDETEEQIDWDPDANSAFLDIGATVELVGAESDIDDGN

SEQ ID NO: 120610 - protein, 87 aa, Heterodera glycines
  Coding regions on vcDNA: vcDNA=SeqID_47033; Strand=-; Position=1 -77,144-260,314-382
  Homolog annotation: Hit_ID=NP_491519.1; Match level="QueryCoverage =98%, HitCoverage=28%, E-value=2e-15, Identity=48%"; Hit description =CHORD protein, with cysteine and histidine-rich domain, zinc-binding (36.0 kD) (chp-1) [Caenorhabditis el
  Essential gene: C elegans homolog=Y110A7A.13; Phenotype=Pvl,Stp
KEIVTNAREDWFQRGGQVHITIYCKGALPSETSAKSDGLTLEVTINGSTKRYELFGEIAPSESVVIISERKVEIVLKQVAKIGWPKL

SEQ ID NO: 120611 - protein, 98 aa, Heterodera glycines
  Coding regions on vcDNA: vcDNA=SeqID_47034; Strand=-; Position=1 -100,152-247,298-465
  Homolog annotation: Hit_ID=XP_420200.1; Match level="QueryCoverage =77%, HitCoverage=56%, E-value=6e-24, Identity=52%"; Hit description =PREDICTED: similar to Integrin beta-1 binding protein 2 (Melusin) [Gallus gallus]
  Essential gene: C elegans homolog=Y110A7A.13; Phenotype=Pvl,Stp
MIPLNLQIAESALKVLQTKTPGGEIEQSATAGAHCTNNTCKKVFTGPESDAEECVFHPGNAVFHEGLKYWSCCGRKTTDFTTFLDQLGCTRGKHCWKK

SEQ ID NO: 120612 - protein, 559 aa, Heterodera glycines
  Coding regions on vcDNA: vcDNA=SeqID_47035; Strand=-; Position=1 -147,245-430,475-545,593-1018,1070-1116,1161-1255,1312-1443,1540 -1700,1745-1826,1885-1970
  Homolog annotation: Hit_ID=CAE64635.1; Match level="QueryCoverage =94%, HitCoverage=86%, E-value=9e-75, Identity=33%"; Hit description =Hypothetical protein CBG09397 [Caenorhabditis briggsae]
  Essential gene: C elegans homolog=C35A11.4; Phenotype=Emb,Lvl
VALLVGLSGAFHFGIQITITNPSQQTFLLFLNSSLHINYGKRMDTKQLEVFVFWSLIVSMLFLGAIFGSLSIRPLADRFGRLRVLFFSNLLCTFGLFCSAFSYFVCQCLLFIFSRFAIGSRFAIGFLLALCLGLAGIFLAECSPKYCRGPKYCRGFVSMSTGALLQLGTVFGSFVAIPRVLGSSNLWWVMFTIEGTQLLATTIILTMVAEESPRFANSHSKKLFLSSVFFCFVIMKHSRDSLAFYHNCSGQILEERMGELRRETLRSVRHRSIVFGWQSKRANRKGTLIGSVVSLIGSVVSLSMGFSGIAVINAFAVELFRTTGVSEINAFAVELFRTTGVSEYWASIDNVGLALLSLISNIASAISNIASALLIDRFGRRRLLLVTLTAILLMNIVISGLMYAYAKTELSWLGLCLIVAISLFTVAFAFGPGPICYFLASELVEQSARSAAQGWANLCQMISRTFLLAIFLPLRASIGVASAYFMISRTFLLAIFLPLRASIGVASAYFLLFVTPILIALLFLFFNLPETPILIALLFLFFNLPETKRRDICEVRHGM

SEQ ID NO: 120613 - protein, 632 aa, Heterodera glycines
  Coding regions on vcDNA: vcDNA=SeqID_47036; Strand=-; Position=1 -160,240-368,904-1007,1054-1155,1197-1313,1360-1536,2073-2194,2244 -2284,2332-2443,2493-2644,2700-2806,2867-3037,3273-3377
  Homolog annotation: Hit_ID=CAE74146.1; Match level="QueryCoverage =99%, HitCoverage=99%, E-value=0.0, Identity=59%"; Hit description =Hypothetical protein CBG21817 [Caenorhabditis briggsae]
  Essential gene: C elegans homolog=T10B5.5a; Phenotype=Emb,Lva,Unc
TMSVPIVLLCEGTQSKQGRDQILSNINACCAVADNIRTTLGPRGLDKLLVDRKGQTTIQTTISNDGATILKKLDIVFPAAVMICDIAKSQDAEVGDGTTSVVILAAELLKSAKPFIEEGVSPQLIIKAFNAASREAISKLRELSVKVTAISKLRELSVKVTGTEESREMLIRCAATTLSSKLLKQERHHFASMVVNAVDYLDVDLPLLLKQERHHFASMVVNAVDYLDVDLPLNMIGVKKVSGGSIKDSRLVKGVAFKDSRLVKGVAFKKAFSYAGFEMQPKHYKEPLIAILNIELELKAERDNAELRIGNVADYQEVVNAEWTILYQKLEKIHESGAKIVLSKLPIGDVATQWFADRDMFCAGRIQEDDLGDMFCAGRIQEDDLGRIMAACRIMAACGGSTLTTVSQIDKIVLGKCAEFYEQQVGSERYNFFIDGSKHKSCYNFFIDGSKHKSCTLLLRGGAEQFIAETERSLHDAIMIVRRAKKNDSIVAGGGAIGGAIEMELAKHLLGLANTREMKDQFFWKAFAKSFEMIPQQLCQNMIPQQLCQNAGLDSISMLGELRAAHQRGEKWAGVDIQRECVADNMEGCVWEPALVKENAIVSATEAACLVLSIDQTIKNPKNKNMPGLPGQ

SEQ ID NO: 120614 - protein, 200 aa, Heterodera glycines
  Coding regions on vcDNA: vcDNA=SeqID_47037; Strand=+; Position=1 -78,128-259,526-626,785-902,1179-1274,1454-1531
  Homolog annotation: Hit_ID=NP_491172.1; Match level="QueryCoverage =87%, HitCoverage=76%, E-value=2e-46, Identity=49%"; Hit description =golgi phosphoprotein 3 (1E78) [Caenorhabditis elegans] gb|AAF60665.1| Hypothetical protein Y47G6A.18 [Cae
  Essential gene: C elegans homolog=Y47G6A.18; Phenotype=Dpy,Unc
MSEGLVQRRRKAAESNNSSNGGQQLDNDDKSAGTYRQTTDSNGAGDEDNDKMQRLTLMEEILLLGLKDRENEKMTGDVILDEALKHIKETPQKETVVSWIEYLRLAKNLVEKGVLTTEKQNFLLFDMTTHPLNDGNAKAKLVKRVQEAVLSKWTNDFQRMDKKMLSLLILAHASDANGGGESSAGSAFDVIYAVFEAFSK

SEQ ID NO: 120615 - protein, 438 aa, Heterodera glycines
  Coding regions on vcDNA: vcDNA=SeqID_47038; Strand=+; Position=1-1317
  Homolog annotation: Hit_ID=NP_508269.1; Match level="QueryCoverage =99%, HitCoverage=66%, E-value=2e-51, Identity=31%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MAFHKIDNDSVNSITNALDFFRIPPTNVSVSSSKVFELLPSNPLTDTPYHFKLHSSQNYIDLSKCYLLSEFRIRKENANGQLVDLAADEVAPIQLIGHTFIRNIKMSINGREVFNANSLMAYKSYFSHELSYSTAAKDSHLNAAGYYRDTGGVLEVGDGCTARRNLFVGSRTAQFMAKIDADLFNQPLYLINFCELDIEILPNDNEFVLITPPGVAAATRYHFEVVGLKMYVKKVSLMDGLALDIARKLELKPARYAVRKTLMKSLFISHGRFEFTSNLFMDQIPRRITMGLVANADYVGTVSRSPFNFQPFNVREISIIANGRSYPQAAYDLDYPNGKYVRPFNDMNEAVGFANSSESNGITLAQFGTTHCIYVFNLTSSGDDQATLFDLIRNGTTAVSIKFNQAVPAGGIMLVVMGECDSLVMLDKNRSISTDITI

SEQ ID NO: 120616 - protein, 96 aa, Heterodera glycines
  Coding regions on vcDNA: vcDNA=SeqID_47039; Strand=-; Position=1 -231,404-577
  Homolog annotation: Hit_ID=NP_502538.1; Match level="QueryCoverage =63%, HitCoverage=11%, E-value=7e-12, Identity=49%"; Hit description =cell death protein, Caspase, ICE-like apoptotic protease., CEll Death abnormality CED-3 (56.6 kD) (ced-3)
  Essential gene: C elegans homolog=C48D1.2; Phenotype=Ste
MFSRNSSPRNSLAASIQIPLHLRNEGECSANLTSKEIFQKDPTNADFLVVHSTTPHYVSWRNSANGAWFVQSLCKVFSEMAPKHCEIFEMLTTVNY

SEQ ID NO: 120617 - protein, 355 aa, Heterodera glycines
  Coding regions on vcDNA: vcDNA=SeqID_47040; Strand=+; Position=1 -47,644-692,739-882,924-1044,1091-1219,1303-1411,1456-1757
  Homolog annotation: Hit_ID=CAE66385.1; Match level="QueryCoverage =92%, HitCoverage=31%, E-value=4e-70, Identity=41%"; Hit description =Hypothetical protein CBG11647 [Caenorhabditis briggsae]
  Essential gene: C elegans homolog=R11E3.6; Phenotype=Let
IHLNASSNPTDSLQQRHEAVVHSRNVLYVCNVCQFECRWNREFYECQFECRWNREFYEHMRRLHFPGPPYSCDSCTYDVDRLTVLLTHRLTHTDEKPFKCSECTFDEKPFKCSECTFRTRNRANLVVHHRLHTGEKPFQCEICGKRFVLKRTLEHHSIARFVLKRTLEHHSIAHSEERPFACDQCNFTTKYQSHLISHRRIHSGELSGELFRCEVPDCDYSSPKKSQLAAHLRTHMGVKSHKCRICHRSFVEKSHCRICHRSFVEKSHLVRHERIHLEEKPFKCQNCEYTSSRRDKLKEHILKYHNQSQSNTRLLKRRYRRARQLQQGSKGKGGGKMDILLNTKYIGKNLIENLR

SEQ ID NO: 120618 - protein, 302 aa, Heterodera glycines
  Coding regions on vcDNA: vcDNA=SeqID_47041; Strand=+; Position=1 -285,561-691,896-998,1044-1328,1574-1678
  Homolog annotation: Hit_ID=CAE71253.1; Match level="QueryCoverage =90%, HitCoverage=42%, E-value=2e-45, Identity=36%"; Hit description =Hypothetical protein CBG18133 [Caenorhabditis briggsae]
  Essential gene: C elegans homolog=C30C11.4; Phenotype=Bmd,Gro
MITLCMPRRKFCLPFSIFAFVRMSFVFSSCVSFGQFARMMGFGAKQQLNVNYGNSVVNFKHILGRTFNDKVVQTFRQHIPCGLMGKFTDDQIEIKVPFFYEENQRRALLNAGRIAGLSLRLITDPAALAYCYGMYNGANLPPPEQPARLVAFVDVGHSSVQASLIAFSAGKAEVLAASFDLTVGGVHFDALLRDYFNEDFGKRFKIDARKTPRAWLRLLDECEKALTMKGTNELELSDQKANVGKQSAHSLCNRMLCERHRRQRSDAKVGDIFDVELVGGSSRIPRIKQIVAGSKFGKSLKG

SEQ ID NO: 120619 - protein, 313 aa, Heterodera glycines
  Coding regions on vcDNA: vcDNA=SeqID_47042; Strand=+; Position=1 -733,2732-2939
  Homolog annotation: Hit_ID=NP_494135.1; Match level="QueryCoverage =23%, HitCoverage=20%, E-value=2e-09, Identity=42%"; Hit description =predicted CDS, POL-like family member (2C233) [Caenorhabditis elegans] gb|AAB71072.1| Hypothetical protei
  Essential gene: C elegans homolog=ZK250.3; Phenotype=Clr,Lvl,Sck
LLLKKFTAFIKRLNELSLCRTLFGFHHLSEGEDIITRLDRLEKLLEGSGNPTLVTIIERLEKLEKLVERLIAGENRYGNRFADPQHTSHTSASTNNNGNVQWGQPPPFAGTGAVSQMITEAIINSEQLKEKSTRAVIKKLPEAMDQQAVVEQIAEQCGVKDKLSPDIHRHPRTRPEGGVKRDRILKVPFLDKFSRDKFLFNFRNAVKKLPNVPQHIKVRRDMTQSELKILYSLRQQAYQANIAAGVPQGSVLGPLLFLIFINDLPSFIANEAASVGIKMYADDVKLYYTHENDDHSNQLDKAIEALEKWSKIN

SEQ ID NO: 120620 - protein, 121 aa, Heterodera glycines
  Coding regions on vcDNA: vcDNA=SeqID_47043; Strand=-; Position=1 -139,196-345,1548-1570
  Homolog annotation: Hit_ID=BAB71316.1; Match level="QueryCoverage =95%, HitCoverage=99%, E-value=1e-33, Identity=59%"; Hit description =unnamed protein product [Homo sapiens]
  Essential gene: C elegans homolog=F25B5.4a; Phenotype=Emb
FQIFVKTLTGKTITLEVEASDPIENVKAKIHDKEGIPPDQQRIIFAGKQLEDARTMADYNIQKEKQLEDARTMADYNIQKESTLQLCLKLFGGARTGKTAHYSRSVSHDITSKKEPVSVLS

SEQ ID NO: 120621 - protein, 194 aa, Heterodera glycines
  Coding regions on vcDNA: vcDNA=SeqID_47044; Strand=-; Position=1 -90,156-365,411-695
  Homolog annotation: Hit_ID=AAR85527.1; Match level="QueryCoverage =100%, HitCoverage=79%, E-value=1e-50, Identity=54%"; Hit description= 14-3-3b protein [Meloidogyne incognita]
  Essential gene: C elegans homolog=M117.2; Phenotype=Emb
MESNRELILYRAKLADQAVRYYDMGQLMKKVVELDNVLNEEERNMLSIAYKAVIRPLRFALREISPIEWTQDGTEKQLQMLKRYREKLVKELHDTCNELVELLDKLISRADDPEVKVFYLKMKADVYRYMAAEAIGGVVDKSRQAYQEAFDIAKDKLRPANATRLGLGLNFCIFYYDNLDMEETAIDFAKKARD

SEQ ID NO: 120622 - protein, 287 aa, Heterodera glycines
  Coding regions on vcDNA: vcDNA=SeqID_47045; Strand=-; Position=1 -159,624-768,816-866,926-1063,1325-1486,1951-2160
  Homolog annotation: Hit_ID=CAE67815.1; Match level="QueryCoverage =98%, HitCoverage=56%, E-value=2e-50, Identity=37%"; Hit description =Hypothetical protein CBG13395 [Caenorhabditis briggsae]
  Essential gene: C elegans homolog=M176.2; Phenotype=Emb,Lva
KLLNDPRAIILFVVVKDLSTWHFSKRYDEYELERLSGGRAKIVHLTTVECFENLKLDDDLTLRLDGRPIGVAYWNLVRLGSDAFGPKSWAALRMIERSTAIKATSLFFELSTSKKIQQLLAKPGMVERFFTDPSEQQMVDAIRATFAKLWGLENKDEETQKIIQDAIAHPERYVLKPNKEGGGGNIWGEEISQKLRKFSRSELAAHILMERINPVTVKNFMVWPFKRAEFAEVINELGIYGYLIGNMNTGEVLEYEQPGNMVRTKNMHNNEGGVSSGNGVLDTPFLY

SEQ ID NO: 120623 - protein, 147 aa, Heterodera glycines
  Coding regions on vcDNA: vcDNA=SeqID_47046; Strand=-; Position=1 -117,527-693,1337-1495
  Homolog annotation: Hit_ID=CAE67815.1; Match level="QueryCoverage =98%, HitCoverage=32%, E-value=2e-18, Identity=32%"; Hit description =Hypothetical protein CBG13395 [Caenorhabditis briggsae]
  Essential gene: C elegans homolog=M176.2; Phenotype=Emb,Lva
MAYKDVIESDTSVRTLLGILEDIKKEGIKQPISIFLQRSIEVNGGSIGSAGCQDRLLSIHQRMLKHTGCSDQMISNALPENRSGAAIAKIIYKAWKLLNDPRAIILFVVVKDLSTWHFSKRYDEYELERLSGGRAKIVHLTTVECFE

SEQ ID NO: 120624 - protein, 412 aa, Heterodera glycines
  misc_feature (7)..(7): Xaa can be any naturally occurring amino acid
  misc_feature (65)..(65): Xaa can be any naturally occurring amino acid
  misc_feature (71)..(71): Xaa can be any naturally occurring amino acid
  misc_feature (358)..(358): Xaa can be any naturally occurring amino acid
  misc_feature (395)..(395): Xaa can be any naturally occurring amino acid
  Coding regions on vcDNA: vcDNA=SeqID_47047; Strand=-; Position=1 -104,271-494,923-1052,1100-1288,1338-1505,1553-1641,1805-1993
  Homolog annotation: Hit_ID=AAH70791.1; Match level="QueryCoverage =95%, HitCoverage=57%, E-value=3e-70, Identity=40%"; Hit description =LOC431830 protein [Xenopus laevis]
  Essential gene: C elegans homolog=Y61A9LA.10; Phenotype=Emb,Lva
KKREDRXERRRRVAERQTNRGKRNEPSDDEEGRQRDKRRRNPRGTADAGGRKVQQALKFSSAPQXFSANHXIVPFSDCQNNPKLAINLYFWPSPASDSPALLRCVDHPFRKNRRNLKKGPVTVVTSKKRRVTFFEVPNDINAMVDAAKIADLALILIDASFGFEALILIDASFGFEMEVFEFINICQVHGMPKVIGVLTHMDNVPKRSQLKSIKKQLKNRFWSELYQGAKLFYLTGMQKQGAKLFYLTGMQKQRYLQHEIKNLGRFISVAKLRPILWRNSHPYVFCDRFEDITDPELIRSDPKVSRSVSLYGYVRGVDPELIRSDPKVSRSVSLYGYVRGVHLKNNSAVHENGKGDSXASEGKSRLGIGAFNPYKGTSRTVSRKMHMYYIPLDGXRRVDFYCEFLILGPIAK

SEQ ID NO: 120625 - protein, 299 aa, Heterodera glycines
  Coding regions on vcDNA: vcDNA=SeqID_47048; Strand=-; Position=1 -131,183-255,503-634,1266-1305,2063-2197,2501-2886
  Homolog annotation: Hit_ID=AAH56086.1; Match level="QueryCoverage =56%, HitCoverage=32%, E-value=3e-29, Identity=37%"; Hit description =MGC69094 protein [Xenopus laevis]
  Essential gene: C elegans homolog=F32E10.1a; Phenotype=Emb,Lva
LFVCGTGDARVEAWDQRCRRRVAMLDCVLNKAIELELDLDSGGGSQIEVSSICFKDALHLAVGLSNGYVLLYDVRSSKPYLSKNHNFGLPITRLQFAPEQELVLSMDGRALKESITEELEAEKPSVYDDFKFVTKSQLEELGLSKLIGTNALRAYMHGFFVDMGTYKKARTATSVGAGALSAICEAERRWRRGGPTLAQIAQGQPRVAARLQAELSINETATMTPHTTDIDGKTGANDEDGTFAGEGGGGDGDEAASSSSKSLAAAEQPSLAAPTTATKDAVSADHGTAIAAAVTKPKK

SEQ ID NO: 120626 - protein, 244 aa, Heterodera glycines
  Coding regions on vcDNA: vcDNA=SeqID_47049; Strand=-; Position=1 -223,273-510,556-829
  Homolog annotation: Hit_ID=CAB88203.1; Match level="QueryCoverage =87%, HitCoverage=69%, E-value=9e-90, Identity=69%"; Hit description =putative cuticular collagen [Globodera pallida]
  Essential gene: C elegans homolog=C15A11.6; Phenotype=Emb
MDVQVVVAPPSKARANPFSSIFRAKRQLPGHCHCGPPQRPNCPPGPPGPSGPPGQPGQPGGAGLPGQPGAPGQPAPPCPPQNIPCPLCPAGPPGSPGAQGLPGQQGAPGQPGAPAPGGGQGPPGASGPQGQPGQPGRSGTPGQPGQPGNNAVIYNTIPGPRGAPGAPGQPGSPGSQGQPGQAGGEGPPGPSWCAWDCPACLATLVSLGSPGHPANRAKTAATARARLALPRWHSKRKWAAVKKA

SEQ ID NO: 120627 - protein, 332 aa, Heterodera glycines
  Coding regions on vcDNA: vcDNA=SeqID_47050; Strand=-; Position=1 -3,190-378,464-610,916-1068,1288-1530,1928-2188
  Homolog annotation: Hit_ID=CAE68383.1; Match level="QueryCoverage =99%, HitCoverage=83%, E-value=1e-137, Identity=30%"; Hit description= Hypothetical protein CBG14139 [Caenorhabditis briggsae]
  Essential gene: C elegans homolog=K10B3.10; Phenotype=Lva
MAFLQNDDLGDSLDAVESLLKKHEDFEKSLAAQEEKIHALDEFATKLIEGGHYAAEDVAKRREKLLARRRHLMDRMAQRRERLKESYRLHSFDRDCDEMLGWIQEKLKTAKDQSYLDPTNIRGKLQKHGNFEQELRANRNRLDEIKATGQELIQSGHYANEHIQTRLNEVEQLWTELADASGLKGAKLQEANQEQLYNRNIEDVELWLSELEGQLASEDFGKDLISVQNLQKKLGLVESDYNAHQERIDAIGHQTREFHDTGHFNAPLIGKKFEALRARFEALREPLQRRKQKLAESLLGHQLFRDIDDELAWIREKEQIAASTNRGRDLVG

SEQ ID NO: 120628 - protein, 499 aa, Heterodera glycines
  Coding regions on vcDNA: vcDNA=SeqID_47051; Strand=-; Position=1 -90,134-272,362-497,541-656,699-820,869-943,988-1066,1112-1210,1381 -1464,1506-1617,1662-1710
  Homolog annotation: Hit_ID=CAE62916.1; Match level="QueryCoverage =87%, HitCoverage=60%, E-value=2e-96, Identity=47%"; Hit description =Hypothetical protein CBG07110 [Caenorhabditis briggsae]
  Essential gene: C elegans homolog=F56D12.1a; Phenotype=Gro,Slu,Stp,Unc
RSFPPCLLRRSASSFTWAFNPSMFTNIDYLSPTNEPVLEYRKGSAESDALEKELLSPTNEPVLEYRKGSAESDALEKELQKLWAEPMEVPLAIGGEKTFRKDFFICFQPFFFICFQPFDHNRPIALFNHATTEDIQNAISIGLAARHQWERLPLIKRADIFLHKRADIFLHAADLVAGKYRMLINAATMLGQAKNIQQAEIDAACELADFLRFNAYFAACELADFLRFNAYFALQNSKYQPISGKGYENSMLLRGLEGFVAAIAPFNFTAIGGNLAGFVAAIAPFNFTAIGGNLASAPALMGNVVMWKPSDTAVASNYVAYGNVVMWKPSDTAVASNYVAYKVFEEAGLSSGVISFLPSDGPTFGNLSSGVISFLPSDGPTFGNAVTNSKDLAGINFTGSVPTFQHLWKQISENLTTYATFPRLIGECGGKNFCGGKNFHFVHPSADVPSVVACTHRAAFEYQGQKCSACSRMVVPESLWSIQKSRMVVPESLWSIQKG

SEQ ID NO: 120629 - protein, 208 aa, Heterodera glycines
  Coding regions on vcDNA: vcDNA=SeqID_47052; Strand=-; Position=1 -144,208-603,750-833
  Homolog annotation: Hit_ID=NP_493580.1; Match level="QueryCoverage =82%, HitCoverage=37%, E-value=4e-11, Identity=28%"; Hit description =putative mitochondrial protein, with 3 coiled coil domains, of bilaterial origin (48.2 kD) (1P387) [Caeno
  Essential gene: C elegans homolog=K11B4.1; Phenotype=Emb,Lva
MFDFPLLTFLATRALLEWTQGERKLDEQIHPKMAPSLEDETNFNEENVRLFRYPFLKNPFWDGHFDENDSDRMAGKALEWLSYHLKLAKNDETNYDETLIRVIRLLGLSIQRKWTEAKSLAEEMFITVAPSDNARQMIYSSMEQMQQFLNFDEQIEAAEKQTEREKDDQNSEESEKMALKKEEERMMEVQRKHFWEWAERRKRLIHSQ

SEQ ID NO: 120630 - protein, 259 aa, Heterodera glycines
  Coding regions on vcDNA: vcDNA=SeqID_47053; Strand=-; Position=1 -104,146-277,318-381,525-723,768-801,919-1095,1281-1352
  Homolog annotation: Hit_ID=NP_491989.1; Match level="QueryCoverage =96%, HitCoverage=60%, E-value=1e-84, Identity=64%"; Hit description =isocitrate dehydrogenase (1H553) [Caenorhabditis elegans] gb|AAK85453.1| Hypothetical protein C30F12.7 [C
  Essential gene: C elegans homolog=F35G12.2; Phenotype=Stp
KHHDLDLVLIRENTEGEYSGLEHESVKGIVESIKIVTRRNIEKIARFAFDYAVLNNRPQITAIHKANIQKLGDGLFLQVCKEVAETEYKNAGLQFNSMIVDNACMQLVSFPQQFNNGILLMPNLYGNIVNKDTALPGGTYNIIVVFLKISNIACGLVGGPGLVSGMNIGEEYAVFETGTRNTGTSLAGKDIANPTAFIRASIDMLRYLELHDYADKLSDALYKALTEQRTHTPDIGGTNHSTEVVQAVINNYSETISNA

SEQ ID NO: 120631 - protein, 382 aa, Heterodera glycines
  misc_feature (297)..(297): Xaa can be any naturally occurring amino acid
  misc_feature (304)..(304): Xaa can be any naturally occurring amino acid
  misc_feature (309)..(309): Xaa can be any naturally occurring amino acid
  misc_feature (371)..(371): Xaa can be any naturally occurring amino acid
  Coding regions on vcDNA: vcDNA=SeqID_47054; Strand=-; Position=1 -125,261-379,434-509,558-644,714-774,822-1072,1401-1671
  Homolog annotation: Hit_ID=NP_500462.1; Match level="QueryCoverage =92%, HitCoverage=61%, E-value=8e-47, Identity=36%"; Hit description =helix Loop Helix containing protein (54.3 kD) (4E780) [Caenorhabditis elegans] gb|AAB37997.1| Hypothetica
  Essential gene: C elegans homolog=W02C12.3a; Phenotype=Unclassified
SLLPAVSKRLTRLPTGATGFGLYSPNESDFRQIISSSAPTSGNVVNSQNAQLTNGGGNGQHGLTEAEIYKDRRKKDIHNMIERRRRYNINERRRRYNINDRIKELGLMLPKSTSEEMKLNKGTEMKLNKGTILKASCDYIRQLQKDREIMIRQQQQTARLEDLTRQYFQQQQTARLEDLTRQYFQRVQELEHQLEKNGINVPPSNLPVLQRVQELEHQLEKNGINVPPSNLPVLGSLSPLSVNESIKKEPPEDSVNSNCAQQSVSFSPSSTPQATKIATSLQDMQIASPIGTAKPSXAKCSTRXITQSXAWRSFPSRSFKHNHGNLMTANSVQNRGPLQGQDPLIPHNNQLSPIIQWDQSGFSPGNDTNPXKKNVVQNIELL

SEQ ID NO: 120632 - protein, 125 aa, Heterodera glycines
  Coding regions on vcDNA: vcDNA=SeqID_47055; Strand=-; Position=1 -96,161-442
  Homolog annotation: Hit_ID=P53021; Match level="QueryCoverage=100%, HitCoverage=100%, E-value=7e-57, Identity=82%"; Hit description =Major sperm protein 1 gb|AAA29146.1| major sperm protein
  Essential gene: C elegans homolog=C04G2.4; Phenotype=Unclassified
MAQLPPEDVATMPTQKVVFNAPFDHKVTCHMRVINPGTKRIGYAFKTTKPKRINVNPPTGVLGPKESVNVAVSCDAFDPGSEDTKNDRVTVQWTNAPDPAAAFKLEWFQGDRKVRRKALPIKYNV

SEQ ID NO: 120633 - protein, 126 aa, Heterodera glycines; identical to SEQ ID NO: 119174
  Coding regions on vcDNA: vcDNA=SeqID_47056; Strand=-; Position=1 -96,151-435
  Homolog annotation: Hit_ID=P53021; Match level="QueryCoverage=100%, HitCoverage=100%, E-value=1e-66, Identity=92%"; Hit description =Major sperm protein 1 gb|AAA29146.1| major sperm protein
  Essential gene: C elegans homolog=C04G2.4; Phenotype=Unclassified

SEQ ID NO: 120634 - protein, 56 aa, Heterodera glycines
  Coding regions on vcDNA: vcDNA=SeqID_47057; Strand=-; Position=1-170
  Homolog annotation: Hit_ID=P53023; Match level="QueryCoverage=100%, HitCoverage=44%, E-value=3e-23, Identity=87%"; Hit description=Major sperm protein 3 gb|AAA29148.1| major sperm protein
  Essential gene: C elegans homolog=ZK546.6; Phenotype=Emb
AVSCDAFDPGSDSSKGDRVTVEWTNTSDPAATAFKLEWFQGDGMVRRKNLPIEYNV

SEQ ID NO: 120635 - protein, 457 aa, Heterodera glycines
  Coding regions on vcDNA: vcDNA=SeqID_47058; Strand=+; Position=1 -51,125-411,489-594,647-919,1009-1147,1208-1312,1397-1725,1924-2007
  Homolog annotation: Hit_ID=NP_491588.1; Match level="QueryCoverage =89%, HitCoverage=84%, E-value=2e-51, Identity=47%"; Hit description =trans-prenyltransferase (43.0 kD) (1F982) [Caenorhabditis elegans] gb|AAB37678.2| Coenzyme q (ubiquinone)
  Essential gene: C elegans homolog=C24A11.9; Phenotype=Age,Unclassified
MGVELPPTITERLSTLKKDVIDALLDKNAVPPELITSLMAGVGGSAFSKALELVPSYNQNLQKMAKYYFTAKGGKLIRPTVSLLMSAACNQCAKRPTTPADTAPGRQAKSQRVTPTSIVNESEEQPIEISMNQYRIAMVAEMIHNATLVHDDVIDESNTRRGQPTANARWGNKQVENEQTTQYQGTGNGQTTQYQGTGNGQTTQYQGTGNGQTTQYQGTGNGQTTQYQGTGNGQTIQHLAVLVGDFILARATKVLCSIGEPPVIETMAEIVEDLVKGELLQLNGPSTSTGNARFNHYMVKTFYKTGSLFANSCRSVAMLSENCNGLLLELTTEFGRNLGLAFQLVDDILDYCATEEAMGKPTATDLRLGLATCPVLFAAEEFPDALNPMIERRFSADGDVQRALELVQRSDGLTQSRRLAKEQGEKAIQCAEQLLPEGGLVRDCLVDIVQRQLSRER

SEQ ID NO: 120636 - protein, 335 aa, Heterodera glycines
  misc_feature (21)..(21): Xaa can be any naturally occurring amino acid
  Coding regions on vcDNA: vcDNA=SeqID_47059; Strand=+; Position=1 -61,118-235,278-314,532-714,771-851,908-951,1000-1081,1157-1319,1396 -1446,2609-2631
  Homolog annotation: Hit_ID=NP_497696.2; Match level="QueryCoverage =99%, HitCoverage=63%, E-value=4e-89, Identity=54%"; Hit description =pim (mammalian oncogene) Related Kinase (prk-2) [Caenorhabditis elegans] emb|CAA84323.2| Hypothetical pro
  Essential gene: C elegans homolog=F45H7.4; Phenotype=Unclassified
VKKFASQHLLQLKHLLGGKSXRGFLKFKRRGFLKFKRLYRLKGALGHGGFGIVYRAVRISDQLPVAVKFIERRNVREWGKFIERRNVREWGKIDDHKVPMEIALLARCSNVSGVIALIDWFSLPEGFLIVMERPIPCMDLFDFIHHQKMLDENLARFLFLPIVKLARFLFLPIVKAVIELTERKVLHRDLKDENILDENILINLANGQIKLIDFGAATVFTRNRCIDFGAATVFTRNRCHDFQGTRLYCPPEWFWFLHSLYLGREATVWSLGVLLFNMLNGRLPFLNEKDICTAHLLGPLPFFTTLSKAARARDLLAQCLSFESVPSCSLNTISS

SEQ ID NO: 120637 - protein, 142 aa, Heterodera glycines
  Coding regions on vcDNA: vcDNA=SeqID_47060; Strand=+; Position=1 -204,314-538
  Homolog annotation: Hit_ID=NP_491114.1; Match level="QueryCoverage =95%, HitCoverage=63%, E-value=1e-27, Identity=42%"; Hit description =mitochondrial ribosomal protein L17 (1D731) [Caenorhabditis elegans] gb|AAF60758.1| Hypothetical protein
  Essential gene: C elegans homolog=Y54E10A.7; Phenotype=Gro
MSTHRLLPSLPRLKVPIGHRPQRLKLPYIPNPRGHLELVRKLVNRVIREERCELKYNRAEECRQYVERWWFIEQDLVDKMWSILVPRFSHYPIDQSYTEIYRLPTIRLKSKVNKETEFWNRYSIAVLELKGRETPSSSEFPS

SEQ ID NO: 120638 - protein, 241 aa, Heterodera glycines
  Coding regions on vcDNA: vcDNA=SeqID_47061; Strand=+; Position=1 -198,333-503,623-763,804-1016
  Essential gene: C elegans homolog=C06A8.2; Phenotype=Emb,Lva
MKSFVKDRFFVFNLDLGLYFFSYLIYIPKFPGQKQGKPSCRKIACTRKNQGLDPGPGQSLVFIGLGFMDSLIVTSLVFDIDSFARKFSAEQSDFTLSRFSEIFMEMELSSIFLGRFSFSDLVEFSENLFIYCSRFMFTPFSSTGSVGNGDQIHFNSDGMSSGRIADRNYKQRLFGLFLCYSFYFLQPSQYVVPISVTSSQLDDFYEFTSSVLLPEENFEALYCFYRLLNANAFSIAPVLGN

SEQ ID NO: 120639 - protein, 176 aa, Heterodera glycines
  Coding regions on vcDNA: vcDNA=SeqID_47062; Strand=+; Position=1 -119,401-547,865-960,1692-1860
  Homolog annotation: Hit_ID=NP_505548.1; Match level="QueryCoverage =93%, HitCoverage=24%, E-value=1e-14, Identity=26%"; Hit description =leucine-rich repeat-containing G protein-coupled receptor (104.0 kD) (5K373) [Caenorhabditis elegans] emb
  Essential gene: C elegans homolog=C50H2.1; Phenotype=Emb
GGSVWTKDWRSGKCCCVGQGIRQIPLDMAGPGRAKAVSTIYFFDVSLGRLTPASFAAFPNLEEIFLDRASLLAHVDSRAFSGLKKLRKIAVLNSGALRELPLLEMGPQHSLPMERIDFSGGHLSANPSLDYIAETAFAGLAHIEHLDMSQTDITALPFIGLRSLKQLTLKVFNLVS

SEQ ID NO: 120640 - protein, 134 aa, Heterodera glycines
  Coding regions on vcDNA: vcDNA=SeqID_47063; Strand=-; Position=1 -169,227-352,409-518
  Homolog annotation: Hit_ID=NP_492537.1; Match level="QueryCoverage =85%, HitCoverage=35%, E-value=3e-09, Identity=33%"; Hit description =putative protein family member (1K150) [Caenorhabditis elegans] emb|CAB02815.1| Hypothetical protein C36F
  Essential gene: C elegans homolog=F27C1.3; Phenotype=Lva
MFKSNASSSVPSARDPNYATLGQLDPNIFVKNNAPTKATSNQQKQQTKEGQMIFVSTRNPNYPTLAKLDPDIFVKNNAPTKTAPIKQQAKGGGRGYATTTDPDYATLGQVDSKIFDKNNEKDEKTGTDDDSESS

SEQ ID NO: 120641 - protein, 60 aa, Heterodera glycines
  Coding regions on vcDNA: vcDNA=SeqID_47064; Strand=+; Position=1 -84,129-227
  Homolog annotation: Hit_ID=NP_569852.1; Match level="QueryCoverage =83%, HitCoverage=46%, E-value=4e-14, Identity=70%"; Hit description =CG16982-PA [Drosophila melanogaster] gb|AAF45536.1| CG16982-PA [Drosophila melanogaster] gb|AAM51125.1| S
  Essential gene: C elegans homolog=ZK287.5; Phenotype=Emb,Lva
MSDAKMEIEESATSTSVASLSAIKKRFEVKKWNAVALWAWDIVVDTCAICRNHIMVFKFC

SEQ ID NO: 120642 - protein, 489 aa, Heterodera glycines
  misc_feature (20)..(20): Xaa can be any naturally occurring amino acid
  Coding regions on vcDNA: vcDNA=SeqID_47065; Strand=-; Position=1 -84,1316-1399,1452-1670,1726-1982,2235-2306,2357-2427,2500-2616,2672 -2899,3060-3256
  Homolog annotation: Hit_ID=CAE59948.1; Match level="QueryCoverage =99%, HitCoverage=90%, E-value=1e-158, Identity=61%"; Hit description= Hypothetical protein CBG03435 [Caenorhabditis briggsae]
  Essential gene: C elegans homolog=C47E12.1; Phenotype=Emb,Lva,Ste,Unc
PRSKKKFKIFFSKQSFNSLXKLSGNKFFKKESAGDSDAIPEGQIKSLAELKMDDIKEMKISQIKTVKGMVDEEMKISQIKTVKGMVDEEVRRTKLRMETLEGDRNEHLAKIGNLLHNSVPISDNEDENRVERTFGDCASRKSYSHVDLVVDLVVMCDGFDGERGTNVAGGRGYFLKGPLVFLEQALIALALQMLNKKGFTPLYTPFFMRKDVMQEVAQLSQFDEELYKVTKGSKSNEDGSPDEKYLIATSEQPIAAFHRDEWLNPSDLPIKYDEWLNPSDLPIKYAGMSTCFRQEVGSHGRVGSHGRDTRGIFRVHQFEKIEQFVICSPFDNESWKHMDEMIGNAEEFMIGNAEEFCKVLGLPYRIVAIVSAELNNAAAKKLDLEAWFPGSGAFRELVSCSNCTDYQSRRLRIRYGQTKKMDGEVNYVHMLNATMCATTRVICAILENNQTEDGIVVPEPLRPFMPSQYSQRIPFVKPAPIAGKSAEKE

SEQ ID NO: 120643 - protein, 65 aa, Heterodera glycines
  Coding regions on vcDNA: vcDNA=SeqID_47066; Strand=+; Position=1 -43,84-205,256-288
  Homolog annotation: Hit_ID=AAH78605.1; Match level="QueryCoverage =96%, HitCoverage=91%, E-value=5e-24, Identity=84%"; Hit description =MGC85550 protein [Xenopus laevis]
  Essential gene: C elegans homolog=Y41D4B.5; Phenotype=Gro,Sck,Ste
MDKPIKLAKVTRILGRTGSQGQCTPVRVEFLDDTNRSIIRNVKGPVREGDILTLLEAEREARRPR

SEQ ID NO: 120644 - protein, 48 aa, Heterodera glycines
  Coding regions on vcDNA: vcDNA=SeqID_47067; Strand=+; Position=1 -97,585-610,655-800
  Homolog annotation: Hit_ID=XP_216991.1; Match level="QueryCoverage =100%, HitCoverage=44%, E-value=4e-23, Identity=89%"; Hit description= similar to ring-box 1; ring-box protein 1 [Rattus norvegicus] gb|AAH51473.1| Ring-box 1 [Mus musculus] g
  Essential gene: C elegans homolog=ZK287.5; Phenotype=Emb,Lva
ASSTNEECTVAWGVCNHAFHFHCISRWLRTRQVCPLDNRDWEFQRYGH

SEQ ID NO: 120645 - protein, 224 aa, Heterodera glycines
  Coding regions on vcDNA: vcDNA=SeqID_47068; Strand=+; Position=1 -45,109-239,433-538,765-884,955-1031,1095-1164,1223-1348
  Homolog annotation: Hit_ID=NP_507514.1; Match level="QueryCoverage =83%, HitCoverage=62%, E-value=1e-28, Identity=36%"; Hit description =ubiquitin specific protease 8 (5S413) [Caenorhabditis elegans] emb|CAC14405.1| Hypothetical protein Y59A8
  Essential gene: C elegans homolog=Y59A8B.2; Phenotype=Gro,Sma
MSAQKIASDSEWKKTPIGQTGLFNMGNTCFMNATLQPLFHTPGFSQLFQEKSAQRFVNGNNSFGTNGVISGSFSALNDLIWSGKFNALRPTAFLVNKRQSFEQNYDDTDLGASASDFNERAKLFSSSPVNDLFNLTNIYRVQCSTCNTTSARFEVVNQLSLEMLTNIDGLTLKDCLEAHFSSASLEDKWEGLSEVQKQTAGDTEHKNLGDSEGADRPFEEIFAD

SEQ ID NO: 120646 - protein, 196 aa, Heterodera glycines
  Coding regions on vcDNA: vcDNA=SeqID_47069; Strand=+; Position=1 -155,405-618,716-842,1024-1118
  Homolog annotation: Hit_ID=NP_496573.1; Match level="QueryCoverage =86%, HitCoverage=38%, E-value=3e-39, Identity=49%"; Hit description =related to bicoid interacting protein (2M394) [Caenorhabditis elegans] emb|CAA19465.1| Hypothetical prote
  Essential gene: C elegans homolog=Y17G7B.18a; Phenotype=Gro,Stp,Unc
MESENGKEEGPSSTTTKPAVLPYGQFPKNVWFLRENYVLDCDEFLEMVGPYCVCFFLIFSAPKVREEYDVILALSITKWVHLNWGDDGLKRFLRRTFLNLRPGGRLLLEAQPFPSYYKKAKMTSDMFETYKAIQFKPYQFKDFLLSDTVGFSECEELGTPTAISKGFERPILVFKKASSSTTPTTTKRKRERCLRP

SEQ ID NO: 120647 - protein, 128 aa, Heterodera glycines
  Coding regions on vcDNA: vcDNA=SeqID_47070; Strand=+; Position=1 -319,571-638
  Homolog annotation: Hit_ID=NP_509377.1; Match level="QueryCoverage =78%, HitCoverage=19%, E-value=2e-16, Identity=37%"; Hit description =predicted CDS, reverse transcriptase like family member (XI784) [Caenorhabditis elegans] gb|AAB37984.1| H
  Essential gene: C elegans homolog=ZK250.3; Phenotype=Clr,Lvl,Sck
MKKEYFINSQRISESDNVRDLGIIIDSKLNFSEHIRKIVRNAYLRIFQILRVLKSREIKTLTAAYKTFVRPQLKYATEVWNPNLKKDIDKIERVQKFFTRKAFRKFVVAVQINKAKEFRDLLKAMSSE

SEQ ID NO: 120648 - protein, 234 aa, Heterodera glycines
  Coding regions on vcDNA: vcDNA=SeqID_47071; Strand=-; Position=1 -101,266-339,747-813,864-935,1527-1664,1959-2022,2326-2511
  Homolog annotation: Hit_ID=XP_310728.1; Match level="QueryCoverage =86%, HitCoverage=38%, E-value=7e-54, Identity=47%"; Hit description =ENSANGP00000010003 [Anopheles gambiae]
  Essential gene: C elegans homolog=Y71H10B.1a; Phenotype=Lva
MNSSAAINANPSMSVPFHLQKQISIINKREPEKRIFVNRTVRLEKIQLFGFDMDYTLAEYKSPIMEAETFKFCIDYLIRIGYPREIAEFEYDPMFSIRGLWFDIKKEVEDCYPNKFVQLSERQIYVLNTLFNLPDAYLITRLVDFFDKFEQTPDRTGVRYSDVTMSYNAIYQDIRAAMDHVHGGISVGQLKKKILTRIGDFVEKDERIGVLLAQLRATGRKTFLLTNSDYEYTK

SEQ ID NO: 120649 - protein, 389 aa, Heterodera glycines
  Coding regions on vcDNA: vcDNA=SeqID_47072; Strand=+; Position=1 -206,552-779,985-1252,1526-1672,1824-2143
  Homolog annotation: Hit_ID=CAE58521.1; Match level="QueryCoverage =100%, HitCoverage=21%, E-value=3e-84, Identity=36%"; Hit description= Hypothetical protein CBG01673 [Caenorhabditis briggsae]
  Essential gene: C elegans homolog=F55F10.1; Phenotype=Lva
MNSANDVGKRLLPLGIRSAFTEFFVAETSAADQLRLIIRGQISTMGEQLVESVLQFYTDVRAQFPGKFNLRTLSRALAVANDQLQQRHYGTARHCLCRACSVAFVSQLDIEQRNRMQLVVTKWLGAVPSTARNGKLSEDDARKFVLIEGHKIPRGPLPVLTNDDNEQQQKQQYIFTQSVRANMALLASVVATGHFPVLMEGETSAGKTSMVMQLAKMSGNQCFRINNHEHTDVQEYIGSYAPDASGRLEFVEGVLLRAVRNGDWIILDELNLAPSAVLEALNRLLDDNRELFVSELNITVRAHPRFRLFATQNPVGTYAGRKRLSRAFLSRFMCLQWDALPHAELPNIVQRRCGVSPRMAELMAAVLAELKVRRAIGGIFASSDGLMTL

SEQ ID NO: 120650 - protein, 156 aa, Heterodera glycines
  Coding regions on vcDNA: vcDNA=SeqID_47073; Strand=+; Position=1 -138,231-563
  Homolog annotation: Hit_ID=CAG81043.1; Match level="QueryCoverage =60%, HitCoverage=63%, E-value=9e-23, Identity=52%"; Hit description =unnamed protein product [Yarrowia lipolytica CLIB99] ref|XP _502855.1| hypothetical protein [Yarrowia lipol
  Essential gene: C elegans homolog=M7.1; Phenotype=Emb
MTLFFNLKKSFLAASHESNQNPIKSNKNANFFGVYATAKKRNFSEIELKDMEKNPLPEGCTARPLDQRTMTPWTVTIRGRAGTPYENGNFQLSMAFPRDYPFKAPQVTFTTRIFHPNIDTRGKVCLDILQTYWAPTLTIEKGGVDLVVDLIMFYMD

SEQ ID NO: 120651 - protein, 438 aa, Heterodera glycines
  Coding regions on vcDNA: vcDNA=SeqID_47074; Strand=+; Position=1-1317
  Homolog annotation: Hit_ID=NP_508269.1; Match level="QueryCoverage =99%, HitCoverage=66%, E-value=7e-48, Identity=27%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MVFKKIDKESVNSITSALSIFTLPPTNVSVSSSSVREYLPLNPLTDIPFHFKILPTASFFDLNKCYILTEMSIKKLDFDTNKYVNLKVNEQAATINMIGATWIKNLKITVQGREIYDSNSLYAYKAYLDAELSYSKNVKESDLQASGYYVDSENQDGTDITQQGFELRRKLFSQSQTAQFITKLDADIFNQDRYMVNGVEIDIQLTPNDNEFMVMAAADDKYRIEITACKLYVKTLEVVDGFALDIQKKLENKEAKYAHRLTMIKSIFISENRTEYNGTLFTGQLPKRVILGMVENAAYVGNQKKSPFNFKPFDIRSVTLIANGKQWPAAPFELNFSKNLYTRAFHEMNEALGMASSTDSNGISLEKYRKGWTIFAFNMTNSMEDNEGIDLITEGTTTVCIQFRSPVPSGGITLIAMSEMDSILILDKNRTVMTDTTI

SEQ ID NO: 120652 - protein, 211 aa, Heterodera glycines
  Coding regions on vcDNA: vcDNA=SeqID_47075; Strand=+; Position=1 -140,189-300,354-562,640-814
  Homolog annotation: Hit_ID=CAE66268.1; Match level="QueryCoverage =86%, HitCoverage=23%, E-value=3e-47, Identity=53%"; Hit description =Hypothetical protein CBG11512 [Caenorhabditis briggsae]
  Essential gene: C elegans homolog=H37A05.1; Phenotype=Emb
MVYLSSRAIGQSHYTKTYLQNFAQGSRTLPDGPVLLSPSSVLMAFRKEVIERKPEEFKIACLTDLKSLFPVGQPFFAGFGNRETDVKSYLAVQIPPERIMIIDPQGSLRRADNKAGGYVSDYPTLAMDSVDYVFPPRVDMDGIDIRTKEDGILSEFVAWRTDAEQFDALVDAELEQYEERSKRAKAIVAGTTDGRGADGKKKMYRNGRRAK

SEQ ID NO: 120653 - protein, 171 aa, Heterodera glycines
  Coding regions on vcDNA: vcDNA=SeqID_47076; Strand=+; Position=1 -50,317-473,595-810,960-1052
  Homolog annotation: Hit_ID=CAE68600.1; Match level="QueryCoverage =95%, HitCoverage=57%, E-value=6e-27, Identity=38%"; Hit description =Hypothetical protein CBG14472 [Caenorhabditis briggsae]
  Essential gene: C elegans homolog=F02E8.1; Phenotype=Lva
MFGWINIYLFFHTAFSFSSNKIIHKISLIICSNSLDKFEKYVYKVTRERFGKMKAYIDNELKEAIEFRKTSKEQADSLKAVHENFPTIFQENLALQLEATYRKNVDYAWQEMKRRLDYLQEVQAIKDRFSKEMMVKLITDGVRKQIEMNEGGIRDKYLDQCIEQLRVLSAK

SEQ ID NO: 120654 - protein, 592 aa, Heterodera glycines
  Coding regions on vcDNA: vcDNA=SeqID_47077; Strand=+; Position=1 -134,186-507,719-949,989-1176,1222-1267,1812-2081,2308-2477,2525 -2581,2699-3059
  Homolog annotation: Hit_ID=CAE71417.1; Match level="QueryCoverage =99%, HitCoverage=99%, E-value=1e-109, Identity=57%"; Hit description= Hypothetical protein CBG18327 [Caenorhabditis briggsae]
  Essential gene: C elegans homolog=Y39A1A.22; Phenotype=Bmd,Gro
MKFGEQLASHLTPEWRKQYIRYEELKSMLYDLMLEAPTEADARDQYVTQMDETFFAECEKELTKISLFFSQKIAEAQGKYHELSAELNLFKESVDHRQTPLTQRKSVRVRFNSATKLAPSSKLQKEQAKTAQQLKLAFSEFYLNLVLLQNYQQLNATGFRKILKKHDKLMLNDRGMAWRINRVEKSTFFLNADIESLINNVETTVINELEGGNRQAGMKRLKVPPLSEKQSAGTTFSLGMFMGIFIVLAIAIVLSLVGLQPKDNNQPKWVAVRLFRGFFLFFLSIFLCGLNMYGWAAAGVNHVLIFEYFICFYATEVDYSGAQLHVRTLNVTEGSIPWGFVDVNTGQDMCMSSVGIRSVVSVLPALVRFLQCLRRYRDSRAWHPHLVNAGKYATTFLWDIFMDWGLIDPTAPKEAPFLREEMIYGSKWYYYFAILEDFVLRLSWVMNVSLAEAWTLQGDFLVCIMAPLEVIRRFIWNYFRLENEHVNNCNALSMLPKTFQFDHLQSPKGGQFRAVRDISVKPIRKGDLESLLAKMDQQDGVTHRGQDLRDRVKKQKKAARDKKQILKKNRITRISLPAIHPQPSNTLLETMH

SEQ ID NO: 120655 - protein, 265 aa, Heterodera glycines
  misc_feature (264)..(264): Xaa can be any naturally occurring amino acid
  Coding regions on vcDNA: vcDNA=SeqID_47078; Strand=+; Position=1 -154,210-304,355-448,496-634,701-815,2130-2175
  Homolog annotation: Hit_ID=CAE69498.1; Match level="QueryCoverage =95%, HitCoverage=60%, E-value=1e-49, Identity=37%"; Hit description =Hypothetical protein CBG15706 [Caenorhabditis briggsae]
  Essential gene: C elegans homolog=W07B3.2a; Phenotype=Emb
RSHNLRRRMKQQNLKKAPKKSSLADDETQRRMKEQNAKKAESARQRYHRMSTEEKKLSTEEKKLYNQRRTEAFRRRRMEEEALLAMPIGRINGEALDRAQQIVIRNARINGEALDRAQQIVIRNAKRAEAARLRYQRMTPEQRRAYNQKRTPEQRRAYNQKRYMPKRKRDMDMMMSMDSPLGIDKTDKMEREDEFDALSSLERDVQRRTQQAQALSSLERDVQRRTQQAQQTLRQRQWVVQQQTPSATTGHSNWIISGDKLRMXT

SEQ ID NO: 120656 - protein, 290 aa, Heterodera glycines
  Coding regions on vcDNA: vcDNA=SeqID_47079; Strand=-; Position=1 -206,465-609,717-1049,1332-1517
  Homolog annotation: Hit_ID=CAE59749.1; Match level="QueryCoverage =51%, HitCoverage=14%, E-value=2e-22, Identity=38%"; Hit description =Hypothetical protein CBG03194 [Caenorhabditis briggsae]
  Essential gene: C elegans homolog=F46C5.6; Phenotype=Unclassified
MREFATSRARQTIVDFFVHDIGHHSSCYRRRLLLDIVPLLLQYFSREFFIDKFLPAVLKLSADPISNIRLQLCRTLPKIKQYLMFPNNDESLSNLERVVRELLASEQNALSRQLIQQFACELSRTEMDKKECRANRAKLAEEKRLWTEHEESTDETDEAEAGQQYSTEHTVTGSDAIGSPESGIFFEEDCWLGTVVGNGARPNNHQQMGGRLCRSATTTSISQHMETEHLIFAKLDRILVSCNNLMKGSTGSWRAHEAYLNGIAVLRNLVSTKDLLSNFVPLLKQEVLTA

SEQ ID NO: 120657 - protein, 374 aa, Heterodera glycines
  Coding regions on vcDNA: vcDNA=SeqID_47080; Strand=-; Position=1 -836,886-1176
  Homolog annotation: Hit_ID=NP_498735.1; Match level="QueryCoverage =68%, HitCoverage=61%, E-value=9e-30, Identity=30%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
YYRDTGGVLEVGDGCTARRNLFVGSRTAQFIAKIDADLFNQPLYLINFCELDIEILPNDNDFVLITPPGVAAATRYHFEVVGLKMYVKKVSLMDGLALDIARKLELKPARYAVRKTLMKSLFISHGRFEFTSNLFMDQIPRRITMGLVANADYVGTVSRSPFNFQPFNVREISIIANGRSYPQAAYDLDYPNGKYVRPFNDMNEAVGFANSSESNGITLAQFGTTHCIYVFNLTSSGDDQAALFDLIRNGTTAVSIKFNQAVPAGGIMLVVMGECDSLALLFSFFAIINMYSKKVGVILFLLRISLPVVSCREEIPEYSEYIRRKAMLTSTTTKTIPSTTSTSTTTTSSPPKSDKLIEEQVSAGLTPLIQLCKD

SEQ ID NO: 120658 - protein, 120 aa, Heterodera glycines
  Coding regions on vcDNA: vcDNA=SeqID_47081; Strand=-; Position=1 -102,160-289,668-751,803-849
  Homolog annotation: Hit_ID=NP_503036.1; Match level="QueryCoverage =88%, HitCoverage=37%, E-value=2e-43, Identity=75%"; Hit description =auxiliary factor (30.9 kD) (4S62) [Caenorhabditis elegans] emb|CAB55137.1| Hypothetical protein Y116A8C.3
  Essential gene: C elegans homolog=Y116A8C.35; Phenotype=Ste
MPRYDATDDLSGAEYLASIYGTEKDKVNCSFFFKIGACRHGDNCLRAHHRPTFSNTVLLKHFYQSPIVNPAQADAFDKVGKKDELEQRHFDEFYEEVFTELQRTYGPVEELNVNWERIFA

SEQ ID NO: 120659 - protein, 396 aa, Heterodera glycines
  Coding regions on vcDNA: vcDNA=SeqID_47082; Strand=-; Position=1-1189
  Homolog annotation: Hit_ID=NP_508269.1; Match level="QueryCoverage =95%, HitCoverage=57%, E-value=2e-33, Identity=26%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTCPQKISDSSPLAINTGLNIFLVPPTNVSVVRSFFRQVLPLATITQESPYLFRLYSDNLWTDLSRIYLYLELSIEKPGANDKWVAIDDADTSVSAIQGIGQTFVQQLKVTVGNTEVYDSGNLYPFKAYITNELSFPINAKKNFLGSTGYYHTINQDDSTDEGFKERCKIFKGGKNAQFLSRLDFDLGNQELYLLNNLDLLFTIYKAKDVFLLQTLKANDSTKYRLTVYDVKIYAKMVEVQPSLNMNLYKNLEKQPATYAVRKTEIKSSFISVGRYEFEYNVFSATIPRRVTIALVGNSAFHGDYKLSPFMFEPFDLREISVHAGGVVYPAVPYKLNFSNDHFVSAFVDMYEALGMANSERSFDISMAQFKKGWIFFVIPLTSTLDDSCGFELLRS

SEQ ID NO: 120660 - protein, 239 aa, Heterodera glycines
  Coding regions on vcDNA: vcDNA=SeqID_47083; Strand=-; Position=1 -177,228-361,782-905,1062-1182,1280-1440
  Homolog annotation: Hit_ID=CAE61283.1; Match level="QueryCoverage =99%, HitCoverage=18%, E-value=9e-92, Identity=60%"; Hit description =Hypothetical protein CBG05103 [Caenorhabditis briggsae]
  Essential gene: C elegans homolog=F56C11.1; Phenotype=Bli,Lva,Lvl,Mlt
MLFADYRYENEHRDLRRVMGVGIAITRGAAAALSVDLALILLTVCRNLLTMLRETFVGEYLPLDSAITFHKIVAITAGTFAAIHTIGHCVNFYHVATQSQEGIAIYVFSAPAVMKRAYHAFRITHLLNVLLYALTILHGLPKLLDSPKFWYIVLGPVIIFIIDRIIGMRKHYKQLRIVDAAILPSDIIYIQFKRPHSFKFRSGQWVRISCPAFSCTFNESHAFSLASAPQSPTLELFIK

SEQ ID NO: 120661 - protein, 149 aa, Heterodera glycines
  Coding regions on vcDNA: vcDNA=SeqID_47084; Strand=+; Position=1-450
  Homolog annotation: Hit_ID=NP_508269.1; Match level="QueryCoverage =91%, HitCoverage=20%, E-value=2e-18, Identity=37%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MALWNTGRSTGIQNWTPFNFKHFDIRDIAVHAGGFIYPMVPYKLAFKKDAFMRAYVDLYEALGMANSDRSCDITRQQFKNGWTLFVIPLTSTLDDSVGYELLRSGTTTIRASFNTAIPGGGVEMIVLGEFDQMIMIDYNRHIVSDSKLG

SEQ ID NO: 120662 - protein, 234 aa, Heterodera glycines
  Coding regions on vcDNA: vcDNA=SeqID_47085; Strand=-; Position=1 -179,914-1057,1117-1211,1541-1749,2334-2411
  Homolog annotation: Hit_ID=NP_502171.1; Match level="QueryCoverage =96%, HitCoverage=53%, E-value=9e-44, Identity=38%"; Hit description =lethal 37Bb (60.0 kD) (4M284) [Caenorhabditis elegans] emb|CAB01237.1| Hypothetical protein M04B2.4 [Caen
  Essential gene: C elegans homolog=M04B2.4; Phenotype=Gro
AKYDAFRRRHPLAHMKVNVNDYELLPMHCEYLIIGGGLTGSAAAYWLKQGFRDENLTVTVQRTPGYSFASLWCYAFGPDGGGRRAVQKCLETSSVIFNFFFLNYNYSNDRGANVILIGREELSSRFPFMNFDDVVLGTVGLENEGIFDTWQLLSALREKNMTLGVRYLKGDMEGTVTYRHRGMQEHGRTTDTADADAAEQSMQTIRGAINAAGPWAGEVARRAGLGSFLCIRPY

SEQ ID NO: 120663 - protein, 186 aa, Heterodera glycines
  Coding regions on vcDNA: vcDNA=SeqID_47086; Strand=+; Position=1 -183,248-378,438-681
  Homolog annotation: Hit_ID=AAL78213.1; Match level="QueryCoverage =100%, HitCoverage=74%, E-value=5e-60, Identity=62%"; Hit description= probable protein kinase Hgg-20 [Heterodera glycines]
  Essential gene: C elegans homolog=R90.1; Phenotype=Lva,Unc
MTDSLVELSPGALVSGRWTVIKKLGAGAFGAVYLCQDQDGITKGALKTEPINAPFPLLALEAIVLRSFDTLRASSGKHFCRCMDLGRDQQPDAASGRTLEFNFIVMSLVGRPFDKLLQESGDCFSPGTAIGAALQLLKALQALHDVGYLHRDIKPANFAIGLPETNEQRLLYLLDFGMARKYLKDD

SEQ ID NO: 120664 - protein, 92 aa, Heterodera glycines
  Coding regions on vcDNA: vcDNA=SeqID_47087; Strand=-; Position=1 -77,378-579
  Homolog annotation: Hit_ID=NP_491233.1; Match level="QueryCoverage =95%, HitCoverage=64%, E-value=2e-30, Identity=59%"; Hit description =RAB family member (23.6 kD) (rab-2) [Caenorhabditis elegans] gb|AAB52431.1| Uncoordinated protein 108 [Ca
  Essential gene: C elegans homolog=F53F10.4; Phenotype=Unc
MITIDGKQIKLQIWDTAGQRDNFLTGDLEARREVKKEEGEQFARENGLVFMETSAKTAANVEEAFIDTAKEIYRKIQEGVFDINNEVNYHYQ

SEQ ID NO: 120665 - protein, 180 aa, Heterodera glycines
  Coding regions on vcDNA: vcDNA=SeqID_47088; Strand=-; Position=1 -309,1840-1899,2085-2255
  Homolog annotation: Hit_ID=BAB55241.1; Match level="QueryCoverage =83%, HitCoverage=38%, E-value=8e-44, Identity=54%"; Hit description =unnamed protein product [Homo sapiens]
  Essential gene: C elegans homolog=C32E8.5; Phenotype=Bmd,Emb,Lva,Unc
MLTKIAGSGTGDENSGSNTTIITMNIDGKVDGEEEERESHRRAAGTSRNGDDTVKKEEEGGGEEAEKQQKRRGEGEEEKENPSFVPSGKLAKDTNTYKGVLIKYNEPPEAKFPKLRWRLYPFKGDDTLPVFYIHRQSAYLIGRDRKIADFPVDHPSCSKQHAALQYRSLQYERSDGSIGR

SEQ ID NO: 120666 - protein, 164 aa, Heterodera glycines
  Coding regions on vcDNA: vcDNA=SeqID_47089; Strand=-; Position=1 -123,504-665,1031-1240
  Homolog annotation: Hit_ID=CAE67815.1; Match level="QueryCoverage =100%, HitCoverage=32%, E-value=5e-27, Identity=40%"; Hit description= Hypothetical protein CBG13395 [Caenorhabditis briggsae]
  Essential gene: C elegans homolog=M176.2; Phenotype=Emb,Lva
MVERFFPNPEDAPMVTAIRKTFAKMWGLENPDDEETKRVIQDAIAHPERYVMKPNKEGGGKNFWEQEIVDRLKKFTSKQRAAYILMERLNPLVAQNYLIWANEKPIFSDVITELGVYTYCVYDTKAGTLVEYTQPGQMIRTKCASSNEGGIGAGLGVFDSLYLY

SEQ ID NO: 120667 - protein, 239 aa, Heterodera glycines
  Coding regions on vcDNA: vcDNA=SeqID_47090; Strand=+; Position=1 -250,395-601,1018-1279
  Homolog annotation: Hit_ID=NP_500157.2; Match level="QueryCoverage =100%, HitCoverage=14%, E-value=2e-47, Identity=43%"; Hit description= cleavage polyadenylation specific factor 1 160kDa (4C774) [Caenorhabditis elegans] gb|AAF36067.2| Hypoth
  Essential gene: C elegans homolog=Y76B12C.7; Phenotype=Emb,Lva
MYSLLHETDGATSVNFSAWGNFLPGPGKQLVTVCAKCIKFYRLNPFFVPTDGFAGQPPTVRLECLLSFTLMAPVRSLAVVRLKFSADCYDSLAMTFDDAKLSIVGVNPATMALTTISLHSIEDEFLRDGYTDENIHQPELRADPEHRCCAFTVYGRHLAVVPFNIVELVRQQSSAVSSREEAKLYNQQQQQQQMLLQSYTIKMRLLDERLDNVLDMCFLHGYYEPTLLFLYEPIQTTAG

SEQ ID NO: 120668 - protein, 297 aa, Heterodera glycines
  Coding regions on vcDNA: vcDNA=SeqID_47091; Strand=-; Position=1 -151,243-346,550-592,798-1202,1837-2025
  Homolog annotation: Hit_ID=CAE58392.1; Match level="QueryCoverage =77%, HitCoverage=82%, E-value=1e-52, Identity=46%"; Hit description =Hypothetical protein CBG01521 [Caenorhabditis briggsae]
  Essential gene: C elegans homolog=T23B12.3; Phenotype=Lva
MTDCRWMASVPMAFEQKVSMAQPQQSMAYLPDIETLRKGKVSPTILKSVGDLTLTRLCALPTQIPFESEVTVGRMLDARVHLGHKVGTLNDNMKWALYGERLGICVFDLEITRHYLLKALEFVRSVAFLGGRFLFVSTNKCCFPMGFPFGGICLFRSSMLMVETMADELGQYAHTRHWQPGTFTNTKSVFGGPIRLPDTVILLNTLTSAMEAHPALVDSAKMCIPTVAIVDSNSDQKGKKSFKELQQLHDKNGPLRLIRIDVSDDRSIRTAFGQVQKQLLDKGGLNLLINNAGILLK

SEQ ID NO: 120669 - protein, 334 aa, Heterodera glycines
  Coding regions on vcDNA: vcDNA=SeqID_47092; Strand=+; Position=1-1005
  Homolog annotation: Hit_ID=EAK89192.1; Match level="QueryCoverage =91%, HitCoverage=3%, E-value=9e-66, Identity=42%"; Hit description =very large probable mucin, 11700 aa long protein with signal peptide and pronounced Thr repeat (308 aa long
  Essential gene: C elegans homolog=ZK945.9; Phenotype=Gro
MFYQTVCLLLLLSASNDVAVFGQEETTTTSTSSTSTSTTSSTSTSTTPTTTSSTSTSTTPSTTTSSTSTSTSTTPTTTSSTSTSTTPTTTSSTSTSTTPTTTSSTSTSTTPTTTSSTSTSTTPTTTSSTSTSTTPTTTSSTSTSTTPTTTSSTSTSTTPTTTSSTSTSTTSSTTSSTSTSSTSSTTSSTSTSTTPSTTSSASTSTSSSSSTTTKPSSGDSGSGASTSCTNAAGDRACNAYKNRCGQFSAWLKKNCAKMCNACTSSDSSTSTTTSTSTSTSTSTSSTTTKSSSGGGSSSSCTNSAGDRACNFYKNRCNTLAGWVKKHCAKACNAC

SEQ ID NO: 120670 - protein, 122 aa, Heterodera glycines
  Coding regions on vcDNA: vcDNA=SeqID_47093; Strand=-; Position=1 -52,115-239,287-327,373-456
  Homolog annotation: Hit_ID=CAE68064.1; Match level="QueryCoverage =100%, HitCoverage=22%, E-value=1e-34, Identity=63%"; Hit description= Hypothetical protein CBG13686 [Caenorhabditis briggsae]
  Essential gene: C elegans homolog=Y116A8A.9; Phenotype=Emb
TSHYMRFALHEEHIPLRLTLTRSKKLLATINKNFGTLAFCRRWLDRLGETKYLMSLRDLCEKDIVKDIVAPYPPLCDQKGCYTAQWEHTILLRPKGCYTAQWEHTILLRPTCKEVVSRGEDY

SEQ ID NO: 120671 - protein, 537 aa, Heterodera glycines
  Coding regions on vcDNA: vcDNA=SeqID_47094; Strand=-; Position=1 -1274,1541-1880
  Homolog annotation: Hit_ID=NP_498735.1; Match level="QueryCoverage =70%, HitCoverage=90%, E-value=5e-46, Identity=29%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MAFHKNDNDSVNSITNALDFFRILPTNVSVSSSKVFELLPSNPLTDTPYHFKLHSSQNYIDLSKCYLLTEFRIRKENANGQLINLNADDINIAPIQMIGQTFIRNVKMSINGREIFNANALMAYKTYFSHELSYSTTAKDSHLNAMGYYRDTDDTLEMGGGCTARRDLFAGSNVAQFIAKIDTDLFNQPLYLINFCELDIEILPNDNDFMLISPIAGAPRYHFEILGLKLYVKKVSLMDGLALDIARKLEVKPARYAVRKTMMKSMFISQGRYEFTSNLFMDQIPRRVTMGLVANADYVGTIRRSPFNFQPFNVREISIVANGRSYPQAPYDLDYPSGKYVRPFNDMNEAVGFANSSESNGITFSQYGKTHCIYVFNLTNSGDDQAALFDLIKNGTTAVSIKFNHPVPDGGIMLVVMGECDSLVIRLSLFKRTTAIVSTTTAPLTITSPKSDRLIDEHVAAVLPPLIQLCKDRPEEENFFHQAVCWALFTLYLMLIISLVLHQLCSIFWLKNGQHTNHKDFERKSSDRASISGLLRL

SEQ ID NO: 120672 - protein, 780 aa, Heterodera glycines
  misc_feature (758)..(759): Xaa can be any naturally occurring amino acid
  misc_feature (776)..(776): Xaa can be any naturally occurring amino acid
  Coding regions on vcDNA: vcDNA=SeqID_47095; Strand=+; Position=1 -46,392-482,530-604,643-681,732-818,859-1141,1306-1511,1561-1645,1686- 1734,1776-1874,1915-2002,2047-2114,2159-2210,2254-2445,2785-2902,2935- 3079
  Homolog annotation: Hit_ID=AAL06642.1; Match level="QueryCoverage =91%, HitCoverage=82%, E-value=1e-103, Identity=35%"; Hit description= serine-threonine protein kinase [Ancylostoma caninum]
  Essential gene: C elegans homolog=C32D5.2; Phenotype=Sma
PWWYFLNTFHHFHRCQCQCQLSPLSFQSLAFGQHHHLLQQNRAVLEVPLSNRCFCNYGPSVCDMEDTCILEVPLSNRCFCNYGPSVCDMEDTCIKHTSAACFHAIVLVKHTSAACFHAIVLVFNSGTGAIERRHFFGCFNSGTGAIERRHFFGCAPLEKGSDASHLTCNAWRSSHSNGRTVCNAWRSSHSNGRTVACCYEGNFCNRNLTLPDSPALEVSTGLKLALSLRAQFAPRHRPSPAFPVPSFAICFSSVWLFGRPCLLLTFAVPFRCWLPPLGCRGIIFPIVVVGCLSFEQSCSASVDGVTLVQRSIALDLQLMEVFARGRYGELRKAFYRGTVVAVKIFYTTEEESWQNERDIYQCIFYTTEEESWQNERDIYQCQMLNHENILQFVAADILSSVESLTQMFVAADILSSVESLTQMLLITDFHLLITDFHPLGSLYDFLRANGRLSLDEALQFALSTISGLEHLHNALRGTAGRRKPLQFALSTISGLEHLHNALRGTAGRRKPEIAHRDIKSKNVLVKRRGVCCVADFSKNVLVKRRGVCCVADFGLAVRFEDGQIVPRSVNIGVGTKEDGQIVPRSVNIGVGTKRYMAPELLRYMAPELLLGTLNVRNFDAFKSADIYSFALVLWEILHCVQVSSRGDTEGFSSFKLELGFSQVSAEGKRRTEDRQQKVQREHRENREQREYREHALPFKGMVGNEIHSDPSFEQMRQIVCSGGEPFKGMVGNEIHSDPSFEQMRQIVCSGGESLPLPXXFTNFRNSVRTMETPMEXRRQC

SEQ ID NO: 120673 - protein, 324 aa, Heterodera glycines
  Coding regions on vcDNA: vcDNA=SeqID_47096; Strand=+; Position=1 -126,177-268,328-431,893-1312,1542-1629,1678-1823
  Homolog annotation: Hit_ID=CAE73909.1; Match level="QueryCoverage =52%, HitCoverage=33%, E-value=2e-16, Identity=35%"; Hit description =Hypothetical protein CBG21517 [Caenorhabditis briggsae]
  Essential gene: C elegans homolog=Y57G11C.9a; Phenotype=Emb
EFFEKDFGACTFDFVKVSPDRTKLYIAVRFDSKAAARKVMENFSTDGELLGFKVEMTWFRDIRRYLAHCAKQGIRPSRFRGRSDYRRDDEQYKGRGRSRQVGGTNGDKKVRLSPPRVLSPSPPPLKKSKKEKRKKEKRQRRSKHMSPSLAVHRQPHSGSDMEMGGEEEDGLSNGGGRKMLKMESSSPVNNSKACGQLGENEPNRGMGGEYPLAFSDDFHWSGQAHCPTVADCTTKAAQGGAAQPVHHPRTVSPPKFKPIGELSDYQQQINGSKGMQELSNIRLATPPPQPPPVLRNVPLPPVTSNNNEMMVDRNYIAKVPLPLF

SEQ ID NO: 120674 - protein, 204 aa, Heterodera glycines
  Coding regions on vcDNA: vcDNA=SeqID_47097; Strand=-; Position=1 -159,210-412,487-739
  Homolog annotation: Hit_ID=CAB88204.1; Match level="QueryCoverage =95%, HitCoverage=66%, E-value=1e-72, Identity=57%"; Hit description =putative cuticular collagen [Globodera pallida]
  Essential gene: C elegans homolog=C15A11.6; Phenotype=Emb
MNMVQPKCPPGPPGPPGPAGTPGLPGSPGNAGEPGQPGQQSGPCPPAAAVGCQKCPAGPTGQPGAQGQPGTLGNDGTPGQPGQSAGPGAAGPPGAPGPAGVPGPPGSPGQPGQPGASATQSTFVPGPPGLPGNAGPPGQPGAPGQPGNPGGQGLPGVPGAPGQPGTAGTPGQPGQPGLPGQPGHDGAYCQCPPRTALLLHRFHA

SEQ ID NO: 120675 - protein, 459 aa, Heterodera glycines
  Coding regions on vcDNA: vcDNA=SeqID_47098; Strand=+; Position=1 -174,397-756,904-1034,1112-1436,1530-1685,1744-1974
  Homolog annotation: Hit_ID=AAN78300.1; Match level="QueryCoverage =100%, HitCoverage=70%, E-value=0.0, Identity=99%"; Hit description =heat shock protein 70 A [Heterodera glycines]
  Essential gene: C elegans homolog=F26D10.3; Phenotype=Lva,Ste
MNPSNTVFDAKRLIGRKFDDPAVQSDMKHWPFKVVQGEGARPKVMVEVKGEDKAFFPEEVSSMVLIKMKETAEAFLGQTVTDAVVTVPAYFNDSQRQATKDAGTIAGLNVLRIINEPTAAAIAYGLDKKGQGERHVLIFDLGGGTFDVSILTIEDGIFEVKSTAGDTHLGGEDFDNRMVNHFVAEFKRKHKKDLSSNPRALRRLRTACERAKRTLSGSTQASIEIDSLFDGIDFYTNITRARFEELCADLFRNTMDPVEKALRDAKMDKSQIHDIVLVGGSTRIPKVQKLLSDFFSGKELNKSINPDEAVAYGAAVQAAILSGDKSETVQDLLLLDVAPLSLGIETAGGVMTSLIKRNTTIPTKTSQTFTTYSDNQPGVLIQVYEGERAMTKDNNLLGKFELSGIPPAPRGVPQIEVTFDIDANGILNVSAQDKSTGKQNKITITNDKGRLYKEEIERM

SEQ ID NO: 120676 - protein, 306 aa, Heterodera glycines
  Coding regions on vcDNA: vcDNA=SeqID_47099; Strand=-; Position=1 -244,500-624,668-799,937-1233,1714-1834
  Homolog annotation: Hit_ID=NP_504547.1; Match level="QueryCoverage =83%, HitCoverage=39%, E-value=3e-85, Identity=53%"; Hit description =crooked neck-like protein 1 (88.0 kD) (5G423) [Caenorhabditis elegans] gb|AAB65909.2| Hypothetical protei
  Essential gene: C elegans homolog=M03F8.3; Phenotype=Emb
MEELVGNIPGARQVFERWMEWEPDEQAWLTFINFEMRYKEVDRARDLYQVKREQRERKPNKQNNARNSALFACPWARLQKLDHLPTTRTTELFKCLTMHEKKFGERLRIEGVIFSKRRHQYEEQVKENPFNYDAWFNYVRLLMAEEADRAEVEECFERAISNVPPYVEKRFWRRYIWLWVYYAIYEELDVEDVGKCREVWRACLDIVPHKQFTFAFTWLMFAQFELRQLNLGSARKILGTAIGKCPKKKLFREYIGDGVAAEGVRPQWRDFEAQHGTEAERSAVERMMPKRVKKRRQITATDGTDA

SEQ ID NO: 120677 - protein, 306 aa, Heterodera glycines
  Coding regions on vcDNA: vcDNA=SeqID_47100; Strand=-; Position=1 -113,169-266,405-527,673-877,939-1064,1605-1802
  Homolog annotation: Hit_ID=NP_705758.1; Match level="QueryCoverage =93%, HitCoverage=30%, E-value=3e-39, Identity=34%"; Hit description =RIKEN cDNA 4930429A22 [Mus musculus] gb|AAH36177.1| RIKEN cDNA 4930429A22 [Mus musculus]
  Essential gene: C elegans homolog=C04G2.6; Phenotype=Sck,Sma,Stp
GQSAKTRARKKHAKALLRRHPPPKKREMKNLVDKCALLGIKIVDKCALLGIKINSISSKTLADSLKVYEHREEYRYGVIPALNQMLMKCMHLAQYFCTGLVESEREFRHYALSVDFYTHFTSPIRRYPDVVVHRLLAACLGYAASPDYSTEQVDKIAGRANSTKTGAKVCSELSGEIFFGAIVRSEGHFEALGIVMGISEGHFEALGIVMGIYDGCFDVLLLKYAIIKRVYLKVLAYTSFEGAVIAPDAQLDVPTWVSSSEEEQRQTVRMMSIVSVRLVPVKNTVKYEVRMGDGGMNALSGCIKKF

SEQ ID NO: 120678 - protein, 186 aa, Heterodera glycines
  Coding regions on vcDNA: vcDNA=SeqID_47101; Strand=-; Position=1 -74,1001-1116,1177-1288,1348-1435,1489-1656
  Homolog annotation: Hit_ID=NP_496011.1; Match level="QueryCoverage =70%, HitCoverage=25%, E-value=2e-12, Identity=34%"; Hit description =glutathione synthetase (55.4 kD) (2J706) [Caenorhabditis elegans] emb|CAB01655.1| Hypothetical protein M1
  Essential gene: C elegans homolog=M176.2; Phenotype=Emb,Lva
MTPKYPGIKAESAGTIKSDEGPAKRLFNKMFPIKLIRLSVLLVILFEFVFIGVKCNAPKETNEDVKNKQNEYLDTKALVEDAIDWAQKISLVWLPKQHMGRSDVTEIVPFTLFPSPFPRKMFEFGQKVQIAYNLLYFRVSNDYEFITKAYEKVAETNIAIRRLLTILKAVTAEGIKQTKSLVLARS

SEQ ID NO: 120679 - protein, 404 aa, Heterodera glycines
  Coding regions on vcDNA: vcDNA=SeqID_47102; Strand=+; Position=1 -187,396-483,600-750,860-963,1253-1358,2552-2758,3144-3339,3395 -3405,3537-3701
  Homolog annotation: Hit_ID=CAF90372.1; Match level="QueryCoverage =46%, HitCoverage=67%, E-value=7e-34, Identity=43%"; Hit description =unnamed protein product [Tetraodon nigroviridis]
  Essential gene: C elegans homolog=F45G2.4; Phenotype=Gro,Lvl,Unc
MSRVFATQSRFLRHILPDGQQQQQEDGDDDVGCQRIEEGMCGTGGTPLANIDQQQPFAWRKIVVRSNPLSGGDCSSGSASIDMGNTRVMCTVNGPRELQQQSVSSSADAAASMEEGVLCVTLRGCDIDASLRYSVERALQAATETAIELNVLSDDGGAFAACLVAAGVAIASANIEMLDVLLACNVLLIPSNSLTAPLRIVFDPDKATIAAHKVKCKSEEEKELKDAFMYRAYIGLNKCSVPLGEIDATDGNGSAALMAIRRFATFMSGAPEKRSFRELSGKIEEALRVLNRTASDSLECAALRVQCLLKLNRGDLAAKEVKRMQEMDEDATITQLAQAWLNMAMAMIEVGRDKLKDAFYIYQEMLDKYGATPLLLTSQAACLIMQQKYEEAEKLLLVLQKKKH

SEQ ID NO: 120680 - protein, 165 aa, Heterodera glycines
  Coding regions on vcDNA: vcDNA=SeqID_47103; Strand=+; Position=1 -104,156-204,688-864,1591-1758
  Homolog annotation: Hit_ID=NP_492721.1; Match level="QueryCoverage =98%, HitCoverage=82%, E-value=3e-51, Identity=48%"; Hit description =der1-like domain containing protein (28.5 kD) (1K976) [Caenorhabditis elegans] emb|CAB01696.1| Hypothetic
  Essential gene: C elegans homolog=F25D7.1; Phenotype=Stp
MGDFGEWYRSIPLITRYWFTGSTVIPLLGRLGIFHPYLMLLSWELFFYKLQLWRPLSALFYYPVTPQTGFHWMLMCYFLYNYSKDLETSQFDGRPADFLFMLIFNWICCTAIYLPWILVAFSMVLRGGGINELVGILVGHTYYFLAFQYALDYGGSVLLRTPQFL

SEQ ID NO: 120681 - protein, 423 aa, Heterodera glycines
  misc_feature (219)..(219): Xaa can be any naturally occurring amino acid
  misc_feature (230)..(230): Xaa can be any naturally occurring amino acid
  misc_feature (238)..(238): Xaa can be any naturally occurring amino acid
  misc_feature (388)..(388): Xaa can be any naturally occurring amino acid
  Coding regions on vcDNA: vcDNA=SeqID_47104; Strand=-; Position=1 -42,515-636,707-865,930-1082,1288-1443,1538-1621,1769-1933,1989-2269
  Homolog annotation: Hit_ID=NP_505237.1; Match level="QueryCoverage =98%, HitCoverage=88%, E-value=2e-80, Identity=42%"; Hit description =human neuronal Ceroid LipofusciNosis related (46.9 kD) (cln-3.3) [Caenorhabditis elegans] gb|AAC26960.2|
  Essential gene: C elegans homolog=C01G8.2; Phenotype=Emb
QMGSKSNAKFDFCNPVLPKPRCHITSTGAILLADIIPSLIIKLFSPFIIDRVPFGFRHLLFRHLLVCIMQALSFVIVAFSQSFTLSLIGIIFASLGNGLGENCLLALSSHYKRSTISAWSSGTSTISAWSSGTGGAGIVGSVAYAALTEPKLFGLSPRNALLSMLIVPIIFAIAYWGLLTPSPTVHRTKLLNPSTWIIQVKRKKHSEFNLNFFNVKILXMNNSEIIKFIXLLLIKFIXLLLHLMVPLGIVYFAEYLINSGLHQLLHFDCAHGFGLSEASQFRWYQTLYQLGVFISRSSVTVLALPTYVLYLLAVLQCGNILIFYFQSLFNYIPHCGNILIFYFQSLFNYIPHIGIVFIVIFVEGLLGGASYVNTFDKIHKKVNYFKKXYILSFLISNFHFSTDFPFFISFFQYYDICVQMFFF

SEQ ID NO: 120682 - protein, 142 aa, Heterodera glycines
  Coding regions on vcDNA: vcDNA=SeqID_47105; Strand=-; Position=1 -36,87-299,382-561
  Homolog annotation: Hit_ID=NP_506180.1; Match level="QueryCoverage =88%, HitCoverage=94%, E-value=2e-20, Identity=48%"; Hit description =unidentified Trans-Spliced transcript, Ribosomal Protein, Large subunit (13.7 kD) (rpl-28) [Caenorhabditi
  Essential gene: C elegans homolog=R11D1.8; Phenotype=Lva
MVYYNNASSYIQWQVIRKNSAFLKRQRGIPKHFSTEPFNMARLNSIRHNGMINKKAVDISAAKDGKGVVMSVKKHKNVAKPLQAVASTALTRDSRRVISAVGNAVTAYKPSHAKLAQRRASQILRSQKTKAKPATVRKGKAE

SEQ ID NO: 120683 - protein, 228 aa, Heterodera glycines
  Coding regions on vcDNA: vcDNA=SeqID_47106; Strand=+; Position=1-687
  Homolog annotation: Hit_ID=CAE63911.1; Match level="QueryCoverage =48%, HitCoverage=6%, E-value=2e-10, Identity=36%"; Hit description =Hypothetical protein CBG08482 [Caenorhabditis briggsae]
  Essential gene: C elegans homolog=H02I12.1; Phenotype=Ste
MCRFGQFVEENCNNGHRFNPTVSGQIAEIKRKVIGVGEKKPSKAMGKMRAVNKSLIQRIWKVFISLYVLKIGRCDPSFACPEHQKPPCFEGQMRVTETPSAAPTAKCTTEYELCRDGRFKRISCPYGEHFAGGRCVAGNCNGGQSGSGQGQTDRTAMCKVRRHVLISGICLDYAQESPGPQGFRSDSKNCAKFYQCANGKWVPKDCAKGTVFNPALAVCDWPANVPGC

SEQ ID NO: 120684 - protein, 61 aa, Heterodera glycines
  Coding regions on vcDNA: vcDNA=SeqID_47107; Strand=-; Position=1-186
  Essential gene: C elegans homolog=W08F4.8; Phenotype =Emb,Gro,Pvl,Rup,Stp,Unc
EMQEAFETQSMAKIFEVAKSMDSEVFKYHLDRCTASGLWIPNAKEAEGHGQEEEEKETEEK

SEQ ID NO: 120685 - protein, 371 aa, Heterodera glycines
  Coding regions on vcDNA: vcDNA=SeqID_47108; Strand=+; Position=1 -30,1343-1415,1460-1592,1770-1929,1987-2082,2126-2257,2304-2409,2451 -2586,2634-2666
  Homolog annotation: Hit_ID=CAE67836.1; Match level="QueryCoverage =96%, HitCoverage=76%, E-value=3e-96, Identity=53%"; Hit description =Hypothetical protein CBG13421 [Caenorhabditis briggsae]
  Essential gene: C elegans homolog=T05H10.2; Phenotype=Emb
FLEKFSKKLISQSVIKAGLYSKKNLGVHVSAAGNLENAIWLENAIWNAIEMGCRSFALFVRNQRRWNAKPMDESVVERWNCAIKKTKFPLHQIVPHGSYLLNAGSPDQKKLEMTRKAMLDECQRCERLGIQFYNFHPGSTTGKCTREQSTTGKCTREQSISTIADTINYVLENTHLITLVVETMAGSGNTIGATFAELRSIIDGLVVETMAGSGNTIGATFAELRSIIDGVQNKERVGVCLDTCHLFAAGYDIANYDIANNYKGVMEEFASTVGLPFLKALHLNDSKGICSSKLDRHENIGKGKSSKLDRHENIGKGKLGTKAFEQIMGDERLDGIPMILETPEGKYPEEMSLLYELERIEMSLLYELERI

SEQ ID NO: 120686 - protein, 155 aa, Heterodera glycines; identical to SEQ ID NO: 119223
  Coding regions on vcDNA: vcDNA=SeqID_47109; Strand=-; Position=1-636
  Homolog annotation: Hit_ID=BAA88337.1; Match level="QueryCoverage =96%, HitCoverage=15%, E-value=2e-18, Identity=36%"; Hit description =ORF2 [Platemys spixii]
  Essential gene: C elegans homolog=ZK250.3; Phenotype=Clr,Lvl,Sck

SEQ ID NO: 120687 - protein, 765 aa, Heterodera glycines
  Coding regions on vcDNA: vcDNA=SeqID_47110; Strand=+; Position=1 -222,532-1168,1336-2774
  Homolog annotation: Hit_ID=NP_510671.1; Match level="QueryCoverage =87%, HitCoverage=73%, E-value=4e-89, Identity=32%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
MPWINSILINARSIANKIADLEYLIETNKHQIILINETWLNTRNTITTELTLNGKFQTVLANRDNKRGGGCAILHVKEPTREKSILDLIFSGKPSIVNDIKVLEHFSTSDHKMISFKVSQEINKTREPKIFVRDFSYKNFQKLNQMILLNRLSCVINTKFYLEEKYNTLLIELMKAFNHTIPKKPLKQIVKQSYPQKIRDLYDEKLKLHKLIKNCKGNEKYKLSYKIVSRVHKKHLKQFWDKRENNIISSGQKALTNYVRKKLNPKNSIPYLIDNSGNICFDEKEKNNIPYILLKNCSETLAVILSDIFRLTLDSGQIPKIWRTSIIVPIYKKGEKSNPENYRPISLTSTVCRVFERILARKIIEFLNKNNFFSKEQFGFLKNRSTTTQLLQTLHDFYEAIQNQKEVDVIYIDFSKAFDSVPIDLLLAKIKNAGIVGKILVFLRNFLSQRSFRVKIEDHYSESYNTYTGVPQGSVLGPLLFLIFINDLPANIPKNVKIKMYADDVKLYIFHQNDSNTNDLSEAIKILEKWSKSNGLEISVEKSQTLYIGKNNSKKEYFLNGKIIPSLEKVKDLGVIIDSKLSFAEHINKIIKNAYLKAYHILRIMKTRELKTIIRMYKTYVRPQLEYAVEIWNPNLKKDIERIEKVQKFFTRKAFKKCGLLHRSYSERLEICQLIELAKRRNIADLTTAFKIMKGFTSLDASKLFTFSDRPTRRPLLLRMRRTTTKSKNNFFNRIAKNWNKLPIVPIQADKANQFRALLKAMYEF

SEQ ID NO: 120688 - protein, 83 aa, Heterodera glycines
  Coding regions on vcDNA: vcDNA=SeqID_47111; Strand=-; Position=1 -186,313-381
  Homolog annotation: Hit_ID=XP_344596.1; Match level="QueryCoverage =92%, HitCoverage=88%, E-value=2e-29, Identity=91%"; Hit description =similar to CG31613-PA [Rattus norvegicus]
  Essential gene: C elegans homolog=Y49E10.6; Phenotype=Emb
LTLSILCSRQLSLLSLQMARTKQTARKSTGGKAPRKQLATKAARKSAPATGGVKKPHRYRPGTVALRIRRYQKSTELLIRKLP

SEQ ID NO: 120689 - protein, 86 aa, Heterodera glycines; identical to SEQ ID NO: 119620
  Coding regions on vcDNA: vcDNA=SeqID_47112; Strand=+; Position=1 -78,446-628
  Homolog annotation: Hit_ID=CAE57188.1; Match level="QueryCoverage =65%, HitCoverage=8%, E-value=2e-12, Identity=60%"; Hit description =Hypothetical protein CBG00032 [Caenorhabditis briggsae]
  Essential gene: C elegans homolog=ZK686.2; Phenotype=Lva

SEQ ID NO: 120690 - protein, 215 aa, Heterodera glycines
  Coding regions on vcDNA: vcDNA=SeqID_47113; Strand=+; Position=1 -104,220-379,768-860,918-946,1158-1245,1394-1495,1564-1637
  Homolog annotation: Hit_ID=CAE60383.1; Match level="QueryCoverage =86%, HitCoverage=89%, E-value=4e-64, Identity=67%"; Hit description =Hypothetical protein CBG03984 [Caenorhabditis briggsae]
  Essential gene: C elegans homolog=F23C8.6; Phenotype=Lva,Unc
LFNLRFASKELSRNAKKCDKQEKEEKVKLTNALKKGNREVAQVHAENSIRKKNEALNYLRMSARIDAVAARVQTDATQKRVSSSMQGVVKAMESAMKSMNLEKVQNLMDRFEKDFEDLDVQSATMEGSMNATTTLNAPRSEVDALIQEAADKAGLELGMEMPAAQTGQLDTVSSKASVADNDDLSKVDNWSSFGRPEANLTSEWTDRMTPFAKSL

SEQ ID NO: 120691 - protein, 402 aa, Heterodera glycines
  Coding regions on vcDNA: vcDNA=SeqID_47114; Strand=+; Position=1 -147,194-289,331-508,551-785,1154-1403,1514-1815
  Homolog annotation: Hit_ID=AAF64254.1; Match level="QueryCoverage =45%, HitCoverage=43%, E-value=3e-35, Identity=44%"; Hit description =novel immunogenic protein NIP-2 [Onchocerca volvulus]
  Essential gene: C elegans homolog=Y48E1B.5; Phenotype=Lva
MQFQRWINGEVEVSKDGTDLSDEGEDESDTLRNIARLVIAGDFARFAQNDIETQRVSMIGAELDSDMDSFSQFDKFLATLLQNLRVDLMPGASDPVQCMIPQQPIPPAVFTLAAPFQPMLNTVTNPYSFELNGVRFLGTSGQNINDLRRLTRGKDTLALMERTLEMGYIFPTVPDTLPGFPFSGRDPLVLDQIPHIYFVGNQPTFEKRIVEFGGKPTKSQKMPFVKFKPGKQFGRYNTRLFKEIVKSKNKEPIPRIVPTDSIESMGFDVLDPQDAGFLQKMAGGPKQPNFQLPPHLRKPEKMEHPLFKSEECFAFEGITGMTDGIDEACALIRATKAQPVPDRVWNSLPRDFLPADFEHSVEDAIWAGERFDPTLEKLPRKFDPILFWIKYKMCYGTPVTKR

SEQ ID NO: 120692 - protein, 334 aa, Heterodera glycines
  Coding regions on vcDNA: vcDNA=SeqID_47115; Strand=-; Position=1 -131,199-591,734-916,958-1255
  Homolog annotation: Hit_ID=CAE66719.1; Match level="QueryCoverage =99%, HitCoverage=65%, E-value=7e-54, Identity=37%"; Hit description =Hypothetical protein CBG12065 [Caenorhabditis briggsae]
  Essential gene: C elegans homolog=E01A2.4; Phenotype=Bmd,Emb,Gro,Unc
MASSVNGTESPTSVRRNNWESDGEEGDNWNVLARTEAEDRQWRSRREERERLGAVGVRHIWGYSPTHNELERVFEEHRIAERMLKEELKRDVISEKNRSEKKRKRKEAREEQNDQSTKEETSDETTEESSKDSESSEDKKRKRKRGRKERGKKRKEESKRRKKHKKSKRKSSTTSGSSDETSKGGGKGDEWVEFTKEMQVKKSKKEEAAMIGPQIPEDLLQKLNPTMAPEMKLDASARNNMLRGEAAAMAAYAAQGKRIPRRGEIGLSSNEISTFESVGYVMSGTRHKAMEATRLRKENQILTAEEKRLLSTFTDEQRTRREDTVLKQFKDLIT

SEQ ID NO: 120693 - protein, 315 aa, Heterodera glycines
  Coding regions on vcDNA: vcDNA=SeqID_47116; Strand=-; Position=1 -26,341-459,506-591,635-822,866-985,1036-1140,1189-1285
  Homolog annotation: Hit_ID=NP_501141.1; Match level="QueryCoverage =98%, HitCoverage=24%, E-value=1e-99, Identity=61%"; Hit description =solute carrier family 12 member (4H981) [Caenorhabditis elegans] gb|AAA81476.1| Temporarily assigned gene
  Essential gene: C elegans homolog=R13A1.2; Phenotype=Emb
IKPELIRDKTGLSLDGRMVVALLAWPTEWVVLVGSFLSTFGAALQCLCSAPRLLQAPRLLQSIAKDDVIPFLQPFAKVTKKNEPFFGLLLTTLIAELGILMGAMDTINEPFFGLLLTTLIAELGILMGAMDTIAAVLDFFFLMCYAFVNIICALHSILGAPNWRPRFVYYHWSLSVLGASLSVLGAALCFFIMFSTHWHYAILSIVFCIVIYKYVEWKGAKKEWGDGIRAKKEWGDGIRGLALSTAQYSLMQIPEKDPHPKNWRPQLLILQSMPWSKELVDLRPQLLILQSMPWSKELVDLRYLKLWDFASQLKA

SEQ ID NO: 120694 - protein, 166 aa, Heterodera glycines
  Coding regions on vcDNA: vcDNA=SeqID_47117; Strand=-; Position=1 -129,191-337,396-617
  Homolog annotation: Hit_ID=AAO14563.2; Match level="QueryCoverage =89%, HitCoverage=25%, E-value=5e-54, Identity=64%"; Hit description =Hsp90 [Heterodera glycines]
  Essential gene: C elegans homolog=C47E8.5; Phenotype=Emb,Ste
MSFSHAALLFIVFAIFAGKSGETFAFQSDIAQLMPKLDNTTGKAHDIENDPSKADKTWTIIDTGIGMTKADLVNNLGAIAKSGTKAFMEALQTGIGALMPGHFGAAFYSAFSVADRVTSKHNDDDCYQWESSAGGSFIIRNCADPEVTRGTKIVLHLQEDQTAYLE

SEQ ID NO: 120695 - protein, 713 aa, Heterodera glycines
  misc_feature (6)..(6): Xaa can be any naturally occurring amino acid
  misc_feature (662)..(662): Xaa can be any naturally occurring amino acid
  misc_feature (677)..(677): Xaa can be any naturally occurring amino acid
  misc_feature (702)..(702): Xaa can be any naturally occurring amino acid
  Coding regions on vcDNA: vcDNA=SeqID_47118; Strand=-; Position=1 -183,283-383,551-1039,1194-1338,1381-1504,1561-1620,1676-1921,1975 -2092,2148-2233,2287-2385,2431-2605,2787-2955
  Homolog annotation: Hit_ID=CAE60409.1; Match level="QueryCoverage =98%, HitCoverage=60%, E-value=0.0, Identity=49%"; Hit description =Hypothetical protein CBG04015 [Caenorhabditis briggsae]
  Essential gene: C elegans homolog=C34G6.6a; Phenotype=Emb,Lva
MRVSCXMAILCLALLSECPAGDSPVFLLHHNTSVASGIRSAPVPGVLECTELCSVARQCQLVGPKSASEGAVAEFGEEMTRTVTKNCVKSERICSSPFHFDVHEQKILVGFAREVVSADSVHRCLSACLNAFDTFGFECESVMYYPVDAECILNTEDRLDRPDLFVDEHEDTVIYLDNNCAGCECQSGILNDQQFAIAAQCYAPYVTQYVAVEGRQLSDELDRFEGLELSECEELCTQRLSVTANDFNCKSFMYSNLTRSCVLSDERSRPLGRANLAEVPGWTYFEKKCFASPRTCRGVPSFTRVPQMLLVGFASFVSPRTCRGVPSFTRVPQMLLVGFASFVMENVPSVTMCLDQCTNPPPETPPPETGQNFVCKSVMYYYNEQECILNAQECILNAESRHSKPDLFIPEEDDFVVDYFDINCRLESEQCSAGEGARSPKIVRTLNAALPEGDGAIHVVETVQAVRECAQKCAAHSPCAAHSPDKCRSFNFDKSSGICNLLYLDGRGSLRPEPKGQVDLYDLHCLVDLYDLHCLETSPEGQSMGCVDPEGAAFSRHRHLYSRVGGELSKELHSVPLSKCLNLCAGAGHCEGLNYNRRNGTCACEGLNYNRRNGTCAVIDSVGGDAESEQVDFYRNVCALKEVQSEESSAANVPKSKRDMGXGEMKGIKSKIGKLMXKKEKKALVSGTSEEKAQKRTKKLDXTNERTAHLTKR

SEQ ID NO: 120696 - protein, 306 aa, Heterodera glycines
  Coding regions on vcDNA: vcDNA=SeqID_47119; Strand=+; Position=1 -176,226-352,398-526,575-750,803-967,1023-1107,1159-1218
  Homolog annotation: Hit_ID=CAE66915.1; Match level="QueryCoverage =99%, HitCoverage=38%, E-value=2e-95, Identity=55%"; Hit description =Hypothetical protein CBG12303 [Caenorhabditis briggsae]
  Essential gene: C elegans homolog=R10E4.4; Phenotype=Emb
MSNLDNPRIFYQDRVFSNDAADNVLDGAREMVAEYKRLDEIYQRFIREFSIGGLNFKYREELKLNYTLGNYSLIVDFNDLATFDEDAAGKIKRYPTTFLPALESAVKRVVDDITHPRPPGEEEIHDIQVIVNLSDKALGIRKIKSSDVSQLVKVSGIVVAASQARSRATKVTLQCRTCRHTIVDREIRAGLEGFQLPRQCQSANQQAAVGGQRCPLDPYMVLPDKCRCIDFQTLKLQELPEDVPHSEMPRHMQIYVDRYLTDKVSPGNRITVTGIYSIKRVTGGKKGGKEDGKAGMSGIRTPYIRA

SEQ ID NO: 120697 - protein, 171 aa, Heterodera glycines
  Coding regions on vcDNA: vcDNA=SeqID_47120; Strand=-; Position=1 -153,491-702,1085-1235
  Homolog annotation: Hit_ID=NP_497421.1; Match level="QueryCoverage =47%, HitCoverage=16%, E-value=1e-09, Identity=37%"; Hit description =transcriptional regulator protein (3C646) [Caenorhabditis elegans] gb|AAK27884.1| Hypothetical protein Y6
  Essential gene: C elegans homolog=Y67D2.7; Phenotype=Emb
MEAQNSNLPLVGTNVGTSEHLEPSIARFGDWRIVNAFGDLSPEPETRFDLAQRFVAFFEKKERGVDMHASIKRRKDYINPALYEALRNAYGIDEKGTCFARAVYDPNAFAADDFYDALGERARSPGGARATPEKDGPATTAAGATPTQQQQKARLFSDRRRKSEMMPKRSE

SEQ ID NO: 120698 - protein, 245 aa, Heterodera glycines
  Coding regions on vcDNA: vcDNA=SeqID_47121; Strand=-; Position=1 -124,345-559,1044-1238,1716-1917
  Homolog annotation: Hit_ID=NP_497421.1; Match level="QueryCoverage =100%, HitCoverage=56%, E-value=2e-18, Identity=28%"; Hit description= transcriptional regulator protein (3C646) [Caenorhabditis elegans] gb|AAK27884.1| Hypothetical protein Y
  Essential gene: C elegans homolog=Y67D2.7; Phenotype=Emb
MNSLLAYGSDSDEEGQHQQSRHGQPEPDQQPREEQKQRGNGGLAGQLSSSSSSSALAAAAVPLEEPCPPRRQSDMFDEDDDEADVFGSERRRNDEDDEEEELDLLLEKGAKFSDSAMLDVGGSSGGGGSTPGPGYTPRSVCSADEPMDEDMAAESSADAIQHRDLPPSPRGECDPELAQRFVAFFEKKERGVDMHASIKRRKDYINPALYEALRNAYGIDEKGTCFARAVYDPNAFAADDFYDAL

SEQ ID NO: 120699 - protein, 633 aa, Heterodera glycines
  Coding regions on vcDNA: vcDNA=SeqID_47122; Strand=-; Position=1 -685,902-987,1085-1279,1652-1860,1906-2047,3069-3236,3292-3393,3744 -4055
  Homolog annotation: Hit_ID=NP_788301.1; Match level="QueryCoverage =89%, HitCoverage=77%, E-value=4e-60, Identity=30%"; Hit description =CG33183-PC, isoform C [Drosophila melanogaster] gb|AAO41453.1| CG33183-PC, isoform C [Drosophila melanoga
  Essential gene: C elegans homolog=C01H6.5a; Phenotype=Bmd,Let,Lva,Mlt
MDHHRFAPPINHSHSSSKTALSPPISSAITSSDTASVAAPSFSSLSIRIHGDQQAQQQQLRHSSHLLLLDDGLRAISNIKKAKVPGKTALSIASTFHELSELKQNIALPSPKPQPHSPSASTVSAFAVSEGGSDVSGALFPPSSSATVRVVESAAAVIYPISSSAHSFQSSTELNNKLRQLDNAAQIAESAKHRPKCSPTVLPGGVLSTTYRKKSNERIVHPGGPGEEPQIEVIPCKVCGDKSSGVHYGVITCEGCKGFFRRSQNAPVNYQCARQKCCTVDRVSRNRCQFCRLKKCLELGMSREAVKFGRMSKKQREKVEDEQEFKYSPPSNNAQNVSSASLPLPLYYGHPPGTHPHHAHHQLQQHQQQQLVHQSNAYHEEEMPSFHTMDGQPIQLLRHATALPTAAPSCVGAHFVFAKCGSVFPVRCHPSLRCRTIEQNRADGWLKFANELTNVTKCIIEFAKMVKEFLELEQDHKIHALKKTTFDLAIIAMAQHYHQQSQTLHVNNLVLPVYQFRCSDRKDEEFGKELISRLQYLSSFQLTSTETALLSAFVLMDQSQAPGMEAFVGQLKSCLGGQLHQRMPDGDEALRQLLEFLPRLRELAKTHRKCLGRFRLQMVDQQSEHQTDRGAAE

SEQ ID NO: 120700 - protein, 135 aa, Heterodera glycines
  Coding regions on vcDNA: vcDNA=SeqID_47123; Strand=-; Position=1 -91,151-322,443-539
  Homolog annotation: Hit_ID=NP_499741.1; Match level="QueryCoverage =99%, HitCoverage=20%, E-value=5e-30, Identity=53%"; Hit description =phosphomannomutase 45A (66.6 kD) (3O391) [Caenorhabditis elegans] emb|CAA16334.1| Hypothetical protein Y4
  Essential gene: C elegans homolog=Y43F4B.5a; Phenotype=Emb
RRLFADLRSDYPALIGQIDVKFVRDLTTGYDNAQPDDRAILPLSTSSYDNAQPDDRAILPLSTSSEMVTFTLVDGSAVTLRASGTEPKVKYYIELRTEPGKEEKLSSVLEQLDQLESDVVDTLLQPTKYGLISRI

SEQ ID NO: 120701 - protein, 709 aa, Heterodera glycines
  Coding regions on vcDNA: vcDNA=SeqID_47124; Strand=+; Position=1 -132,403-999,1334-1623,1708-1807,1859-2005,2138-2299,2342-2499,2610 -2763,2805-2885,3035-3343
  Homolog annotation: Hit_ID=CAE65082.1; Match level="QueryCoverage =37%, HitCoverage=27%, E-value=4e-52, Identity=41%"; Hit description =Hypothetical protein CBG09940 [Caenorhabditis briggsae]
  Essential gene: C elegans homolog=R06C7.8; Phenotype=Emb
MGMKEGEHKKKIVKSMGILGSQSIQWQRKDSKRTCEWLDFWKLVVAISNIYIYYLLLILFRPLSSKYFGESSDETDTVALIKVIADRPEDVRRTLTMFPAKLQEQQQHHHLHVSPRDELPQEQQQPNPLPTCREEFPQEQQQPLPVCREEFSIFRDPAKSMVHLLIMLPFHRLPNVQICCDLDDVTLAGAHGKFAPTVFTSTPRRSVAFCAFEPPMMEMDNDGLMGPAPSEDREERVGGLFAPGKKMTTNDIVKALPNLKIGSTIMEETEEDEKENSFASPHRKKARQGTNASHPPSLVHSSKQTSQLNDVSHNQPKAVSAETPTEEGQPDPDTTHLGIVEQIKTGTENPWDEEKRNQILQTAHVMVESHAFMTEKCPRFELNRTIHLGGESFSIEDLLGQGGFARVYRANSREDGCTYAIKYESPACPWEVYICSALKRRIPSQFAAYLMEVRDAYIFKNASAIVYEYFPKGTLLDLTNVYKKNGTVVGGLLATFFGIHLARALRQVHETANIIHADVKPDNVMLLTAALNAHDSLDNLLKTPVLKLIDWGRSIDMNHFQGVEFHGKAGTENFDCVEMKTGMPWTFQTDFYGFCATMYVMMNGEYLAHGSVRRVDAVVRSVPEHSQLQTAAKMVKYIGPNGKPTGRGCENGAFGVEKSDRTVQRIRQTTGVKEKGQDIGSDFCANDITYPKMLFCFIYKNNCPPHINK

SEQ ID NO: 120702 - protein, 349 aa, Heterodera glycines
  Coding regions on vcDNA: vcDNA=SeqID_47125; Strand=-; Position=1 -45,106-266,360-645,813-934,996-1113,1170-1250,1328-1563
  Homolog annotation: Hit_ID=NP_496476.1; Match level="QueryCoverage =99%, HitCoverage=30%, E-value=3e-50, Identity=30%"; Hit description =putative protein, with 3 coiled coil-4 domains, of ancient origin (2L871) [Caenorhabditis elegans] emb|CA
  Essential gene: C elegans homolog=F54D5.14; Phenotype=Emb
MCIELENFMCHNKLRLNFDVDSNNCFYIIGPNGSGKSALFAGLNIGLGGTGRSNERGKTLHSYIKDGKSDAHIRIYLSNEGPFACANFDEVVVVERHITEKATNFTLKTSAKFGGRERVVSRKRAELDALLEQFGIELDNPLAWLSQDRSRQFLQQMKPEKLYQLYRKTAEMDSTDLMFQSIEAHFDEFCRVFDSLAAEKKAREENYIQMKNRHKASREIKDKKVERQRLLWYNFWAPIRDNITRVNGNRAEVGTLSTEKVDLLEQIQQHMAQKDKLIQKQQSLLPQKEEEVKKCKQQHEKIMEMKRKVRELEFEITDLKRDLHKRTHQKMAFDKDIGEANAKLAAIIG

SEQ ID NO: 120703 - protein, 158 aa, Heterodera glycines
  Coding regions on vcDNA: vcDNA=SeqID_47126; Strand=+; Position=1 -132,193-346,401-508,584-666
  Homolog annotation: Hit_ID=CAE74465.1; Match level="QueryCoverage =95%, HitCoverage=42%, E-value=2e-80, Identity=96%"; Hit description =Hypothetical protein CBG22211 [Caenorhabditis briggsae]
  Essential gene: C elegans homolog=M01D7.7a; Phenotype=Egl,Prz
MKTRLICQRSERRKWIHCFENVTSIMFLVALSEYDQVLVECDNENRMEESKALFRTIITYPWFQNSSVILFLNKKDLLAEKILYSHLADYFPEYDGPPRDEITAREFILKMFVDLNPDAEKIIYSHFTCATDTENIRFVFAAVKDTILQHNLREYNLV

SEQ ID NO: 120704 - protein, 185 aa, Heterodera glycines
  Coding regions on vcDNA: vcDNA=SeqID_47127; Strand=-; Position=1 -237,763-890,1502-1692
  Homolog annotation: Hit_ID=XP_221142.2; Match level="QueryCoverage =98%, HitCoverage=22%, E-value=3e-40, Identity=50%"; Hit description =similar to phosphatidylglycerophosphate synthase [Rattus norvegicus]
  Essential gene: C elegans homolog=Y48G1C.4; Phenotype=Emb,Sck,Stp
QRVESAKRRVVLSALYLGTDALEQRLVHRLAVAAKTVATKRPVKVRILLDFFRATRGATADGKSSTTMLAPLCIYDNVEVRLFHTPKLRGLLKSALPERTNEIVGLQHMKFFVFDNSVLITGANLSDQYFVNRRDRYLLIEDCPLLADFFVDLFHLVGDNSFRLLADGRVEFTAGGTLSPIHPET

SEQ ID NO: 120705 - protein, 294 aa, Heterodera glycines
  Coding regions on vcDNA: vcDNA=SeqID_47128; Strand=-; Position=1 -207,276-668,725-1007
  Homolog annotation: Hit_ID=CAA65506.1; Match level="QueryCoverage =98%, HitCoverage=94%, E-value=4e-80, Identity=51%"; Hit description =cuticular collagen [Teladorsagia circumcincta]
  Essential gene: C elegans homolog=T07H6.3a; Phenotype=Bmd,Gro,Unc
MVDFDKNAAQREAESLRTLAFFGVCLSTVATVIAVLSVPFAYQHFQQIGAQMQNDVDFCKMRSGNMWREVTRTQAYSKVTHDSRHKRQVGGCCGCGVSPPGLPGPPGPQGQPGGDGQPGGSGQPGAPGPQRVYLEFHETVNSSLGQAAPRPYPPSGGCVPQCDAAQPGLPGPPGPPGPEGQPGQPGQSAPPASPGRPGQPGPPGPDGQPGNPGESGQLGQPGKLSQGPPVVGPPGPQGPPGQPGQPGENGQPGQPGGPGPQGYPGDGGNPGAPGNPGGVGEPGQLGAQGASGQC

SEQ ID NO: 120706 - protein, 86 aa, Heterodera glycines
  Coding regions on vcDNA: vcDNA=SeqID_47129; Strand=+; Position=1 -116,538-787
  Homolog annotation: Hit_ID=CAE62104.1; Match level="QueryCoverage =48%, HitCoverage=4%, E-value=4e-11, Identity=76%"; Hit description =Hypothetical protein CBG06138 [Caenorhabditis briggsae]
  Essential gene: C elegans homolog=M04B2.1; Phenotype=Lvl,Ste
LQLYIIYTLLGLERHLVMVHGLVTADLLAKAQRKADSGRCKLCSKQYAVAPPTKSWNGIWRRNIRTPGPTSNSSNINNSSSSSSSN

SEQ ID NO: 120707 - protein, 203 aa, Heterodera glycines
  misc_feature (9)..(9): Xaa can be any naturally occurring amino acid
  Coding regions on vcDNA: vcDNA=SeqID_47130; Strand=-; Position=1 -300,564-718,815-840,1078-1221
  Homolog annotation: Hit_ID=NP_502173.2; Match level="QueryCoverage =86%, HitCoverage=19%, E-value=2e-59, Identity=62%"; Hit description =nuclear zinc finger protein, Mog interacting, Ectopic P granules MEP- 1, GEX (Gut on EXterior) Interacting
  Essential gene: C elegans homolog=M04B2.1; Phenotype=Lvl,Ste
PLKNCNSFXLKATSAAAAAAHSAATAVGGGAAAPTSHPHQHQHHYVCEICDLAQLTDREQYRVHLQSAHRQLLGKNNAEMASGAPLACSRCRDRFWTYEGLERHLVMVHGLVTADLLAKAQRKADSGRCKLCSKQYAFNILQHLVSDHQIKLCSAEIMYSCDVCSYRCTSYQKLERHLETEHPKATAATSTTAAAAAAATLGK

SEQ ID NO: 120708 - protein, 117 aa, Heterodera glycines
  Coding regions on vcDNA: vcDNA=SeqID_47131; Strand=-; Position=1 -186,400-567
  Homolog annotation: Hit_ID=NP_490676.1; Match level="QueryCoverage =100%, HitCoverage=47%, E-value=5e-47, Identity=68%"; Hit description= ribosomal Protein, Large subunit (28.1 kD) (rpl-7) [Caenorhabditis elegans] gb|AAB54165.1| Ribosomal pro
  Essential gene: C elegans homolog=F53G12.10; Phenotype=Emb,Lva
MLRIADPYIAWGYPSQKIIRQLVYKRGYAKESGQRIPITDNAIVERNMGKSDVICVEDMIHQIWTVGPHFKQVTNFLWPFKLSNPVGGFKKKSNHFVEGGDYGNREDQINKLLEKMI

SEQ ID NO: 120709 - protein, 248 aa, Heterodera glycines
  Coding regions on vcDNA: vcDNA=SeqID_47132; Strand=-; Position=1-768
  Homolog annotation: Hit_ID=NP_510671.1; Match level="QueryCoverage =100%, HitCoverage=25%, E-value=1e-46, Identity=37%"; Hit description= predicted CDS, endonuclease/exonuclease/phosphatase family and RNA -directed DNA polymerase (XR69) [Caeno
  Essential gene: C elegans homolog=ZK250.3; Phenotype=Clr,Lvl,Sck
ISFSNKKVCSGVPQGSVLGPLLFLIYINDLPDALPSGVRIKLYADDVKLYISDTEIMHKALHNLSEWANKWQIRISIKKTFVLHLGNKNPKEIYKIDGNIINVVDTIRDLGINIDNKLQFSNHVAQIIKNAYLRMRSLFRVIKSKSSRIWIILYKTYVRPLLEYAPEVWNPSLLKNIKKIEKCQKYFTKRVLFKCSLPPIPYQQRLEYLQLPTLESRRKLSDLFMAHKIIYGRTEIPMKYSNLLNALT

SEQ ID NO: 120710 - protein, 284 aa, Heterodera glycines
  Coding regions on vcDNA: vcDNA=SeqID_47133; Strand=-; Position=1 -81,127-372,423-487,544-665,712-947,1002-1103
  Homolog annotation: Hit_ID=AAO85519.1; Match level="QueryCoverage =87%, HitCoverage=79%, E-value=3e-73, Identity=54%"; Hit description =putative serine/threonine phosphatase [Oesophagostomum dentatum] gb|AAO85518.1| putative serine/threonine
  Essential gene: C elegans homolog=W09C3.6; Phenotype=Ste
MAEAPRPFPDNLIQKIVRSKQMEFPKEVSSGEIQQLCAAATDAFKRQPSLVEILPPVMVCGDVHGQFPDLMRIFNCLGTPPEKKYLFLGDYVDRGAQSVETIMLLLCYKVKYPTSIVLLRGNHETSNINATYGFKKELEERYPAHSQALFDSFNDTFAWMPLTGLIGQKILCMHGGISEKIRSIEQLKQLERPMLLPPTDSLHIDLMWADPMEAQGQLPNPRGAGVLFGEDVVIRTCQLLKISCIIRAHQFIQSGFEPMFNQRLITVFSAPAYTGQTNTGAVLE

SEQ ID NO: 120711 - protein, 172 aa, Heterodera glycines
  misc_feature (61)..(61): Xaa can be any naturally occurring amino acid
  misc_feature (130)..(130): Xaa can be any naturally occurring amino acid
  Coding regions on vcDNA: vcDNA=SeqID_47134; Strand=-; Position=1 -174,412-564,773-965
  Homolog annotation: Hit_ID=NP_500841.1; Match level="QueryCoverage =79%, HitCoverage=37%, E-value=2e-34, Identity=51%"; Hit description =constitutive photomorphogenic COP9 SigNalosome subunit, Jun activation domain binding protein (41.0 kD) (
  Essential gene: C elegans homolog=B0547.1; Phenotype=Emb
GGGGNRRHQYNVFCTFYFRFLLFFQIFKMTDSMFKYDQREQRMIRNVKQWEQDPHYFKEVXISALILLKMVMHRSGGNIEIMGLMNCRVDANTIIVLDAFALPVKGFFTRKKLQTNTNYFLKKKIRFFVXCSNLAQVFSWYHLHPGYALWLSGIDVNTQSINQQFQVRSSHT

SEQ ID NO: 120712 - protein, 170 aa, Heterodera glycines
  Coding regions on vcDNA: vcDNA=SeqID_47135; Strand=-; Position=1 -181,237-371,427-561,617-678
  Homolog annotation: Hit_ID=NP_492537.1; Match level="QueryCoverage =90%, HitCoverage=79%, E-value=1e-17, Identity=37%"; Hit description =putative protein family member (1K150) [Caenorhabditis elegans] emb|CAB02815.1| Hypothetical protein C36F
  Essential gene: C elegans homolog=F27C1.3; Phenotype=Lva
MANIFEFYGLLLPISATDPNYGTLKNLDADIFTKNAPAKPAAAPKAGPAPHGGGGQALTPTTDPNYGTLKNLDADIFTKNAPAKPAAAPKAGPAPHGGGGQALTPTTDPNYGTLKNLDADIFTKNAPAKPAAAPKAGPAPHGGGGQALTPTTDPNYGTLQNLDAEIFVKK

SEQ ID NO: 120713 - protein, 341 aa, Heterodera glycines
  Coding regions on vcDNA: vcDNA=SeqID_47136; Strand=-; Position=1 -118,167-202,259-384,447-518,585-656,710-844,900-1034,1090-1224,1280 -1414,1469-1530
  Homolog annotation: Hit_ID=NP_492537.1; Match level="QueryCoverage =90%, HitCoverage=89%, E-value=1e-31, Identity=35%"; Hit description =putative protein family member (1K150) [Caenorhabditis elegans] emb|CAB02815.1| Hypothetical protein C36F
  Essential gene: C elegans homolog=F27C1.3; Phenotype=Lva
PKAGAAVPTPQTSAVGGPPGAAEAPSSVKSSEKSGGSKKGPAPKKGAAAKKGPPAAAAKKPSPKGKAPPPQKKSGKGSAKGPMPPAASKELVPQSEPNYGTLVGLDKEIFAKEQQAKGGMPPPPMGAPQPQQQAPGPAMTPTTDPNYGTLKNLDADIFTKNAPAKPAAAPKAGPAPHGGGGQALTPTTDPNYGTLKNLDADIFTKNAPAKPAAAPKAGPAPHGGGGQALTPTTDPNYGTLKNLDADIFTKNAPAKPAAAPKAGPAPHGGGGQALTPTTDPNYGTLKNLDADIFTKNAPAKPAAAPKAGPAPHGGGGQALTPTTDPNYGTLQNLDAEIFVKK

SEQ ID NO: 120714 - protein, 443 aa, Heterodera glycines
  Coding regions on vcDNA: vcDNA=SeqID_47137; Strand=-; Position=1 -330,377-1378
  Homolog annotation: Hit_ID=NP_508269.1; Match level="QueryCoverage =95%, HitCoverage=64%, E-value=1e-42, Identity=25%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTCAKRISQQSALAFNSALNIFAVPPTNVSVARSFFRELLPLSTISQEGPYLFRMYNDSLWADLSRVYLYLELSVEKANAQGIMEPIDSVVDKEVGVCQSIGQTFVQQLKVEVQNMELYDSGTLYPFKAYISNELSFPANAKSHFMASNGYYVSRTHDDANDDGFKKRCARFSGGCKAEFISRLDFDLGNQELYLLNNMDVLFTIYRSKDAFLVHSLGAGAAGTSYALRVHDIKLYVKVIEVQPSLNISIYKTLEKQPATYAVRRTEVKSCFLTAGRTEMDHNIFSAAIPRRLTIALVANRAFNGAYAHTPFNFRPYDIRAISVHAGGNTYPAIPHRMNFVGAAYVRPFVDMYEALGMANSERSMDITLEQFRDGWTFFVVPMTSTLDDSCGFELLRSGTTSVRLQFNREIPQGGVEMICLGEFDQLIMIDYNRHIVTDSKIA

SEQ ID NO: 120715 - protein, 493 aa, Heterodera glycines
  Coding regions on vcDNA: vcDNA=SeqID_47138; Strand=-; Position=1 -67,111-216,262-435,481-594,637-766,811-894,937-1054,1106-1159,1204 -1337,1471-1607
  Homolog annotation: Hit_ID=CAE58368.1; Match level="QueryCoverage =99%, HitCoverage=65%, E-value=1e-101, Identity=46%"; Hit description= Hypothetical protein CBG01494 [Caenorhabditis briggsae]
  Essential gene: C elegans homolog=F25G6.6; Phenotype=Gro,Unc
RISQFFQIPSIVNYSISAFDAKAIIRKLLVEAVEKRLMAIIRKLLVEAVEKRLMGNRQFGFMLSGGLDSSLIAALATRFLATRFLRASPIAFSVGFEDSPDLVNARKVAEYLGICHRVLVISARECVEAIPEVVFSLETFDPLVVVFSLETFDPLVVRCGVAHFLLCKHIAASSEVKVLLSGEGADELFGSYAYMQRAPSAPKVLLSGEGADELFGSYAYMQRAPSAPLLQREIVRRLRLLHQYDVLRCDRCTSCHGLEIRVPFLDKKFVSFVCDRCTSCHGLEIRVPFLDKKFVSFVAQLPPSFKLIPGKTEKFLLRNAFQNLAQLPPSFKLIPGKTEKFLLRNAFQNLLPGEVLWRSKEGFSEALGKVDLGVDLGELLGKHAEGLIGVKNFANRTMLFPLQNFANRTMLFPLQTPQTKEEFWYRMIFEQRFNLRKLNNVIHTKVYRQRKWRRKQRKPPPIGRGKKGREEKQERKGEEKRIRRRSTGSAKLA

SEQ ID NO: 120716 - protein, 480 aa, Heterodera glycines
  misc_feature (64)..(64): Xaa can be any naturally occurring amino acid
  misc_feature (475)..(475): Xaa can be any naturally occurring amino acid
  Coding regions on vcDNA: vcDNA=SeqID_47139; Strand=-; Position=1-1474
  Homolog annotation: Hit_ID=NP_510671.1; Match level="QueryCoverage =85%, HitCoverage=43%, E-value=1e-68, Identity=35%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
LLQIFNKKRLVFGISRLNLYGFSFKKIKYVLIKTMSNHIFSIGNPRVYKKKIQNNLISVEGLNXGKEEGKVKETPLGHLHTWAMLLRIYNNKISESQFGFVRNRSTTNQLITVVEDWYEAIINKNVDCIYIDFQKAFDSVPHNLLLDKLKKIGIQGKLLNWIKSFLSNRTFRVKIGDTLSSVKKVGSGVPQGSVLGPLLFLIYINDLPDVIPSGVNIKLYADDVKISRADTEIMHKTLHNLFEWANKWQIKVSIQKTFVLYLGSKNPKETYKFDGNTINAVDTIRDLGVNIDNKLQFSDHVNQITRNAYLRMRSLFRIIKSKSSKIWITLYKTYIRPLLEYAPEVWNPSLQKNIKKIEKCQKYFTKRVFFKCNLPPIPYQNRLEYLQLPTLENRRNLFDLFMAHKIVYGRTDLKLFSIFRPSTRFNIPFYRFNTKYKLGKNPFAGRATKLWNQLDKELIKTNSFNLFKNKIKNSXVMLMI

SEQ ID NO: 120717 - protein, 153 aa, Heterodera glycines
  misc_feature (146)..(146): Xaa can be any naturally occurring amino acid
  Coding regions on vcDNA: vcDNA=SeqID_47140; Strand=-; Position=1 -109,191-436,544-653
  Homolog annotation: Hit_ID=CAE70049.1; Match level="QueryCoverage =85%, HitCoverage=42%, E-value=1e-29, Identity=50%"; Hit description =Hypothetical protein CBG16481 [Caenorhabditis briggsae]
  Essential gene: C elegans homolog=F57B9.4a; Phenotype=Age,Unclassified
FSRRFESDRSYSVVPLFNGSRIHSYLKLIRADKPIGTWLLYWPCAWSIAFAAPPGCLPSPYFLALFGGGAFLMRSAGCILNDLWDQDIDKRVSSYSSNQIGIGLSSYSFSKSVTRNTLSSIFFIWIQISNYSAFSSSVFKTMHYNXAQAYVME

SEQ ID NO: 120718 - protein, 74 aa, Heterodera glycines
  Coding regions on vcDNA: vcDNA=SeqID_47141; Strand=-; Position=1 -93,141-269
  Homolog annotation: Hit_ID=CAE64608.1; Match level="QueryCoverage =86%, HitCoverage=10%, E-value=3e-09, Identity=46%"; Hit description =Hypothetical protein CBG09364 [Caenorhabditis briggsae]
  Essential gene: C elegans homolog=CD4.4; Phenotype=Emb,Lva,Unc
MSKLRNYTEDQLQNLLQDESRLNAMVDSMPQVSSLPNDKEIKLAQSKSLAEYNLSIEPQLNKALSHLRETHANA

SEQ ID NO: 120719 - protein, 573 aa, Heterodera glycines
  misc_feature (5)..(5): Xaa can be any naturally occurring amino acid
  Coding regions on vcDNA: vcDNA=SeqID_47142; Strand=-; Position=1 -123,295-382,438-605,692-742,792-946,1014-1169,1264-1411,1527 -1577,1622-1753,1798-1946,2073-2294
  Homolog annotation: Hit_ID=NP_000169.1; Match level="QueryCoverage =98%, HitCoverage=97%, E-value=4e-62, Identity=31%"; Hit description =glutathione synthetase [Homo sapiens] emb|CAB93423.1| GSS [Homo sapiens] gb|AAH07927.1| Glutathione synth
  Essential gene: C elegans homolog=M176.2; Phenotype=Emb,Lva
IQSNXLITQRERCRLETIVQEAVDWAHTVSLVNRVKDQLERSDVVEIVPFALFPSPFPRRLFEEAKAVQKTFQLLYFRVSQNYEFLKRTTFQLLYFRVSQNYEFLKRTLGEAGKGDAYIGHLLDILDDVQQRGNKQPISLILQRADYMCHLNADGEYELKQVEVNMGAIGGNARTEGVSKVHLKQVEVNMGAIGGNARTEGVSKVHRRVFSKLGLSANLPPNESCAGAAEALVKAWKQFNDKQFNDPLSVIVFMSYTKVQSIFDQRLVQYEIAGNKIEIVRLTLQECGEKLLILDPNDSSLSYKGRKVAIIYQRNFLFEKDWQTEKEWDIRRKLERSNAILTTNVRIDLAGTKKVQQTLALPGMLEHFLPDQKAETIAAVQQTLALPGMLEHFLPDQKAETIAAVRKTFAGLWGLDKDDKETRAIIEAIEKPERFVLKTNRDGGGNNFWDIIEAIEKPERFVLKTNRDGGGNNFWDEQLADKLRTMTRKERGGLILMEKLEIEIIELIGDKPINGSFPFQLTSELGIVGYFLGNAKTMVDNVQRGHMLRSKAAEAREGGVGIGIGLHDSPYLF

SEQ ID NO: 120720 - protein, 271 aa, Heterodera glycines
  Coding regions on vcDNA: vcDNA=SeqID_47143; Strand=+; Position=1 -471,514-736,1072-1193
  Homolog annotation: Hit_ID=NP_499926.1; Match level="QueryCoverage =56%, HitCoverage=16%, E-value=3e-12, Identity=30%"; Hit description =abnormal DAuer Formation DAF-18, PTEN phosphatidylinositol 3' phosphatase, regulates dauer formation and
  Essential gene: C elegans homolog=T07A9.6; Phenotype=Rup
MESRNWQSQDGEEHPHKTHQSGCRASLDIVTITSGDANTDSEWVEEIVVERPPGLAAHCPEESLKRIFPNDKQAPRYGIEEMIRDAFHKNLISDAYNTRRMSQARGVGQPIPKAPIGRPNANGPSCLMRRPDEHVSVFGVQEIDRAYKNKDMDTAFKLFIVTRCIDESNEKNVLLAEQHIAATRQKQAQKDKEKSNKMEQRQRKLGPTSSATAQSVGHLDSGSLTLADSPHVVHYVHLTRAFVPNLLVMAPLIQSEMANHRCFNNEEIMRM

SEQ ID NO: 120721 - protein, 269 aa, Heterodera glycines
  misc_feature (266)..(266): Xaa can be any naturally occurring amino acid
  Coding regions on vcDNA: vcDNA=SeqID_47144; Strand=-; Position=1 -106,170-204,532-567,628-723,783-835,1012-1217,1443-1561,2294-2372
  Homolog annotation: Hit_ID=NP_505843.1; Match level="QueryCoverage =97%, HitCoverage=71%, E-value=4e-85, Identity=60%"; Hit description =putative N-myristoylated protein family member, with at least 4 transmembrane domains (5L674) [Caenorhabd
  Essential gene: C elegans homolog=K10D6.2a; Phenotype=Emb
MPSTAIQKLLLAVSIFLIIAGIVLTVAGVFSPAWQVVDIREFRVDIREFRAEHQHGLWWDCIRAEKHVVAVGDFYEEAPLHHVVAVGDFYEEAPLHCMYKFDESAALVIERALNHVNHVDEDGAAGEAEHHRFWGWHKVVLSLILLSQLAAFVAVCTGVCAPCFAPSTFCFAISLFIAMLLSVLADGIFFFSANRVDIRFVTGEQVIGYAFYLHLGGTLCWAFAFVCAIATTYKFLTSNGQQRIRSFILPFSLQTQKLSLRFLLFXLFI

SEQ ID NO: 120722 - protein, 441 aa, Heterodera glycines
  misc_feature (63)..(63): Xaa can be any naturally occurring amino acid
  misc_feature (434)..(434): Xaa can be any naturally occurring amino acid
  Coding regions on vcDNA: vcDNA=SeqID_47145; Strand=+; Position=1 -153,1193-1519,1575-1724,1772-1818,1864-2028,2720-3062,3590-3647
  Homolog annotation: Hit_ID=XP_394802.1; Match level="QueryCoverage =98%, HitCoverage=88%, E-value=1e-45, Identity=30%"; Hit description =similar to Drosophila cyclin E type I [Apis mellifera]
  Essential gene: C elegans homolog=C37A2.4a; Phenotype=Emb
NPSRRDWGKCGRNIRLGHLLSRKPSKHKATHKEHHSDQIGTHSSEKCVNLLEIRFLECFHPFXPIVSLSKLDIGPRRGRKEPLTLPHSSSSDLGSPQKVLNLNNLNAYNKIIIIASTNKVWSLLCEKDEKRRDPHVFSRQKKINAKMRAMLLDWLMDVCADKQLHRETFVCADKQLHRETFHLCIDYIDRFIALNHQMQPQRLQLFGSTALVIASKVEEIYPPKEIYPPKIAEIAEYTDGCCSEADIRGIEEIMLCCSEADIRGIEEIMLEKLDWTCYPVTAVHWLALFMQLMNTDEVIPAQRVVISAGWYSFVVMFQILDLAMLDSGCLRFRYSELATAVVLCCYARTFDLPTHRCRPDRLIALHKYFFPLGFSPEKVRDARAYIEPFVRVFDLSEPTGTAIPCPDVPHGDRHNIQTYTSKSRMTEKKNEWVXTDIKSTN

SEQ ID NO: 120723 - protein, 93 aa, Heterodera glycines
  Coding regions on vcDNA: vcDNA=SeqID_47146; Strand=-; Position=1 -178,466-569
  Homolog annotation: Hit_ID=CAE65135.1; Match level="QueryCoverage =94%, HitCoverage=45%, E-value=3e-17, Identity=57%"; Hit description =Hypothetical protein CBG10001 [Caenorhabditis briggsae]
  Essential gene: C elegans homolog=R10E11.8; Phenotype=Ste
MSGDNSALIAAEQAAYGPFFGSLGVTAAMIFTAAGSAYGTAKSGKFFPRGRGRVGILKICTGIACMAVARPDLVMKAIIPGTLCIFCLPIMSI

SEQ ID NO: 120724 - protein, 678 aa, Heterodera glycines
  Coding regions on vcDNA: vcDNA=SeqID_47147; Strand=-; Position=1 -490,644-922,1105-2372
  Homolog annotation: Hit_ID=NP_508269.1; Match level="QueryCoverage =64%, HitCoverage=66%, E-value=1e-46, Identity=27%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MGASKPIEEEIEGVKTRGESLKDLIVSKQIETVLFKYLKERRKFSIDFNDQRIDFIELSAQLGYILGFEDPTKILSGAIAKYYCDLKGGIDSLCVYINGITENVIVGDQLASLLRIVVVEGKFGDVIEKIYNTPMYIKVVVKEINEIEIEIRTREGRLIPFQWVEQIGSGEAFNYFRGIPPYQRGYGRQRGGGVGDVLRFLWRALLPKLKSAGTLLGREALDTGTRVLDTIEKAETPNKQVIINEVKKGMDNVLEKALSIFTLPPTNVSVSSSSVREYLPLNPLTDIPFHFKIHPTASFFDLNKCYILTEMSIKKLDSYTNKYVNLKVNEQAATINMIGATWIKNLKITVQGREIYDSNSLYAYKAYLDAELSYSKNVKESDLQASGYYVDSENQDGTDITQQGFELRRKLFSQSQTAQFITKLDADIFNQDRYMVNGVEIDIQLTPNDNEFMVMAASDDKYRIEITACKLYVKTLEVVDGLALDIQKKLESKEAKYAHRKTLIKSTFISENRTEYNGTLFTGQLPKRVIIGMVENAAYVGNQKKSPFNFKPFDVRSVTLMANGKQWPAAPFELNFNKNLYTRAFHEMNEALGMASSTDSNGISLEKYRKGWTIFAFNMTNSMEDNEGIDLITEGTTTVCIQFRSPVPSGGITLIAMSEMDSILILDKNRTVMTDNTI

SEQ ID NO: 120725 - protein, 790 aa, Heterodera glycines
  Coding regions on vcDNA: vcDNA=SeqID_47148; Strand=-; Position=1 -1083,1168-1540,1694-1972,2154-2789
  Homolog annotation: Hit_ID=NP_502799.1; Match level="QueryCoverage =57%, HitCoverage=70%, E-value=6e-17, Identity=22%"; Hit description =putative nuclear protein, with 2 coiled coil-4 domains (4P607) [Caenorhabditis elegans] emb|CAB16521.1| H
  Essential gene: C elegans homolog=F19G12.2; Phenotype=Unclassified
MKKYQGVTDGRTIQALNEEALRMRTAMKHRRKNLNAFNKAVLKKDLQISAEEYERTSYEQNKDYVEPFFDSHPTDYWEHIHKKYEGLQDDYKKIRELREQQQFLTDEQKKQSIQDEIDQLRRLVDYRKKRFAALEYEAKKRDALQQQPMALALTHGEALKERIGKIEGTTTTADGEETKTHGKSLVELIEQVQKERDDSKAKTEGKTRGEILGDKLKAKIDEQDSSADGATHGEVLKNKPETTIGEKVMTRGEILGEKLKSKDEEKKEERITHGEALKNRIEQIPEEEKTKGKTRGEILKEKIGASKPIEEEKTEGKTRGEILKEKIGASKPIEEEKTEGKTRGEILKEKIGASKPIEEEIERRKFSIDFNDQRIDFIELSAQLGYILGFEDPTKILSGAIAKYYCDLKGGIDSLCVYINGITENVIVGDQLASLLRIVVVEGKFGDVIEKIYNTPMYIKVAVKEINEIEIEIRTREGRLIPFQWVEQIGSGEAFNYFRGIPPYQRGYGRQRGGGVGDVLRFLWRALLPKLKSAGTLLGREALDTGTRVLDTIEKAETPNKQAIINEVKKGMDNVLEKALSIFTLPPTNVSVSSSSVREYLPLNPLTDIPFHFKIHPTASFFDLNKCYILTEMSIKKLDSDTNKYVNLKVNEQAATINMIGATWIKNLKITVQGREIYDSNSLYAYKAYLDAELSYSKNVKESDLQASGYYVDSENQDGTDITHGGFELRRKLFSQSQTAQFITKLDADIFNQDRYMVNGVEIDIQLTPNDNEFMVMAASDDKYKIEITA

SEQ ID NO: 120726 - protein, 413 aa, Heterodera glycines
  Coding regions on vcDNA: vcDNA=SeqID_47149; Strand=-; Position=1 -22,295-423,481-625,653-762,824-1102,1159-1441,2501-2577
  Homolog annotation: Hit_ID=CAE68896.1; Match level="QueryCoverage =99%, HitCoverage=35%, E-value=3e-61, Identity=36%"; Hit description =Hypothetical protein CBG14867 [Caenorhabditis briggsae]
  Essential gene: C elegans homolog=K07A12.2; Phenotype=Emb
NCALKCFSEPLVKFATGATPSSSDVGKMLSSIPDLVVNIPGFGTMDASKLHPSLVLHPSLVEHVLKGGQIPGIPKETLDHIVKQYMQRLYVAASNLQGRPTTESTKLLRPISELPNEMVEKVVQNKPLPHLTTESTKLLRPISELPNEMVEKVVQNKPLPHLTQEQTEVIKQYYMQQMPSSQYYMQQMPSSSGGDIGKTFGIAVNGNASEPLNLTGLLPPKVFQMMKLLPPNYNLSKLPPELTQQVMRGEMPDLTKLPLDLQQWIKDNFDRLVATFFPFVQPDLSIDEIMKKLTFFPFVQPDLSIDEIMKKLPTFEHPPMSTFSPYDINKVDADLVVQQRNEEEANHRFWRIFAASALALAGAVTLGVLSAFFWYLKRSRRLADPPMEAAQFAAAPAALHLAVASSATEGPSS

SEQ ID NO: 120727 - protein, 85 aa, Heterodera glycines
  Coding regions on vcDNA: vcDNA=SeqID_47150; Strand=+; Position=1 -93,151-180,313-405,542-583
  Homolog annotation: Hit_ID=CAE69086.1; Match level="QueryCoverage =94%, HitCoverage=98%, E-value=6e-16, Identity=49%"; Hit description =Hypothetical protein CBG15104 [Caenorhabditis briggsae] emb|CAE74544.1| Hypothetical protein CBG22301 [Cae
  Essential gene: C elegans homolog=K12C11.2; Phenotype =Dpy,Emb,Gro,Pvl,Stp
MADESATNAGGAGAAGGAQPAEYIKLKVVDQDSNAERTGVQVTSLRFLFDGRSVKDDHTPRSLEIEDDNIIEVYQGQIVGSILDD

SEQ ID NO: 120728 - protein, 85 aa, Heterodera glycines
  Coding regions on vcDNA: vcDNA=SeqID_47151; Strand=-; Position=1 -204,253-304
  Essential gene: C elegans homolog=F55A11.4; Phenotype=Emb
MVIKSNSVISRSHSDHFQEASGSLSATSGSEDAIKHWGWWRHFVAGATAGCVSRSVTAPLDRLKVFLQVNANHKTPHTLPSAVDY

SEQ ID NO: 120729 - protein, 297 aa, Heterodera glycines
  misc_feature (253)..(253): Xaa can be any naturally occurring amino acid
  misc_feature (263)..(263): Xaa can be any naturally occurring amino acid
  misc_feature (276)..(276): Xaa can be any naturally occurring amino acid
  Coding regions on vcDNA: vcDNA=SeqID_47152; Strand=+; Position=1 -140,277-347,435-555,628-808,866-980,1091-1339
  Homolog annotation: Hit_ID=NP_509674.1; Match level="QueryCoverage =97%, HitCoverage=28%, E-value=3e-93, Identity=60%"; Hit description =metabotropic GLutamate receptor subunit (mgl-1) [Caenorhabditis elegans] emb|CAA87374.1| Hypothetical pro
  Essential gene: C elegans homolog=ZC506.4; Phenotype=Gro
HSQTPVVKASGRELSYVLLFSCLLCYSMTFVLLSKPSWTVCTIRRTGIGLAFSCLYSALLVKTNRIHRIFATRTRATRTRRAPPLISPISQLLLTSAFIGSKMIFSLVWLIIQPPGTRHFHPTRAEVVLTCIVPDHHFLYSLAYESLLLIMCTVYAVKTRKVPENFNETRYIGFCMYYTTCVLWGCLILFFFGTGSDFQLRTTALCMSTSMSANVALVCIFSPKIYVILFEKDKNVRKEGSGSMLNKKMGSRXAKNDHSSIGXSGVINALIRDGDXGRSGGDWAIPLITFSYYANNL

SEQ ID NO: 120730 - protein, 259 aa, Heterodera glycines
  Coding regions on vcDNA: vcDNA=SeqID_47153; Strand=-; Position=1 -255,330-722,767-895
  Homolog annotation: Hit_ID=NP_509479.1; Match level="QueryCoverage =98%, HitCoverage=48%, E-value=1e-64, Identity=52%"; Hit description =troponin T (tnt-2) [Caenorhabditis elegans] pir||T16441 hypothetical protein F53A9.10 - Caenorhabditis el
  Essential gene: C elegans homolog=F53A9.10a; Phenotype=Gro,Slu
MPTTQEERKAKSEANKAKREEEKRKRQNMMAGAFVGGFGEEKPSGRNFVVQKREEGSDALGQNAESGGGPKLRGGPNKAQQQEAKRNYMSIVNRPVDVSNMLPNDIKAKIKQLHARIVKLEGEKYDLEKQNERQQYDVGIGTQINANRFGPPLLIQLKELGERQKQFARQKALESGMDPSEMEENSSLPPKVRVASKFDRQTDRRGYGERRNKFEHPPPKPEPKIAHGSGRPPPEWGRKELEELENIRKNLEPPKYQEQ

SEQ ID NO: 120731 - protein, 131 aa, Heterodera glycines
  Coding regions on vcDNA: vcDNA=SeqID_47154; Strand=-; Position=1 -187,228-437
  Homolog annotation: Hit_ID=XP_417190.1; Match level="QueryCoverage =98%, HitCoverage=52%, E-value=2e-40, Identity=62%"; Hit description =PREDICTED: similar to hypothetical protein [Gallus gallus]
  Essential gene: C elegans homolog=T10C6.5; Phenotype=Emb
VEDTSSARNLDADEPFDELNEDDTDLDEDSDNEAELMAELERIRKERAAERASKEAKEREEQERIREENILHGNPLLNPASSEFKVKRRWDDDVVFKNCARGIDERKKTPSFINDAIRSEFHRKFMEKYIK

SEQ ID NO: 120732 - protein, 504 aa, Heterodera glycines
  misc_feature (498)..(498): Xaa can be any naturally occurring amino acid
  Coding regions on vcDNA: vcDNA=SeqID_47155; Strand=-; Position=1 -62,104-137,181-225,350-486,534-633,680-772,825-933,1131-1282,1393 -1436,1501-1612,1666-1767,1820-1946,2029-2155
  Homolog annotation: Hit_ID=NP_501695.1; Match level="QueryCoverage =98%, HitCoverage=62%, E-value=1e-136, Identity=37%"; Hit description= FiBuLin, extracellular matrix protein (77.0 kD) (fbl-1) [Caenorhabditis elegans] emb|CAC35817.1| Hypothe
  Essential gene: C elegans homolog=ZK783.1; Phenotype=Gro,Lvl,Unc
VDECLLLVDDCAETQRCLNTPGGFKCIRTQSCPGGFKCIRTQSCGTGYAMDSETEGTGYAMDSETEQCVDVDECALGAHDCGPMYQCRNTQGSFRCVPKRCAADEAMDPNSGECKSVNCPVGYKAIDGRSVNCPVGYKAIDGRCEDIDECREARHCAIFEECVNTPGVNTPGSFRCQEQGNVWSNGYHMDKDSGFCLDTDECARKTHSCETDEQTDECARKTHSCETDEQCTNLPGTYRCNCGAGFEFNDFARRCEDVDECVKFGAHACSLQAQCVNTFGSHECLCGPGFKLGADNRSCDDIDECASGVARCQQKCINSPGSYQCICCINSPGSYQCICERGFQLGIDEVTCEDIDECAIWAKSGNDLCMGQCVNLPGSFANDLCMGQCVNLPGSFACTCPLGYEIMADGITCKDIDECQIDECQSENICAPGHLCINLLGNYRCQRIECPRNYFPDRNYKNRCVKRPGFCENLLLERCKKLPIHISWQNITIPKVNXREKGKR

SEQ ID NO: 120733 - protein, 113 aa, Heterodera glycines
  Coding regions on vcDNA: vcDNA=SeqID_47156; Strand=+; Position=1 -130,185-396
  Homolog annotation: Hit_ID=NP_741382.1; Match level="QueryCoverage =87%, HitCoverage=21%, E-value=3e-14, Identity=46%"; Hit description =tYrosinyl tRNA Synthetase (50.1 kD) (yrs-1) [Caenorhabditis elegans] gb|AAB09162.2| Tyrosinyl trna synthe
  Essential gene: C elegans homolog=K08F11.4a; Phenotype=Lva
MLYQNLRKIVPSADSQPLSSFIHDLLRRKLLSCTHPEFPYKQQDITAYSSTLPNVLYAGVDPTADSLHLGNLLVLNSLIRASFFGCSPILLIGKATASVGDPSGHKRGARQNI

SEQ ID NO: 120734 - protein, 224 aa, Heterodera glycines
  Coding regions on vcDNA: vcDNA=SeqID_47157; Strand=-; Position=1 -26,573-867,1482-1530,1615-1678,2218-2341,3246-3364
  Homolog annotation: Hit_ID=CAE60354.1; Match level="QueryCoverage =94%, HitCoverage=47%, E-value=7e-53, Identity=51%"; Hit description =Hypothetical protein CBG03950 [Caenorhabditis briggsae]
  Essential gene: C elegans homolog=F54D7.2; Phenotype=Gro
SWFLRFILKNFSKKFFFFQFYPRWLAPNVLTFAGALIVMCCYGLVVCFDPGLSANSATGPAELNIPRWVWLVCGVGTFLAHLLDGTDGKQARRVGASGPTGELCKYAYLIFAFPTFRVDHGFDSWSTVPFTITIFSLFGRGQFSVEPLTLLSVLIAVQLVFIASHWEKYNTGVLFLSWGYDASQYPLSSVFHWFSVPTVVNFFTIFRIHLFDAHSPAVNWCCTN

SEQ ID NO: 120735 - protein, 723 aa, Heterodera glycines
  misc_feature (14)..(14): Xaa can be any naturally occurring amino acid
  Coding regions on vcDNA: vcDNA=SeqID_47158; Strand=-; Position=1 -70,665-752,802-935,989-1151,1212-1346,1690-1761,1817-1928,1982 -2066,2119-2223,2503-2662,2713-2788,2853-2962,3038-3141,3196 -3220,3281-3392,3610-3900
  Homolog annotation: Hit_ID=NP_741052.1; Match level="QueryCoverage =97%, HitCoverage=68%, E-value=0.0, Identity=51%"; Hit description =voltage gated CLC-type chloride channel subunit, epidermal, regulator of osmolarity (97.3 kD) (clh-1) [Caen
  Essential gene: C elegans homolog=B0491.8a; Phenotype=Emb,Sck,Ste
LRIDRKFFQKIYPXESTRKFQKYSGFVSWVGFLVVFVGAAALVCKYVSAQAIGSGIPEIKVIMSGIPEIKVIMNGFMLQNYLSFRTLVAKMLSLTLTLGSGLPVGKEGPFVHMGAGPFVHMGAIVGTLLSKVTRAWQSSAFFSNEGREFEILSSGCSVGIACTFSSPAGAVLYGIECTHKYFAVLYGIECTHKYFAVKNYWRAFFATTCAALIFRFANAVIIPPHIAGTITAYYQTSFPNEVFLVEEIPVFVLVGLLSGLFGALLVGLLSGLFGALFVVVHRRIAYFKRRNRTFRAIFGKNSMSFTIFMALIVGIVTFSMSFTIFMALIVGIVTFPDGFGRFIAGKYTFRETLGDFISYTFRETLGDFISNCTMTLYNVTSMGCGGKVIQRWTGQCSSLLPFPLPNLFFHFQFFLVAICITLALPAGIFVPSFVIGACGGRIIGELMVVVFPEGIRGSDGMVVVFPEGIRGSDGPQIYPGLYAVVGAAAYTGAAAYTGAVTHSLSIAVIVCETTGQLCALLPVLVALMVANAVVANAVSSFLQPSIYESIINIRKLPHLAELPPSRISVHTLKVEQVHTLKVEQIMVRIMVRDVVFVTKLTTYKELRELLICTPHLRSYPLVTDEEERILLGSVARKYLHYLLTSHLGPDPALLLHGSRRRKSRTMSGFSEGTFHRNPTPNNTLATTAVPANYKMSMINDRNLFGNTLLSISPLHDDQSSELG

SEQ ID NO: 120736 - protein, 226 aa, Heterodera glycines
  Coding regions on vcDNA: vcDNA=SeqID_47159; Strand=-; Position=1 -327,888-1033,1937-2144
  Homolog annotation: Hit_ID=NP_491672.1; Match level="QueryCoverage =69%, HitCoverage=65%, E-value=8e-39, Identity=74%"; Hit description =proteasome Regulatory Particle, ATPase-like, S6a (48.1 kD) (rpt-5) [Caenorhabditis elegans] gb|AAC19196.1
  Essential gene: C elegans homolog=F56H1.4; Phenotype=Emb
MSLNFWILKSNRKRKEQTLTLMPTKPKCAVIKTSTRATYFLPVVGLVDPEEMKPSDLVGVNKDSYLILEKLPPEYDSRVKAMEVDERPKETYSDIGGCDSQIRELVEAIVIAATNRVDVLDPALLRSGRLDRKIELPAPNEKARAHIVRIHSRNMNVDTGHNYIMAATDYDALQNWISVLTSCSFEFMEATRQSLESVEEKGTEKEEKEGEKSEESTEKGGTEKND

SEQ ID NO: 120737 - protein, 379 aa, Heterodera glycines
  Coding regions on vcDNA: vcDNA=SeqID_47160; Strand=-; Position=1 -217,466-627,889-1115,1319-1603,1999-2083,2289-2453
  Homolog annotation: Hit_ID=NP_741768.1; Match level="QueryCoverage =53%, HitCoverage=41%, E-value=8e-23, Identity=29%"; Hit description =Platelet-Activating Factor acetylhydrolase (43.4 kD) (paf-2) [Caenorhabditis elegans] gb|AAL65779.1| Paf-
  Essential gene: C elegans homolog=C52B9.7a; Phenotype=Emb,Ste,Stp
DGSCYWTYTLEQVLSPTPPPSPPLPTAVEGTPQQQNGPVPIGEKLTTDNNNERQIGQQQILLGQTFDWAQFKNRLALDRCVCMGHSFGAASSLSACAEYPSLFNACVLLDAWLYPVERRMYPATVQPVLMLNASKWQWPHNVRRMQRLLAKATTATNDDKTATETTTTTAPQQQSQDGAATTAATAQPSVTNTDSRMMFTIKGIVHQSFSDFGFLVPGRVARYIGVQSDLDPLLTGTAVFEMVLQFLESQFLHQQQQKEDEEDTEDEEGEEDESEEEEKEEEGEKESKEREEEGKAINASALDRLRRLVAEKYAAFVVEGTDIPQAKLDEVAPLVEAEQQQAVSAEEERKVANDSGVDTPPTTETTTEEAAENNNQPSI

SEQ ID NO: 120738 - protein, 95 aa, Heterodera glycines
  Coding regions on vcDNA: vcDNA=SeqID_47161; Strand=+; Position=1 -17,363-539,996-1088
  Homolog annotation: Hit_ID=XP_415288.1; Match level="QueryCoverage =100%, HitCoverage=3%, E-value=4e-28, Identity=63%"; Hit description =PREDICTED: similar to DNA polymerase epsilon, catalytic subunit A (DNA polymerase II subunit A) [Gallus g
  Essential gene: C elegans homolog=F33H2.5; Phenotype=Emb
FIFVRATLLFWHPSQVLRKGSGTLCEALLMVQAQRSNIIFPNKQTAKEQRMTDAGHLILSDTYVGGHVEAVESGVFRADIPCRFKLDVEALAQLV

SEQ ID NO: 120739 - protein, 421 aa, Heterodera glycines
  misc_feature (23)..(23): Xaa can be any naturally occurring amino acid
  misc_feature (38)..(38): Xaa can be any naturally occurring amino acid
  Coding regions on vcDNA: vcDNA=SeqID_47162; Strand=+; Position=1 -270,363-517,576-722,1022-1176,1227-1319,1374-1470,1520-1568,1621-1716
  Homolog annotation: Hit_ID=NP_871868.1; Match level="QueryCoverage =84%, HitCoverage=53%, E-value=2e-70, Identity=44%"; Hit description =lipolytic enzyme, G-D-S-L family (1J397) [Caenorhabditis elegans] emb|CAD56582.1| Hypothetical protein F3
  Essential gene: C elegans homolog=T19D7.7; Phenotype=Dpy,Unc
IRNNNLILVKANRNNDHATKGNXLDSKRWKINFLHRFXKDYADNSSQTAERINSHINKHLTSHENEESDTSEDEEEEEEDQGDSDVSEERNNPEDLINSELSAVKLPDSEQQRPDDAVSIINSAFSNRKSFSCPKTKSDLLTGTSTANLSPEDTSTANLSPEDIGIIASMGDSLATGAGLWPRTDIEFRGAAFPIGGDATIDGLVTVPNILREFIDSNLLFGVSHGMGQRDQLPENQLNVAVSGASSSSMPGQAVELVRRMKRLRELAVELVRRMKRLRELDVFNTWALIIVTIGTEEVCKNCVCKNCTGPNTKALVQALDILNRGIHKALVILLGPIHVTSLYQQKFNLLPIHVTSLYQQKFNLLKTRCLCSQNKDDKFMSALSEEWVKTRCLCSQNKDDKFMSALSEEWVKAFEEIQTH

SEQ ID NO: 120740 - protein, 320 aa, Heterodera glycines
  Coding regions on vcDNA: vcDNA=SeqID_47163; Strand=+; Position=1 -488,734-1208
  Homolog annotation: Hit_ID=NP_508269.1; Match level="QueryCoverage =47%, HitCoverage=23%, E-value=3e-21, Identity=34%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTCLQKISDSSPLAINSGLNIFSVPPTNVSVVRSFFRQVLPLATITQESPYLFRLYSDNLWTDLSRIYLYLELSIEKPGANDKWVAIEDADTSVSAIQGIGQTFVQQLKVTVGNTEVYDSGNLYPFKAYITNELSFPINAKKNFLGSTGYYHTVNQDDSTDEGATIPRRVTIALVGNSAFHGDYKLSPFMFEPFDLREISVHAGGVVYPAVPYKLNFSNDHFVTAFVDMYEALGMANSERSFDISMAQFKKGWTFFVIRMTSTLDDSCGFELLRSGTTNVRATFNSPIPLGGVEMIVLGEFDQMIMVDYNRHIVTDSKLG

SEQ ID NO: 120741 - protein, 224 aa, Heterodera glycines
  Coding regions on vcDNA: vcDNA=SeqID_47164; Strand=-; Position=1 -132,204-333,380-436,489-593,647-796
  Homolog annotation: Hit_ID=NP_490765.1; Match level="QueryCoverage =96%, HitCoverage=41%, E-value=3e-39, Identity=41%"; Hit description =HIV Tat specific factor 1 (51.8 kD) (1B131) [Caenorhabditis elegans] gb|AAK29956.1| Hypothetical protein
  Essential gene: C elegans homolog=Y65B4A.1; Phenotype=Dpy,Unc
HGTVLKSKVERAKFEMKGEFDRPKKRRRLTGAQKKRFFEKQQKIFEWIFEWKPEKPRNYRPPCECTLVLRGMFNLEEIDANAQRIFTLKEDTQKLDTQKLCERFGPVKKVTVYDTNPDGVVTVTNPDGVVTVTFDNVEHTDAAVQAIDGRIVAGRVVQAKHWDGKEKFKRAETAAKHWDGKEKFKRAETAQEKERRENAWEEFLGNDEDEKEMEEDKKETEEDK

SEQ ID NO: 120742 - protein, 101 aa, Heterodera glycines
  Coding regions on vcDNA: vcDNA=SeqID_47165; Strand=+; Position=1 -125,803-983
  Essential gene: C elegans homolog=T05H4.12; Phenotype=Ste
MAFRALSFARRPFTTSSICRKEIDLVAGVYLNKVREVVGKQSEILNSPQLKKELNDQLNRLAQKFHLPDADAVAKLGLQFKVRWYLGDLETKTFEQIGIVY

SEQ ID NO: 120743 - protein, 230 aa, Heterodera glycines
  misc_feature (9)..(9): Xaa can be any naturally occurring amino acid
  Coding regions on vcDNA: vcDNA=SeqID_47166; Strand=-; Position=1 -223,675-839,1017-1327
  Homolog annotation: Hit_ID=NP_501220.1; Match level="QueryCoverage =85%, HitCoverage=22%, E-value=2e-60, Identity=57%"; Hit description =aminopeptidase (100.0 kD) (4I310) [Caenorhabditis elegans] gb|AAB03152.1| Puromycin-sensitive aminopeptid
  Essential gene: C elegans homolog=F49E8.3; Phenotype=Emb
QGWRDAKPXLLMPHLIVLKTPSLGAMENWGLITARESSVLYDPAKSSSSHRQWLTTVMSHEVAHFWFGNLVTMKWWQDLWLKEGFACFMESLFTAKKYPEFKVWSTFVDNTVVRAMGMDSLRNSHPIEVPIENPNELDEIYDEVTYEKSCSVLRMLFNYLGESTFQKALRAYLKKHQYANADTDDLWHCMSEASDGTVRFSKNPLENYQNFFSLKFHKKFELKIINLKKL

SEQ ID NO: 120744 - protein, 157 aa, Heterodera glycines
  Coding regions on vcDNA: vcDNA=SeqID_47167; Strand=+; Position=1 -154,201-410,460-519
  Homolog annotation: Hit_ID=NP_506131.1; Match level="QueryCoverage =99%, HitCoverage=67%, E-value=6e-41, Identity=55%"; Hit description =ribosomal protein S11 (22.6 kD) (5M974) [Caenorhabditis elegans] emb|CAA99938.1| Hypothetical protein W04
  Essential gene: C elegans homolog=W04D2.5; Phenotype=Gro
LSMNTTEIDRHLPTAMTLLQPFDGVPFRELPVVHIKASSNNTIIHAFNFITRAIIYTSCRKERAIIYTSCRKEGFKNTKKKSPLAGQTTGVAAGQKLLRRGVSTVRVIIKGIGPGRISSVRGLALAGVNVVSISDVTISDVTPIPELGPRPKKIRRV

SEQ ID NO: 120745 - protein, 576 aa, Heterodera glycines
  Coding regions on vcDNA: vcDNA=SeqID_47168; Strand=+; Position=1 -267,360-530,608-798,972-1623,1793-1928,2435-2748
  Homolog annotation: Hit_ID=NP_494723.1; Match level="QueryCoverage =68%, HitCoverage=42%, E-value=1e-55, Identity=33%"; Hit description =NFkB activating protein like (2E417) [Caenorhabditis elegans] gb|AAC71118.1| Temporarily assigned gene na
  Essential gene: C elegans homolog=T08H4.1; Phenotype=Emb
MHSSSFTLPLRSNNSNSGGGSIMNLHQTSGSEDFGTRRSAITAGSAGGGGGSRQISVGSAGGPTISGTSTISAGSGMTTIGRKGIFFAREKLTFAHLEKIYAQAIANRSNDLSILELEAHWTNFVHINKLLNKRQSDQQEAIWEIITTERRYILQLQSLEDMEWCFVELQKQGFMRDVNRQCVFLNYSQLLRCNLAFWQCAIVPMLERSRQSHEPLNALLMQPGFDSIPDWSFCYIDFNIGHADSHAYVQKRQKDNEVFAEFVKWAEQHTMLNRQKLVDVLSSPMQRMTRYSLLLKAVQRCAADTEEKIGIQVRFVLLWHNFAHFIPSGHDRMRGDGHNSVELRAEQQRLAPPIVRDHEDHRELRRGGQRRVRTAFPFAHGAGARPTVGPAEQPAPTIAGRYEPSAAPLQPDAANAVHRRAAPVQADQEVHCILFTDMLLICRMVSRRNDRLRVTKPPMHISNLRFHHFSEGTEGCFGSVERLVAQPPSCNKCCGGGGHNATHRNATSVDICASHLRRGETLRTMPVHQKQLAQKNTALAQCKGCAEAGPNNGDFEGVVHRKSRSMDSQVAIWGAV

SEQ ID NO: 120746 - protein, 114 aa, Heterodera glycines
  Coding regions on vcDNA: vcDNA=SeqID_47169; Strand=-; Position=1 -110,595-757,800-868
  Homolog annotation: Hit_ID=XP_395732.1; Match level="QueryCoverage =92%, HitCoverage=37%, E-value=3e-20, Identity=50%"; Hit description =similar to Serine/threonine protein kinase 6 [Apis mellifera]
  Essential gene: C elegans homolog=B0207.4; Phenotype=Mei
MKQPEPIINKENLRPANQPSNKMHEGINYSEFGKEWKHPNILRMFNYFHDDKKVYLILEYALHGELFKVLQKSRRFSESTSAQVITPKLFIYIFQVSDALNYCHSKKVIHRDIK

SEQ ID NO: 120747 - protein, 478 aa, Heterodera glycines
  Coding regions on vcDNA: vcDNA=SeqID_47170; Strand=-; Position=1 -234,590-748,819-1208,1255-1320,1388-1572,1746-1808,2023-2062,2112 -2349,2400-2461
  Homolog annotation: Hit_ID=NP_055809.1; Match level="QueryCoverage =94%, HitCoverage=29%, E-value=3e-55, Identity=31%"; Hit description =mitogen-activated protein kinase binding protein 1-like [Homo sapiens]
  Essential gene: C elegans homolog=H24G06.1a; Phenotype=Bmd
MENQSNKGLFAIFGLFLMRFSLPFQAKLERVFGTPACSSSLSVDPISGLVAYPAGSIVVVLNPRTLSQAHLVCASKNQLTSLAFSPNGRYIVTGEFGGDPKVRVWELRHEKHTHGEQRVELEGHRLGISCVSFTKDSDQVISIGNQHDKSVCVWDWRTRKKLAETRLTCQVGNIHLLFTKCTNKHHLLCQVNAMDVSESGRMFVTVGVRHVKFWYLGSNSNGENGSAGVVLHGRSAILADQRNNTFVDVCCASNNRTFSITISKLLVEFVDKKLTNIYELGGEVPFSLSIGASHQLFMGFGNGAIRAMNLERMEPELELCRPHALHCDICAMGDGTGTEENQAKKFPDVHSIVFHSHSKTLTALYSSQLFHVGPVFDIEVSKSQPQLFFTAGADETVRIWCMNNSDTATAHSVTTVTDSNGSPSPPILDIGPPNHFSLELRKILYLNPGTDTLSEQPDKNFGGIMSDTLGLHYGSALH

SEQ ID NO: 120748 - protein, 373 aa, Heterodera glycines
  Coding regions on vcDNA: vcDNA=SeqID_47171; Strand=+; Position=1 -333,718-882,927-1229,1472-1692,1745-1843
  Homolog annotation: Hit_ID=NP_491250.1; Match level="QueryCoverage =95%, HitCoverage=41%, E-value=1e-120, Identity=59%"; Hit description= XPA-binding protein 2 like (99.5 kD) (1E447) [Caenorhabditis elegans] gb|AAB37794.1| Hypothetical protei
  Essential gene: C elegans homolog=C50F2.3; Phenotype=Emb
MPRIWIDYCMLMIRRGQITETRRVFDRAIRALPITQHMRIWPLYIDFATRHNVPETAIRVYRRFLKVYPGGREDFVEYLKSIDKLDEAAQQLVILVNEDRPISEKGKTGHQLWTELCDLISKNPNKIFTLRVEPIIRQGIGRYTDQVGGLWLALAEYYIRMPNFEKARDIFEEALGVVKTVRDFTQLFDAYSKFMERLTSLKMDALSSARPTQVDERELELELVMTRFEHLMNRRPLLLNSVLLRQNPHNVHEWVNRVQIYEGDPENQIATFEKAVATVDPKQQVGRLGQLWIEFGKLYEKLDKLDEARKVFDRAVQANFVRVDELAQVWCEYAEMELRHSNYELATALLRRATTPPPVRRDSYFDDSAKCRT

SEQ ID NO: 120749 - protein, 481 aa, Heterodera glycines
  Coding regions on vcDNA: vcDNA=SeqID_47172; Strand=+; Position=1 -269,334-575,627-706,759-1034,1151-1350,1400-1578
  Homolog annotation: Hit_ID=CAE67008.1; Match level="QueryCoverage =100%, HitCoverage=16%, E-value=0.0, Identity=69%"; Hit description =Hypothetical protein CBG12408 [Caenorhabditis briggsae]
  Essential gene: C elegans homolog=F32H2.5; Phenotype=Emb
ASLRCLAQHGRFLEIGKVDLAQNSALGMSLFLKNVTFHGILLDAIMDQSVGDMEDWMECARLFEQGIHRGVVRPLDATVFPSDKCEEAFRFMSAGKHKGKVLIQIRFMSAGKHKGKVLIQIREEEQQLLCAPSPMRVRAVCRTLCNPEHVYLITGGLGGFGLELAQWLINRGARKLVLTSRSGIRTGYQSRCVHFWRRMKVSVAVYQSRCVHFWRRMKVSVAVSTLNIAKKEDAVELVRSCLEIGPEDAVELVRSCLEIGPLGGVFHLAMVLRDCLFENQNQQNFKDAAEAKYFGTISLDEATRKGEQLRWFVVFSSITSGRGNAGQTNYGWSNSTMERIIEQRRADGFPGIAIQWGAIGDVGVILENMGDNNTVVGGTLPQRMPSCLGSLDLFLSWNHPIVSSYIKADTSGKKQSGGGNLLQYIKADTSGKKQSGGGNLLQTIAHILGVNDVSQLNPDANLGDLGLDSLMGVEKQALERD

SEQ ID NO: 120750 - protein, 142 aa, Heterodera glycines
  Coding regions on vcDNA: vcDNA=SeqID_47173; Strand=+; Position=1 -83,285-405,589-811
  Homolog annotation: Hit_ID=CAA65506.1; Match level="QueryCoverage =99%, HitCoverage=47%, E-value=5e-22, Identity=40%"; Hit description =cuticular collagen [Teladorsagia circumcincta]
  Essential gene: C elegans homolog=T07H6.3a; Phenotype=Bmd,Gro,Unc
MDAEDANGKREAESLRVIAFFGVCLSTISMMICVVTVPLAYQHFQQIGSLMQNELDFCQSRSGNIWREIARTQAYSHASGGVRYTRQAAASGYGAAPPPPAAPSSATAGGGYGGTAAVSAPAPSPPPASYGGIAPAASAKPS

SEQ ID NO: 120751 - protein, 121 aa, Heterodera glycines
  Coding regions on vcDNA: vcDNA=SeqID_47174; Strand=+; Position=1 -106,185-285,358-456
  Homolog annotation: Hit_ID=AAB65952.1; Match level="QueryCoverage =97%, HitCoverage=97%, E-value=5e-30, Identity=57%"; Hit description =Groundhog (hedgehog-like family) protein 5 [Caenorhabditis elegans] ref|NP_505223.1| GRounDhog, hedgehog-l
  Essential gene: C elegans homolog=F41E6.2; Phenotype=Emb
PLFVLLLHLLLAAVVRSQDSCYVTDSGHTCCDKALESAMKSAMSSAMKSAMSGKDLLSSADRIQKSAEGAIGGKFETVVAFDDFAHKSVVAFDDFAHKSHFKDGKSCKVEKDGQVALAWQP

SEQ ID NO: 120752 - protein, 273 aa, Heterodera glycines
  Coding regions on vcDNA: vcDNA=SeqID_47175; Strand=-; Position=1 -264,747-787,1248-1407,2814-3077,3240-3332
  Homolog annotation: Hit_ID=BAB14877.1; Match level="QueryCoverage =37%, HitCoverage=15%, E-value=9e-14, Identity=40%"; Hit description =unnamed protein product [Homo sapiens]
  Essential gene: C elegans homolog=F41E6.4a; Phenotype =Emb,Gro,Pvl,Stp,Unc
MEMASESAVTTTTSANLLLDQQHLKNSTKRETIANASADSVSEDSEEQVGRADSTVPSNDEEEEMRGYNLIPPEARPSSTLEKVEFEREENESEENEPSDSRGIVGMLEYDASFDEPKKHREFLWERSKFREVLPISSEELKAKIHQTFRLQYVQERIYPLIEYLINNHWENTFSKVDYVQTFVKMHDIWEAHLANKSDEGEKVKENGQTTPLAMTPPNAQWRKEREHDDEELFFSKDDDDEMLMMRTELPVFSVGISLRQRAAQCPSAGYPK

SEQ ID NO: 120753 - protein, 133 aa, Heterodera glycines
  Coding regions on vcDNA: vcDNA=SeqID_47176; Strand=+; Position=1 -264,905-967,1005-1079
  Homolog annotation: Hit_ID=CAC35844.1; Match level="QueryCoverage =52%, HitCoverage=21%, E-value=7e-09, Identity=40%"; Hit description =Hypothetical protein Y111B2A.15 [Caenorhabditis elegans] gb|AAC36062.1| tyrosylprotein sulfotransferase-A;
  Essential gene: C elegans homolog=Y111B2A.15; Phenotype =Gro,Lon,Pvl,Unc
MGTRQRCHFLTFCCVAFVTIVFLLFLFPSDDQRREAADSRTYAQKRHSADGGASSAAEVDNLAPFIFIGGIPRSGTTLMRAMLDAHPEIMYEQCNAVGQAKCLPVYYEQLISVGFASHAGNETVTELLGFAVE

SEQ ID NO: 120754 - protein, 561 aa, Heterodera glycines
  Coding regions on vcDNA: vcDNA=SeqID_47177; Strand=+; Position=1 -532,1467-2245,2288-2662
  Homolog annotation: Hit_ID=NP_498735.1; Match level="QueryCoverage =66%, HitCoverage=91%, E-value=8e-42, Identity=27%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MRLVHGKDLTPDVHYLHEKDDYHFVNAVHKYIVRHPELPWDSPEFNPSANIQQNIAEFREIFEREVFDENYELKTREEKNELIELVKGFRFYFADELGRFMLRIFSDKISHITLTDQLAYVLGYEQQQEIHNEDQAKYAVDLAGGVSHLCIYLNSGIIESMIFGNSFANLLQVIAVEVFVQIHPITSYIDLSKVFVCTEFKLKKIAEDGVVVDVPANAAVGLIQMPGATFIRNLKVHINQREVYDSNQLYSYKVYLDTELSYPAAAKDAYFGVAGYFRDSDPTKVNEKRKKAVEESKSFQTISKLSADIFNQDLYMISNVEIDIELALQSDDFMVHQDAANKDKYTLEIVDCRLIVKTVDLMDGLSLDIARKLDTEPARYGIRKSFMKSLFVTGGRYDFSANLFTEEVPRRVVIGLVSNQNYIGHNQKNPFYFNHHNVRDIELTASGRTYPQYPYNLDYKNNRYARAYHDAQEHLGMACTTESNGISYSMFKTAYCLYVFQMTNAQEDSPGFELIKEGCTAVNIRFTEAVPNEGVTLIAYGEADGLILIDRNRSITSDLTV

SEQ ID NO: 120755 - protein, 193 aa, Heterodera glycines
  Coding regions on vcDNA: vcDNA=SeqID_47178; Strand=+; Position=1 -292,354-575,2526-2552
  Homolog annotation: Hit_ID=AAO14563.2; Match level="QueryCoverage =96%, HitCoverage=26%, E-value=1e-55, Identity=62%"; Hit description =Hsp90 [Heterodera glycines]
  Essential gene: C elegans homolog=C47E8.5; Phenotype=Emb,Ste
FDGQSGETFAFQAEIAQLMYNMDNATTKVCLTELVTNFLHNFCETFFKGAIENDPSKADKTWTIIDTGIGMTKADLVNNLGTIAKSGTKAFMEALQTGIVALMPGHFGAGTGIVALMPGHFGAGFYSAFSVADRVTSKHNDDDCYQWESSAGGSFIIRNCADPEVTRGTKIVLHLKEDQTAYLQVKWVREFAV

SEQ ID NO: 120756 - protein, 539 aa, Heterodera glycines
  Coding regions on vcDNA: vcDNA=SeqID_47179; Strand=-; Position=1 -116,174-360,428-598,668-809,863-987,1044-1124,1194-1328,1376 -1417,1481-1632,1677-1905,1993-2232
  Homolog annotation: Hit_ID=AAD34471.1; Match level="QueryCoverage =98%, HitCoverage=65%, E-value=1e-137, Identity=47%"; Hit description= cullin 1 [Mus musculus]
  Essential gene: C elegans homolog=D2045.6; Phenotype=Emb
MNNHPVRFDTIWRDLSPGLESIFKTQERMAPQRYMEYYTLVFNHCTTSQQSSNFTHETTNNRARRGNRGTPAAAAGAEFVGEELYTRLRHFVEEYARKLLQECQRLSGDQLLDYYTEQWTKFQFSSTVANGIFSYLNRHWIKRNIDEATRPGILEVYNLAVSIWKSVIFDELHHNITSAALALVEKDRNGERITTRLISGVVASYIELGINELDPAPAVGQQQNSVVHRPSVKYQVYRNNFEQRFLEDTRNFYTTESNNFLQSNSANVQDYMKKVEQRLSEERDRCQIYLDNTTMDSLMEACDTALIKQHLELFHDKFESLLTRQQNDHLGRMYTLCSRVPNGLAKLKEILKAYIEQEGKAAIQQIAREASNNPKQYIDCILKKHKLYNRLVVDSFKTDHGFVQSMDCAFRKFINNNEITAMARNASKSSQLLVLYCDQLLRKSARNTEDEKMDEYLDQVMTVFKYIDDKDMFHAFFHKFLCKRLVYDTSASEEQERCMIAKLKHMCGFEYTSKLERLLTDVALSRDHSEQYKQVANEI

SEQ ID NO: 120757 - protein, 456 aa, Heterodera glycines
  Coding regions on vcDNA: vcDNA=SeqID_47180; Strand=+; Position=1-1371
  Homolog annotation: Hit_ID=NP_508269.1; Match level="QueryCoverage =97%, HitCoverage=64%, E-value=7e-40, Identity=26%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MSVIKKIDKDSVEGLEGSLSLFSLPPTNVAINKTSVRELLPLSALNQTGPYLFRLFSDSQYCDLSKTYMYLLSSIERKNAAGEWVPISDAEPDDKRVSVVQNYGSSFVRALKVNISGIEVFDSSIYYHYRDYIMNELGYSHEIRKAFHEAACYYADEDDGQDSATNEGFIARASRFSNGKQCETMVKLNFDLAHQSALMLNNQDVVFTIHRNNDAFLLLTPHWKKADGTMQENTKEYRVRVHDMRLYVRTVDVTPSLNLAISRQLESASAKYPLRKIEMSSIFLGKGRTELAHNVFTSTLPRRLICCFVSTDAYSGNRKLSPFKFEHANVRAISAEANGQSFPSTPYLLSFDAAQQRFMRAFVDMYAGLGLDDSDTKTVSIGLQRFLNGWAFFVIPMTSTLDDTDGFELIRQGTCTLKVQFEKPIKDDGYEMLILGEFDSVLSINADRVLSTDGSV

SEQ ID NO: 120758 - protein, 213 aa, Heterodera glycines
  Coding regions on vcDNA: vcDNA=SeqID_47181; Strand=-; Position=1 -115,231-361,471-591,692-831,874-979
  Homolog annotation: Hit_ID=AAR09171.1; Match level="QueryCoverage =95%, HitCoverage=52%, E-value=4e-46, Identity=46%"; Hit description =aldolase [Heterodera glycines]
  Essential gene: C elegans homolog=F01F1.12a; Phenotype=Gro,Unc
QTMGMTFELSEKNDELRDIVARMLQPGKGILAADDPAVALDSRLTLFGMENSAENRRRFRQLLFTTPNIHKHISAVIVQDETYRQMTDQGDQLVDLLRRTGIAVGVKVDEDTIPLFPMPTEVQLLGLDGLAARCAEYKKGGCSFAKFRCAYRISQRTPSKWALEQNAMVMARFAVTCRVMARFAVTCRSFGLVPIVEPDLNGEGTHGMRNANR

SEQ ID NO: 120759 - protein, 124 aa, Heterodera glycines
  Coding regions on vcDNA: vcDNA=SeqID_47182; Strand=+; Position=1 -111,216-425,581-633
  Homolog annotation: Hit_ID=XP_415070.1; Match level="QueryCoverage =91%, HitCoverage=20%, E-value=7e-09, Identity=28%"; Hit description =PREDICTED: similar to CDC45L [Gallus gallus]
  Essential gene: C elegans homolog=F34D10.2; Phenotype=Emb
HIFSCDDASYTLSPVDSFPTLEKAINDHVRQAKNIVLVTFWVLESRRPLNLEDIYNANSVRVLAPAAEVAEWTLPEASAIFETMVEQEDEDDDDEASDGDEENRPPSDDREEAEDGEAAMAGDS

SEQ ID NO: 120760 - protein, 342 aa, Heterodera glycines
  Coding regions on vcDNA: vcDNA=SeqID_47183; Strand=-; Position=1 -107,799-1034,1129-1240,1294-1392,1445-1521,1978-2259,2310-2427
  Homolog annotation: Hit_ID=NP_955953.2; Match level="QueryCoverage =52%, HitCoverage=22%, E-value=1e-31, Identity=45%"; Hit description =cullin 1 [Danio rerio] gb|AAH66480.1| Cullin 1 [Danio rerio]
  Essential gene: C elegans homolog=D2045.6; Phenotype=Emb
GQHFARGALREVAGRLQEEDGDRIDPFIALNKPKKCNTQQIVILMQYNERNTYTLGELHVTLGTDFPADQLCAVVQSLVKTNLLKLTSADGTALTETKLNDNEQKFTFNSEFQSRKLKVDLVRAMSSARETNKESEDVQKTVDEDRKLVIQAAIVRIMKMRKSLKHQLLVAEVLNQLTTRFQPKVPIIKKCIDSLIEKEYLKRSEEDRDFWLYTDVWMDMFPFFDRLQLGLKLALLSPRFEFLVDKHFDGTSELPILKNIVLRKNKVTAVPELRVFIDNANYVPFPVPDHSLPKKIRFKHLRICYIDHSFIAFIRANQQMFDKGTNLEFSVSWNETFFAQPI

SEQ ID NO: 120761 - protein, 133 aa, Heterodera glycines
  misc_feature (35)..(36): Xaa can be any naturally occurring amino acid
  Coding regions on vcDNA: vcDNA=SeqID_47184; Strand=+; Position=1 -120,393-501,554-640,1018-1170
  Homolog annotation: Hit_ID=NP_491077.1; Match level="QueryCoverage =93%, HitCoverage=92%, E-value=8e-16, Identity=37%"; Hit description =nuclear Transport Factor 2-related eXporT protein, binds Ran-GTP (15.5 kD) (nxt-1) [Caenorhabditis elegan
  Essential gene: C elegans homolog=Y71F9AM.5; Phenotype=Emb,Lva
MSSSALVKIKLDQEVCADAEKLVRLYTELADVHRXXISKLYSAHDPQIVWNGNPYKGMPEIETFWRNLPETSHDVACLDAHRIDPTSDDMSLVVLAMGTVIIGGLSHAYNQSLLLVLEGSTYKIKSDNYRVID

SEQ ID NO: 120762 - protein, 143 aa, Heterodera glycines
  misc_feature (16)..(16): Xaa can be any naturally occurring amino acid
  misc_feature (35)..(35): Xaa can be any naturally occurring amino acid
  misc_feature (139)..(139): Xaa can be any naturally occurring amino acid
  Coding regions on vcDNA: vcDNA=SeqID_47185; Strand=-; Position=1 -134,2275-2356,2406-2594
  Homolog annotation: Hit_ID=NP_740903.1; Match level="QueryCoverage =87%, HitCoverage=84%, E-value=2e-28, Identity=57%"; Hit description =deoxyuridinetriphosphatase (52.1 kD) (1K163) [Caenorhabditis elegans] ref|NP_492542.1| deoxyuridinetripho
  Essential gene: C elegans homolog=K07A1.2; Phenotype=Ste
DLEASKIELRERSKKXKSSLSSRWAHPTYALTRVXINFSGLEAFAHPPTFGSENSAGADLYSAESYVVPAKGQVLISTGLQVLISTGLSVAIPEGHYGRVAPRSGLAVKHSIDVGAGVIDSDYRGELRVNLYCFVGNNXEIWS

SEQ ID NO: 120763 - protein, 4940 aa, Heterodera glycines
  Coding regions on vcDNA: vcDNA=SeqID_47186; Strand=+; Position=1 -471,518-738,788-1511,1555-1676,1747-1952,2037-2243,2295-2558,2609 -2875,2924-3305,3357-3508,3586-3732,3778-4069,4114-4307,4352 -4409,4456-4955,5017-5508,...
  Coding regions on vcDNA: Position=...5552-5728,5773-5859,5905 -6201,6246-6622,6664-6972,7023-7352,7397-7553,7595-7978,8021 -8167,8210-8445,8499-8736,8781-9056,9101-9397,9440-9673,9733 -10032,10078-10482,10527-10802,...
  Coding regions on vcDNA: Position=...10883-11170,11219-11419,11467 -11945,12029-12260,12312-12635,12701-12913,12960-13577,13627 -13890,13936-14041,14180-14600,14680-15166,15205-15461
  Homolog annotation: Hit_ID=NP_491363.1; Match level="QueryCoverage =99%, HitCoverage=96%, E-value=0.0, Identity=49%"; Hit description =dynein heavy chain, LEThal LET-354 (dhc-1) [Caenorhabditis elegans] gb|AAK21472.1| Dynein heavy chain prote
  Essential gene: C elegans homolog=T21E12.4; Phenotype=Emb
YIQNELTQWLDELRRIKKPGERDGRKLGPLEKSQVNDLQGAVRHLKQNIEIPEVVLEFDSNIQQIVDVARKENRKPFLNNLQNHINIWIKAIQKMTKLDRDPTSGTALQEVTFWVNLERALLQIQEICESDEFIVTMEALKLGKRFHATVAFESNTGLKEMLVTAQDYNQMMKDVQINSNTGLKEMLVTAQDYNQMMKDVQINDLLCAFDLAAVKTAVSTILGSIKKMRSTKYPLKRAYGFITTISTDLCERLVQLLKPRLLMHAPMLLKPRLLMHAPMSELEEIMDQCKKIFTAWDEEADKVMMMFRDLAKKQRPADAKPMLRMIYRHKLLELRLEQLYRFRTQHEQLSNMISRVLRFAGPTSLESFGVIDSDPEKEVEDNGINCSFKILQIGKAYDAVKELDYLDMGQQGQQAWESAMQYYRDHISRVEAELASRLRDQLGGAKNADEMFTIFSRYNALLVRPHIHSAIREYQTALIDGVKADIVELQETILDTKKRELAIRCADRYDIPAFSASMMWVRQIYDIPAFSASMMWVRQIESQLNMNIKRIENVLGEGWANHLEGKELSKECELLRKELSKECELLRQKLDTSHLHKEWTDKMLAKCEVQNDRLFIVDKLQRDGKIIHRIRVNYSPDSIRITKEVRNLKNLGYRIPFKIMSHSHTISTYYPNAISLIESMRIYESTNEIVLNRQSIDQLIASYRNIIHNLLNEGVKTEWTGVKTEWTNFKLESFVVKLADAVGNYQEKVSDLIEWLDKIELEMSSMDKCQFKQEIIAQILGSIQKIVDQMALNNYSNLKKWIENLDKTLENKMARRLEEAIRVWIKLLKQSTLENKMARRLEEAIRVWIKLLKQSRDELEDERVSIVPEIHPIPLEIRIISQCIVVVPTLEKARLSLFNQFSSWHGIVTNQTRISCNRFQVLQNNADTVLQNNADTQTYKSVLLKMPHSQQIIQETHFAIEDIMMKLGDYVSQWTRYQALWDFQQEMFFERLGTDLCNWMKVLLDIKKARTMVDSPETRHNIFPFVVDFTRVQSKVSIKYDFWQREVLNKFGSALGSSMSSMQQFFSDISKDRHELESQSIDSTNTSSTVALIMHVQSLKKRIKASQEQVDTFLSGVDTFLSGQKLLTVHRYPFPQSWLYAENVEGEWSALLDVLNRKDVAIQSQVANLQTRILEEDKLLEKHINDLVSQVANLQTRILEEDKLLEKHINDLVAEWNKSKPVHGAQRPKEALILLSGFEDKFKRLRDERSNVLNAKNTLEISDSLIPNQTTNKLEIAIEELNDLTGVWDSLLPVYNVWDSLLPVYNNIDELKEIPWLSVQSRKLRQNLEELLAKLKSLPSQYRSYESYDYAKRLLQNYLKMNSLIIELKSDSMNSLIIELKSDSLKERHWRNLTREMHVNWVLSELTLLTREMHVNWVLSELTLGQVWDIDLSRHEETIKKIMIVAHGERVLEDYLRQVKEYWTDYAVDLVNYQQKAKLIRGWDDLFNKLKEHMSSLGQMKLSLYYKQFEEDALSWEEKLNKMNTIFDSWIDVQRRWVYLEGLFTGSADIAHLLPSESNRFNMVSNEFLGLMRKVSTSPRILDVVSTSPRILDVIHIQGVQKILERLADMLSKIQKALGEYLERERNSFPRFYFVGDEDLLEILGNSKDLMRVQKHLKKMFAGIMAVEFNEQSRTISAIISREGESVTLKCPVDLKQLPKIDEWLRGLEREMQSTLATLLGESLSSFSKLVIENIQHEELMELMDLYPAQIIGICVDVWWAQIIGICVDVWWSSAVESCLSKHGSAENVLQTVEKWLSMLCESVLRDQTAIRRKKISNLITEFVHKKNVCRITEFVHKKNVCRQLVKNNVKNSQDFWWLQNLRIYFNSNLRIYFNSNEKDPRKSCFIKMANAEFFYGFEYLGIQEKLVQTPLTDRCYLTMTHALHCRLGGSPFGPAGTGKTESVKALGHQLGRFVLVFNCDETFDFQAVGRILAGLCQVGAAVGRILAGLCQVGAWGCFDEFNRLEERMLSAVSQQIQMIQETVRADSDMVDLVGKSLTVNPNMAIFITMNPGYSGRSNLPDNLKQLFRSLAMTSPDRGLIAEVMLFSQGFQSAEILANKIVPLFTLCKEQLSNQCLCKEQLSNQCHYDFGLRALKYVLVSAGNIKRDAIQRSYDEPSQSGDGAGEQAVASQMSEQQMLIQSVCETLTPKLVSEDITLLQSLLHDVFPDISYSPKQVESLKNEVLNICLKNEVLNICKTEHFSCSPITGEKGNLWLEKVLQVYQITNLNHGLMLVGASGSGKTTAWKTLLKALENHELVEGVSHVIDAKSISKDTLYGTLDPNTREWTDGLFTHIIRKIIDNVRGELDKRQWIIFDGDVDPEKIIDNVRGELDKRQWIIFDGDVDPEWVENLNSVLDDNKLLTLPNGERLSIPPNVRIIFEVADLKFATMATVSVRIIFEVADLKFATMATVSRCGMVWFSEDVVTPEMLFESFLLRIKNEPLISGNANRLLNIQIICENTLSMHMDANGLVPLCLEFAVEQLEHIMEPTRQRLLLTFFSMLNFSVKQLLQYDSDHPDFPPSEEQIANFISRSLLVNLIWAFADFPPSEEQIANFISRSLLVNLIWAFAGDGSWKNRKSLSDFVRASTTIQLPPDQSLPITDYFVTTDGDWESWLLPITDYFVTTDGDWESWLTKVPQIEIEPQRITDTLTVIPTLDTVRHEMLLNTWLNERKPLVLCGPPGSGKTMTLLAALRSLPDMDVINVNFSSSTTPELLRSLPDMDVINVNFSSSTTPELLMKNFDHYCEYRKTPTGVVLAPVQITRWLVIFCDEINLPQPDKYGTQRVISFMRQLVEQNGFYRTTNGFYRTTDRTWVTLERIQFVGACNPPTDPGRNPLSARFLRHVPVIYVDYPGRTSLNQIYGTFARAMLRQTMQIRGMAEPLTEAMTDFYLQSQEHFTQDDQPHYVYSPRELTRWYLQSQEHFTQDDQPHYVYSPRELTRWVRGISEAIMPLDSVSHEELVRLWAHEALRLFHDRLVRDDERVWTNELVDQVAHKYFAASCNLDAALERPLLYSCWLKKHYSPVSSKHYSPVSSKELEDYVMHRMRQFAEEELDVKLVLFDQILDHVLRIDRVFRQPQGHLLLIGVSGSGKTTLSRFVAWLNGFTIFQLKVHSKYIFQLKVHSKYKAADFDEDIRHVLRRAGCRNEKICFIMDESNMMETGFLERLNTLLANGKVPGLFEGDDFNTLLSQIKEGAQRQGFMLDSHEELYKWFTAQIVQNLHVVFTMNPSGIVQNLHVVFTMNPSGDGLRERASTSPALFNRCVLDWFGDWSNSALFQVGHELTSMCEIDKSDYTPPAALEHCCDRLPTEIAYRDAVVNSFVHIHNIVRKTNVTESRKGHRVMAITPRHFLDLIKHYVTMSKEKRDELADEQIHLNNGLRKINETEQQVKEELADEQIHLNNGLRKINETEQQVKELQKSLNEKEVDLRKKQGEANAKLQLMLGDQREAENEKRTSETLQKQIREEKQCIDRKKDEVKRELAEVKPAVEEVKPAVEEAKSAVSGIKKAQLVEVRSMASPPNAVKIAMEAICLLLGEKQTEWKSIRAILVKDDFIPHILQFNTDSITPEITEKMKQYEGNPDWEFEKVNRASVACGPMVKVNRASVACGPMVKWARAQLSYAKMLNKIEPLNNELKRLEKDAEEKTVKGEELKHKIEALENRIQELKDEYAQLIGEADEYAQLIGEAEHIKQDLQVVQEKVNRSIHLLKSLRVECDRWETGRERFAQQNETLVGDVLLSAAFLSYSGYYDQLLRDTIFQKWMGILDSSQIMFRHELARIEYLSTADERLQWNNNGMPKDELCTENAIMLRRFNRFPLIIDPSGQSIEFICKEFSTASEKEKNTKFFILNFRKNLESALRFGTTLLVQDVESYDPILNPVLNKEVKRTGGRVLITIGDQDIDLSPAFKIFLFTRDSSVEFPADVCVEFPADVCSRVTFVNFTITRASLETQCLHQVLRSERPDIDKKRNDLLKLQGEFAVRLRHLEKALLNALNESKGKILDDDSVIATLEKLKNEAQEVAKKSAETDQVMKEVEIVSQKYYKLANACSLIYLMLHRLDEIHLLYNYSLDFLLDIFTTVLKSPQLGNVKDYDARLSIILQNLFSVMYSRVSIGMLVMYSRVSIGMLHNDQILLASLLLRIYSRLRCRECLRAGLEQLTALPPEQVLSSAHMLMTKAFGSEFMQQDKVVNLREIILNEVRQNVRYHLLIKHLLLKVQCKVPVLLCSATGYDVSNRVEDLAFELKMDILSIALGSAEGFEQADKALQSTSRSGRWILLKNVHLATEWLTQLEKKFRLHNPHPHFRLILTAEIGSALPISMIQASRVLIFEPSTGLKANLLRSLSIQASRVLIFEPSTGLKANLLRSLSSISPARIAKAPAERARLYFIICWFHAIVQERLRYQPLGWANSYEFTDADFRVACDTLDSTVDMVAQNRANVKPDKLPWLALRTLLNRANVKPDKLPWLALRTLLSQCIYGGKIDNDFDQAILDTLLDKLFTSNSFDADFILIENIGVNALNMPDETKKDGLINWVINIKALQKPNWIGLPNNAEKVLIAERGTAFTNRNAIMKKSFFINYRARIYTEDDQNADDELAYEADDLERNKQAPTWMVQFSGQCKSWLDALPQQLQRLRQLQRLRRTKENVRDPLFRFFEREINLGARLLSDIRRDLNELLSICHGDQKQNNHSRELIAALVKRKRVPDNWLQFSVPKDVTALEWMRDFVQRMEQLKRLSLENLRYEEVWLGGMFFPEAYITATRQLIAQTNGWSLEQMYMHITKTEEGQLKSTAFTLTGVIDLRAIGVLCEADEIKLTDEVHVGTGVIDLRAIGVLCEADEIKLTDEVHVGVPRLQFTWTLEGHSPASVVVPVYLYSNRAKFLFGLNLPIGFDHSMLSQRGVAFVSNCSL

SEQ ID NO: 120764 - protein, 126 aa, Heterodera glycines
  Coding regions on vcDNA: vcDNA=SeqID_47187; Strand=-; Position=1 -149,573-728,896-971
  Essential gene: C elegans homolog=M176.2; Phenotype=Emb,Lva
MNIGSVVGSAMGPRTAEMHRRMLQRMRMDASNVPENRAFNTLARGLFQAWLRFGDPNAVVVFAVFQGSMHRFDERAVEYELQRISDWQVKVVRLSSKEAYSNHFRRYIHMISNAIGPESSQHQFAF

SEQ ID NO: 120765 - protein, 230 aa, Heterodera glycines
  Coding regions on vcDNA: vcDNA=SeqID_47188; Strand=+; Position=1 -144,203-454,505-801
  Homolog annotation: Hit_ID=CAE73435.1; Match level="QueryCoverage =88%, HitCoverage=32%, E-value=1e-38, Identity=44%"; Hit description =Hypothetical protein CBG20878 [Caenorhabditis briggsae]
  Essential gene: C elegans homolog=R05H10.2; Phenotype=Lva
MRASLLRPGTALAKGMSEEDAKLRQRMLEVAKTKLKNLTMFVSPNRLVIHNIPFSWKDDQLKSVCSEAAGDCPATAISECRIMRQLKGQNEKGRAILGKSSGFGFVTFTEHTLALNCLRKLNNNPTTFSDERRPIVEFSIENLNALRVKERRQQKETKSEENEEEKQQTKNRVGNAEALEKTKREMMAGGKKWLPKKLGTKIRHKKPQNGLSTTPGKRRGQFVEQRAGMV

SEQ ID NO: 120766 - protein, 179 aa, Heterodera glycines
  Coding regions on vcDNA: vcDNA=SeqID_47189; Strand=-; Position=1 -70,957-1059,1418-1458,1723-1959,2464-2551
  Homolog annotation: Hit_ID=CAE66635.1; Match level="QueryCoverage =93%, HitCoverage=78%, E-value=3e-58, Identity=61%"; Hit description =Hypothetical protein CBG11972 [Caenorhabditis briggsae]
  Essential gene: C elegans homolog=T03F1.8; Phenotype =Gro,Pvl,Unc,Unclassified
WTWTWIPCWTWTLISWTKIRKIQVRPIIISGPSGCGKSTILARAMKEYPEAFAFSISHTTRKPRDGELDQQHYYFVDRREMEQMIDAGQFLEHAEFGGNLYGTSKKAVDDVQSSGKICVLDVELNGVRNFKALQFDAKFVLVRPPSIEVLEQRLRQRGSETEETIAKRLKHAKEDMEAG

SEQ ID NO: 120767 - protein, 245 aa, Heterodera glycines
  Coding regions on vcDNA: vcDNA=SeqID_47190; Strand=-; Position=1 -50,249-366,476-532,1024-1074,1459-1580,1824-1932,2146-2234,2289 -2363,3846-3895
  Homolog annotation: Hit_ID=CAE71961.1; Match level="QueryCoverage =89%, HitCoverage=98%, E-value=1e-68, Identity=57%"; Hit description =Hypothetical protein CBG19031 [Caenorhabditis briggsae]
  Essential gene: C elegans homolog=T15B7.2; Phenotype=Lva,Unc
KPGDVYLLAYNAIQFLGWGSILVKTVLWLASGHSFPELYQNVEMELKIFQTAAILEIVHSVVGLVRSPVFTTIVQVFSRVTVVWMILHKVASARLSFGVPMLLLAWSITEVVRYSFYALNLLAVPYALTWMRYTFFIALYPMGAGGEVLTMVAALGEIARRKHFTIEMPNSWNMSFNFYYIIIALCLIYLPGFPKLYGYMFIQRKYMFIQRKKVLGGGGKSSKTTTEGANKILALNFQPRLQSQW

SEQ ID NO: 120768 - protein, 325 aa, Heterodera glycines
  Coding regions on vcDNA: vcDNA=SeqID_47191; Strand=+; Position=1 -161,434-595,949-1150,1197-1343,1398-1703
  Homolog annotation: Hit_ID=EAL40780.1; Match level="QueryCoverage =77%, HitCoverage=22%, E-value=1e-18, Identity=27%"; Hit description =ENSANGP00000025440 [Anopheles gambiae str. PEST]
  Essential gene: C elegans homolog=ZC376.6; Phenotype=Emb
MHTHPLSVDHGRPTTQRLPTHQTCAFALCCVEHAPSFAGTRPFRRVQKVDKKGNRLSKSLDILLGRATVEQQFCYYELILKAMSLSLDGKWPRALVDKLQLAWERFDSEIEEKEALLRSFGGTQRLAVVQTYIELCDDEDGTEIDDIEEIRQILCSQIHQLFIADTHLPKLVHFNMYPLRLVPVIVQRVPSAHVLINSINELITGSNLERRIFAIVLITELLELYKIPSAFAALSLISDMLDAMLVSLVTDEFIVLMLNVVPSLARLVLLSPFHAEQFLTILERTRKLAFSRMAIYSSLSQARKSPERKLFEMVNRTMEDLPKLT

SEQ ID NO: 120769 - protein, 428 aa, Heterodera glycines
  misc_feature (341)..(341): Xaa can be any naturally occurring amino acid
  Coding regions on vcDNA: vcDNA=SeqID_47192; Strand=-; Position=1 -278,371-517,565-686,744-850,945-1270,1474-1673
  Homolog annotation: Hit_ID=CAE70651.1; Match level="QueryCoverage =95%, HitCoverage=72%, E-value=2e-81, Identity=41%"; Hit description =Hypothetical protein CBG17356 [Caenorhabditis briggsae]
  Essential gene: C elegans homolog=C47A10.1; Phenotype=Emb
PLIRPNSSIHLVFLQKPSLNATNSAGIRPSAVKGAIEFKDVHFAYPSRPQLKVLKSVSLRIDAGESVALIGHSGSGKSTIVALLMRFYEATKGCVSLDGVPLSDLNVPWLRQTIGLVQQEPVLFAATVEDNLRMGREEATKEEMETACRMANAIGFEEMETACRMANAIGFINKLPQGFKTLVGQGGIQLSGGQKQRLAIARVLLRNPRILLLAIARVLLRNPRILLLDEATSALDAESEQIVQEAIDNASSGRTTNASSGRTTITIAHRLSTVRNADRIVVFEHGRIVEMGNHEKLIRPNSVYKQMVPNKNEKGLKWGGGDKRTEKERNSIGPIKWHFRXWPNKLKKKSQREPRREKPLLVITAQNTLFLFDRLDDELHEMGARPASPLDILRYAGPEMPFVFFGVVSAIWPANKTSPDEKNSQKIR

SEQ ID NO: 120770 - protein, 113 aa, Heterodera glycines
  Coding regions on vcDNA: vcDNA=SeqID_47193; Strand=+; Position=1 -127,360-572
  Homolog annotation: Hit_ID=CAE59222.1; Match level="QueryCoverage =97%, HitCoverage=19%, E-value=2e-21, Identity=46%"; Hit description =Hypothetical protein CBG02540 [Caenorhabditis briggsae]
  Essential gene: C elegans homolog=F28B12.3; Phenotype=Emb,Gro
SGSRHAVAIKMEPPSNGPLFTEMHVYMRVLKPEHLDKWKKDKGLKFLGLPHFISNGSFTYEGQQIRYLVIPKFALSLESVRAARTPSAVLSWTEVSAVAKTVVHALAYLHDQG

SEQ ID NO: 120771 - protein, 188 aa, Heterodera glycines
  Coding regions on vcDNA: vcDNA=SeqID_47194; Strand=+; Position=1 -209,353-491,625-752,1007-1075,2776-2797
  Homolog annotation: Hit_ID=NP_495185.1; Match level="QueryCoverage =100%, HitCoverage=30%, E-value=4e-49, Identity=48%"; Hit description= vaccinia related kinase (67.4 kD) (2G213) [Caenorhabditis elegans] gb|AAK31507.1| Hypothetical protein F
  Essential gene: C elegans homolog=F28B12.3; Phenotype=Emb,Gro
LKFLGLPYFISNGSFTYEGQQIRYLVIPKFALSLESVRAARTPSAVLSWTEVSAVAKTVVHSLAYLHDQNYVHGDVKAANLMMESKSDFSRVVLIDFGLARRLPDALVEKENKKQAHNGTPLFTSCDAHRGCLPSFRGDLEILVHNMFYWTTGTLPWESVEQNLDAVYEAKKSLVANAPGRPQNEIQN

SEQ ID NO: 120772 - protein, 290 aa, Heterodera glycines
  misc_feature (282)..(282): Xaa can be any naturally occurring amino acid
  Coding regions on vcDNA: vcDNA=SeqID_47195; Strand=-; Position=1 -138,191-229,277-410,465-510,570-677,871-974,1026-1173
  Homolog annotation: Hit_ID=NP_741172.1; Match level="QueryCoverage =91%, HitCoverage=21%, E-value=2e-74, Identity=56%"; Hit description =pharyngeal and intestinal protein kinase involved in feeding (112.9 kD) (kin-18) [Caenorhabditis elegans]
  Essential gene: C elegans homolog=T17E9.1a; Phenotype=Dpy,Emb,Ste
MPSNTKLKPANLKHPEVAELFSLKDPEQRYEDLREIGHGAFGSVFYALDKDTQETVAIKALDKDTQETVAIKKMNFSGKKMNFSGKQSVEKWNDIIREVRFLKSVRHPNIVCYKASFLKEHSCWLVMELVMEYCVGSTADILKVYKKAFLEVEVYKKAFLEVEIAAICEQTLNAIAHLHSLKRIHRDIKAGNILLTESGVVKLADLGSASLSSPAQTFVGSPYWMAPEVIIAQDTGGVYDEMAPEVIIAQDTGGVYDERADIWSFGITCIELGPTLIIIGFXNTDKNYIS

SEQ ID NO: 120773 - protein, 258 aa, Heterodera glycines
  Coding regions on vcDNA: vcDNA=SeqID_47196; Strand=-; Position=1 -168,518-608,910-1091,1163-1288,1345-1554
  Homolog annotation: Hit_ID=CAE75059.1; Match level="QueryCoverage =75%, HitCoverage=25%, E-value=2e-21, Identity=31%"; Hit description =Hypothetical protein CBG22973 [Caenorhabditis briggsae]
  Essential gene: C elegans homolog=K06H7.6; Phenotype=Mei,Ste
MLVSIYGSKDLFVKEYQHLLAERLVHNGWDRYLQSEFNYLETMKRRFTDGELNHCEVELELELDGRNVQIVAPLTQAQIILLFTEKEIWDVASLAEATELEILDLRKRLDWWTSKGLLSQGPSDPITLEDTFYLVSTTEAIENYLKQSAVHQSGTFYEYMYSDEEEEEKPLVEDVAEELEQYWNYTKGLLMHRATCEPLTAQFLHRMFKNFTSPGKMAPSLEAVQIFMQRKIKQNLVVFENGVYKATKELKSQSNNTK

SEQ ID NO: 120774 - protein, 449 aa, Heterodera glycines
  Coding regions on vcDNA: vcDNA=SeqID_47197; Strand=-; Position=1 -336,390-1403
  Homolog annotation: Hit_ID=NP_498735.1; Match level="QueryCoverage =94%, HitCoverage=99%, E-value=1e-43, Identity=28%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MSCPKKISEQSALAFNSALNVFTVPPTNVSVSRSFFRELLPLSTISQEGPYLFRLFNDNLWADMSRVYLFLELSIQKEDGGGRWVPIEAAVAADQLVAPAQCVGQTFVQQLKVEVQNTELYDSGTLYPYKAYLTNELSFPNSAKGHFMASAGYHPSRKHDDATDAGFLARCARFAGGRKARFLSRLDFDLGNQELYLLNNMDVLFTIYRAKDAFLLQSLAAAAAAAAAAQHYALYLHDIKLYVKMVEVQPSLNLSIYKTLEKQPATYAVRKTEVKSVFLTAGRTEMDHNIFSAAIPRRLTIALVANGAFNGQLALSPFNFKPYAIREISVHAAGHVYPAVPHRMDFSGCAYIRPFVDMYEALGMANSERSMDITLEQFHDGWTIFVVPMTSTLDDSCGFELLRSGTTSIRLAFNEAIPAGGVEMVVLGEFDQLIMIDYNRHIVSDSKIA

SEQ ID NO: 120775 - protein, 449 aa, Heterodera glycines
  Coding regions on vcDNA: vcDNA=SeqID_47198; Strand=-; Position=1 -57,105-213,264-619,667-829,883-1356,1405-1595
  Homolog annotation: Hit_ID=AAP20434.1; Match level="QueryCoverage =99%, HitCoverage=99%, E-value=0.0, Identity=94%"; Hit description =beta-tubulin isotype 1 [Cooperia oncophora]
  Essential gene: C elegans homolog=C36E8.5; Phenotype=Emb
MREIVHIQAGQCGNQIGSKFWEVISDEHGIQPDGTYKGETDLQLERINVYYNEAHGGKYVPRAVLVDLEPGTMDSIRAGPYGQLFRPDNFVFGQSGAGNNWAKGHYTEGAELVDNVLDVVRKEAEGCDCLQGFQLTHSLGGGTGSGMGTLLISKIREEYPDRIMSSFSVVPSPKVSDTVVEPYNATLSVHQLVENTDETFCIDNEALYDICFRTLKLQNPTYGDLNHLVSVTMSGVTTCLRFPGQLNADLRKLAVNMVPFPRLHFFMPGFAPLSAKGAAAYQACSVAELTKQMFDAKNMMAACDPRHGRYLTVAAMFRGRMSMREVDDQMMSVQNKNSSYFVEWIPNNVKTAVCDIPPRGLKMSATFVGNSTAIQELFKRISEQFTAMFRRKAFLHWYTGEGMDEMEFTEAESNMNDLISEYQQYQDATVDDEGEYEAEDTTQPTAEVE

SEQ ID NO: 120776 - protein, 124 aa, Heterodera glycines
  Coding regions on vcDNA: vcDNA=SeqID_47199; Strand=-; Position=1 -68,117-276,915-1061
  Homolog annotation: Hit_ID=NP_495445.2; Match level="QueryCoverage =60%, HitCoverage=19%, E-value=2e-20, Identity=60%"; Hit description =probable rna phosphate cyclase-like protein (41.6 kD) (2H339) [Caenorhabditis elegans] gb|AAB93426.2| Hyp
  Essential gene: C elegans homolog=ZK1127.5; Phenotype=Emb,Lva
MLHGNISDIYITIDQRKGPQGGLSPGFGIFLTAETTEGVFFHGEAMSRPKGQNEDQTVPEEIGEQAARRLLDEIHMEWWKVMKEIVGKGGNAMKNGSEDKCLMTCVGVGFLQHQQRPTLIVLFC

SEQ ID NO: 120777 - protein, 571 aa, Heterodera glycines
  Coding regions on vcDNA: vcDNA=SeqID_47200; Strand=+; Position=1 -721,939-1934
  Homolog annotation: Hit_ID=CAE66864.1; Match level="QueryCoverage =98%, HitCoverage=50%, E-value=6e-58, Identity=29%"; Hit description =Hypothetical protein CBG12238 [Caenorhabditis briggsae]
  Essential gene: C elegans homolog=ZC247.1; Phenotype =Gro,Sck,Sma,Ste,Stp
ETQAATTTAREHYPATVSYEGPLSATTRKWELEGAPLNSHVTVYHHGRSDLAAPEQQQPVAEKVTTKISSLFKRKPHHEDFPVSEPFTGQLDETARVSELFHEPIDASVSVYSAGRSDEHVVVQPTTIAEAEPVPLVEYPRTTAYDGPLQSTSKGAEMEGQPLDAHVSAYHHGRSDMAPPAAPKETITTKLTSIFKKTTAQEDEYPPKTEPFLGPVAQTNRQRELEAVPVVDRIERIPKGFYEEGELHPVVVHEEKELTPSEAEKRPGTLERITHLFKRTATEGEWPMVTEPFTGPHAETSRKGELEARPLGELVAAYASGRSDEVGPMQTIETQAATTTAREHYPATVSYEGPLSATTRKWELEGAPLNSHVTVYHHGRSDLAALEQQQPVAEKVTTKISSLFKRKPHHEDFPVSEPFTGQLDETARVSELFHEPIDASVSVYSAGRSDEHVVVQPTTIAEAEPVPLVEYPRTTAYDGPLQSTSKGAEMEGQPLDAHVSAYHHGRSDMAPPAAPKETITTKLTSIFKKTTAHEDEYPPKTEPFLGPVAQTNRQRELEAVPVVDRIERIPK

SEQ ID NO: 120778 - protein, 238 aa, Heterodera glycines
  misc_feature (19)..(19): Xaa can be any naturally occurring amino acid
  misc_feature (231)..(231): Xaa can be any naturally occurring amino acid
  Coding regions on vcDNA: vcDNA=SeqID_47201; Strand=+; Position=1 -94,137-298,552-686,730-950
  Homolog annotation: Hit_ID=CAE71104.1; Match level="QueryCoverage =92%, HitCoverage=23%, E-value=7e-52, Identity=48%"; Hit description =Hypothetical protein CBG17957 [Caenorhabditis briggsae]
  Essential gene: C elegans homolog=C35D10.4; Phenotype=Age,Unclassified
DSIHRTLFVSSSQHKLCFXALKELFVWRFMQTDPNWSNFLFAPNPSMDTDPNWSNFLFAPNPSMDRYQLVLLDFGSTRSFSKTFIDKYMRILKAAYAADREEMLKWSREIGFLTGYETKTMEQAHCEAIAIIGETLTCTDAYDFSEQSVTPRINKLVPVMLEHRLTASVTPRINKLVPVMLEHRLTAPPDEIYSLHRKLAGSFLTAAKLKASVACGRLFLNYFANYIYFTXSFILFVD

SEQ ID NO: 120779 - protein, 203 aa, Heterodera glycines
  Coding regions on vcDNA: vcDNA=SeqID_47202; Strand=-; Position=1-612
  Homolog annotation: Hit_ID=NP_491608.1; Match level="QueryCoverage =66%, HitCoverage=59%, E-value=8e-44, Identity=67%"; Hit description =ribosomal Protein, Large subunit (23.7 kD) (rpl-19) [Caenorhabditis elegans] gb|AAB53979.1| Ribosomal pro
  Essential gene: C elegans homolog=C09D4.5; Phenotype=Lva,Ste
MGSAKRHGTRNARMPEKVIWMRRMRVLRHLSKRYRDAKKIDKHLYHELYLKAKGNAFKNKRNLMEYIFKKKTENQRSKQLAYGFWVQLNSAQPVILCFREQAEARRNKNKETRKRREERLVQKRKELLHKISESEKEKTPQPLVTKPAEKEQPKPQPVAARTADKEQPKTQPAAVKTAEKEQPKSKTETVGKRVLVGVSLIEV

SEQ ID NO: 120780 - protein, 291 aa, Heterodera glycines
  misc_feature (163)..(163): Xaa can be any naturally occurring amino acid
  misc_feature (245)..(245): Xaa can be any naturally occurring amino acid
  Coding regions on vcDNA: vcDNA=SeqID_47203; Strand=+; Position=1-888
  Homolog annotation: Hit_ID=NP_510671.1; Match level="QueryCoverage =96%, HitCoverage=28%, E-value=1e-41, Identity=33%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
LGPLLFLIYINDLPDALPSGVRIKLYADDVKLYICYSKNRNSMHKALHNLSEWENKWQIRISIKKTFIHLGNKNPKEIYKIDGNIINVVDTIRDLGINIDNKLQFSNHVTQVIKNAYLRMRSLFRVIKSKSSRIWIILYKTYVRPLLEYAPEVWNPSLLKNIXKIEKCQKYFTKRVLFKCSLPPIPYQQRLEYLQLPTLESRRKLSDLFMAHKIIYGRTEIPLKYLNLLNALTFPFIDLTRKINXAKKLYLLRGGTKIWNQLDKKLIEINSLNQFKNKIKTFISVRLTGKI

SEQ ID NO: 120781 - protein, 384 aa, Heterodera glycines
  Coding regions on vcDNA: vcDNA=SeqID_47204; Strand=-; Position=1 -138,194-1210
  Homolog annotation: Hit_ID=NP_498735.1; Match level="QueryCoverage =99%, HitCoverage=89%, E-value=2e-41, Identity=28%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MSRVYLFLELSIQKEDAGGRWVPIEAADQLVGPIQCIGQTFVQQLKVEVQNTELYDSGTLYPYKAYLTNELSFPNSAKGHFMASAGYHPSLKHDSATDAGFMARCARFEGGRKARFLSRLDFDLGNQELYLLNNMDVLFTIYRAKNTFLLQNLAPAPAAGAAARQQYALYLHDIKLYMKVVEVQPSLNLSIYKTLEKQPATYAVRKTEVKSVFLTAGRTEMDHNIFSAAIPRRLTIALVANGAFNGQLAQSPFNFKPYSIREISVHAGGQMYPAVPHRMDFSGAAYIRPFVDMYEALGMANSERSMDITLDQFRDGWTIFVVPMTSTLDDSCGFELLRSGTTSIRLAFNEEIPAGGVEMVVLGEFDQLIMIDYNRHIVSDSKIA

SEQ ID NO: 120782 - protein, 176 aa, Heterodera glycines
  Coding regions on vcDNA: vcDNA=SeqID_47205; Strand=+; Position=1 -66,2093-2236,2274-2441,2556-2705
  Homolog annotation: Hit_ID=NP_728118.1; Match level="QueryCoverage =86%, HitCoverage=46%, E-value=3e-22, Identity=40%"; Hit description =CG32495-PC, isoform C [Drosophila melanogaster] gb|AAN09450.1| CG32495-PC, isoform C [Drosophila melanoga
  Essential gene: C elegans homolog=M176.2; Phenotype=Emb,Lva
MQLLYFRVGCDFDFLFEAYKDVLLASPGGVERFFPDPAEADKVKAIREIFTGLWGLEGHDEKTERIIAVEDAIENPSNYVLKPNGECGGNNYYDDQLVEKLRTMTNNQEERAAHILMQKLHPMITKNYFLRPTILPRLGVVVSELGVYGTLMGNMLDRTVSYNAQSGHLLRTKLAG

SEQ ID NO: 120783 - protein, 156 aa, Heterodera glycines
  Coding regions on vcDNA: vcDNA=SeqID_47206; Strand=+; Position=1 -24,84-530
  Homolog annotation: Hit_ID=A48145; Match level="QueryCoverage=66%, HitCoverage=68%, E-value=1e-29, Identity=57%"; Hit description =ubiquitin-conjugating enzyme ubc-2 - Caenorhabditis elegans
  Essential gene: C elegans homolog=M7.1; Phenotype=Emb
MALRRIKQELAELKQEPITGCTAAPMDDGKDMFHWKATIKGPPESPYEGGTFNMDIVFRRDYPFTPPIVKFETPVYHPNVNKQGGICLDVLKTTHWAPSLTISKGESDAGKSRQNADKILRRQNDPIQNDHQNRTFWKSVDILSCEWDFSNSEMPF

SEQ ID NO: 120784 - protein, 185 aa, Heterodera glycines
  Coding regions on vcDNA: vcDNA=SeqID_47207; Strand=-; Position=1 -411,458-601
  Homolog annotation: Hit_ID=NP_871964.1; Match level="QueryCoverage =80%, HitCoverage=21%, E-value=9e-25, Identity=42%"; Hit description =3'-5' exonuclease (68.1 kD) (2K881C) [Caenorhabditis elegans] emb|CAD59140.1| Hypothetical protein C14A4.
  Essential gene: C elegans homolog=C14A4.4a; Phenotype=Lva
MRLMLAGGDEAMEENGRMEESTGKGMAREWPSDAQADEGGRMSLGNGATAEDEAVEEHPYAEELAQFEPTEHSQMMALPETVKVSVFHLYTFMQLFFLFKKPTPLESSPPIWVRQLKDLEALIDTLNEVHEFSFDVEHHSFRSFLGLSCLLQISTRSADYLVDPFPLWPHLHLLNEPFTNPNIVK

SEQ ID NO: 120785 - protein, 575 aa, Heterodera glycines
  misc_feature (48)..(48): Xaa can be any naturally occurring amino acid
  misc_feature (62)..(62): Xaa can be any naturally occurring amino acid
  Coding regions on vcDNA: vcDNA=SeqID_47208; Strand=+; Position=1 -143,1368-1591,1911-2145,2447-2488,2669-2778,2839-2916,3181-3276,3378- 3451,3674-3825,3889-3953,4200-4265,4698-4936,5224-5367
  Homolog annotation: Hit_ID=CAE59824.1; Match level="QueryCoverage =98%, HitCoverage=38%, E-value=1e-148, Identity=48%"; Hit description= Hypothetical protein CBG03294 [Caenorhabditis briggsae]
  Essential gene: C elegans homolog=ZK675.1; Phenotype=Unclassified
FFNFSICQTAILLTTNLFGIFFIYPAFIALDLKRRKAGRRDLEFLCYXKTKIGSFPINNRPXTAFKYIFYQNNYFLLFTIASKISVSQNATPTPSAETVQNYTLHGFLHIVYIPLLRRRAVKFAILVTMVALFALGIYGLSRSTIGLELSDVLPDNTAPAAFLKTRDKLFSFYPMAVVIRGANVDFAAQQHQIDLLRRDIGLSPFVVKLPDGEPSERYWLQLFRDWLRGMQQRLDVAKRDGLLDNFDGDGTAKHHSPDLQIAYSLAAKHHSPDLQIAYSLACSYGQNYDCARKAGTVRLIDESGTINTEGFYNYLYGWHEYEQMFYSVSQASFYPRLRKLRQGPPGPMNFIPPAPKPLFSRIPFYCDGLRDTPTIMRMIREIRAISENYSRAGLPNYPEGVAFTFVAFTFWEQYLHLDYYLVLAIGIISVSVFCVISTIIFNPWAPLWVTCVVASMTVELAGFMGLAGVKLNPISSVTLITAVGIGVEFTAHVALAFLTSLGTREERMVNAQHMFVPVIHGGMSTLLGIIMLAFSDFDFVVQYFFVVLTALVIIGLFNGLAVLPVLLAYVGPPCE

SEQ ID NO: 120786 - protein, 317 aa, Heterodera glycines
  misc_feature (312)..(312): Xaa can be any naturally occurring amino acid
  Coding regions on vcDNA: vcDNA=SeqID_47209; Strand=+; Position=1 -127,190-413,469-794,1013-1153,1588-1707
  Homolog annotation: Hit_ID=NP_501798.1; Match level="QueryCoverage =100%, HitCoverage=77%, E-value=2e-61, Identity=40%"; Hit description= novel nuclear protein 1 (45.9 kD) (4K746) [Caenorhabditis elegans] emb|CAA93111.1| Hypothetical protein
  Essential gene: C elegans homolog=C47E12.7; Phenotype=Lva
MDEDMEEVEIVFAQRLASGEPTARQRAMKHLRTHIRERTKTDGFSSVSLARLCKGLHYALWMQDKMTLQEELADEICALCNYFRTDEQLLEFVVVLFTTLSKEWPHIDRWRMDKFLMLVRRLVRTLVRRLVRTLFRQLSSHRWDPPLCDQFLQMFRSSLLSANSPLCESLKFHCASVWLDELDTAATAKVTPSEGNAGKNCEAFPLDEQRSLDFVWPYVQLLQEQISWEINKLVNLQKKTEEKSSSFEFDYKRIGELLFEVGKQQKVPSRRRKRIYALCKKFECAAQGDDPFHLEGVKIRKKKRRRKNSSSXQVAIV

SEQ ID NO: 120787 - protein, 137 aa, Heterodera glycines
  Coding regions on vcDNA: vcDNA=SeqID_47210; Strand=-; Position=1 -137,201-477
  Homolog annotation: Hit_ID=AAO14563.2; Match level="QueryCoverage =100%, HitCoverage=19%, E-value=6e-71, Identity=98%"; Hit description= Hsp90 [Heterodera glycines]
  Essential gene: C elegans homolog=C47E8.5; Phenotype=Emb,Ste
MVTGEYGWSANMERIMKAQALRDSSTMGYMASKKNLEINPDHSIIKSLRDRVEKEQDDKTAKDLVVLLYETSLLTSGFSLEDPQQHASRIYRMVKLGLDIPDEEEPAEQQPSTSGEPTIAEKIAGAEEEASRMEEVD

SEQ ID NO: 120788 - protein, 193 aa, Heterodera glycines
  Coding regions on vcDNA: vcDNA=SeqID_47211; Strand=-; Position=1 -147,441-560,629-940
  Homolog annotation: Hit_ID=CAE65924.1; Match level="QueryCoverage =66%, HitCoverage=8%, E-value=9e-18, Identity=34%"; Hit description =Hypothetical protein CBG11092 [Caenorhabditis briggsae]
  Essential gene: C elegans homolog=F26H11.2c; Phenotype=Gro,Stp
SLLLCEIHLAFLRLFFREEDSEHTIFAATETTVSVNILIQLMDSMSFAEHSNYPFVELDKRLRVLKWMCERFFQFDLIKRIVGGTHKTVHDEQCRSCGKAGGGFGKLLACAECEAVYHVHCDADLVPGPTPPPQPQAPPPNPQTVPSSASDPTTATSNGGGGAGGGVAVTTAPATPVAAEDDPNWRCPLCRIY

SEQ ID NO: 120789 - protein, 441 aa, Heterodera glycines
  Coding regions on vcDNA: vcDNA=SeqID_47212; Strand=+; Position=1-1326
  Homolog annotation: Hit_ID=NP_498735.1; Match level="QueryCoverage =95%, HitCoverage=100%, E-value=1e-46, Identity=30%"; Hit description= predicted CDS, putative cytoplasmic protein family member (3J53) [Caenorhabditis elegans] gb|AAK84536.1|
  Essential gene: C elegans homolog=F19G12.2; Phenotype=Unclassified
MTFHKIDASSIDSITNAVDFFSIPPTNVTVSSSKVFEILPSNPLTDTPYHFKIHSSQNYIDLSKCYLLTEFRMRKLTAPNGEWGYLDATDQVVPIQLIGHTFIRDMKIAINGREIFNSNSLMAYKTYLSHELSQSLEAKVSHLTAAGYDREDASNLQNANSEGFKSRRQRYLGGRTAQYIAKIDADLFNVPQYLINHCEIDITIQPHDDNFLLIDTLDPPGQPYNIELVGLKLYCKKVSLMDGLALELAKKLEMKPARYAVRKTMMKALFISPGRYEFNANLFMDQVPRRVTMGLVANSDYVGNTKRSPFNFQHFNVRELSVVANGRSYPQAPYDIDYENWKFVRPYNDTQEALGFANSTYGNGIDYFSFLHTHCIYVFNMTNSGDDHGGLFDLIKKGCTAVNIKFKKPVPDGGITLIVMGEADSIYFLDKNRTIATDTTI

SEQ ID NO: 120790 - protein, 180 aa, Heterodera glycines
  misc_feature (115)..(115): Xaa can be any naturally occurring amino acid
  misc_feature (179)..(179): Xaa can be any naturally occurring amino acid
  Coding regions on vcDNA: vcDNA=SeqID_47213; Strand=+; Position=1 -57,432-578,634-876,1863-1917
  Homolog annotation: Hit_ID=AAL78218.1; Match level="QueryCoverage =100%, HitCoverage=100%, E-value=2e-66, Identity=73%"; Hit description=histone Hgg-28 [Heterodera glycines]
  Essential gene: C elegans homolog=ZK131.1; Phenotype=Unclassified
MTDTANRQRRGRGERRTRVLLRDSAKKITKASILRLARRAGVARINAEVYDEVRAALRSYLETIIRDAAIYCQHERRKTMKAIYCQHERRKTMKSRDVVHALKRQGNLMYGFEQXAQGRGGRIYLEPAPYDIFMDNYYHCTYVCICLYCIVYCFVIYQCNSGPKCPLLAIISKNFVWFXK

SEQ ID NO: 120791 - protein, 241 aa, Heterodera glycines
  Coding regions on vcDNA: vcDNA=SeqID_47214; Strand=+; Position=1 -78,149-194,537-894,954-1196
  Homolog annotation: Hit_ID=CAE62667.1; Match level="QueryCoverage =86%, HitCoverage=14%, E-value=1e-33, Identity=40%"; Hit description =Hypothetical protein CBG06805 [Caenorhabditis briggsae]
  Essential gene: C elegans homolog=F54G8.3; Phenotype=Pvl,Stp,Unc
QKPPNAWLCDQKQRTAREGRKSSDGQLVPRFFDGLPMLTLMHIILTGLPGARKWTGGVFGNFYQSIFLSMPVCTIGNNCVTFSSARYEFTDSDGFTDLVDRRTMDVSKEQRGIINVLTSHDYLGYSVRYGRFGFWYEHTEAGEEAANFTVVSGATRYNQTGAVVFLPFWRHVQAENQRQLGLSDDFFLLAGHQLGSGFGSALEVLDLNADGFDDLLVGAPFEFHLRSDGASGGAVYVFYSA

SEQ ID NO: 120792 - protein, 241 aa, Heterodera glycines
  Coding regions on vcDNA: vcDNA=SeqID_47215; Strand=+; Position=163 -452,509-776,1094-1260
  Homolog annotation: Hit_ID=NP_491278.1; Match level="QueryCoverage =61%, HitCoverage=42%, E-value=2e-22, Identity=37%"; Hit description =CD45 family member (1E541) [Caenorhabditis elegans] gb|AAB52356.1| Hypothetical protein F47B3.1 [Caenorha
  Essential gene: C elegans homolog=K07F5.8; Phenotype=Stp
MSGRSGRSGKRRQDGPGRPSRSRQQQHTQRGVQSAYQGPREPPEQPTVRGWEDTHDFSSALKIFVNETTRRNVKELVNEYTELNAMPRPETSPEFTRHMDCNRYRDVICAEQGRVRLDNGRYIHANWITALGEQRFICTQGPLETTCADFWTMIVQENIESIVMLCDTVEQNKTKCHQYWPTPDKKESDGPEHSVALHIAYDTLQRGHRLNILSLARNLRQHRAQSVQTPDQYLYIYFVML

SEQ ID NO: 120793 - protein, 84 aa, Heterodera glycines
  Coding regions on vcDNA: vcDNA=SeqID_47216; Strand=-; Position=1 -126,184-250,300-359
  Homolog annotation: Hit_ID=NP_491261.1; Match level="QueryCoverage =100%, HitCoverage=41%, E-value=8e-16, Identity=45%"; Hit description= proteasome Beta Subunit (22.8 kD) (pbs-4) [Caenorhabditis elegans] gb|AAB37663.1| Proteasome beta subuni
  Essential gene: C elegans homolog=T20F5.2; Phenotype=Emb
MADNLRSEDMWRVNAIIGGFDSTDKKAYLTMIDYLATNIPPQNFIFYGFPGAFAYSIMDSFYRTDLTEQEGLGLVQRMIDQVKR

SEQ ID NO: 120794 - protein, 110 aa, Heterodera glycines
  Coding regions on vcDNA: vcDNA=SeqID_47217; Strand=-; Position=1 -229,573-673
  Homolog annotation: Hit_ID=NP_491896.1; Match level="QueryCoverage =88%, HitCoverage=15%, E-value=2e-18, Identity=48%"; Hit description =metalloenzyme (59.2 kD) (1H147) [Caenorhabditis elegans] gb|AAB96720.1| Hypothetical protein F57B10.3a [C
  Essential gene: C elegans homolog=F57B10.3a; Phenotype=Age
MDRDNRWERIKALIFEKNIVFGLAFFLKVAYEALVAGEGEKCEPANAVQLVNERYANQQTDEFLTPIVFSDEARVKDNDTLVFFNYRADRMREITSAWVVCKTCRIWAPM

SEQ ID NO: 120795 - protein, 269 aa, Heterodera glycines
  misc_feature (227)..(227): Xaa can be any naturally occurring amino acid
  Coding regions on vcDNA: vcDNA=SeqID_47218; Strand=+; Position=1-830
  Homolog annotation: Hit_ID=NP_508294.1; Match level="QueryCoverage =98%, HitCoverage=23%, E-value=7e-35, Identity=30%"; Hit description =predicted CDS, endonuclease/exonuclease/phosphatase family and RNA -directed DNA polymerase (XC178) [Caeno
  Essential gene: C elegans homolog=ZK250.3; Phenotype=Clr,Lvl,Sck
PSRVKIKLYADDVKLSRADTEIMHKALHNLSEWANKWQIRVSIKKTFVLHLGNKNPKEIYKIDGNIINVVDTIRDLGINIDNKLQFSNHVTQIIKNAYLRMRSLFRVIKSKSSRIWIILYKTYVRPLLEYAPEVWNPSLLKNIKKIEKCQKYFTKRVLFKCSLPPIPYQQRLEYLQLPTLESRRKLSDLFMAHKIIYGRTDLNPFKYSNLLNALTFPFIDLTRNINXAKNLYLLGRVTKIWNQLDKRLIEINSLNQFKNKIKTISIPVK

SEQ ID NO: 120796 - protein, 335 aa, Heterodera glycines
  Coding regions on vcDNA: vcDNA=SeqID_47219; Strand=-; Position=1 -39,292-574,675-946,1069-1480
  Homolog annotation: Hit_ID=CAE73788.1; Match level="QueryCoverage =82%, HitCoverage=34%, E-value=2e-65, Identity=44%"; Hit description =Hypothetical protein CBG21338 [Caenorhabditis briggsae]
  Essential gene: C elegans homolog=T20F10.1; Phenotype=Gro,Slu,Unc
MEYVPGGDMMQLLPDNILIDRSGHIKLTDFGLCTGLRWTHDKRHYVVYDEQSNGAPIGHVRDDSFSLPPGLDQRVKVLEMRHHRKRDRAHSVVGTGNYMAPEVVQKIGHTQLCDWWSVGVILYEMVYGRPPFLSQRDDPAETQFMIVHWRRFLDLRNAMGVRLSKQCVDCVAKLCCDQENRLGHRNGAKDIKAHPWFKNPEDTSNFDTFEVENEELIRTNGNGNDRLKCAAYGGGKPLGPNFIDFTFRHFFSEGMCPPARGRSPQVRPSLAPLMESSTEGGNAAKSPAGEVFAKPKQIVTITGKAKVVPFTSSKRVPAPSIPSDSSKATTVQIGG

SEQ ID NO: 120797 - protein, 152 aa, Heterodera glycines
  Coding regions on vcDNA: vcDNA=SeqID_47220; Strand=+; Position=1 -212,270-350,1348-1512
  Homolog annotation: Hit_ID=XP_392223.1; Match level="QueryCoverage =36%, HitCoverage=4%, E-value=7e-09, Identity=47%"; Hit description =similar to FtsJ homolog 1 isoform b; cell division protein; rRNA (uridine-2-O-)-methyltransferase [Apis me
  Essential gene: C elegans homolog=C16C10.2; Phenotype=Lva,Lvl
AKELLICHSSSPTASPQPSGCFLTSANVVAELDRIRREQNRSGAGEADGQSTAATTPNASRRPSNSSAAAVSGSVEDELAKIKVVLRQHERRIRLLEPGNETIRGHLEKRKDWIRRTRDHQEKSADIKKLKRSARERNPDEFHFHMLRSQIG

SEQ ID NO: 120798 - protein, 155 aa, Heterodera glycines
  misc_feature (141)..(141): Xaa can be any naturally occurring amino acid
  Coding regions on vcDNA: vcDNA=SeqID_47221; Strand=-; Position=1 -208,259-462
  Homolog annotation: Hit_ID=NP_493695.1; Match level="QueryCoverage =83%, HitCoverage=62%, E-value=2e-28, Identity=51%"; Hit description =mitochondrial ribosomal protein L41 like (20.9 kD) (2A579) [Caenorhabditis elegans] gb|AAB37899.1| Hypoth
  Essential gene: C elegans homolog=B0432.3; Phenotype=Lva
TYLFSQHSLMVRHVTASCFRAPWPFEKKGSTGWRKNGPVVIESHKWPGQQKEFPELSPKFLGANFKQLWRYTGVAPTGFNDPKTDDFVYTGVAPTGFNDPKTDDFVHVPEMVPELVVPDLANFELKPYVSYKTDAKIEERXKKFKTTNISIALGY

SEQ ID NO: 120799 - protein, 190 aa, Heterodera glycines
  Coding regions on vcDNA: vcDNA=SeqID_47222; Strand=-; Position=1 -24,97-213,269-496,657-860
  Homolog annotation: Hit_ID=AAH61765.1; Match level="QueryCoverage =99%, HitCoverage=36%, E-value=3e-78, Identity=76%"; Hit description =Seryl-aminoacyl-tRNA synthetase [Rattus norvegicus] ref|NP _001007607.1| seryl-aminoacyl-tRNA synthetase [R
  Essential gene: C elegans homolog=C47E12.1; Phenotype=Emb,Lva,Ste,Unc
MSTCFRQEVGSHGRDTRGIFRVHQFEKIEQFVICSPFDNESWKHMDEMIDNAEEFCKVLGLPYRIVAIVSAELNNAAAKKLDLEAWFPGSGAFRELVSCSNCTDYQSSRLRIRYGQTKKMDGEVNYVLMLNATMCDTTRVICAILENNQTEDGIVVPEPLRPFMPSQYSQRIPFVKPAPIEQEKVQKKKK

SEQ ID NO: 120800 - protein, 214 aa, Heterodera glycines
  Coding regions on vcDNA: vcDNA=SeqID_47223; Strand=+; Position=1 -26,364-419,575-622,1067-1194,1641-2015,2094-2105
  Homolog annotation: Hit_ID=CAA10901.1; Match level="QueryCoverage =84%, HitCoverage=45%, E-value=2e-55, Identity=62%"; Hit description =GSK3 beta [Paracentrotus lividus]
  Essential gene: C elegans homolog=Y18D10A.5; Phenotype=Emb,Gro
MYQLFRALGYYRAPELIFGATDYTTKIVLAELLLGQPFFPGDSAGVDQLVEIIKVLGTPSRDEIQHMNPNYTEFRFPMIRPHPWHRVFRARTPQEAIDLVSHLLKYTPSVRPSPFEALAHDFFDELRSPTCKMPSTGGPLPPLFDFTEHELQIEPRLNEKLVPKCQSASASSSLSATMPKTSTAPDGGGAKQQEGVGGGVVKTDESDSKQQGLY

SEQ ID NO: 120801 - protein, 427 aa, Heterodera glycines
  Coding regions on vcDNA: vcDNA=SeqID_47224; Strand=-; Position=1 -21,62-229,290-319,374-518,812-839,894-1085,1972-2066,2289-2351,2418 -2517,2952-2989,3021-3195
  Homolog annotation: Hit_ID=CAE70246.1; Match level="QueryCoverage =92%, HitCoverage=33%, E-value=1e-107, Identity=51%"; Hit description= Hypothetical protein CBG16735 [Caenorhabditis briggsae]
  Essential gene: C elegans homolog=F08C6.1a; Phenotype=Dpy,Lva,Unc
AKFFDPNVWVHPLRGQGKFEKTLSFKTKFFDPNVWVHPLRGQGKFEKTLSFKTLNLSHNFWLLELFLIISTHFSTRIVRYEVYQTQPSAIASSAIASYLHENGNAQRYLDLFCRHQRNLGNAQRYLDLFCRHQRNLGAREWDHALMLTGFDIHRGYGATSISGIARLDGMCDSWNSCTLAETLAEGLDFTSAFIGTHELGHAVGMRHDEPYCPGTHIMSASLGPGKVTWSSCSTRDYQMFIQRLDARQNNCMRSSLLREQLPITESLKPGQVYDAHEQCRLMHGPSYVQVSPRHDHYDGVCHMMWCGQSNYGRGVCHMMWCGQSNYGRIITSHPALEGTVCGTNQWCSLGRCMPWGSSAPLQPQPVATVPMLTPLQPQPVATVPMLTTVMSNDGQFSAWNARQGNPCQIHAYAGRVASARSASGPTM

SEQ ID NO: 120802 - protein, 438 aa, Heterodera glycines
  Coding regions on vcDNA: vcDNA=SeqID_47225; Strand=+; Position=1-1317
  Homolog annotation: Hit_ID=NP_508269.1; Match level="QueryCoverage =99%, HitCoverage=66%, E-value=6e-49, Identity=30%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTFHKIDNDSVNSITNALDFFRIPPTNVSVSSSKVFELLPSNPLTDTPYHFKLHSSQNYIDLSKCYLLTEFRIRKENVNGQLINLGIDDINIAPIQMIGQTFIRNIKMSINGREIFNANALMAYKSYFSHELSYSTTAKDSHLNAAGYYRDTGDTLEMGGGCTARRDLFAGSNVAQFIAKIDTDLFNQPLYLINFCELDIEILPNDNDFVLISPVVGAPKYHFEVMGLKMYVKKVSLMDGLALDIARKLELKPARYAVRKTMMKSMFISQGRYEFTANLFMDQIPRRITMGLVANTDYVGTIRRSPFNFQPFNVREISIIANGRSYPQAPYDLNYPNGKFVRPFNDMNEAVGFSNSSESNGITFAQYGRTHCIYVFNMTNSGDDQAALFDLIKNGTTAVSIKFNHPVPDGGIMLVVMGECDSLVMLDKNRSISTDTTI

SEQ ID NO: 120803 - protein, 274 aa, Heterodera glycines
  Coding regions on vcDNA: vcDNA=SeqID_47226; Strand=+; Position=1 -114,357-701,971-1336
  Homolog annotation: Hit_ID=CAA65506.1; Match level="QueryCoverage =67%, HitCoverage=54%, E-value=1e-14, Identity=32%"; Hit description =cuticular collagen [Teladorsagia circumcincta]
  Essential gene: C elegans homolog=EGAP7.1; Phenotype=Dpy,Unc
MNQQKEEKKASKGEREEDVKVLLAEAERFKRLAFLGVMYEIVRRPKRSPMVSQFLISNHGSLSAAQFTPNTAQRRKSRQGGYEQVIAGYAAAGSQVAPPPAPPAPANAYPGNNSPPPPAQEVPQAPPSSPAPSAANYAAGAQAPSAGAQQVPLLLTPDRPAGWAPKGHPDSQDCQANPEFRERPGLKAPRAHPAPAERMDRPDSRDQEVKEKGAEQMQAYTSGLDGQLSDVPGVQGPPGPVGPPGPPGVPGEPGQQGQSQVMRGRAENNHANGH

SEQ ID NO: 120804 - protein, 340 aa, Heterodera glycines
  Coding regions on vcDNA: vcDNA=SeqID_47227; Strand=+; Position=1 -253,402-482,691-818,1044-1209,1434-1480,1523-1675,1798-1933,2021-2076
  Homolog annotation: Hit_ID=NP_500617.1; Match level="QueryCoverage =99%, HitCoverage=35%, E-value=1e-133, Identity=61%"; Hit description= dehydrogenase, E1 component and Transketolase, central region (115.7 kD) (4F462) [Caenorhabditis elegans
  Essential gene: C elegans homolog=T22B11.5; Phenotype=Emb,Lva
EYVDEELKKYGAILENAHESAKQVTELRNRDWLDSPWDDFFRGKNPSQLLPTGIERDSLEHIVNKISQVPDGFNLHRGLLRLLKGRKEMLSENNLDWSIGESLAYGSLLMEAFLSLNFFLCQTQAEYTVCNSSLSEYAVLGFELGYSVVNPNSLVIWEAQFGDFANTAQCIIDQFISSGQAKWIRQTNLTLLLPHGSEGMGPEHSSARPERFLQMCNEDDGIDLKSVALDEAFVARQLNETNWIVANCTTPANFFHLLRRQIYLPFRKPLIVFTPKSLLRHPLAKSPVDDFLPGTSFRRAIPEEGSATNNPAAVERLVFCSGKVYYEILTERRNQGLDDK

SEQ ID NO: 120805 - protein, 79 aa, Heterodera glycines
  Coding regions on vcDNA: vcDNA=SeqID_47228; Strand=-; Position=1 -78,242-403
  Essential gene: C elegans homolog=ZC513.1; Phenotype=Unclassified
MAPLAKTFLGPELARGLKEGLPYPLKDTIRFIRPKLTLHEGYIRLATDFELSEQHMRQRVAEAFERIKNEHEPPGQFRN

SEQ ID NO: 120806 - protein, 144 aa, Heterodera glycines
  Coding regions on vcDNA: vcDNA=SeqID_47229; Strand=-; Position=1 -150,197-239,324-479,531-616
  Homolog annotation: Hit_ID=NP_497619.1; Match level="QueryCoverage =96%, HitCoverage=98%, E-value=2e-25, Identity=41%"; Hit description =putative cytoplasmic protein (16.3 kD) (3D877Co) [Caenorhabditis elegans] gb|AAK29975.1| Hypothetical pro
  Essential gene: C elegans homolog=Y71H2AM.4; Phenotype=Lva
MESTRISEAEIKRREAQMMEGARPFNVFDPFTWSFPGKIAATSTGILTCSVTYYMLWYRKPWYAALNMKILIFAAGISGAYFIAKSRARVMADRDAVVSHYVQTHPEDFEHLTLNNFYGRPYRDLLLPWVPIRAQYNKLEKEAN

SEQ ID NO: 120807 - protein, 413 aa, Heterodera glycines
  Coding regions on vcDNA: vcDNA=SeqID_47230; Strand=+; Position=1 -148,201-254,302-424,468-645,974-1350,1392-1508
  Homolog annotation: Hit_ID=CAE74915.1; Match level="QueryCoverage =98%, HitCoverage=50%, E-value=1e-146, Identity=67%"; Hit description= Hypothetical protein CBG22795 [Caenorhabditis briggsae]
  Essential gene: C elegans homolog=C03G5.1; Phenotype=Unclassified
FICYFRRMLRKLKHSASFPLISAFTRRFSKNVSGYKIVDHTFDAIVVGAGGAGLRAAMGLSEGGGAGLRAAMGLSEGGMKTAVITKLFPTRSHTVAAQGGINMKTAVITKLFPTRSHTVAAQGGINAALGNMNPDDWRWHFYDTVKGSDWLGDQDAIHYMTREAPRAVIELEGSDWLGDQDAIHYMTREAPRAVIELENYGMPFSRTEEGKIYQRAFGGQSNDFGRGGQAHRTCCVADRTGHSLLHTLYGASLQYNCNYFVEYFALDLLMSREGHCVGVVAINLEDGSIHRFRAANTVLATGGYGRAYFSCTSAHTCTGDGTALVARAGLCNSDMEFVQFHPTGIYGAGCLITEGCRGEGGFLINNEGERFMERYEGGFLINNEGERFMERYAPVAKDLASRDVVSRSMTIEI

SEQ ID NO: 120808 - protein, 616 aa, Heterodera glycines
  misc_feature (349)..(349): Xaa can be any naturally occurring amino acid
  Coding regions on vcDNA: vcDNA=SeqID_47231; Strand=-; Position=1 -104,690-769,1020-1269,1315-1521,1568-1701,1775-2169,2254-2402,2634 -2846,2900-3053
  Homolog annotation: Hit_ID=CAE74694.1; Match level="QueryCoverage =99%, HitCoverage=99%, E-value=1e-110, Identity=39%"; Hit description= Hypothetical protein CBG22508 [Caenorhabditis briggsae]
  Essential gene: C elegans homolog=F52C12.2; Phenotype=Unclassified
GRKRRTKSIRPPRANRSPSRKDVKTERRSSEREKRGDSDEEKRSERTTEEMGGESCEEMEDFPRRLAMFDFGQCDPKRCSGRKLCRVGLVSVQRFSHRFPGLLLTPAASVTISPVDRPLVMAKGLAVVDCSWNRLDTTPMHKAKGSEHRLLPFLLAANPVNYAMPFKLKGSEHRLLPFLLAANPVNYAMPFKLSCVEAFAAALFIVGLEEAAKCVLAPFKWGPNFLALNAEVLSAYAKCSSGDEVIRCQRQFMEKIEACSSGDEVIRCQRQFMEKIEAEAKRSKERTVKYPTSSSEEDEEAEEAKLKYLFGFKGAKLKYLFGFKGWIIWGLLHFFGWAISLKFTQNPFXALRLKSLPTEGASVALQKTETVDAIVSQTDCELYEWNDALFQGAEARLFACTFLRRRAVMKERFVKRYRHAELDARLAKERTRAELKAILKCQEIGIGIRVPSVFFVDPLKNRIIFELICSSGSSDRAPTAKHFLDKLQRDESASKLAEFGHEFGRILRTMHDANLIHGDLTTSNVLVLTNGDQSLALIDFGLAQFSSKPEDKAVDLYVLERAIRSAHIGMAHIGMGKMMDAILDAYKTKGAEGTRTAVLLKLDEVRRRGRKRDMIG

SEQ ID NO: 120809 - protein, 360 aa, Heterodera glycines
  Coding regions on vcDNA: vcDNA=SeqID_47232; Strand=-; Position=1 -100,226-321,375-578,766-1138,1208-1517
  Homolog annotation: Hit_ID=NP_725570.1; Match level="QueryCoverage =92%, HitCoverage=66%, E-value=5e-57, Identity=38%"; Hit description =CG4311-PE, isoform E [Drosophila melanogaster] ref|NP_725569.1| CG4311-PD, isoform D [Drosophila melanoga
  Essential gene: C elegans homolog=F25B4.6; Phenotype=Emb,Lva,Lvl,Unc
MDLEGADEKNACFGGTQALFHAVDWMYANYATEKRLAIVVCADVAVYSAGPARCTGGAGAVAFLIGPNAPIALERGLRACHSQNVYDFYKPIGGVSTQFPRVDGPNSVETYLNAVDMCYGRFCEKWNKKFCTGPPCSLSDFVAVIFHSPYARLTQKAFSWLSFVDFKRGMMDDGVTADDDDVSDWDQLSAYKSKSLHEIFAVERTKTRSDGDRFTDKILRMSSRTADAKLNPFLEFSRRIGNMYTPSVYAQLINVFLNTELSDKSNGKRILIFSYGSGCIAAMYSLRFNLYTEKLMAAYGAIKQSAKKAHARLDQRIRHSPKQFTAALERTEQMSREGGQFGDEPPNEPFMYRYLHRNSR

SEQ ID NO: 120810 - protein, 198 aa, Heterodera glycines
  misc_feature (184)..(184): Xaa can be any naturally occurring amino acid
  Coding regions on vcDNA: vcDNA=SeqID_47233; Strand=-; Position=1 -295,339-425,501-611
  Homolog annotation: Hit_ID=NP_501180.1; Match level="QueryCoverage =85%, HitCoverage=26%, E-value=4e-46, Identity=59%"; Hit description =phosphate (57.5 kD) (4I161) [Caenorhabditis elegans] gb|AAB03157.2| Hypothetical protein C48A7.2 [Caenorh
  Essential gene: C elegans homolog=C48A7.2; Phenotype=Pvl,Stp
PPPPPPLSNAIAPLVSLYTIYDEGSVHQKGETSVYLLLYGAAGMCVGLWLLGHRVIYTVGENLTRITPPSGFSIEFGAALTVLFASKLGLPISSTQCKVGSVVAVGLVQAHPVVHWTVFRTQCKVGSVVAVGLVQAHPVVHWTVFRNISLSWLVTLPIAGVVTLPIAGVMSAIVMFLLRMLILXGSSEHHQRKGRLFM

SEQ ID NO: 120811 - protein, 99 aa, Heterodera glycines
  Coding regions on vcDNA: vcDNA=SeqID_47234; Strand=+; Position=1 -141,277-435
  Homolog annotation: Hit_ID=NP_776643.1; Match level="QueryCoverage =100%, HitCoverage=20%, E-value=8e-32, Identity=61%"; Hit description= tryptophanyl-tRNA synthetase [Bos taurus] pir||YWBO tryptophan-tRNA ligase (EC 6.1.1.2) [validated] - bo
  Essential gene: C elegans homolog=Y80D3A.1; Phenotype=Lva
INKYAFSGGRDTKEEHRQFGGDCTVDTSFQFLRFFLDDDERLEEIREQYASGAMFSGELKAIAIGIVQGIVSELQTRRKTITNDVVREFTTPRKLAYDF

SEQ ID NO: 120812 - protein, 273 aa, Heterodera glycines
  Coding regions on vcDNA: vcDNA=SeqID_47235; Strand=-; Position=1 -27,155-290,447-489,553-657,925-1026,1428-1580,1806-2069
  Homolog annotation: Hit_ID=NP_741442.1; Match level="QueryCoverage =98%, HitCoverage=15%, E-value=1e-110, Identity=75%"; Hit description= voltage-gated Calcium Channel Alpha subunit, putative L-type calcium channel alpha 1 subunit, EGg Laying
  Essential gene: C elegans homolog=C48A7.1a; Phenotype=Pvl,Stp
LSGKLPSLQVVLNAILRAMIPLLHIALLVLFVILIYAIIGLELFCGKLHSTCIDSVTLELAQLDPSTCGFSSAYHCEPSSASAIHSVRHKWLCSHNTTWMGPNNGITNFDNIGLAMLTVFQCVSLEGWTEVMYWVNDAVGREWPWIYFVTLVILGSFFVLNLVLGVLSGEFSKEREKANARGLFQKFREKQQLEEDLKGYLDWITQAEDIEQLGDDEHADEHGESGAGDGDEDGEHSDGETQRPSALLTQWRLLQRMNRRCRRGCRRMVKSQT

SEQ ID NO: 120813 - protein, 188 aa, Heterodera glycines
  Coding regions on vcDNA: vcDNA=SeqID_47236; Strand=-; Position=1-567
  Homolog annotation: Hit_ID=AAM95790.1; Match level="QueryCoverage =67%, HitCoverage=95%, E-value=3e-24, Identity=46%"; Hit description =histone H3.3 variant; TgH3.3 [Toxoplasma gondii]
  Essential gene: C elegans homolog=ZK131.7; Phenotype=Emb,Gro
MARTKQIAKKRMSEKKATEQDALVSKQNLPTQAVKKAGSDMGHRAKRQLATKSAPNRRPRYQASHLLPPPEEPLQQKRFKKRGALALQEIRKFQESVNLLIPRSTFFRVVREVTMKFADGMRWQGKALLALQTMTECHLVNMFEDVNMCALHAGRVTIMPKDIALVRKIRGETTLAPSSGLRQTNRRR

SEQ ID NO: 120814 - protein, 407 aa, Heterodera glycines
  Coding regions on vcDNA: vcDNA=SeqID_47237; Strand=-; Position=1 -57,118-155,205-312,686-944,1097-1357,1707-1858,1915-2017,2129-2374
  Homolog annotation: Hit_ID=NP_499212.1; Match level="QueryCoverage =100%, HitCoverage=42%, E-value=1e-110, Identity=78%"; Hit description=sex determination DEAH box protein, similar to pre-mRNA splicing factor ATP-dependent RNA helicase., Ma
  Essential gene: C elegans homolog=K03H1.2; Phenotype=Emb
ECGYAIRFEDCTSEKTIIKYMTDGILLRECLSDPDLDSYAAIIMDEAHERSLNTDVLFGLLRDVVARRSDLKLIVTSATMDADKFANFFGGHTPIFQIPGRTFPVEIYHARVPVEDHVDAAVKQAVKIHLGGMEGDILIFMPGQEDIEVSPSIHVTCALIKEKLGELDEAPPLAVLPIYSQLPSDLQAKIFQKAPGGMRKCIVATNIAETSLTVDGIFFVVDPGYCKLKVFTEKIGMDTLQQVPQCRRFAAVPFHGLTADGQHAELHVPALDIGCTGQHWPTDGFGTQNGGISAGPNTVQNAADVRGHGLQQRNFDHCVDAFHSFAVPESDHLTYLNTYIQWQKHKYSSKWCTDNFVHAKAMRKVREVRAQLAEIMESQRLEMLSSGTDWDVVRKCVCSAYFYNAAR

SEQ ID NO: 120815 - protein, 123 aa, Heterodera glycines
  Coding regions on vcDNA: vcDNA=SeqID_47238; Strand=-; Position=1 -126,177-260,735-896
  Homolog annotation: Hit_ID=NP_871701.1; Match level="QueryCoverage =86%, HitCoverage=67%, E-value=2e-14, Identity=40%"; Hit description =RanBP1 domain containing protein, Nuclear Pore complex Protein NPP-9 (95.6 kD) (npp-9) [Caenorhabditis el
  Essential gene: C elegans homolog=F59A2.1a; Phenotype=Emb
MTDKGGDSDDEAAEEFVPTGTFKPIVPLPSKVDVKSGEENEEVLFSARCKLFRYDPMDKKNKERGIGELKDFSESSEGIDEVFLLKFRDQTTAEEFANKLEETGKRLGETPKEKEAAEKEPRQ

SEQ ID NO: 120816 - protein, 140 aa, Heterodera glycines
  Coding regions on vcDNA: vcDNA=SeqID_47239; Strand=+; Position=1 -66,185-304,401-530,574-631,1107-1155
  Homolog annotation: Hit_ID=NP_508970.1; Match level="QueryCoverage =88%, HitCoverage=45%, E-value=6e-47, Identity=67%"; Hit description =SurFeit homolog (31.8 kD) (sft-4) [Caenorhabditis elegans] gb|AAB00591.1| Surfeit homolog protein 4 [Caen
  Essential gene: C elegans homolog=C54H2.5; Phenotype=Unclassified
MNQFRVGGQRELLGVAEDYADDILRHTKKILPHLARLFLVSTFIEDGCRMWVQWDDQREFMQESWSCGWFLAMLFVVFNFFGQILPVVMVMIRKYIGIACAILAGVVVLQTFAYHIIWDLKFLASVNLAFLLMPDILIVL

SEQ ID NO: 120817 - protein, 306 aa, Heterodera glycines
  misc_feature (63)..(63): Xaa can be any naturally occurring amino acid
  misc_feature (142)..(142): Xaa can be any naturally occurring amino acid
  Coding regions on vcDNA: vcDNA=SeqID_47240; Strand=+; Position=1 -79,132-452,652-917,1117-1258,1305-1343,1427-1450
  Homolog annotation: Hit_ID=AAM98028.1; Match level="QueryCoverage =88%, HitCoverage=15%, E-value=8e-65, Identity=51%"; Hit description =Inositol triphosphate receptor protein 1, isoform g [Caenorhabditis elegans]
  Essential gene: C elegans homolog=F33D4.2a; Phenotype=Unclassified
SFCNYILKVHQSKEMALRGGAATWRRHVRLKHHVRLKHLATDQYLSIMPISEERKESDSRRPXNGGKAKQRPSSSLSASSVVGHANSAADAFQLDSAFVLVPKHSEDPIRDDNLLFSLDPCAKCSTVSLFSHWSTFNLFAHXSGCWVHTTNPQITSNLFHSSKNEKGWVKVICEGHKVDKEAFALLPVPPNEVRDLDFANDACRALSQFVDLIRSGRSVGKEAINSTTQLLVDAIFFVTNASNHLADPLRLFNFTPIRDRQKLLREQGVLAQVFALLKAPFMPRQVFALLKAPFMPRQGSGEVQPL

SEQ ID NO: 120818 - protein, 66 aa, Heterodera glycines
  Coding regions on vcDNA: vcDNA=SeqID_47241; Strand=-; Position=1-198
  Homolog annotation: Hit_ID=CAE56255.1; Match level="QueryCoverage =93%, HitCoverage=9%, E-value=1e-20, Identity=74%"; Hit description =Hypothetical protein CBG23896 [Caenorhabditis briggsae]
  Essential gene: C elegans homolog=W06H3.3; Phenotype=Emb,Lva,Unc
MAEEPVKLILVTGGVMSGVGKGIVSSSIGVLLKGCGYRVTVIKIDPYINVDAGTFSPFEHGKLTLP

SEQ ID NO: 120819 - protein, 89 aa, Heterodera glycines
  Coding regions on vcDNA: vcDNA=SeqID_47242; Strand=+; Position=1 -100,450-618
  Homolog annotation: Hit_ID=NP_496011.1; Match level="QueryCoverage =95%, HitCoverage=17%, E-value=3e-10, Identity=36%"; Hit description =glutathione synthetase (55.4 kD) (2J706) [Caenorhabditis elegans] emb|CAB01655.1| Hypothetical protein M1
  Essential gene: C elegans homolog=M176.2; Phenotype=Emb,Lva
NIVPADVVKIAPFTLFPSPFPRELFVQAQKVHKAIQLMYFRAASNFEFLKDVHKGLLKTDQNFIETFKSIESRHLEGIKQPLTLFCNRA

SEQ ID NO: 120820 - protein, 126 aa, Heterodera glycines
  Coding regions on vcDNA: vcDNA=SeqID_47243; Strand=+; Position=1 -102,163-442
  Homolog annotation: Hit_ID=NP_509784.1; Match level="QueryCoverage =84%, HitCoverage=19%, E-value=2e-31, Identity=53%"; Hit description =abnormal DAuer Formation DAF-12, abnormal cell MIGration MIG-7, steroid hormone receptor-like, possibly N
  Essential gene: C elegans homolog=F11A1.3a; Phenotype=Unclassified
CESCKAFFRRNALRPKEFKCPYSNECEITALSRRFCQKCRLRKCFEVGMKKEWILSDEQLKRRKNARIKCQQQQQHPNGGGIAREHQHNRHNNQHQHHQQVERESTVRNGTYNDGGKWQKFGTTGE

SEQ ID NO: 120821 - protein, 108 aa, Heterodera glycines
  Coding regions on vcDNA: vcDNA=SeqID_47244; Strand=-; Position=1 -76,122-165,254-358,709-809
  Homolog annotation: Hit_ID=NP_871865.1; Match level="QueryCoverage =85%, HitCoverage=26%, E-value=1e-22, Identity=51%"; Hit description =putative endoplasmic reticulum protein family member, with at least 5 transmembrane domains, of ancient o
  Essential gene: C elegans homolog=F28B3.5a; Phenotype=Age
MAVAVADNANSNNNNAVLAIFFGQFGIGLMHTTFMFYYVKVFLNIFQVNEYWFNWSQLLFLIWNAINDPLFGYLQDVGGTWMKDRGKIFTYFGPFLVLSFPDHLVPVA

SEQ ID NO: 120822 - protein, 166 aa, Heterodera glycines
  Coding regions on vcDNA: vcDNA=SeqID_47245; Strand=-; Position=1 -193,447-544,605-815
  Homolog annotation: Hit_ID=CAE64199.1; Match level="QueryCoverage =59%, HitCoverage=22%, E-value=1e-25, Identity=53%"; Hit description =Hypothetical protein CBG08829 [Caenorhabditis briggsae]
  Essential gene: C elegans homolog=C37H5.6a; Phenotype =Emb,Gro,Pvl,Stp,Unc
NVAPFNPAALVPIRSSLRPILPSAVASPALAFRRQPSVASSAWSKPTKRVSAPVRSRLNCLTPILAVTKVDILDQFHEIKIAIGYELNGRQIEYPPATVDDWANLCVHYKTFEGWQSPTTSARQWEQLPDKCRAYLEFIQNQLGVPVEYIGVGKGREQLIVRTNNG

SEQ ID NO: 120823 - protein, 137 aa, Heterodera glycines
  Coding regions on vcDNA: vcDNA=SeqID_47246; Strand=+; Position=1 -174,220-381,435-512
  Homolog annotation: Hit_ID=AAG12473.1; Match level="QueryCoverage =91%, HitCoverage=32%, E-value=4e-49, Identity=76%"; Hit description =transcription factor DP1 [Brugia malayi]
  Essential gene: C elegans homolog=T23G7.1; Phenotype=Emb,Stp,Unc
MRTFQIRHRSTDKTRGLRHFAHKVCEKVKQKVQTNYNEVAEELVNEYFDNIVEVPSDPEKLQYDTRNIRRRVYDALNVLMAMNIIEKEKKEIRWVGLPTSSLAECRRLEEEKAQRQERIRQKTEQLQELIVQVIEQT

SEQ ID NO: 120824 - protein, 256 aa, Heterodera glycines; identical to SEQ ID NO: 119337
  Coding regions on vcDNA: vcDNA=SeqID_47247; Strand=-; Position=1 -192,260-324,387-511,571-809,876-1025
  Homolog annotation: Hit_ID=NP_491237.1; Match level="QueryCoverage =99%, HitCoverage=82%, E-value=5e-73, Identity=50%"; Hit description =protein phosphatase 1A (34.6 kD) (1E406) [Caenorhabditis elegans] gb|AAB42233.1| Yeast glc seven-like pho
  Essential gene: C elegans homolog=W09C3.6; Phenotype=Ste

SEQ ID NO: 120825 - protein, 253 aa, Heterodera glycines
  misc_feature (242)..(242): Xaa can be any naturally occurring amino acid
  Coding regions on vcDNA: vcDNA=SeqID_47248; Strand=-; Position=1 -111,178-302,363-601,674-777,1646-1719
  Homolog annotation: Hit_ID=CAE65057.1; Match level="QueryCoverage =96%, HitCoverage=64%, E-value=5e-42, Identity=39%"; Hit description =Hypothetical protein CBG09902 [Caenorhabditis briggsae]
  Essential gene: C elegans homolog=W09C3.6; Phenotype=Ste
MGEGTPKIHFPPFFVKYPSNFMLLRGNHECANINRVYGFYDEIDRRYPRPGYGFYDEIDRRYPRPGARRLFDLFNQVFAWMPFVGLVGEKILCMHGGISNQIRSLDMHGGISNQIRSLDQLSNLLRPQTEPLLRSLEIDLLWADPSTSITGVAPNNRGAGVMFGADVVESVRNLLGIDYIVRAHQLVMDGVEYFALVMDGVEYFANRHLITLFSAPRYTGKNNTGATLLIIQKNLNLSMKHXNSKLSIKTENN

SEQ ID NO: 120826 - protein, 394 aa, Heterodera glycines
  Coding regions on vcDNA: vcDNA=SeqID_47249; Strand=-; Position=1 -102,176-363,472-633,692-839,893-1079,1449-1667,2373-2551
  Homolog annotation: Hit_ID=NP_491653.2; Match level="QueryCoverage =87%, HitCoverage=37%, E-value=2e-77, Identity=45%"; Hit description =periodic tryptophan protein 2 homolog (102.1 kD) (1G218) [Caenorhabditis elegans] gb|AAB37807.2| Hypothet
  Essential gene: C elegans homolog=F55F8.3; Phenotype=Lva
MVAPKQTQLNALCADKAGDLVIASSKDNFDIYVWALATGHLLEVLNGHTNLVTGLALSENTLFSASSDGTLKLWNIIEGNCLESVQLTSEGLDVKHSPSAMLLAVLCYDSSIALFDTVNTQQLGTIDTKLDIDAARQKADKVKKASSERNKTFTCIAFSPDGSLLLAGGQSNTFCLYSVAGRIRLRTFKLSFNASLEGVKDDINSRRQTEFGNIDLFDISDSEDERHNPRKAIKLPGTRHTDMAERSIHQPVTVTKMGFCPTGGSFAVVSTEGVALYSLFQMRRFDPFQLEIDVVPNSIVQFSLSGEHAKAISLALRLNDAKLTRRVVESVPILQPTKLADFLQSAAEQSAAAPKTTANPIAVSSLPKVALALLVIGGGEVGHGVQNVGAVLRE

SEQ ID NO: 120827 - protein, 285 aa, Heterodera glycines
  Coding regions on vcDNA: vcDNA=SeqID_47250; Strand=-; Position=1 -56,106-247,304-448,529-696,764-1038
  Homolog annotation: Hit_ID=CAE60250.1; Match level="QueryCoverage =97%, HitCoverage=43%, E-value=5e-58, Identity=41%"; Hit description =Hypothetical protein CBG03824 [Caenorhabditis briggsae]
  Essential gene: C elegans homolog=T23D8.1; Phenotype =Bmd,Egl,Emb,Rol,Unc
TCCVCCAFTIVTFLIDIERFEFPEKAIFFEFPEKAIFYMAICYLLVSATYMVGLVEEDSLSCAVSSATKQQLVTQGNEGNENILCSAVAVVHYFFNFAGTLWWLVLCFSWFLVTTLKWGEAPVGQVSSYFNILAWSYFNILAWSLPAIGSVLLVAMGAVDGDMFTGICSLGNLRPEFYFRLALVPQSIAIGVGLVLFASGVGLVLFASGFVSILRIRSYIKGHRFVTDKSSDKLSKLMFRIGCFSLVYVLPMAVGIFCAFYQTENIGHWLTNWLSNECFLATNLP

SEQ ID NO: 120828 - protein, 155 aa, Heterodera glycines
  Coding regions on vcDNA: vcDNA=SeqID_47251; Strand=-; Position=1 -112,157-203,244-341,387-520,569-646
  Homolog annotation: Hit_ID=YP_142814.1; Match level="QueryCoverage =74%, HitCoverage=75%, E-value=7e-20, Identity=42%"; Hit description =ubiquitin-conjugating enzyme [Mimivirus] gb|AAV50726.1| ubiquitin -conjugating enzyme [Mimivirus]
  Essential gene: C elegans homolog=M7.1; Phenotype=Emb
VFVVVCACVISRRRPSLRNELLRLIDLGHQIQVVDENIYRWKVKIPGPPTSLYFPGVYTVNIEIPCVYPNQAPKVQFETRILHPNIKNGDFCVNLLTLWNASNNMTDVLQAISHVLLEPNYESPYNTEAAFAYHHNQVAYENSVRRMVQLYAVGG

SEQ ID NO: 120829 - protein, 208 aa, Heterodera glycines
  Coding regions on vcDNA: vcDNA=SeqID_47252; Strand=-; Position=1 -200,290-489,537-706,795-860
  Homolog annotation: Hit_ID=CAE67460.1; Match level="QueryCoverage =91%, HitCoverage=64%, E-value=4e-27, Identity=36%"; Hit description =Hypothetical protein CBG12961 [Caenorhabditis briggsae]
  Essential gene: C elegans homolog=C06A8.1a; Phenotype=Gro
MLASVINDRFNRHSQCAPFFSLEFYPPLKEHPKNLADFFEMLDHLKQAQPLFVDITWSRRNDPGNLAKLNSSSAIAIATAAIFGKERTMLHICCNDHTRTESISHVKQTLSHGIANIMALRGDDMPTEQTLLTKNTKHFAIDLVKWTRELEETGGYFGNDRLTVAVAGHIYPPMKNISYRQCMEHLRAKVNAGADFVVTQFFLDANLF

SEQ ID NO: 120830 - protein, 73 aa, Heterodera glycines
  Coding regions on vcDNA: vcDNA=SeqID_47253; Strand=+; Position=1-220
  Homolog annotation: Hit_ID=CAE57451.1; Match level="QueryCoverage =86%, HitCoverage=9%, E-value=2e-19, Identity=68%"; Hit description =Hypothetical protein CBG00414 [Caenorhabditis briggsae]
  Essential gene: C elegans homolog=C06G3.10; Phenotype=Lva
MPDYDETTDLQLCFNKTHFQRSDFNVERFVNLARKRVTLDQLQNDLRIYLRHLQNFMVELINDDYADFANLSS

SEQ ID NO: 120831 - protein, 489 aa, Heterodera glycines
  Coding regions on vcDNA: vcDNA=SeqID_47254; Strand=+; Position=1 -258,605-1816
  Homolog annotation: Hit_ID=NP_508269.1; Match level="QueryCoverage =79%, HitCoverage=59%, E-value=2e-42, Identity=27%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MHVDFDPLQVDWSTFSSEYVQFGGYNIYRGLPYQRGAGVGAVFRSLMRYLLPIGKQIGYAIGCQGMESGNRVFTNVLEGKDLKESLVLPLATITQESPYLFRLYSDNLWTDLSRVYLYLELSIEKPGANDKWIAIEDADTSVSAIQGIGQTFVQQLKVTVGNTEVYDSGNLYPFKAYITNELSFPINAKKNFLGSTGYYYTVNQDDSTDEGFKERCKIFKGGKNAQFLSRLDFDLGNQELYLLNNLDLLFTIYKAKDVFLLQTLKANDSTKYRLTVHDVKIYAKMVEVQPSLNMSLYKTLEKQPATYAVRKTEIKSSFISVGRYEFEYNVFSATIPRRVTIALVGNSAFHGDYKLSPFMFEPFDLREISVHAGGVVYPAVPYKLNFSKDHFVSAFVDMYEALGMANSERSFDISMTQFKKGWTFFLIPLTSTLDDSCGFELLRSGTTNVRATFNSPIPLGGVEMIVLGEFDQMIMVDYNRHIVTDSKLG

SEQ ID NO: 120832 - protein, 165 aa, Heterodera glycines
  Coding regions on vcDNA: vcDNA=SeqID_47255; Strand=+; Position=1 -175,726-875,917-1090
  Homolog annotation: Hit_ID=CAE70725.1; Match level="QueryCoverage =44%, HitCoverage=30%, E-value=9e-17, Identity=52%"; Hit description =Hypothetical protein CBG17468 [Caenorhabditis briggsae]
  Essential gene: C elegans homolog=F47D12.4a; Phenotype =Emb,Gro,Pvl,Sma,Stp
SAFFFFSNEKRQEVSGEHPEWKVGQIAQELGVRWKALSDEERAIYEKKAQEDKERYAELIQTTAEHVLQSQGGAHVVSTSAGGQPQMVILQQQPQQGQPGTQLPMQILHYNKQSKREGFPLPPWSQFPRLVKKHVLGLVRLFVVVKEEHVSSASAAQQCATQQHA

SEQ ID NO: 120833 - protein, 180 aa, Heterodera glycines
  Coding regions on vcDNA: vcDNA=SeqID_47256; Strand=+; Position=1 -147,190-332,386-555,834-916
  Homolog annotation: Hit_ID=NP_065917.1; Match level="QueryCoverage =72%, HitCoverage=17%, E-value=1e-15, Identity=34%"; Hit description =kelch-like 1 protein; kelch-like 1; kelch (Drosophila)-like 1 [Homo sapiens] sp|Q9NR64|KHL1_HUMAN Kelch-l
  Essential gene: C elegans homolog=C47D12.7; Phenotype=Unclassified
VTFVKDGCEHFLIKLMTIENCLGLRELSDQHSCEQLLAAIEAFMLEHFMEICHKEEFMALDSVTTLERLAKSDDLNITDERFLFEFLVKWVEMDKTGLRLNSLTRLLRFVRFFQLPFDYFVNIKQLPLISQSSEALAFVQSQSEAFLEAISASAVHFRTKINLPTESRHSQLQAVWASIN

SEQ ID NO: 120834 - protein, 288 aa, Heterodera glycines
  Coding regions on vcDNA: vcDNA=SeqID_47257; Strand=-; Position=1 -240,321-385,465-589,661-899,1112-1309
  Homolog annotation: Hit_ID=AAO85519.1; Match level="QueryCoverage =92%, HitCoverage=84%, E-value=5e-79, Identity=54%"; Hit description =putative serine/threonine phosphatase [Oesophagostomum dentatum] gb|AAO85518.1| putative serine/threonine
  Essential gene: C elegans homolog=W09C3.6; Phenotype=Ste
MTTIWQLCEDATNVLRDQASLVETKPPLVMCGDIHGQFVDLKRIFNKMGYPPFTKYMFLGDIVDRGNQSVETIVLLLLYKVRYPTEFYILRGNHECASINRIYGFYDEINERYGQHNVRPLWERFNMTFAWLPFVGLVSDCILCMHGGIAPEMTNIQQLRMLRRPSIDPPVPSLELDLLWADPSTAVEGTAPNPRGVSILFGADVVAEVCRKLNIELVVRAHQCVPFGVSFFANSYMLTLFSAPMYVTEKNVGAVLVIDAKLQLSFRFFKGTQITPSIGPASRRECSQ

SEQ ID NO: 120835 - protein, 202 aa, Heterodera glycines
  Coding regions on vcDNA: vcDNA=SeqID_47258; Strand=+; Position=1 -111,145-348,388-477,603-806
  Homolog annotation: Hit_ID=CAE63488.1; Match level="QueryCoverage =82%, HitCoverage=28%, E-value=2e-51, Identity=58%"; Hit description =Hypothetical protein CBG07956 [Caenorhabditis briggsae]
  Essential gene: C elegans homolog=F28D9.1; Phenotype=Sck
MDAGFYRGTSSEQDIRFTDKERKLLRQMKFENVLETKLTKVDLAKINLDVIKPWITLKLNEILGMEDDVVVEYVFTQLEEKELNPKKMQINLTGFLNARRAREFMAEMWQMFVEAQDSPEGIPTSLVEKKVQELKASNSNKQPMQTYHKATEVDWNQRYQTLTGGRYGKMDPKAQVSKSHMSDTFMKGGGRRPPAKAARSGR

SEQ ID NO: 120836 - protein, 259 aa, Heterodera glycines
  Coding regions on vcDNA: vcDNA=SeqID_47259; Strand=-; Position=1 -69,1579-1821,1873-2048,2103-2209,2263-2446
  Homolog annotation: Hit_ID=CAE65128.1; Match level="QueryCoverage =85%, HitCoverage=34%, E-value=2e-27, Identity=32%"; Hit description =Hypothetical protein CBG09993 [Caenorhabditis briggsae]
  Essential gene: C elegans homolog=ZK632.2; Phenotype=Pvl,Rup,Stp,Unc
MAMRLPSPHNQRNEWLRHQHTFAMAATQTMENEKTLQGEGIFAEPVLPQKNLPLKPAKSEESDEGTATEQTQQQQQQPTISDLRYQQPFWALVPAEDKQEYFLEIIKEGTVIGTVRLHDSAHQKSFWSIGRFEPCDIKLEHPSVSRFHAILQYGECIKGRPGWFIFDMNSTHGVRLNKQPLKKRTYVPLHNGFVFQIAGSSRLFTVCGGPKREQKEEENKEKAQPMGKTENKKDAEEEGEDEEEQQLRYYEKDPLGWLQ

SEQ ID NO: 120837 - protein, 337 aa, Heterodera glycines
  Coding regions on vcDNA: vcDNA=SeqID_47260; Strand=+; Position=1-1014
  Homolog annotation: Hit_ID=NP_498735.1; Match level="QueryCoverage =99%, HitCoverage=78%, E-value=1e-40, Identity=31%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MSINGREVFNSNSLMAYKTYFSHELSYSNTAKDSHLNAAGYYRDIGGSLETGDGCIARRNLFARSRTAQFIAKIDADLFNQPLYLINFCELDIEILPNDNDFVLITTPAVAQGAAAAPRYRFEVVSLKMYVKKVSLMDGLALDIARKLEVKPARYAVRKTLMKSMFISHGRFEFTANLFMDQIPRRITMGLVANSDYIGTISRSPFNFQPFNVREISIIANGRSFPQAPYDLDYPNWKYVRPFNDMNEAVGFANSLESNGISYEQFGKTHCIYVFNLTSSGDDQAALFDLIKNGTTAVSIKFNQAVPTGGIMLVVMGECDSLVMLDKNRSISTDITI

SEQ ID NO: 120838 - protein, 44 aa, Heterodera glycines
  Coding regions on vcDNA: vcDNA=SeqID_47261; Strand=+; Position=1 -49,109-237
  Homolog annotation: Hit_ID=AAO31780.1; Match level="QueryCoverage =100%, HitCoverage=47%, E-value=2e-17, Identity=90%"; Hit description= ribosomal protein L37A [Branchiostoma belcheri tsingtaunese] gb|AAK52799.2| 60S ribosomal protein L37A [B
  Essential gene: C elegans homolog=Y48B6A.2; Phenotype=Lva
MAKRTKKVGIVGKYGTRYGASLRKTVKKMEVSQHAKYTCAFCGK

SEQ ID NO: 120839 - protein, 96 aa, Heterodera glycines
  Coding regions on vcDNA: vcDNA=SeqID_47262; Strand=-; Position=1 -155,389-521
  Homolog annotation: Hit_ID=AAH86885.1; Match level="QueryCoverage =100%, HitCoverage=73%, E-value=4e-44, Identity=86%"; Hit description= Unknown (protein for MGC:107552) [Mus musculus] gb|AAH46113.1| RPS15A protein [Homo sapiens] ref|NP_73376
  Essential gene: C elegans homolog=F53A3.3; Phenotype=Emb,Ste
VIIRPSSKVIIRFLTVMMKHGYIGEFEIVDDHRAGKIVVNLTGRINKCQVISPRFDIRMADLEKWTSNLLPSRQFGFLVLTTSAGIMDHEEARRKH

SEQ ID NO: 120840 - protein, 165 aa, Heterodera glycines
  Coding regions on vcDNA: vcDNA=SeqID_47263; Strand=-; Position=1 -234,448-711
  Homolog annotation: Hit_ID=CAE70690.1; Match level="QueryCoverage =83%, HitCoverage=34%, E-value=4e-33, Identity=53%"; Hit description =Hypothetical protein CBG17407 [Caenorhabditis briggsae]
  Essential gene: C elegans homolog=F13D2.2; Phenotype=Lvl,Prz
MPLNDVSNNEGIAQNGTTDSLADADNGTEVMPPQHLFSDYVEIAYLGLVICAGLALNISVLKRLMVERRRARRSNKVMSGFLLLKLNLNVSDILILLIHASGKLGWLITYDWRGGDALCRLFNLLSMFTLYLSSNIVICIALDRLFTVLTAQRMDLGQQKVRTKK

SEQ ID NO: 120841 - protein, 76 aa, Heterodera glycines
  Coding regions on vcDNA: vcDNA=SeqID_47264; Strand=+; Position=1-228
  Homolog annotation: Hit_ID=AAM73862.1; Match level="QueryCoverage =82%, HitCoverage=6%, E-value=1e-10, Identity=57%"; Hit description =putative serine/threonine protein kinase; HcSTK [Haemonchus contortus]
  Essential gene: C elegans homolog=H39E23.1a; Phenotype=Spo
MYQQLVNLSPPSQQPPQSSSATHQGGHHRHTSSGHHRSSGMTASSSRAPNRTRTGDDLHIGKYKLLKTIGKGNFAK

SEQ ID NO: 120842 - protein, 887 aa, Heterodera glycines
  Coding regions on vcDNA: vcDNA=SeqID_47265; Strand=+; Position=1 -151,198-339,406-427,495-878,929-1110,1155-1347,1391-1471,1558 -1643,1687-1781,1823-1852,1902-2032,2077-2176,2355-2473,2534 -2667,2870-3065,3110-3217
  Homolog annotation: Hit_ID=CAE60849.1; Match level="QueryCoverage =99%, HitCoverage=99%, E-value=0.0, Identity=52%"; Hit description =Hypothetical protein CBG04558 [Caenorhabditis briggsae]
  Essential gene: C elegans homolog=C47E8.7; Phenotype=Emb
MAHLIQDGFVVNDATWKLGIFITDMNISRELFVRGDMTIGSLMMQLVGQIGETQDWSDHYMWWPDRRKWETQDWSDHYMWWPDRRKWLKHTRSTLDQIGITAATYLEFTPMHKHAKVQLPDLQVQLPDLQIIDARLDFSVPILKVTQKICQELAIRHPEELSLKRDIPPDILRKGASVESEAQIQPYMKPGEESIGPGTLRTAKPIRASTVNLTSGRGSPALSQASAMGPGHLFNASEIGTLPKMGTIPRGMSPGPAAYREVLGRTPEPYREVLGRTPEPGYSEGGGLECDQFDENLINSPKITPGRETFRPQNYLEKAALNRGWLDSSRSLMEQGICEGDVVSLMEQGICEGDVVLLRFKFMQFFDMNLRYDPVRINQLYEQAKWSVLLEEVEHTEEESSLFAALQLQAALQRNSPDRESPLQAALQRNSPDRESPERDEVDVLLDELEQTLDTTASLSRRDLTYVPELTEYLKYLKPKKLGFNNFKRAYFTPKKLGFNNFKRAYFTFRDLYLSYYNTAQDANGPPLGHYYLKPPLGHYYLKGCEVSQDLSVSQGKFNIKLQVPSSGCEVSQDLSVSQGKFNIKLQVPSSEGMSELILKCDTEQQFAKWMAACRLASRGKTMADSSYNSEVESIKAACRLASRGKTMADSSYNSEVESIKKVLQMQAGTAAQNGAQNKKKSQPVQLPTDFNSEEFVCQRYWKRSGNKSKMQQRISDAHSNKMQQRISDAHSNVKTLSCTEAKLQYIRNWEALPEHGLHYFIVKFRNGKKAELIAVAHNRMMKVNSDNGESSKTWRFSGMKKWHVNWEIRHLKIQFDNEDVEFKPLSADCKVVHEFIGGYIFLSMRSKDQNVVHEFIGGYIFLSMRSKDQNQTLDEEGFHRLTGGWG

SEQ ID NO: 120843 - protein, 112 aa, Heterodera glycines
  Coding regions on vcDNA: vcDNA=SeqID_47266; Strand=+; Position=1 -110,283-509
  Homolog annotation: Hit_ID=NP_493272.1; Match level="QueryCoverage =97%, HitCoverage=44%, E-value=9e-44, Identity=76%"; Hit description =translation factor (26.3 kD) (1N561) [Caenorhabditis elegans] emb|CAB16860.1| Hypothetical protein C47B2.
  Essential gene: C elegans homolog=C47B2.5; Phenotype=Lva
MVALRAQFEASNDVGVFCKLTNAYCLVGIASSENFYSIVEAELADVIPVIHCTVAGCRIVGRVTAGNRHGLLVPNATTDQELQHIRNSLPDSVQIRRVDERLSALGNVIAWS

SEQ ID NO: 120844 - protein, 223 aa, Heterodera glycines
  Coding regions on vcDNA: vcDNA=SeqID_47267; Strand=-; Position=1 -81,187-253,628-767,954-1014,1059-1139,1413-1448,1496-1698
  Homolog annotation: Hit_ID=CAE73577.1; Match level="QueryCoverage =100%, HitCoverage=63%, E-value=1e-103, Identity=81%"; Hit description=Hypothetical protein CBG21051 [Caenorhabditis briggsae]
  Essential gene: C elegans homolog=C04C3.3; Phenotype=Emb,Gro
AMDEELERDERVFLLGEEVAMYDGAYKISKGLWKKYGDERIVDTPITEMGFAGLAVGAAFAGLRPICEFMTFNFAMQAIDQLVNSAGKTYYMSAGRVTVPIVFRGPNGFAAGVAAQHSQDYAAWYAHVPGLKVVAPYSAEDAKGLLKAAVRDENPVIFLENELLYGVPFPVSDEVLNADFVLPIGQSKIERVGAHVTLVSYSKAVQNCLEAADQLKAEGVEAE

SEQ ID NO: 120845 - protein, 405 aa, Heterodera glycines
  Coding regions on vcDNA: vcDNA=SeqID_47268; Strand=-; Position=1 -145,190-366,498-614,655-1128,1172-1475
  Homolog annotation: Hit_ID=NP_496558.1; Match level="QueryCoverage =100%, HitCoverage=49%, E-value=1e-151, Identity=61%"; Hit description=DNA replication licensing factor Mini Chromosome Maintenance (99.3 kD) (mcm-2) [Caenorhabditis elegans]
  Essential gene: C elegans homolog=Y17G7B.5a; Phenotype=Emb
DYREQPELDALSQSGIDDTSDITELSIDARRRAELDMARRDQMTVDDAIYWEDGDDEAIHLMRRRKQRGLSSADEHSLAGEPAEEDIRIDIIENPRGRPTREHIKDESIKHMVAENRESLEVDYNDLAHESGEPDITYFLPEAPTEVLECLNRAATTVVVSIFPWYHRITTEVKVRIKNLPMEEDIRMLRQVHLNMLIKTAGVVTITTGILPQLGIVKYDCKSCSYVLGPFVQRQDEETKPSTCPSCQSRGPFELNTEETIYHNYQRVSIQESPNLVAAGRLPRSKEVILLGDLCDSCKPGDEIELTGVYSNGYDGSLNSRQGFPVFNTVIIANHITRKDRIESDSLTDEDIKAIHELAKHPQIAQQIFCSVAPNIYGHAEVKQAIALALFGGEAKNPQGKHNIR

SEQ ID NO: 120846 - protein, 765 aa, Heterodera glycines
  misc_feature (13)..(13): Xaa can be any naturally occurring amino acid
  misc_feature (17)..(17): Xaa can be any naturally occurring amino acid
  misc_feature (142)..(142): Xaa can be any naturally occurring amino acid
  misc_feature (743)..(743): Xaa can be any naturally occurring amino acid
  Coding regions on vcDNA: vcDNA=SeqID_47269; Strand=-; Position=1 -195,236-386,632-936,1028-1171,1219-1268,1320-1506,1564-1678,1732 -1898,2168-2236,2336-2555,2608-2666,2711-3043
  Homolog annotation: Hit_ID=CAE65190.1; Match level="QueryCoverage =97%, HitCoverage=83%, E-value=1e-110, Identity=35%"; Hit description= Hypothetical protein CBG10063 [Caenorhabditis briggsae]
  Essential gene: C elegans homolog=ZK1098.1; Phenotype=Lva
ATAHADSTEYLKXNESXSSAGVSNGTSVCTQHTADDGRSYYYNKATKVSSWTKPDDLKTKEEVIKELSVWKEYKTPEGKPYYYKELSVWKEYKTPEGKPYYYNTQTKVTTWSKPEALNKVKSILFFFCSGAQNHVIPEHSIXVSLKFSSVIVILFLSERYYLFSETKTKKEESDAANESKPDLVHLSSNSEIEKAMEATLKTLVVKKSDEPIEAKEITQKKEEEDDSEYNLKKRQEKRINTNMNWEQASKYIQNDPRYKILAKVSEKKQVFNAWKTQRYKEERDERRFAIKMAKDERRFAIKMAKEGLEKWLMAHQRMKPTLRYHKAELMAHQRMKPTLRYHKAEGIFAMELQWKAVTEPERREIFEDVKIALAKKDTEQKKALKERNIKALSDILDGIDKIDYRTALSDILDGIDKIDYRTTWAEAQRILIENPSFAKDTTLQGMDKEDALVVFQKHIKLSEEMDKEDALVVFQKHIKLSEEQYVKEKQLEAKRIKRQERKTREAFIQLLHGLHDRALVTPASSWAQLYPMISADQRFENMLLTNGSTALDLFKFYVDELRTKYHEDRKTIKEFLEFKKITIDESTTFDAFRQWVKEGPNSDQLDPVNVKLCFNDLCDRILMLCDRILMKKKEAERDELKKQKRAELAFWDLLRSQKRAELAFWDLLRSLSPAVGPNSDWEQIKEQLKESGQLETTAEEEQLKRLFDSFVKSLQDICGHYHSAVSSSSKKRKKEKRKSTNRXGNGGREDGKAKKFRKMHPTRKR

SEQ ID NO: 120847 - protein, 69 aa, Heterodera glycines
  Coding regions on vcDNA: vcDNA=SeqID_47270; Strand=-; Position=1 -86,135-301
  Homolog annotation: Hit_ID=AAL05950.1; Match level="QueryCoverage =92%, HitCoverage=47%, E-value=2e-19, Identity=65%"; Hit description =frataxin [Caenorhabditis elegans] ref|NP_495183.1| FRataxin Homolog (15.7 kD) (frh-1) [Caenorhabditis eleg
  Essential gene: C elegans homolog=F59G1.7; Phenotype=Emb,Gro
SPRIGTYVINKQTPNKQIWLSSPVSGPKRYDLSDKGRWVYKHDGVTLHELLEKEFRHIFKNDQISLHQS

SEQ ID NO: 120848 - protein, 299 aa, Heterodera glycines
  Coding regions on vcDNA: vcDNA=SeqID_47271; Strand=-; Position=1 -238,358-690,1011-1336
  Homolog annotation: Hit_ID=EAL49477.1; Match level="QueryCoverage =60%, HitCoverage=34%, E-value=2e-13, Identity=30%"; Hit description =hypothetical protein 42.t00003 [Entamoeba histolytica HM-1:IMSS]
  Essential gene: C elegans homolog=Y111B2A.14; Phenotype=Emb
MNNKSQVFIHFSGTIDESNSMKKERKWVTISELGQRDLEEELEKVREISLDLEGEVSKVREEIKTMLKHIMKPLMEFHKIGIHLNFKPKNLIVFEKTEEEEELPKLEEKKAENEKSKQNIFPLFKMFNRKNEAEKKAKEEKERKEREREEKERKEREREEKERKEREREEKERAKTIKWEEKVIKLTDFDGHSKNGHLVSWAYHFTIDPQKTFGYKEKVDEKIGELFRSAKLKFEGGEFKPDRTKLTRLALPIDNYECMENLKYDEYWPSGNWWYNYLTVIHDILTLWDKMPEIVFLSV

SEQ ID NO: 120849 - protein, 929 aa, Heterodera glycines
  misc_feature (152)..(152): Xaa can be any naturally occurring amino acid
  Coding regions on vcDNA: vcDNA=SeqID_47272; Strand=+; Position=1 -70,178-319,362-528,639-797,846-882,927-1159,1232-1537,1599-1739,1808- 2010,2069-2216,2268-2460,2512-2736,2792-2962,3031-3231
  Homolog annotation: Hit_ID=CAE56591.1; Match level="QueryCoverage =98%, HitCoverage=45%, E-value=0.0, Identity=33%"; Hit description =Hypothetical protein CBG24338 [Caenorhabditis briggsae]
  Essential gene: C elegans homolog=T22A3.8; Phenotype=Lva,Unc
SFLSLLPFPICDLSLSFSVPFPILSLQSDQLTLEYYGRLNFFPRENISVTIPLMPTENWFDARTRRNVDKAVFMRALADVKGILVRARAVFMRALADVKGILVRARYSQYQLQSSIYGFHMETAWDSATAETDKNLATVALSDHEQLTINTXTKVCACPEHFGGNSCEKCEKGYRRVNGQIYDGMCQKCECQGHSDSCDPFTGHCLHCQCDPFTGHCLHCQHNTTGLNCEHNTTGLNCEHCLSGFYGNPSLGPLLGQCRPCACPTVAHSHSAECTLSQLVMDQVAAVGQDDYVCTACETGYDGNKCESCADGFFGCADGFFGDPFADKCHPCECNDNIDPAAIGNCDRRTGKCLRCVGHTTGDQCEQCLPDHWGSALLHSCRPCRCHHKGAFSSQCSNETGKCECREGYAGERCDRCVCDRCVLGHGDVENGCPKCLCNSTGSLGIACDEFSGQCACKKGVYGKRCDLCVPSYFNFGPEGCDLCVPSYFNFGPEGCEFCHCNKFGAFPDKECHNMTGECQCRRNVEGLKCERCVKGFFNLTSGDGCQSCECDSQGSSCECDSQGSLEGQSCDTVTGQCGCRAGVTGRKCDKCEPNHYGFDSSGCKLCRVCPAPGQVCDAVTGDCVCPPLCRVCPAPGQVCDAVTGDCVCPPNTRGEMCEQCTQNAWNYHPYRGCELCQCDGIGADSQLCDSQTGQCKCKVGYVGHRCDHCEPGHQTGQCKCKVGYVGHRCDHCEPGHHSFPDCRPCECDTAGTESSECRGNTCLCSNEGQCKCKKNVAGQKCDRCRENAFSLEAWNPNLEAWNPNGCTECFCSNKSAICHQSARVWHQIYAPDRSVLFESPFEMFDRRHRLHILKELPSHYNSELPSHYNSYPTDHTPLYWPLPQGFKGDKTGSYNGFLRFRIRNDDNFRGRPNVLPDAHSFRIYPQVL

SEQ ID NO: 120850 - protein, 59 aa, Heterodera glycines
  Coding regions on vcDNA: vcDNA=SeqID_47273; Strand=+; Position=1 -12,261-428
  Homolog annotation: Hit_ID=NP_116147.1; Match level="QueryCoverage =91%, HitCoverage=49%, E-value=5e-25, Identity=92%"; Hit description =PHD-finger 5A [Homo sapiens] gb|AAM14623.1| transcription factor INI [Rattus norvegicus] ref|NP_620243.1|
  Essential gene: C elegans homolog=Y54F10BM.14; Phenotype=Emb
MRRAGRCVICGGPGTSDAYYCKECTIMEKDRDGCPKIVNLGSAKTDLFYERKKYAFKKT

SEQ ID NO: 120851 - protein, 650 aa, Heterodera glycines
  Coding regions on vcDNA: vcDNA=SeqID_47274; Strand=+; Position=1 -175,217-365,407-523,619-822,946-1221,1303-1434,1506-1740,1800 -2048,2101-2375,2433-2570
  Homolog annotation: Hit_ID=CAE61909.1; Match level="QueryCoverage =98%, HitCoverage=73%, E-value=1e-158, Identity=43%"; Hit description= Hypothetical protein CBG05905 [Caenorhabditis briggsae]
  Essential gene: C elegans homolog=F49E8.3; Phenotype=Emb
GKSKTGANLRIYSVPGKKEQGNYALELVTKSIDFYSEWFDFKMPLPKCDVLAMPDFAMGAMENWGLITARENCSLYDPTKSPSTHKQLLTLLLSHEVSHFWFGNLVTMKWWSDLWLKEGFASFTQYLFTDKNYPEFKIWSDFVDAEVVPIDNPNELEEIYDSITYAKSNSIIRMLFNHLGEATFQKAIRDYLKKHQYANAETNDLWKSLSDASGIDVKALMSSWTQQMGFPLVTVEEKILDGDRIELHLKQSRFLADGGHDEANPVWQVPFGVTTAADLTHPKAKFLLMKAEDKFIVDGVKSNEWVKVNSNFSSFFRVQYSPNMLQSLLDGVKNRELGVLDRYQLASDLYALVKSSRVSVSHFLALLTVCQEEEDYFVWSAIDSGIGSIAHSLKHLDDERKLLDRFERFVCKMIEPVAAKLGWEPKEGETIHVGRLRALLLSRLSHFRHQPTIQMALSKFNALIEKGVDVVPDLRKLIFRAVGSTNDEKIIAALKNLMETSGYAQVELSCVLGLGQCSDLKMLEDIFNYGVIQGKIRDQDLYLLFAATEMAPMACCGHFAWDFFKNNFALLIEKYGSVNSNVFLHCFNCVTSGFCSNAMAEDIMEFFKKELDEHSLKTLERPLRQAVESIKVKESLLKNNVPDLDKYLQN

SEQ ID NO: 120852 - protein, 310 aa, Heterodera glycines
  Coding regions on vcDNA: vcDNA=SeqID_47275; Strand=-; Position=1-935
  Homolog annotation: Hit_ID=NP_510671.1; Match level="QueryCoverage =99%, HitCoverage=31%, E-value=1e-63, Identity=39%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
LKNNKISEYQFGFVRNRSTTSQLITVVEDWYEAIINGKVDCIYIDFQKAFDSVPHNLLLYKLEKIGIKGKLLMWIKGFLSNRTFRVKIGDSLSSSKKVTSGVPQGSVLGPLLFLIYINDLPDALPSGVKIKLYADDVKLYICYKARTETEIMHKALHNLFEWANKWQIKVSMQKTFILYLGSKNPKETYKFDGNTINAVDTIRDLGVNIDNKLQFSDHVNHITRNAYLRMRSLFRIIKSKSSKIWITLYKTYIRPLLEYAPEVWNPSLQKNIKKIEKCQKYFTKRVFFKCSLPPIPYQNRLEYLQLPTLR

SEQ ID NO: 120853 - protein, 479 aa, Heterodera glycines
  misc_feature (7)..(7): Xaa can be any naturally occurring amino acid
  misc_feature (15)..(15): Xaa can be any naturally occurring amino acid
  misc_feature (18)..(18): Xaa can be any naturally occurring amino acid
  misc_feature (21)..(21): Xaa can be any naturally occurring amino acid
  Coding regions on vcDNA: vcDNA=SeqID_47276; Strand=+; Position=1 -204,250-419,747-945,1344-1546,1810-1885,1981-2036,2149-2405,2617-2852
  Homolog annotation: Hit_ID=NP_510529.1; Match level="QueryCoverage =95%, HitCoverage=27%, E-value=1e-126, Identity=51%"; Hit description= 2 polypeptide (XP854) [Caenorhabditis elegans] emb|CAA93776.1| Hypothetical protein F39B1.1 [Caenorhabdi
  Essential gene: C elegans homolog=F39B1.1; Phenotype=Unclassified
WRFNNFXTLSRQFKXLSXHFXQIELVPSCKTLREIQIVSSGAAGVFKDEVLNEWLARQNPSEFQYKAALENFRRSCAGWCALENFRRSCAGWCVATYVLGIGDRHNDNILVTTNGHVFHIDFGKYMGDWQMAAGFKRDRVPFVFTPEMAYVINGGQSSTEHFQRFVDECCQALNLLRKSAPTVLNIMRFLSCSDIPGMSMESVAFVENNLLLDLSDAQATMLFTQMIMDSLQSKFPRLNFLAHTLAQFRGNPLGGRSEDMNRLSFISELYNEKNEGRLESVHVNSYEKWKNPEKIYMYKLLVKRQQENVTTVIFRSFAEFQELHWKLCYRFSSRAIPQLCQTVTFGRTNIRTVAVRRQVDLQYFLQRLFALSDEVAHSELVYTFMHSIYRDTEPEAHKQSDGALSTQCQLLLRLAWEEAQNKLRIFVGHAKNLPLVGREQAPDSYVKSYLRWTGTSAAQPRQWKRKTHVVRNAQNPTYN

SEQ ID NO: 120854 - protein, 388 aa, Heterodera glycines
  Coding regions on vcDNA: vcDNA=SeqID_47277; Strand=+; Position=1 -202,247-490,549-708,760-889,937-1178,1223-1411
  Homolog annotation: Hit_ID=NP_740775.1; Match level="QueryCoverage =93%, HitCoverage=45%, E-value=0.0, Identity=81%"; Hit description =ubiquitin-protein ligase with C2 and WW domains; suppressor of deltex; atrophin-1 interacting protein Nedd-
  Essential gene: C elegans homolog=Y65B4BR.4a; Phenotype=Unclassified
MGGPEDSRVRVISAIIFMITWITVFRLTDAPLPEGWEMRITEQGVPFFIDHNNKTTTYNHPRTGRPVGPLGGPGLHMAADKTFKNKVAQFRYLCYSNSVPNHVKISVTRNNLFEDSFQEIMRKNPFDLRRRLYIQFKAEDGLDYGGIAREWFFLLSHEVLNPMYCLFMYANSSNYSLQINPASFVNPDHLKYFEFIGRFIAMALFHGKFIYSGFTLPFYKKMLNRKITLKDLESVDTEFYNSIVWIRDNDIDECDMELYFVVDYDLLGEVKTHELKENGTEIAVTEANKNEYIELLVEWRFNRGIEQQTVAFFNGFTSVFPLQWLQYFDERELELLLCGMQEIDVDDWQRHTAYRHYAVQSKQVIWFWQFVRSLDQEKRSKLLQFVTG

SEQ ID NO: 120855 - protein, 140 aa, Heterodera glycines
  Coding regions on vcDNA: vcDNA=SeqID_47278; Strand=+; Position=1 -154,654-796,891-1013
  Homolog annotation: Hit_ID=NP_871846.1; Match level="QueryCoverage =60%, HitCoverage=40%, E-value=3e-18, Identity=58%"; Hit description =nascent polypeptide-associated complex NAC and Ubiquitin-associated domain containing protein (22.1 kD) (
  Essential gene: C elegans homolog=Y65B4BR.5a; Phenotype=Gro,Stp
MVTAEDTVKTKEEDPKKTTTDDGSSSEEEVPELEEGDVTEEQKKVAEAAGLTWYFYLEDLAQHAQITDVENLKPPSIIRDVRNRITPAEEESDGEEVERADATGIEEKDIELVMSQANVSRNKAITALKKADNDLVNAIM

SEQ ID NO: 120856 - protein, 304 aa, Heterodera glycines
  Coding regions on vcDNA: vcDNA=SeqID_47279; Strand=+; Position=1-915
  Homolog annotation: Hit_ID=NP_500944.1; Match level="QueryCoverage =98%, HitCoverage=97%, E-value=4e-38, Identity=31%"; Hit description =putative cytoplasmic protein family member (4H15) [Caenorhabditis elegans] gb|AAC48087.1| Hypothetical pr
  Essential gene: C elegans homolog=F19G12.2; Phenotype=Unclassified
MNVKKSFLASTGHYATRTHDSVADEGFKARCKIFEGGKRAQFLSRLDFDLGNQELYLLNNLDLLFTIYKARDTFIMQTLKADDTTRYRVRVHDVKLYAKMIDVQSSLNLSIYKTLEKQPATYAVRKTEIKSCFISEGRFEIDYNVFSATIPRRMTIALVANGAFNGNYALSPFNFKPFDIRDIAVYAGGMIYPIVPYKLDFAKDIFVRPFVDMYEALGMANSERSFDITKEQFKSGWTFFVIPLTSTLDDSTGYELLRSGTTSIRATFNSAIPEGGVEMIVLGEFDQMIMIDYNRHIVSDSKLS

SEQ ID NO: 120857 - protein, 347 aa, Heterodera glycines
  misc_feature (345)..(345): Xaa can be any naturally occurring amino acid
  Coding regions on vcDNA: vcDNA=SeqID_47280; Strand=-; Position=1 -30,1154-1392,1471-1697,1884-2239,2303-2449
  Homolog annotation: Hit_ID=CAE72309.1; Match level="QueryCoverage =97%, HitCoverage=41%, E-value=3e-95, Identity=55%"; Hit description =Hypothetical protein CBG19441 [Caenorhabditis briggsae]
  Essential gene: C elegans homolog=H15N14.2; Phenotype=Emb
HFYCIFVKNFIIFQPSSKGVYNWRRQINGDWHIKRANTVDHIEFVGESEANMRKLFADAEEEWRRCGPNSWLHIIIFDEIDANCKQRGSGGGSSTGVHDTVVNQLLTKMDGVEQLNNILVIGMTNRKDIIDEALLRPGRMEVQLEISLPDKQGRIQILNIHTAPMREHNKLDSDVNIEQIAKRTKNFSGAELEGLVRAAQSSAMNRLVKPGGKVQQVKDTNGRKKEKPKGQFRWTTKQLTLNRLLYGGLCLWGDCVSRVLEGGRLLIKETAAPDTRGFVRALLAGPPNTGKSFLAAQIAPPNTGKSFLAAQIAKDSEFPFIKVCTPEEMVGYSEAEKCAKIRKVXFE

SEQ ID NO: 120858 - protein, 240 aa, Heterodera glycines
  Coding regions on vcDNA: vcDNA=SeqID_47281; Strand=-; Position=1 -111,848-1007,1066-1169,1218-1413,1459-1493,1536-1652
  Homolog annotation: Hit_ID=XP_311026.1; Match level="QueryCoverage =72%, HitCoverage=51%, E-value=2e-10, Identity=26%"; Hit description =ENSANGP00000019935 [Anopheles gambiae]
  Essential gene: C elegans homolog=Y116A8C.42; Phenotype=Ste
VTLRDGRTQTLDNVFIRGSQIRFSVLPDTLKNAPMFKVAKLQQRLSAALTSKQFYEAHQILRTVHARLSAERRFTELLEQIQSTVLILCEAKEYTSAIDLAELYAETLKQSEATLNTENLQILLTMFSNLPSTFNSDSPSSDRRIPFLNKTLDWALKSAKGKPEMLRACALLQRKFGDVFFSEGQEEQAERYARSAEYLLDEADRIEGIPIGGEGSSGENRETDNADDAAQKIDSELELD

SEQ ID NO: 120859 - protein, 190 aa, Heterodera glycines
  Coding regions on vcDNA: vcDNA=SeqID_47282; Strand=+; Position=1 -126,168-381,432-514,559-708
  Homolog annotation: Hit_ID=AAP13778.1; Match level="QueryCoverage =99%, HitCoverage=43%, E-value=4e-98, Identity=91%"; Hit description =Dumpy : shorter than wild-type protein 23, isoform b [Caenorhabditis elegans]
  Essential gene: C elegans homolog=R160.1a; Phenotype=Gro,Lvl
MIGGLFVYNHKGEVLISRIYRDDVNRNAVDAFRVSVIHARQQIRSPVTNIARTSFFHIKRGNVWMCAVSRRNINASMVFEFLNRFADTMQSYFGKLNEENVKNNFVLIYEILDEILDFGYPQNTDPGVLKTFITQQGVRTASKEEQAQITSQVTGQIGWRREGIKYRRNELFLDVIEYVNLLMSQQGPIN

SEQ ID NO: 120860 - protein, 250 aa, Heterodera glycines
  misc_feature (100)..(100): Xaa can be any naturally occurring amino acid
  Coding regions on vcDNA: vcDNA=SeqID_47283; Strand=-; Position=1 -68,106-450,511-573,640-682,744-831,1303-1358
  Homolog annotation: Hit_ID=CAE60449.1; Match level="QueryCoverage =100%, HitCoverage=50%, E-value=1e-37, Identity=42%"; Hit description= Hypothetical protein CBG04057 [Caenorhabditis briggsae]
  Essential gene: C elegans homolog=F33D11.5; Phenotype=Ste
LAAVDIGRFLSDVVLISYDKFLGCIGHIEEERTAKAQRRRRRGCIGHIEEERTAKAQRRRRRRKRRRSGQNAKRKRQNGAEGSVFQCLMRVICVAFMSNXCHFPQERRLPLSVDAAILLLFCMLGGVVYIAAAGNHNFIEGFFVTFNLVANLTMSEMPTDMPTDISRLMTLIYIFVFVTFVLLSMCADLAASELKWVFLKIHYVFLKIHYFGCKINWAKRRSLKKQQQQQIEYCLAIRQLAKKFYYENRK

SEQ ID NO: 120861 - protein, 144 aa, Heterodera glycines
  Coding regions on vcDNA: vcDNA=SeqID_47284; Strand=-; Position=1 -132,1624-1819,2325-2428
  Homolog annotation: Hit_ID=XP_319845.1; Match level="QueryCoverage =71%, HitCoverage=24%, E-value=5e-37, Identity=73%"; Hit description =ENSANGP00000016500 [Anopheles gambiae]
  Essential gene: C elegans homolog=F13H8.9; Phenotype=Emb
MRRLSQLFLRCHWTPSEIAASCRHASSAATARPLYMDVQATTPMEHKCVLDSCRFLEHEGDFHVTYIPVQNNGLISLEVLEQAIRPETSLVSIMAVNNEIGVRQPLKEIGELCRKKNVHFHTDAAQAVGKVPLNVDELKIDLIK

SEQ ID NO: 120862 - protein, 276 aa, Heterodera glycines
  Coding regions on vcDNA: vcDNA=SeqID_47285; Strand=-; Position=1 -24,496-609,659-791,938-1164,1537-1684,1757-1862
  Homolog annotation: Hit_ID=NP_872117.1; Match level="QueryCoverage =98%, HitCoverage=28%, E-value=1e-119, Identity=75%"; Hit description= glycogen phosphorylase (97.7 kD) (5E63) [Caenorhabditis elegans] gb|AAO25987.1| Hypothetical protein T22
  Essential gene: C elegans homolog=T22F3.3a; Phenotype=Emb
QLIRDGWQIEEPDDWLRFGNPWEKARPEYMLPVNLYGRVEKDDGKSHWRDTHLIFAMPYDTPSHWRDTHLIFAMPYDTPVPGFRNNVVNTLRLWSAKAENHFPLKFFNDGDYIQAVMDRNLSENITRVLYPNDNVFVGKELRLKQEYFLVAATLQDIIRRFKSSNYGSRDPVRVDFDTFPDKVAIQLNDTHPSIGIPELLRLLVDVEGLSFDKAWEICVRTFAYTNHTLLPEALERWPVAMLALERWPVAMLEHLLPRHLEIIYLINQRFIGRSAF

SEQ ID NO: 120863 - protein, 97 aa, Heterodera glycines
  Coding regions on vcDNA: vcDNA=SeqID_47286; Strand=-; Position=1 -79,315-529
  Homolog annotation: Hit_ID=A57694; Match level="QueryCoverage=98%, HitCoverage=45%, E-value=6e-13, Identity=42%"; Hit description =transcription factor IID 30k chain - human
  Essential gene: C elegans homolog=K03B4.3a; Phenotype =Bmd,Dpy,Emb,Stp,Unc
MPMDEGDDAVVEQPQQLGAGAPDQSTGSDVRPGSSLADFYRDLENYRPTIPDSVALYYMRKNGIANPDVRVVRLFSLAAQKFISDICLDAMQQARHK

SEQ ID NO: 120864 - protein, 153 aa, Heterodera glycines
  Coding regions on vcDNA: vcDNA=SeqID_47287; Strand=+; Position=1 -172,529-545,617-690,1472-1537,1612-1676,1722-1789
  Homolog annotation: Hit_ID=NP_871631.1; Match level="QueryCoverage =94%, HitCoverage=31%, E-value=1e-56, Identity=58%"; Hit description =DNaJ domain (prokaryotic heat shock protein) (dnj-18Co) [Caenorhabditis elegans] emb|CAD82917.1| Hypothet
  Essential gene: C elegans homolog=T04A8.7a; Phenotype=Gro
EFYTPTEKYALKTAHKRPRRPKSLRIYETHVGISSQEPKVNTYRDFADTVLPRIKGQGYNAIQLMAIMEHAYYASFGYQVTSFFAASSYFHDNVRGYHTQWDSRLFNYNETETLRFLLSNLCWWIDEYGFDGFRFDGVSSMLYHSHLISMLSK

SEQ ID NO: 120865 - protein, 120 aa, Heterodera glycines
  Coding regions on vcDNA: vcDNA=SeqID_47288; Strand=-; Position=1 -114,172-290,341-469
  Homolog annotation: Hit_ID=XP_418374.1; Match level="QueryCoverage =99%, HitCoverage=19%, E-value=9e-36, Identity=57%"; Hit description =PREDICTED: similar to DKFZP564O0463 protein; HSPC064 protein [Gallus gallus]
  Essential gene: C elegans homolog=ZK430.7; Phenotype=Lva
MQYVLSVLWSSDNKFVLSGSDDMNIRLWKANAAEKLGPLCPREKAAIEYSQKLRDTFQGHPEVRRIVKHRHVPKAIYSATREHRIIRESQRRKDKNRRKNTKSAATEPFTSERAKAIVSE

SEQ ID NO: 120866 - protein, 538 aa, Heterodera glycines
  Coding regions on vcDNA: vcDNA=SeqID_47289; Strand=-; Position=1 -70,122-255,358-618,686-774,824-1006,1045-1101,1171-1335,1762 -1897,1954-2072,2126-2261
  Homolog annotation: Hit_ID=CAE60137.1; Match level="QueryCoverage =92%, HitCoverage=93%, E-value=1e-126, Identity=47%"; Hit description= Hypothetical protein CBG03683 [Caenorhabditis briggsae]
  Essential gene: C elegans homolog=ZK430.7; Phenotype=Lva
MKVKVISRHPDEYQRETKHDIFKVPRNPRNYAAPPDPFQQQVEYTRALNAAKLERMFAKPFLAAFDGHNEAVNLLVVNLLVKHPTRLSTVLSGARDGQVRVWHLATRRCLHVLQAHSGPINGLSVDASDGLHFVTVGQDAQLKVWPLPIEFDGNAQPTQPVHSLSLDGVPHGCSHVAMLSLDGVPHGCSHVAMSSDFVTCGEGISVWRLFRSSPIRHLFRSSPIRHYAVGPNTVQHINCNPIEEGIMAGCAADRSIFLFDTRQKVPLSRVVLKLRTNSIAWHPLEPFTFVAANIAWHPLEPFTFVAANEDYNLYTFDMRRLDSARLYTFDMRRLDSARHVHQGHTSAVMDVDFAPSGHEFVSGSFDRSLRIFPVEQWRSREVYHTPRMQYVLSVLWSSDNKFVLSGSDDMNIRLWKANAAEKLGPLCPREKAAIEYSQLCPREKAAIEYSQKLRETFQGHPEVRRIVKHRHVPKAIYSATREHRIIRESQRRKATREHRIIRESQRRKDKNRRKNTKSAATEPFTSERAKAIVSEGLE

SEQ ID NO: 120867 - protein, 184 aa, Heterodera glycines
  misc_feature (12)..(12): Xaa can be any naturally occurring amino acid
  Coding regions on vcDNA: vcDNA=SeqID_47290; Strand=-; Position=1 -62,1279-1452,1553-1779,1918-2008
  Homolog annotation: Hit_ID=CAE64961.1; Match level="QueryCoverage =98%, HitCoverage=77%, E-value=8e-42, Identity=47%"; Hit description =Hypothetical protein CBG09795 [Caenorhabditis briggsae]
  Essential gene: C elegans homolog=C34C12.8; Phenotype=Lva
LSWEEIFLISSXRRMMLMMLECREQIEQMEKLKSDNEMLTDKYKRTLADMENLRKRTQRQIEEAKLFAIQPFCKDLLEVADVLDLALNSLEKMKTEDGAASLDSGVNKGIKMTKEVLLKTFKKHGLVPVQPEGQKFDPNLHEAVYEIPKDQARMPAGHIAHVLNIGYSLHDRPIRPAKVGVVKM

SEQ ID NO: 120868 - protein, 339 aa, Heterodera glycines
  Coding regions on vcDNA: vcDNA=SeqID_47291; Strand=+; Position=1 -82,127-288,335-476,545-651,718-895,945-1260,1305-1338
  Homolog annotation: Hit_ID=CAE67776.1; Match level="QueryCoverage =73%, HitCoverage=20%, E-value=5e-29, Identity=32%"; Hit description =Hypothetical protein CBG13351 [Caenorhabditis briggsae]
  Essential gene: C elegans homolog=C08B11.3; Phenotype=Emb
FLLLCSNCRWHLLRKIAYDTLSNIARNIKLVDKLSTVLLNTVQKGLHSDDKCKVMRSMEIVAGLCATPTNESIVCEFFEESQIIPRIFALLSLKDILMCMCAMESVLAISELGRVACEAVARCDRVVEMLVGFLTTDALSFGTVGLAGMHVVEVHGHQTRPYVAPNKKNPPPPLKLQPVQPPVQYAQQRHQTPASSTTTTAPPFGEAMEFAINARTDTLETCPDAFHRRATDGNDSAQFASHQRHPPTRKKVYLKSSRLPFLNHRQQLATDAPPLQNGLSSIAAAVPSSIESVANERDFMCEWLMQSEGDDDWSDEEGTAAGPIEPCARLSRRPNPIDF

SEQ ID NO: 120869 - protein, 321 aa, Heterodera glycines
  Coding regions on vcDNA: vcDNA=SeqID_47292; Strand=+; Position=1 -60,117-299,347-450,694-885,935-1082,1157-1435
  Homolog annotation: Hit_ID=NP_741090.1; Match level="QueryCoverage =99%, HitCoverage=30%, E-value=1e-111, Identity=64%"; Hit description= ZYG homolog (3B500) [Caenorhabditis elegans] pir||T33672 hypothetical protein T24C4.6 - Caenorhabditis e
  Essential gene: C elegans homolog=C08B11.1; Phenotype=Emb
MENHLDEQVMVRNCCLCLCQFDIPQDIMFGYGHVANLLVKVLETHSSDPLTQRIVVFLLNSMACHVEGVQKIEVGEFGAIEIILQQIARKLQSNQCDDVMDTAWSFLWNITGQLLVLDETPANCSRFLKAEGLTLFYRCYVKFPSQMELVRNMMGLIGNIAEVFDLRDQLMIDDYLNIFCTLLDNLSDGIEISYNSAGVLAHLVSDGDERWKTTKVKNSRRHVSDLIVRATELWDLNARRFINYRSFKPILGLLSQWLAIGSQQWAIWALANLTTTDRAKYCRFVVEEGGVELVEQLVNSSNSTNAIRNLAQTVLNNIEEW

SEQ ID NO: 120870 - protein, 209 aa, Heterodera glycines
  Coding regions on vcDNA: vcDNA=SeqID_47293; Strand=+; Position=1 -193,270-448,1521-1609,1743-1911
  Homolog annotation: Hit_ID=NP_491246.2; Match level="QueryCoverage =37%, HitCoverage=34%, E-value=2e-19, Identity=51%"; Hit description =ubiquinone biosynthesis protein (26.2 kD) (1E437) [Caenorhabditis elegans]
  Essential gene: C elegans homolog=T03F1.2; Phenotype=Age,Unclassified
MRSLQKSPYYCGQFGLVQRFGRQKEHRRDFGIERRGDQKGDGGVGDGSASGGGGGQRQIQQIKKDFSQQMFDHIGAIDDSPSASSSLLIAISELQRALLGIGSAVMSLVDPKRGDMVATMGETTVTVKYFEAVQLGFPMCVAAAIFGALRLGPVHRRQLIERNIPWVVQQAERGRFLLALDWERRFEQKIADLQRECSIEPFSAECSNE

SEQ ID NO: 120871 - protein, 195 aa, Heterodera glycines
  Coding regions on vcDNA: vcDNA=SeqID_47294; Strand=-; Position=1 -112,170-262,548-690,1212-1339,1385-1493
  Homolog annotation: Hit_ID=NP_494834.1; Match level="QueryCoverage =100%, HitCoverage=48%, E-value=2e-49, Identity=41%"; Hit description= membrane transporter like (50.3 kD) (2E985) [Caenorhabditis elegans] gb|AAA81125.2| Hypothetical protein
  Essential gene: C elegans homolog=F10G7.5; Phenotype=Gro
MDTDDPILKHISPNSRAYVVIIAGIILQFTYGLVYTFGNLLPYLASYLRWKVDPELNDGTLIWFQSLLAGFPFAFLVGGYLEKVIGARWGAAFGSFLYTLGVALSYLAIQKSYFSLWLPHRVGLVSGLITAGFGSGAFIMSPIQTKYINPDNLNIDSTGYFTQPELLERVPKMFLLLATIFGTLQFVALFFIADP

SEQ ID NO: 120872 - protein, 269 aa, Heterodera glycines
  Coding regions on vcDNA: vcDNA=SeqID_47295; Strand=+; Position=1 -103,759-778,1289-1449,1500-1842,1893-1989,2067-2152
  Homolog annotation: Hit_ID=NP_492315.3; Match level="QueryCoverage =71%, HitCoverage=9%, E-value=1e-63, Identity=63%"; Hit description =abnormal GONad development GON-2, putative TRP homologous cation channel ltrpc1 family member (gon-2) [Cae
  Essential gene: C elegans homolog=T01H8.5; Phenotype=Pvl,Stp
MPADLLDQRLQFKRHHVVNGFIHTSAYAQRSVHENRMDRMEEFRQLSLELLDHCYKEDDAQTLQLLTYELSYWGHQTCLSLAVIVNNKQFLAHPCCQILLADLWHGGLRIRSNSNIKVLMGILFPPSIFLLEFKSREELLLQPQTAAEHQKDINESSSSSSDSSSSSSSSDSENDGDESDAGERGGATAEERRRTSHSHGSMQSLNFTSIFKSKRKRRRPSHSRSSTTAKEDIEMSKQRNRVTSRSWRLYTLFNVVYWTYYMFIAKSTT

SEQ ID NO: 120873 - protein, 256 aa, Heterodera glycines; identical to SEQ ID NO: 119337
  Coding regions on vcDNA: vcDNA=SeqID_47296; Strand=+; Position=1 -192,261-325,389-513,574-812,881-1030
  Homolog annotation: Hit_ID=NP_491237.1; Match level="QueryCoverage =99%, HitCoverage=82%, E-value=5e-73, Identity=50%"; Hit description =protein phosphatase 1A (34.6 kD) (1E406) [Caenorhabditis elegans] gb|AAB42233.1| Yeast glc seven-like pho
  Essential gene: C elegans homolog=W09C3.6; Phenotype=Ste

SEQ ID NO: 120874 - protein, 432 aa, Heterodera glycines
  Coding regions on vcDNA: vcDNA=SeqID_47297; Strand=-; Position=1 -86,305-453,501-588,634-770,816-992,1048-1225,1278-1506
  Homolog annotation: Hit_ID=NP_496148.1; Match level="QueryCoverage =93%, HitCoverage=63%, E-value=5e-62, Identity=37%"; Hit description =FAD-synthetase (59.0 kD) (2K235C) [Caenorhabditis elegans] emb|CAA91346.1| Hypothetical protein R53.1 [Ca
  Essential gene: C elegans homolog=R53.1; Phenotype=Gro
DLTIFFYTIRNVMPGVPHFVSKFRHLKDYLFPSSLLECLRTIYTKKSEIHLQQKLSQLAAKHQNVSIGSYPTMENNYFKTRLYFKTRLSIESISKELGNLAYEELANEFSGWVVNYDPEPWEDCVHKLDIYFSGWVVNYDPEPWEDCVHKLDIYCATQTKEFSVKLFNAIATIDEILDKYSLDQLAISFNGGKDCTLSLDQLAISFNGGKDCTLLLHLFRICVTKKFGKEKRIEGFFVEDEFCELIAFVRNISPNYSLDLLELKGALKKGLAELYSLDLLELKGALKKGLAELKVVRPNIEAVLMGSRATDPRGRFMKSKCEWTDQGWPSFLRVCPLLDWTYTEVWKFLRDMSIPYVCPLLDWTYTEVWKFLRDMSIPYCHLYDMGYTSLGECSTTGKNPALKVEGTEDRSYFVNIYNRVFSAVKKGSGVIF

SEQ ID NO: 120875 - protein, 127 aa, Heterodera glycines
  Coding regions on vcDNA: vcDNA=SeqID_47298; Strand=-; Position=1 -81,266-305,357-619
  Homolog annotation: Hit_ID=CAE57412.1; Match level="QueryCoverage =88%, HitCoverage=21%, E-value=6e-15, Identity=42%"; Hit description =Hypothetical protein CBG00367 [Caenorhabditis briggsae]
  Essential gene: C elegans homolog=ZK550.4; Phenotype=Gro,Unc
MSANNGKEDKKVLTEIPENLKYLVILLVDKIVKERLVPEEVDGKLRKVNYLFINYKAVINVAKYKIDHIRQKLEVREKDDVHKYVLATFLSTNYLRAHYRCTGANCKRQYDAMDIGKIYDPFSQEMR

SEQ ID NO: 120876 - protein, 279 aa, Heterodera glycines
  Coding regions on vcDNA: vcDNA=SeqID_47299; Strand=+; Position=1 -91,146-338,380-551,598-684,731-814,1091-1303
  Homolog annotation: Hit_ID=CAE71194.1; Match level="QueryCoverage =97%, HitCoverage=57%, E-value=1e-108, Identity=63%"; Hit description= Hypothetical protein CBG18052 [Caenorhabditis briggsae]
  Essential gene: C elegans homolog=C07G2.3a; Phenotype=Emb
MDVEHHVAKLMVELSQSQDDEIGDGTTGVVVLAGALLEHAESLLDKGIHPTKIADGFELACKKAIEKLESIAQQFPIDDREALVKSAMTSLGSKVVNKCLRQLGEIAVDAVLSVADLGQHDVNFELIKVIGKVGGRMEETALIRGVVIDKTLSHPQMPRRIENAKIAILTCPFEPPKPKTKHKLDIASTDEFKQLQRYEKETFEKMINELVAIATNGRIVPRFAELTPEKLGSAGLVHELKFGTDNEQMLCIEQCPNNRAVTVLIRGGNKMAIRGLTEE

SEQ ID NO: 120877 - protein, 326 aa, Heterodera glycines
  misc_feature (287)..(287): Xaa can be any naturally occurring amino acid
  misc_feature (293)..(293): Xaa can be any naturally occurring amino acid
  Coding regions on vcDNA: vcDNA=SeqID_47300; Strand=-; Position=1 -22,122-243,305-409,450-696,760-1086
  Homolog annotation: Hit_ID=NP_499157.1; Match level="QueryCoverage =99%, HitCoverage=34%, E-value=4e-59, Identity=39%"; Hit description =vps53-like, N-terminal (3K844) [Caenorhabditis elegans] emb|CAA81595.1| Hypothetical protein T05G5.8 [Cae
  Essential gene: C elegans homolog=T05G5.8; Phenotype=Lon
VLSIGISDGDFGQETDLFHSICNSALMLLVQDAETMCEPSLQAMNKINWSNVDQVGDEWSNVDQVGDESPYVSTIRKNLRASVPLIRDYFSERRKYFAHFCLKLASQLVNRFLGAYFSERRKYFAHFCLKLASQLVNRFLGALFKCRPISIAGAEQLLLDTHSLKTFLLSLPSVESAVVTKPPTQYTAILNKGMTKAEMVLKAVMADKSNQEEFVAHFIRIAVMADKSNQEEFVAHFIRILPDSDAAELQRILEMRPIRRNEQNQIIQLYKTKVESPSVFILNVPNXMGFFCXGANPTPIGTLSVSQPTQSVYSSLMASIGDSSMR

SEQ ID NO: 120878 - protein, 182 aa, Heterodera glycines
  Coding regions on vcDNA: vcDNA=SeqID_47301; Strand=-; Position=1 -27,72-251,488-829
  Homolog annotation: Hit_ID=CAE58579.1; Match level="QueryCoverage =92%, HitCoverage=93%, E-value=5e-67, Identity=70%"; Hit description =Hypothetical protein CBG01745 [Caenorhabditis briggsae]
  Essential gene: C elegans homolog=E04A4.8; Phenotype=Emb,Gro
MPIKASGETLRKYIVVGRKLPTANDSNPTLHEMVIFASNHVVAKSRFWYFTSMLRRVKKTHGEIISCQEVFEKKPGSVKNFGIWLRYDSRTGHHNMYREYRDVCEAGAVTQCYRDMGARHRAQADRIQIIKVQTISVADCKRAGVKQFQNSKIKFPLPHRVNSKRRNVSQCHYTYFLLLFLI

SEQ ID NO: 120879 - protein, 307 aa, Heterodera glycines
  Coding regions on vcDNA: vcDNA=SeqID_47302; Strand=-; Position=1 -132,192-272,430-578,755-926,1156-1208,1512-1659,2101-2289
  Homolog annotation: Hit_ID=CAE75019.1; Match level="QueryCoverage =93%, HitCoverage=74%, E-value=1e-61, Identity=41%"; Hit description =Hypothetical protein CBG22923 [Caenorhabditis briggsae]
  Essential gene: C elegans homolog=F22B7.5a; Phenotype=Emb,Lva,Sck
MLRYVCLFPRRSFHFSTFLPKDYYKILGLSKTAKESDIKKAYYEMAKKYHPDVNKAKGASEKFQELSEAYEVLGDPKRRAEYDRFGAGGPQPGAASGSPGGPQSARDFGWEFHSGKSAEQVFRDIFRDFDPFGNAGAFGSGRRSFGETQHGFDAAQEVVVNVTFEEAARGVRKEVRINWIPVGNATAAVFSQGLRSSRCGGQGAYNKNPCLECEGHGQSVQNKNFHLDIPAGIDNGQVLRTQVSRATLGGTIDVPSISTNNDGKTRVHIPAGTSSHAQMVLKGKGIKRLEQPGYGDQILNIKVNVPK

SEQ ID NO: 120880 - protein, 135 aa, Heterodera glycines
  Coding regions on vcDNA: vcDNA=SeqID_47303; Strand=+; Position=1 -108,381-482,1013-1119,1879-1966
  Homolog annotation: Hit_ID=AAH45063.1; Match level="QueryCoverage =68%, HitCoverage=30%, E-value=6e-29, Identity=66%"; Hit description =Pabpn1-prov protein [Xenopus laevis]
  Essential gene: C elegans homolog=C17E4.5; Phenotype=Emb,Lva,Unc
MVSHMDEELSFEDEEQEPTPNGAPAGSVSVTMSEDNSGTAVTGTGSPVIPNPMSLEEKQLVDARSIYVGNVDYSATPDQLEEHFRGCGAIERVTILTDKFTGHPKGFAYIQFADVDAVNTSTSLNDSLFLGRQIK

SEQ ID NO: 120881 - protein, 78 aa, Heterodera glycines
  Coding regions on vcDNA: vcDNA=SeqID_47304; Strand=+; Position=1 -57,580-727,776-807
  Homolog annotation: Hit_ID=NP_476988.1; Match level="QueryCoverage =98%, HitCoverage=52%, E-value=5e-18, Identity=55%"; Hit description =CG17769-PA [Drosophila melanogaster] gb|AAF56511.1| CG17769-PA [Drosophila melanogaster] gb|AAL48405.1| A
  Essential gene: C elegans homolog=T21H3.3; Phenotype=Emb,Ste
MAENRREELPQIDGLTSEQVFDKDNDGFISPVELRFVMQNLGEELTESEVHEMIREADLDGDGKVNFNEFVFMMRQKV

SEQ ID NO: 120882 - protein, 136 aa, Heterodera glycines
  Coding regions on vcDNA: vcDNA=SeqID_47305; Strand=+; Position=1-3,45- 179,315-530,696-752
  Homolog annotation: Hit_ID=A30033; Match level="QueryCoverage=93%, HitCoverage=97%, E-value=3e-40, Identity=65%"; Hit description =development-specific protein 217 - sea urchin (Tripneustes gratilla) sp|P13732|RL22_TRIGR 60S ribosomal protei
  Essential gene: C elegans homolog=C27A2.2a; Phenotype=Emb,Lva
MAISKGTKITPKGGKGGKGKKKKLTLKFVIECKNPVEDGIMKTATFETFLNERIKVGGKTNQLAANGVKVEATKTKLVVTSEQPFSKRYLKYLTKKFLKRNALRDWLRVVASAKDTYELRYFQINQEDEDESDNEA

SEQ ID NO: 120883 - protein, 304 aa, Heterodera glycines
  misc_feature (283)..(283): Xaa can be any naturally occurring amino acid
  Coding regions on vcDNA: vcDNA=SeqID_47306; Strand=+; Position=1 -797,1798-1924
  Homolog annotation: Hit_ID=NP_502721.1; Match level="QueryCoverage =98%, HitCoverage=22%, E-value=1e-36, Identity=32%"; Hit description =endonuclease/exonuclease/phosphatase family and RNA-directed DNA polymerase (4O953) [Caenorhabditis elega
  Essential gene: C elegans homolog=ZK250.3; Phenotype=Clr,Lvl,Sck
HRFNQNCLFSNNLNWNKGSVLGPLLFLIFINDLTNYIPPEVGIKLYADDVKIYISHDNDAKRDLLSSVGLSKWSKDNGIAIAHEKCAALYLGKNNSTEYKIGEKVILSVDCVRDLGVLVDQKLSFNNHISKILKAAYYKAYQILKILKTRNISTLILAYKSYIRPHLEYASEIWNISSKEQSKRIEKVQKYFTRIVYKKCGLKAIPYEKRLEICKLEKLSTRRSLTDMNMTFKIIRGLTHLDPKKYFEFSSRSQRKTFRIQNNLHFFNAIFELSILSFGHKKXNLFNKNFKQKRIKIFPVLLLI

SEQ ID NO: 120884 - protein, 300 aa, Heterodera glycines
  Coding regions on vcDNA: vcDNA=SeqID_47307; Strand=-; Position=1 -224,311-466,652-774,907-1202,1257-1315,1360-1406
  Homolog annotation: Hit_ID=AAH77528.1; Match level="QueryCoverage =90%, HitCoverage=28%, E-value=1e-48, Identity=44%"; Hit description =Pik3c3-prov protein [Xenopus laevis]
  Essential gene: C elegans homolog=B0025.1a; Phenotype=Gro,Unc
SDRSSVRQRPPEVQTAVSATVAPAVSSPTASMLLGPIETMAMFGAQESMDLATFLIRAACENSLIANFLFWYLKVEMEANATDSDETNAPSSVSAMYCLVMGRLKQELSKGNGSARHTLSTIATQKKFVDTLVDIAKVISDLSGSRSKKQEVLRKKLSENVDLTELKGLGLPLDPSIHVRAVQPESAVLFSSNLMPMRLTFSTVRDALTPYECAEAYTTIFKRGDDLRQDQLVLQMIRLMDELLKEDKLDLCLTPYAVLATSCSEGFVQFIRGATPLADIKSIQVGHTAHIQTVFIHTLR

SEQ ID NO: 120885 - protein, 220 aa, Heterodera glycines
  Coding regions on vcDNA: vcDNA=SeqID_47308; Strand=+; Position=1 -162,218-340,381-513,998-1242
  Homolog annotation: Hit_ID=CAE74018.1; Match level="QueryCoverage =85%, HitCoverage=18%, E-value=8e-91, Identity=78%"; Hit description =Hypothetical protein CBG21666 [Caenorhabditis briggsae]
  Essential gene: C elegans homolog=F38E11.5; Phenotype=Ste
MPLRLDVKRRLLARSDRVKSVDLHLNEPWMLISLYNGFVHIWNYDSQQLIKSFEVCDLPVRAAKFIVRKNWIATGSDDMQLRIFNYNTLERVHQMEAHSDYLRSLAVHPTQPFLLTSSDDMLIKLWDWEDKWKLKQTFEGHTHYVMQLVINPKDNNTFATASLDKTIKVWQFGSSVPNFTLEGHEKGVSPWIPLSFELWVMVYRNRSIASIIITEVRSPT

SEQ ID NO: 120886 - protein, 504 aa, Heterodera glycines
  misc_feature (502)..(502): Xaa can be any naturally occurring amino acid
  Coding regions on vcDNA: vcDNA=SeqID_47309; Strand=-; Position=1 -149,206-290,402-569,940-990,1132-1295,1810-1983,2292-2415,2461 -2511,2636-2773,3051-3212,3488-3703
  Homolog annotation: Hit_ID=CAE67815.1; Match level="QueryCoverage =95%, HitCoverage=95%, E-value=1e-74, Identity=33%"; Hit description =Hypothetical protein CBG13395 [Caenorhabditis briggsae]
  Essential gene: C elegans homolog=M176.2; Phenotype=Emb,Lva
KHILINNQQFITCFKLFLGAFELKRMAQYAIEWCHNNALILRRKEDEGNSDAADAALFPPLTLFPSPFPRDAFEQALKAQKAMNLLYFRVARDYEFLMNAYKDVIKGDEHIAKLVDILKKVHEEGIRQTITVMLQRADVVENNETNEVKYEPKQVEVNTGAIGATGLKRRTTEFHRRMLKKATGMDATTAIPDNKPDAALIDTFYMAWRKFDDPKAIMVCLIYSNDPFQYDLRYIAEELEKKSSGKMDVEIYSLADYSERENSTKSFSLRLDGRKVAIVYSGQSALGCKFDLGMEFRQIIELSTAIKAPSLAVAIKAPSLAVAISSSKKVQQMLTMPGAIERFFPEPSDAATVAQIRATFAKIWGLENEDNDTEKLIEDAIENPGNYVLKPNRECGGHNYYDDKLVEKLKEFTQTERGAHILMQKLRPMVVKNYVLRPYEAARLEEVIPELGIYGFLIGDLKAGRVLHNVQQGYHFRTKLSHVNEAGISAGFGFYDSVYLYXWS

SEQ ID NO: 120887 - protein, 496 aa, Heterodera glycines
  Coding regions on vcDNA: vcDNA=SeqID_47310; Strand=-; Position=1 -113,508-1684,1915-2115
  Homolog annotation: Hit_ID=NP_508269.1; Match level="QueryCoverage =77%, HitCoverage=58%, E-value=7e-42, Identity=30%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MVHIVFDPSIIGYDEYMQYGSGIESEDYFRGSSPFQRGANSITNALDFFRIPPTNVSVSSSKVFELLPSNPLTDTPYHFKLHSSQNFIDLSKCYLQSEFRIRKENEHGHLIDLAADEVAPIQMIGQTFIRNIKMSINGREVFNSNSLMAYKTYFSHELSYSNTAKDSHLNAAGYYRDIGGSLETGDGCIARRNLFARSRTAQFIAKIDADLFNQPLYLINFCELDIEILPNDNEFVLITTPAVAQGAAAAPRYRFEVVSLKMYVKKVSLMDGLALDIARKLEVKPARYAVRKTLMKSMFISHGRFEFTANLFMDQIPRRITMGLVANSDYIGTISRSPFNFQPFNVREISIIANGRSFPQAPYDLDYPNWKYVRPFNDMNEAVGFANSLESNGISYEQFGKTHCIYVFNLTSSGDDQAALFDLIKNGTTASNNRGISIIFRIYKKTKNGLAQKQPSTQYNACPRVSKTQIIDTTSQYNFDPAGKSSNHHNNPSSTP

SEQ ID NO: 120888 - protein, 164 aa, Heterodera glycines
  Coding regions on vcDNA: vcDNA=SeqID_47311; Strand=-; Position=1 -188,361-395,484-566,615-657,730-875
  Homolog annotation: Hit_ID=AAA68776.1; Match level="QueryCoverage =70%, HitCoverage=72%, E-value=2e-48, Identity=83%"; Hit description =Inhibitor of cell death protein 1 [Caenorhabditis elegans] ref|NP _495336.1| transcription factor btf3 (17.
  Essential gene: C elegans homolog=C56C10.8; Phenotype=Emb,Gro,Stp,Unc
GTARRKKKVVHKTTAMDDKKLQTNLKKLSVTNIPGIEEVNMIKDDGTVIHFNNPKVQASVPANTFSITGTAENKQITDMLPGILNQLGAESLTHLKKLANNVTTQFKPSAEDDDVPGGVEERIEDHGGTCPLVVFTIVTQATTVAVGLANQFPHYQPHRYDKSD

SEQ ID NO: 120889 - protein, 372 aa, Heterodera glycines
  Coding regions on vcDNA: vcDNA=SeqID_47312; Strand=+; Position=1 -109,217-303,351-450,490-569,626-733,789-869,1116-1165,1229-1321,1381- 1570
  Homolog annotation: Hit_ID=CAE68128.1; Match level="QueryCoverage =93%, HitCoverage=35%, E-value=1e-114, Identity=59%"; Hit description= Hypothetical protein CBG13773 [Caenorhabditis briggsae]
  Essential gene: C elegans homolog=Y41E3.4; Phenotype=Emb,Lva
HLHFHEVGKNDTTEGYVRTENTERLLREHVKAVGGKVVTRFPPEPNGILHIGHAKAINIDFGLAKARGGICYLRLDDARGGICYLRLDDTNPEKEEERFVQEIVDMVNWLGYSPYKITHSSDYFDQLYSWALTLIRLGYSPYKITHSSDYFDQLYSWALTLIRKNLAYVCHQSTDEMRGFNPPPNLAYVCHQSTDEMRGFNPPPSPWRNRPMEESLRLFQAMKNGAAMKNGAFDEGQATLRLKLTLEDSKQDPVAYRVKYLPHHRTGDKWCVYPTYDYTHCLCDSLENVTHSLCTKEFQARRSSYYWLCRSSYYWLCNALDLYCPVQWEFARLNVNYTVVSKRKLLKLIQAGIVESVCFKRSNKHKISRFSF

SEQ ID NO: 120890 - protein, 484 aa, Heterodera glycines
  Coding regions on vcDNA: vcDNA=SeqID_47313; Strand=+; Position=1 -153,200-302,350-467,513-717,1110-1369,1423-1594,1676-1872,1926-2172
  Homolog annotation: Hit_ID=NP_490854.1; Match level="QueryCoverage =57%, HitCoverage=95%, E-value=5e-82, Identity=53%"; Hit description =mitochondrial ribosomal protein L15 (33.8 kD) (1B913) [Caenorhabditis elegans] gb|AAK09082.1| Hypothetica
  Essential gene: C elegans homolog=Y92H12BR.8; Phenotype=Lva
TSHYQLSRVGFIPAKSTLRVKQFPSSINESTEEWEIAFDEFVYIEQADFREVAEKSYRRLTLEQPVGLRHVNLAVKIDKLERDEHGNPIELVVTANPVSSECKPKAFIHWVARPVLCEVRLYDKLFVHKNPEDPAEVPGGFLTDINPNSLHVLSNAMVDGSIIRTIRPLDRFQFERNGFFCLDPNDSWSSEKKKAVTSAAERALDIVGNASRVRLQDLRDNPGARTVGRQVRAKGHNQAGHTIGELQHASKPPLGWVWGDYYKPWQRSFDGDRRFNGDINLRREYIPISLVELQRLIDLGWLDTSRLVDIAAICATKLLEQKFKPELRQFGIHLTDEVQWASCTAIAAIERAGGRIRTAYYDTESLKAMSDAEKWFRTGKPIPRRKHPPYSLMEYYMDPDHRGYLANPEDIETSRVRLADIVGYTLVTGPPPFENEQKRPDQVFLGLEPGQLVSLEDEKVFEPTHPTLVEYYRGEEQQVADTIR

SEQ ID NO: 120891 - protein, 483 aa, Heterodera glycines
  misc_feature (296)..(296): Xaa can be any naturally occurring amino acid
  misc_feature (351)..(351): Xaa can be any naturally occurring amino acid
  misc_feature (441)..(441): Xaa can be any naturally occurring amino acid
  misc_feature (444)..(444): Xaa can be any naturally occurring amino acid
  misc_feature (481)..(482): Xaa can be any naturally occurring amino acid
  Coding regions on vcDNA: vcDNA=SeqID_47314; Strand=+; Position=1 -184,367-506,609-641,692-844,924-1111,1204-1395,1559-2107
  Homolog annotation: Hit_ID=NP_505114.1; Match level="QueryCoverage =97%, HitCoverage=82%, E-value=2e-67, Identity=36%"; Hit description =carboxylesterase precursor family member (64.2 kD) (5I685) [Caenorhabditis elegans] gb|AAA96175.1| Hypoth
  Essential gene: C elegans homolog=K07C11.4; Phenotype=Gro
LHAFPWDFQKPIPPKRWHGVRNAIRPVAPCVPRAQTVQQMSEDCLYLNIFTPHQHSLRKSPVLFLIHGGAFEVGSAAVDNYTDLGMRYVSAGIVVVSIQYRLGIIGFSSTGDKQMAGNFGLWDQFAALNFGLWDQFAALEFVSENIAQFGGNPADITLFGESAGAASVSFLGLSPHSQGLFQKCVQLSGSPLSAWALNGRVINETAQLAAAINCAENGREGIKECLKGKTVDELFEGVEKVGGQNAPGIRLHKWGPLLDGDFLPADIPQLIERAPPKPTVMGIADLETLLWSDYGXLNTNCLNLNKEIVQFYTRDKAVERIENEVCEENHFGKRKRKSENKMGNKIGNGNXQFKMFFLLSDLQFAVPVIWEAAQKAQKGWPIYFFKNSYFNEVVFPKVVKSDVRKTKNGQNKCVKLRYFCNLNGTFNTHFLCLNVQIYITXNFXNAILKKTTIYLFFAKNGSEFENLKLNETDLVRNLLDXXI

SEQ ID NO: 120892 - protein, 182 aa, Heterodera glycines
  Coding regions on vcDNA: vcDNA=SeqID_47315; Strand=-; Position=1 -78,131-205,1174-1361,1654-1861
  Homolog annotation: Hit_ID=NP_498057.1; Match level="QueryCoverage =70%, HitCoverage=41%, E-value=9e-33, Identity=47%"; Hit description =putative cytoplasmic protein of eukaryotic origin (47.2 kD) (3G76) [Caenorhabditis elegans] gb|AAL02444.1
  Essential gene: C elegans homolog=C27F2.10; Phenotype=Bmd,Dpy,Emb,Unc
MGRVRRHCVVPFECAARAQCVRLAGGREKDANWFMPILYVLCSDLRLIARIDLSRAEEALTFAFEHCPAHFMHNKRLILMYLVPVKMFLGHMPTQQLLVRYNLGQFADVAASVNASILNTHLIKLDAFLAVLRFLGTDIDADELSCILANLIAQKKIKGYISHQRQTLVISKQTPFPSLSAA

SEQ ID NO: 120893 - protein, 147 aa, Heterodera glycines
  misc_feature (12)..(12): Xaa can be any naturally occurring amino acid
  misc_feature (114)..(114): Xaa can be any naturally occurring amino acid
  Coding regions on vcDNA: vcDNA=SeqID_47316; Strand=-; Position=1 -153,197-250,378-618
  Homolog annotation: Hit_ID=NP_496290.2; Match level="QueryCoverage =100%, HitCoverage=60%, E-value=1e-27, Identity=48%"; Hit description= programmed cell death 10 (24.8 kD) (2K896) [Caenorhabditis elegans] emb|CAA90115.2| Hypothetical protein
  Essential gene: C elegans homolog=C14A4.11; Phenotype=Dpy,Emb
FLKLLLIESGVXGTNVQESYLRMHANAATEELELPQFAHIAEFQYLSMRAVSLCKVLARIPDEMTDRRPFLETIKEIASSIKQLLDTTNAIIALVPRCYQPRQINLTPFLSYFXNCLVVEKRKREFVQVSKRFSSTLKDYFKHQEPN

SEQ ID NO: 120894 - protein, 299 aa, Heterodera glycines
  misc_feature (257)..(257): Xaa can be any naturally occurring amino acid
  misc_feature (294)..(294): Xaa can be any naturally occurring amino acid
  misc_feature (298)..(298): Xaa can be any naturally occurring amino acid
  Coding regions on vcDNA: vcDNA=SeqID_47317; Strand=-; Position=1-904
  Homolog annotation: Hit_ID=NP_508294.1; Match level="QueryCoverage =96%, HitCoverage=24%, E-value=3e-38, Identity=32%"; Hit description =predicted CDS, endonuclease/exonuclease/phosphatase family and RNA -directed DNA polymerase (XC178) [Caeno
  Essential gene: C elegans homolog=ZK250.3; Phenotype=Clr,Lvl,Sck
LNFVPQGSVLGPLLFLIYIIDLPDVIPSGVNIKLYADDVKIYICYKAKTETEIMHKALHNLFEWANKWQIKVSIQKTFVLYLGSKNPKETYKFDGNTINAVDTIRDFGINIDNKLQFSDHVNQITRNAYLRMRSLFRIIKSKSSKIWITLYKTYIRPLLEYAPEVWNPSLQKNIKIEKCQKYFTKIVLFKCNLPPIPYLKRLEYLQLPTLENRRKLFDLFMAHKIVYGRTDLDYLKFSNLLNALMSPFIGLTQNINXAKNLFPLRGGTKLWNQLDKEIIKINSLNQFKTKITPXRIKXP

SEQ ID NO: 120895 - protein, 206 aa, Heterodera glycines
  Coding regions on vcDNA: vcDNA=SeqID_47318; Strand=+; Position=1 -56,616-754,801-851,1117-1278,1862-2074
  Homolog annotation: Hit_ID=EAL32779.1; Match level="QueryCoverage =100%, HitCoverage=40%, E-value=2e-27, Identity=36%"; Hit description= GA19893-PA [Drosophila pseudoobscura]
  Essential gene: C elegans homolog=M176.2; Phenotype=Emb,Lva
MKIIRISLPACARQMKLGQLTLDPQDNTLRLYGQKVAVTYIATEAPNPSDDEWKVRLLFERSTAIKSPTIGQDLANQKKVQQDAIRNPQNYVIKPNREGGGHNIWGEDLKQKLLTFTKDERNAHILMEKLNPVVIHNYIVRPMPNNYKYGEMTTELSIIGYAFGNVDEMEVKKNVQKGHFLRTKLAHVNEGGVSFGNGAWDIPFLI

SEQ ID NO: 120896 - protein, 234 aa, Heterodera glycines
  Coding regions on vcDNA: vcDNA=SeqID_47319; Strand=+; Position=1 -293,352-763
  Homolog annotation: Hit_ID=CAE62165.1; Match level="QueryCoverage =52%, HitCoverage=61%, E-value=9e-52, Identity=72%"; Hit description =Hypothetical protein CBG06212 [Caenorhabditis briggsae]
  Essential gene: C elegans homolog=T12G3.5; Phenotype=Gro
MIVLRCLAFLMIGERQQTKSKTWDITFVIIDLESTHCRGSPTAKSSSTGRNTKWGQKKESLDWLCLPGMKLCLEDWVTSILKHISTTFGELPRSAFTRNTIFDVCLSLLKIREPWRESQARFGENDYIDLLGDGSLHPAQLQYHVPRWLRGFPGQNRAIEPVKLIHYRNLYKSKLEQNSPHKWHQLNKRIKYLLQYHNYDKSDELRAERSLGLWEEEPDYFYKDKSRRSYQDLV

SEQ ID NO: 120897 - protein, 243 aa, Heterodera glycines
  Coding regions on vcDNA: vcDNA=SeqID_47320; Strand=+; Position=1 -101,156-280,333-459,514-597,1132-1308,1658-1708,1758-1826
  Homolog annotation: Hit_ID=CAE72630.1; Match level="QueryCoverage =100%, HitCoverage=50%, E-value=3e-91, Identity=64%"; Hit description= Hypothetical protein CBG19828 [Caenorhabditis briggsae]
  Essential gene: C elegans homolog=H04M03.4; Phenotype=Unclassified
IHLVPYPAQFAVPLFPDAVKKQCLKELKQRYENKEIKSPPENFEEWVLHHFGPQILDVFFNPYSKKVWTVKPSKMSPIWVGTRVAKLPQEKLEELCSMDANVLKNADFGWGPNAQFNFPKYGGTGAVWKNMTEKLPSEWFKYNSKVLRVDHRQKCVHYVQLNANGQPTGPTKSLKYDALINSSPIDAFVADNKICEMPLLEHNKVFVIGVGLKLPMTEFCEKYTWLYFPDPDVPFYRVTFFSR

SEQ ID NO: 120898 - protein, 75 aa, Heterodera glycines
  Coding regions on vcDNA: vcDNA=SeqID_47321; Strand=+; Position=1-226
  Homolog annotation: Hit_ID=EAK88214.1; Match level="QueryCoverage =66%, HitCoverage=83%, E-value=9e-12, Identity=71%"; Hit description =polyubiquitin with 3 Ub domains [Cryptosporidium parvum]
  Essential gene: C elegans homolog=ZK1010.1; Phenotype=Emb
MIEIIILYVIFYSIIMRLCHRITAKKTTFIQIFVKTLGGMTLTIFAHSFDTIENVKAKIQDKEDIPPDQQRIIFS

SEQ ID NO: 120899 - protein, 149 aa, Heterodera glycines
  Coding regions on vcDNA: vcDNA=SeqID_47322; Strand=+; Position=1 -362,489-576
  Homolog annotation: Hit_ID=AAN46118.1; Match level="QueryCoverage =67%, HitCoverage=17%, E-value=1e-10, Identity=42%"; Hit description =intermediate filament protein HG-IF1 [Heterodera glycines]
  Essential gene: C elegans homolog=F38B2.1a; Phenotype=Lvl,Unclassified
MSPFGAQVRDSRDREKKELSDLNDRLANYIEKVGFGSAEHGQARPKPKQSTISTRTNLGPFPRSTEPQVEGGPGHAARTPRQGHHHHQDDVRERDSDGQKVDRRHGPIKARVGAGRGQTATKSQGWTKNYGLRKLYRFWIPMMTDYGFP

SEQ ID NO: 120900 - protein, 269 aa, Heterodera glycines
  Coding regions on vcDNA: vcDNA=SeqID_47323; Strand=+; Position=1 -112,219-310,386-598,673-771,814-965,1388-1529
  Homolog annotation: Hit_ID=NP_497702.1; Match level="QueryCoverage =92%, HitCoverage=63%, E-value=2e-77, Identity=52%"; Hit description =ATP GTP-binding protein like (47.6 kD) (3E489) [Caenorhabditis elegans] emb|CAA84329.1| Hypothetical prot
  Essential gene: C elegans homolog=F59A2.4; Phenotype=Emb
MDQNNDQRRAVNEYRLNEDNELRLEVGKEEVILELLEGFRAAVFTYKGALIEVVGRTDSAYIAQQTPMIIYLNTHAALESMRKSAETQLVADRTSSARGPRLLVAGPTDVGKSTLCRILCNYAVREGRTPLYVDLDIGQGSVSIPGTIGCLYIEKPADIVDGFDRKAAYVHNFGHISPSANIRLYDLLVKELALAVRKKSKSSSICDVSGFIVNTCGWVKGDGYACIVNAAEAFEPDVVIVLDHERLYNELQQDLPSFVKAMIDYYTIF

SEQ ID NO: 120901 - protein, 33 aa, Heterodera glycines
  Coding regions on vcDNA: vcDNA=SeqID_47324; Strand=+; Position=1-102
  Essential gene: C elegans homolog=F55D10.2; Phenotype=Gro
VNTLVTPDHTKKAYVRLAADYDALDVANKIGII

SEQ ID NO: 120902 - protein, 100 aa, Heterodera glycines
  Coding regions on vcDNA: vcDNA=SeqID_47325; Strand=-; Position=1 -97,417-524,570-667
  Homolog annotation: Hit_ID=NP_502542.1; Match level="QueryCoverage =100%, HitCoverage=60%, E-value=1e-40, Identity=78%"; Hit description= ribosomal Protein, Large subunit (17.8 kD) (rpl-12) [Caenorhabditis elegans] emb|CAB05226.1| Hypothetica
  Essential gene: C elegans homolog=JC8.3a; Phenotype=Ste
NRVAKIDVVPSAASLIIKELREPPRDRKKVKNVKHSGNLTIEQVINIARQMRPRSIARKLQGTVKEILGTAQSVGCTVDGQHPHDIVDMIRAGEIEVPEE

SEQ ID NO: 120903 - protein, 189 aa, Heterodera glycines
  misc_feature (1)..(1): Xaa can be any naturally occurring amino acid
  Coding regions on vcDNA: vcDNA=SeqID_47326; Strand=+; Position=1 -53,81-289,320-441
  Homolog annotation: Hit_ID=NP_491891.1; Match level="QueryCoverage =53%, HitCoverage=12%, E-value=5e-27, Identity=54%"; Hit description =excision repair (1H135) [Caenorhabditis elegans] gb|AAB96723.1| Hypothetical protein F57B10.6 [Caenorhabd
  Essential gene: C elegans homolog=F57B10.6; Phenotype=Emb
XHAFFTPDIFKNGAEFLTLLGIPFMKAPAEAEAQCVELERLGLGAEFLTLLGIPFMKAPAEAEAQCVELERLGLVDGIVTDDSDVWLFGGRKVYRHMFSRKRHLQKYCAEEIGKKLGYELEGLRRAEFVQLGMLAGGDYSRGLEKLGYELEGLRRAEFVQLGMLAGGDYSRGLERIGVVAALELISEFP

SEQ ID NO: 120904 - protein, 104 aa, Heterodera glycines
  Coding regions on vcDNA: vcDNA=SeqID_47327; Strand=+; Position=1 -75,193-357,883-957
  Homolog annotation: Hit_ID=XP_318556.1; Match level="QueryCoverage =65%, HitCoverage=46%, E-value=6e-29, Identity=86%"; Hit description =ENSANGP00000020247 [Anopheles gambiae] gb|EAA13707.2| ENSANGP00000020247 [Anopheles gambiae str. PEST]
  Essential gene: C elegans homolog=R09B3.5; Phenotype=Dpy,Emb,Lva
MTTTKEGSIKREQFYVRYYVGHKGKFGHEFLEFEFRPDGKLRYANNSNYKNDTLIRKECYVGKSVMDELKRIIEDSEIMNSKLQGKIWLFSVFLQNRSAKSYIL

SEQ ID NO: 120905 - protein, 171 aa, Heterodera glycines
  Coding regions on vcDNA: vcDNA=SeqID_47328; Strand=-; Position=1 -134,386-477,638-736,982-1145,1481-1509
  Homolog annotation: Hit_ID=CAE70305.1; Match level="QueryCoverage =88%, HitCoverage=39%, E-value=3e-59, Identity=71%"; Hit description =Hypothetical protein CBG16826 [Caenorhabditis briggsae]
  Essential gene: C elegans homolog=Y38F2AL.3a; Phenotype=Emb,Lva,Lvl
FCLISNLFLPLAVDMRTYVTKFQWEAARYPIKQSLKALSELIGKQVSQIDNDLKMKATAYNALKNALASIDRKTASLITRDLSDLVKADDFVLGSEYLQTVCVVVPKLLTKDWETKYHTFATMVVPGSARKIVEDADHALYTVTLFQKVLDEYKGACRENKYIVPRSRFDR

SEQ ID NO: 120906 - protein, 270 aa, Heterodera glycines
  misc_feature (262)..(262): Xaa can be any naturally occurring amino acid
  Coding regions on vcDNA: vcDNA=SeqID_47329; Strand=-; Position=1 -59,291-443,686-735,787-844,976-1161,1490-1556,1609-1733,1820-1864
  Homolog annotation: Hit_ID=NP_494777.1; Match level="QueryCoverage =97%, HitCoverage=32%, E-value=3e-73, Identity=52%"; Hit description =myeloperoxidase family member (80.8 kD) (2E693) [Caenorhabditis elegans] gb|AAA83575.1| Hypothetical prot
  Essential gene: C elegans homolog=ZK430.8; Phenotype =Bmd,Dpy,Lva,Lvl,Unc
NTAFVDGSTIYGSNAKDLYKVRDGRTGFLKMSSFNGMMVLPFDASRCANRGTCAAATFVTGDSRVNMFIGLSSLYTLFVREHNRIARELQSLNRAWSGDRLFQRIARELQSLNRAWSGDRLFQETRKIVGAEIQAVLYNEFIPLMLGPSAERLIGPYNGYDQNVDPTVANEFTAAAFRFGHGTIVEQFSRLTENGQSIAAGPFPLNEGTFKSQKLTFKSQKLLSEGGIDPVLRGFWNTPIKRPQQMTAAVTEHLFSSRKIGXMNKGINDQ

SEQ ID NO: 120907 - protein, 159 aa, Heterodera glycines
  Coding regions on vcDNA: vcDNA=SeqID_47330; Strand=-; Position=1 -175,740-813,896-979,1397-1543
  Homolog annotation: Hit_ID=CAE71457.1; Match level="QueryCoverage =80%, HitCoverage=10%, E-value=2e-16, Identity=33%"; Hit description =Hypothetical protein CBG18375 [Caenorhabditis briggsae]
  Essential gene: C elegans homolog=F43D9.1; Phenotype=Dpy
MVSFAAFTVACLRQFMWSKPTAELGMAHFVPTAGDGIGSSRAFLHRYRTAFPKYENYLELDFDGPLDYEERKEQIFALLRWPLEAGLANKAVSWLAEFDKYKKNVEYRIDEDSILPLLTHAFLPAKQFHKFASDVYISQGHIQRSRMYLELSDEGRQNM

SEQ ID NO: 120908 - protein, 438 aa, Heterodera glycines
  Coding regions on vcDNA: vcDNA=SeqID_47331; Strand=-; Position=1-1317
  Homolog annotation: Hit_ID=NP_508269.1; Match level="QueryCoverage =99%, HitCoverage=66%, E-value=6e-50, Identity=30%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MAFHKIDTDSVNSITNALDFFRIPPTNVSVSSSKVFELLPSNPLTDTPYHFKLHSSQNFIDLSKCYLLTEFRIRKENVNGQLVDLTADDINIAPIQMIGQTFIRNIKMSINGREIFNANALMAYKTYFSHELSYSTTAKDSHLNAAGYYRDPGDVLETGDGCTARRDLFALSNVAQFIAKIDTDLFNQPLYLINFCELDIEILPNDNKFVLIAPLAGAPRYRFEVVGLKLYVKKVSLMDGLALDIARKLEVKPARYAVRKTMMKSLFISPGRYEFTANLFMDQIPRRVTMGLVANADYVGSIRRSPFNFQPFNVREISIVANGRSYPQAPYDLDYPSGRYVRPFNDMNEAVGFANSSESNGITFAQYGKTHCIYVFNLTNSGDDQAALFDLIKNGTTAVSIKFNHPVPDGGVMLVVMGECDSLVMLDKNRSISTDTTI

SEQ ID NO: 120909 - protein, 417 aa, Heterodera glycines
  Coding regions on vcDNA: vcDNA=SeqID_47332; Strand=-; Position=1-1252
  Homolog annotation: Hit_ID=NP_508269.1; Match level="QueryCoverage =98%, HitCoverage=62%, E-value=9e-47, Identity=29%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MAFHKIDTDSVNSITNALDFFRIPPTNVSVSSSKVFELLPSNPLTDTPYHFKLHSSQNFIDLSKCYLLTEFRIRKENVNGQLVDLTADDINIAPIQMIGQTFIRNIKMSINGREIFNANALMAYKTYFSHELSYSTTAKDSHLNAAGYYRDPGDVLETGDGCTARRDLFALSNVAQFIAKIDTDLFNQPLYLINFCELDIEILPNDNKFVLIAPLAGAPRYRFEVVGLKLYVKKVSLMDGLALDIARKLEVKPARYAVRKTMMKSLFISPGRYEFTANLFMDQIPRRVTMGLVANADYVGSIRRSPFNFQPFNVREISIVANGRSYPQAPYDLDYPSGRYVRPFNDMNEAVGFANSSESNGITFAQYGKTHCIYVFNLTNSGDDQAALFDLIKNGTTAVSIKFNHPVPDGGVMLVVM

SEQ ID NO: 120910 - protein, 125 aa, Heterodera glycines
  misc_feature (22)..(22): Xaa can be any naturally occurring amino acid
  Coding regions on vcDNA: vcDNA=SeqID_47333; Strand=-; Position=1 -101,850-1125
  Homolog annotation: Hit_ID=P53021; Match level="QueryCoverage=100%, HitCoverage=100%, E-value=4e-41, Identity=68%"; Hit description =Major sperm protein 1 gb|AAA29146.1| major sperm protein
  Essential gene: C elegans homolog=ZK546.6; Phenotype=Emb
MCYISAKFLSNLICFKLKVNAXRKNCRTIYSSILWPRRVGRGEVTPTKPKRINMNPPNGVLGPKESVNVAVSCDAFDPGSEDTKGDRVTVEWTNTPDPAATAFKLEWFQGDGMVRRKNLPIEYNV

SEQ ID NO: 120911 - protein, 395 aa, Heterodera glycines
  Coding regions on vcDNA: vcDNA=SeqID_47334; Strand=-; Position=1 -258,553-677,1296-1479,1900-1982,2111-2292,3250-3413,3789-3962,5140 -5160
  Homolog annotation: Hit_ID=CAE60739.1; Match level="QueryCoverage =94%, HitCoverage=48%, E-value=1e-142, Identity=35%"; Hit description= Hypothetical protein CBG04423 [Caenorhabditis briggsae]
  Essential gene: C elegans homolog=K08C7.3a; Phenotype=Dpy,Muv,Ste,Unc
NGLVFVAFKMPKSSKKKIKSNFLQHNTEGDQCQRCQAGFMQKKWRPSHEGDPFVCEPCNCHGHSSECVYEEELDEKKASLDIYGKFSGGGHCQNCQHNTKGINCNKCTPGFFRPNGKEWSELDVCQPCRCDPTKHTGNCAESTGQCECLPQFTGPNCDQCSPGYYHPPECRPCDCHVNGTEGSQCLVKPDGQCPCKDGFAGRLCDKCAAGYANITDCPPCGCDAEGSVSSECDVKTTACACKSNFGGLRCEQCAKGYYKHPQCEFCDCDPSGTEDQVCDSASGQCLCKAGFAGRRCDRCDDEFYGYPNCRECSCHEKGSKTKECDQKTGECPCFANFTGRTCDKCSAGHYRFPECLACDCFSAGSKGLTCDFDGQCYCRENFEGKRCERCFQFIY

SEQ ID NO: 120912 - protein, 175 aa, Heterodera glycines
  Coding regions on vcDNA: vcDNA=SeqID_47335; Strand=-; Position=1 -113,737-848,891-1159,1210-1243
  Homolog annotation: Hit_ID=NP_501375.2; Match level="QueryCoverage =77%, HitCoverage=18%, E-value=5e-38, Identity=50%"; Hit description =prion-like Q/N-rich domain protein, Prion-like Q/N-rich domain protein PQN-9 (83.4 kD) (pqn-9) [Caenorhab
  Essential gene: C elegans homolog=C07G1.5; Phenotype=Emb,Lva,Lvl,Unc
MPNPITLVDMTSDNVVDYQWCTREELAELKLETRERQHVKEALKHIQKRYRNSNPHISHHALLILEACVKNCGKKFIREVATKEVMDDLKSMIISDPPEKIREKLLELIQCWTSAFKGIPEFKIVEDTHSLLKMNGFEFPPIDEAKAMFLADCAPDWAEGDNCYRGRVEFGMFTR

SEQ ID NO: 120913 - protein, 112 aa, Heterodera glycines
  Coding regions on vcDNA: vcDNA=SeqID_47336; Strand=-; Position=1 -16,77-109,269-444,690-803
  Homolog annotation: Hit_ID=NP_741146.1; Match level="QueryCoverage =67%, HitCoverage=84%, E-value=8e-29, Identity=78%"; Hit description =myosin light chain (10.2 kD) (mlc-3) [Caenorhabditis elegans] gb|AAM22061.1| Myosin light chain protein 3
  Essential gene: C elegans homolog=F09F7.2a; Phenotype=Egl,Unc
MPSQGELKEIFNLYDEELEGKIDATQIGDVARACGLKPTNAMVWKAAGEEYKRKGEKKLAFEEWLPIFEQLQKEKVKAWASPLQHLIFHGMIFVQEIQVQAFLKMSNSNGNI

SEQ ID NO: 120914 - protein, 398 aa, Heterodera glycines
  Coding regions on vcDNA: vcDNA=SeqID_47337; Strand=-; Position=1 -57,116-165,241-643,1341-1553,1603-1790,1847-2132
  Homolog annotation: Hit_ID=CAE63450.1; Match level="QueryCoverage =99%, HitCoverage=46%, E-value=1e-107, Identity=59%"; Hit description= Hypothetical protein CBG07909 [Caenorhabditis briggsae]
  Essential gene: C elegans homolog=Y46G5A.4; Phenotype=Emb
MNRLDRSLVEDLFADRHIQVLVSTATLAWGVNLPAQTVIIKGTQIYNPQKGAWTEIGPLDIMQMMGRAGRPQHNALGKGILMTHNTELQYYLSLMNQQVTNTDFGFCRNENFFIQLPIESQLVAKLPDTLNAEIVLGTVTNVVEAMEWLTYTYLHVRMCKAPALYGIVADKVLGLCKMVNARQWQSLNPLHQFKKLPLDIVRTLDKKNLSFDRLYDLDAHQLGELVRVPKMGKPLYKFIRQIPKLDMTTLILPITRSTLRVELTITPDFQWDEKVHGSSEGFWIFVEDVNGEIILHHEYFLLKQKYCEEEHVVKMFVPVFDPLPPLYFIRIVSDRWLGSETVLPVSFRHLILPEKYPPPTELLDLQPLPVSALNNATFEAIFSKRGIRLFNPIQTQGK

SEQ ID NO: 120915 - protein, 307 aa, Heterodera glycines
  Coding regions on vcDNA: vcDNA=SeqID_47338; Strand=+; Position=1-924
  Homolog annotation: Hit_ID=NP_508269.1; Match level="QueryCoverage =93%, HitCoverage=40%, E-value=4e-25, Identity=25%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MEQNSSENQGFMKRAARFSDGRMCETMVKLNFDLAHQNARMLNNQDIVFTIHRNSDALLLQTPPWKTVHADGTETWNENTDEYRIRLHDRRVYVRTVDATPSLNLAISKQLENSFAKYALRKGEMRSVFLGTGRTELSHNVFTSTLPRRLICTFVSTDAYSGARHLSPFKFEHAHVRSLSAEANGQTFPSTPYLFSFEGGPDNKQQRFIRAFVDMYAGLGLDETDNNKTVSIDMQRFLNGWAFFVIPMTSTLEDTAGFELIRQGTCTVKVQFEQPIKADGYEMLILGEFDSILSINADRVLSTDGSV

SEQ ID NO: 120916 - protein, 414 aa, Heterodera glycines
  misc_feature (13)..(13): Xaa can be any naturally occurring amino acid
  misc_feature (406)..(406): Xaa can be any naturally occurring amino acid
  Coding regions on vcDNA: vcDNA=SeqID_47339; Strand=+; Position=1 -110,157-268,314-369,425-493,552-577,627-750,944-1020,1077-1239,1510 -1563,1609-1716,2757-2817
  Homolog annotation: Hit_ID=NP_509146.1; Match level="QueryCoverage =87%, HitCoverage=67%, E-value=5e-95, Identity=52%"; Hit description =DeHydrogenase, Short chain (46.3 kD) (dhs-28) [Caenorhabditis elegans] gb|AAA83184.1| Dehydrogenases, sho
  Essential gene: C elegans homolog=M03A8.1; Phenotype=Gro
DSFRFLFSKECFXTGAGGGIGRTYALEFARRGAKVIVNDLGGNDLGGDRHGKSASTSAADKVVAEILAAGGKAVPNYDSVENGDKIVRTAIDVENGDKIVRTAIDNFGRIDIVINNAGILRDVSFGKIVINNAGILRDVSFGKMSEFDWDSVMKVHVKSVMKVHVKGAFSVTKAAGAFSVTKAAWEHMRAQKYGRLVFTSSNSGIYGSFGQANYAAAKMALIGLSNTLALEGAKYNIASNVLVPTAGSRMTQTVMPEELLTVPTAGSRMTQTVMPEELLTAMKPEFVTPLTVFLAHESCNATGRVFEAGAGWYGTVEQFRSRGKVIAEPTVEKLVENWEEICDMSGAQHIGSMREVEKLVENWEEICDMSGAQHIGSMREVMENLMDALGVNKSTRVGSSPGSPSXSHSAFPAH

SEQ ID NO: 120917 - protein, 313 aa, Heterodera glycines
  Coding regions on vcDNA: vcDNA=SeqID_47340; Strand=+; Position=1 -132,730-845,901-979,1042-1139,1211-1380,1533-1623,1734-1823,1958 -2047,2117-2194
  Homolog annotation: Hit_ID=CAI19708.1; Match level="QueryCoverage =83%, HitCoverage=26%, E-value=2e-29, Identity=30%"; Hit description =novel protein [Homo sapiens]
  Essential gene: C elegans homolog=Y40B1B.6; Phenotype=Unclassified
LRSAAAQARLPYDRDDQKGVGAVPGDEPSPGFGGTVPLHSQSNARRLDRPKTVIVIGAGPAGLAAARQLKFFGFSVILLEGRARPGGRVQTINRTHSADLGAMIVMGIMGNPLVTLIQQAPVTVFRASNRCPIYDNQASSFGKLVDSRKDDMIERSFNRILGTISYLSHAEGVTETKLPGETAGRKISLGKAFELILSQQELRVKNKWLNFWQKYYYLLKKLEIEKLRVDSLHAQLADCMQRLRENGIANPAEATAETIAVNFEESAEKVEQQMIVRALRKITEITLEKYDEAERERNNTENVLKDFKQMEPR

SEQ ID NO: 120918 - protein, 952 aa, Heterodera glycines
  Coding regions on vcDNA: vcDNA=SeqID_47341; Strand=+; Position=1 -817,881-1192,1333-1386,1817-2236,2404-3659
  Homolog annotation: Hit_ID=NP_508269.1; Match level="QueryCoverage =45%, HitCoverage=66%, E-value=1e-44, Identity=28%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MPSSNSFYVIVPSNTNVEGNRTNSFRVRLPRKLQFNSEWDVGLGVIIYPHSWPSLGTSEDQFVQIEWKIGENVQIPIPSSNVTNPVELWKSLYKLLEEGNKPFAVKVEGVQKKFTEAANTARQLGRAEYINKQQQQQRDKRNVNDDDDDDDKNEEELLNALLAGVDTLLDLYGATSGGLLEREKRAATSKVPLRNWDDTEEEYQKKLDKYFLRLRGRNLEHLEGLITEKLNAEIALMDDEERTILDQTKELGMTAWIKIFQSAYSACFLHFDNQLAYILGFNSTDFTEKETIAKFMPDMSGGVASFHVYAPDLIEPMMIGDVIAPVLRIVTIRGKPDEIIEEQFLSVQYHRVLVKEISEIFIEIRTSGGNLMPFQYAVAATPAPYSMVINVDPSEVVVQYGGYNVFRGVPYQRGSGIGSVFRSLLRYLIPIGKEIGTAIGRQGLESGNRVLSNVLEGRDLKESLVSEGKTGLKNLLEKAANNINAQKGQGFDFKRYTKRNDAREGGAIGKAKKGINKLQSRLGPHDFLPANTPAVPPTNVSVVRSYFREVLPLVTITQESPYLFRLYSDNLWTDLSRIYLFLDLSIEKPDVDGNWVSIAATDAQVGTIQGIGQTFVQQLKVSVGNTEIYDSGNLYPYKVYITNTLSFPMNVKKSFLASTGHYATRTHDSVADEGFKARCKIFEGGKRAQFLSRLDFDLGNQELYLLNNLDLLFTIYKARDTFIMQTLKANDTTKYRVRVHDVKLYAKMIDVQSSLNLSIYKTLEKQPATYAVRKTEIKSCFISEGRFEIDYNVFSATIPRRMTIALVANGAFNGNYALSPFNFKPFDIRDIAVYAGGMIYPIVPYKLDFAKDIFVRPFVDMYEALGMANSERSFDITKEQFKSGWTFFVIPLTSTLDDSTGYELLRSGTTSIRATFNSAIPEGGVEMIVLGEFDQMIMIDYNRHIVSDSKLS

SEQ ID NO: 120919 - protein, 364 aa, Heterodera glycines
  misc_feature (6)..(6): Xaa can be any naturally occurring amino acid
  Coding regions on vcDNA: vcDNA=SeqID_47342; Strand=+; Position=1 -395,554-585,637-754,834-861,907-1033,1088-1168,1212-1254,1343-1400
  Homolog annotation: Hit_ID=NP_504414.3; Match level="QueryCoverage =98%, HitCoverage=31%, E-value=1e-117, Identity=60%"; Hit description= Na/Ca eXchanger (103.1 kD) (ncx-2) [Caenorhabditis elegans] gb|AAM29661.1| Na/ca exchangers protein 2, i
  Essential gene: C elegans homolog=C10G8.5a; Phenotype=Gro
PPPPNXAEYEMITKGPKSRAFYRVQATRRLVGGGDIVRKRLEREHDKAGDVTVQEQERQARRHTCRIFFDPAHYTVLESVGVFDVMVGRDGGPDGLTVMADYYTEDGTANAGSDYQPVKGTLTFHPEDKHQKISIEIVDDDVFEEDEHFYLHLTNLRFEEDEHFYLHLTNLRVRTRDGLILDPSRIGGVPVAMFDLPTTATIMILPTTATIMILDDDHAGVFSFEHDHYVTVENCGHVTDDDHAGVFSFEHDHYVTVENCGHVTLRVQRTSGCRGQVVLPYRTIDGTIDGTASGGKHFEVKEGEVVFENNQTEAFIDIGIMDTEQYEQTEAFIDIGIMDTEQYERSDFFSMELKDPIWTKKMSD

SEQ ID NO: 120920 - protein, 157 aa, Heterodera glycines
  Coding regions on vcDNA: vcDNA=SeqID_47343; Strand=+; Position=1 -80,273-673
  Homolog annotation: Hit_ID=AAN46118.1; Match level="QueryCoverage =82%, HitCoverage=22%, E-value=6e-59, Identity=90%"; Hit description =intermediate filament protein HG-IF1 [Heterodera glycines]
  Essential gene: C elegans homolog=W10G6.3; Phenotype =Lvl,Unc,Unclassified
EGDGPGLKQLVEQVVRTTGINEVADTETMRVVKGETSSRQSYQRSAKGNVSILETSPEGKYVVLENTHRSKEETIGEWKLKRRIDGKREIVYTLPANFVLRPMARLKVRFRFWRRAHSPPDQSIIDWSEERKKNTVSGLTQGCDRFLFVRNVLILGY

SEQ ID NO: 120921 - protein, 235 aa, Heterodera glycines
  misc_feature (2)..(2): Xaa can be any naturally occurring amino acid
  Coding regions on vcDNA: vcDNA=SeqID_47344; Strand=+; Position=1 -28,159-248,282-392,837-937,1317-1489,1544-1686
  Homolog annotation: Hit_ID=NP_496205.1; Match level="QueryCoverage =98%, HitCoverage=16%, E-value=4e-64, Identity=51%"; Hit description =phospholipase C gamma (2K519) [Caenorhabditis elegans] emb|CAA88745.1| Hypothetical protein T01E8.3 [Caen
  Essential gene: C elegans homolog=T01E8.3; Phenotype=Stp
NXGGIGVKKSDAHVAEEWFHGKVGRDEAKARLLQAARHNNGLFLVRESTTGLFLVRESTTFIGDFTLSFLHSGCVHHCRIKGGTIGGERKYHLLDSVKRDTLYELISFYTHNALDTPNFKTFLQTPCPQPQPHLDKPWFSANADTEQAEKLLNAVPMDGAFMVRYSSTDKTVFVVSLRIDNNLCHFRLIDNNLCHFRLKREGRLFMVAQRTFETLCHLVDFYASTPFVRGVSLKF

SEQ ID NO: 120922 - protein, 234 aa, Heterodera glycines
  Coding regions on vcDNA: vcDNA=SeqID_47345; Strand=-; Position=1 -111,211-387,577-770,894-1113
  Homolog annotation: Hit_ID=CAE66968.1; Match level="QueryCoverage =100%, HitCoverage=38%, E-value=1e-28, Identity=34%"; Hit description= Hypothetical protein CBG12363 [Caenorhabditis briggsae]
  Essential gene: C elegans homolog=DY3.2; Phenotype=Emb
MTSFSDEVEHRYQAKLQEQLQAMRDDFDNRIAQNRAEVDELYRNKLGEAAENANRNRDLAAKAREEAAMWRVRVQDLENSSKDHQGIVESLNRRVKDLEAALRRAHEDADIRIQQRDEQIEQLQKEIALMISDYQDLLDVKVQLDTELQAYQKMLEQEETRLHITPSTSPNTSVVGQNISTPNMVISTPRPVSPRLATPVTQSESLTTVRRGVKRRRLNQDDIVSFDKTSSSWK

SEQ ID NO: 120923 - protein, 119 aa, Heterodera glycines
  Coding regions on vcDNA: vcDNA=SeqID_47346; Strand=-; Position=1 -89,220-325,593-757
  Homolog annotation: Hit_ID=CAA52188.1; Match level="QueryCoverage =96%, HitCoverage=19%, E-value=6e-18, Identity=43%"; Hit description =lamin [Caenorhabditis elegans] pir||S42257 lamin - Caenorhabditis elegans
  Essential gene: C elegans homolog=DY3.2; Phenotype=Emb
MASKSKRTTRSQREAAIHIDASADETIESSSNGSTINSSSGHLSSRQDEKNHLCNLNDRLAGYIERVRSLETENARLQIQVREVEVVERKEKENLSARYEIKIDELRKQLEFFTREKAK

SEQ ID NO: 120924 - protein, 253 aa, Heterodera glycines
  Coding regions on vcDNA: vcDNA=SeqID_47347; Strand=+; Position=1 -81,129-328,378-642,720-818,862-978
  Homolog annotation: Hit_ID=CAE67980.1; Match level="QueryCoverage =85%, HitCoverage=89%, E-value=2e-46, Identity=44%"; Hit description =Hypothetical protein CBG13586 [Caenorhabditis briggsae]
  Essential gene: C elegans homolog=K08D12.1; Phenotype=Emb,Lva,Unc
MEFSSTDYLNEHQRFDYQILPKVEYTGTTLVGMECFGGIVVATDSRSSSGTYISNRTTDKITMLNDRIVILRAGTQADTQALADIVMYYAEAHAIMDEEDEITVRNVANYARKMHYNYRGQLNSTFLVAGYDSLNMGQLYVIPGGGYTTRHPYYTSGSGSSYIREYLQNQWKEDLDGEVVRQILKKAVFEAQRRDGASGGLIHTAIINAKGISRKTYRPDKEDFPIVSPEKFYPNLPEHILQPGLVTIERMET

SEQ ID NO: 120925 - protein, 581 aa, Heterodera glycines
  misc_feature (9)..(9): Xaa can be any naturally occurring amino acid
  misc_feature (289)..(290): Xaa can be any naturally occurring amino acid
  Coding regions on vcDNA: vcDNA=SeqID_47348; Strand=+; Position=1 -166,262-322,363-452,498-605,651-820,907-991,1120-1442,1487-1759,1803- 2060
  Homolog annotation: Hit_ID=NP_501725.2; Match level="QueryCoverage =97%, HitCoverage=29%, E-value=1e-92, Identity=35%"; Hit description =putative protein, with 2 coiled coil-4 domains, of eukaryotic origin (4K462) [Caenorhabditis elegans] emb
  Essential gene: C elegans homolog=ZK1251.9; Phenotype=Gro
TKDTKCYQXGSSGCMERIEESTFKSHLQDEVRQILLTWENEHRNNDWEIEPSLKRMAEIMAEILEEAINDYLQNNPDPMDERHPFKSQPDERHPFKSQPSRPLGYLLKMITKEENFLNKLIISYLIISYLLARDNPRLNMFAARLLLDLLPGIDTNVILADAESLLTQLFRWADAESLLTQLFRWAENGDSRELRAYSMALLGSAMAEQAHQYRQQNATLIPIALQRLHHQDEQLRHQDEQLRKESKVVGPTDFSLLRQEEQHENGSNCPLSYKSSSGRTHKGRQKTAXXTTDGLSPTSKRSFTKLRTMISMLINSIRGVSTIDDSNSSWRQIMQPILVGTHSLYPLSIEMEQRLILNYLGPTSEYQDNLSIVLENHALNLSIVLENHALDVVLNFLEIDGPNHKCRDIRLLFDGVRYISSLLIHRKFAWEFIAAQGIQRLLRINRKSIASTAVTTCLYYLAYSADIMEKVCHLPEQVLNDIIDYALYALDHNHESVCHLPEQVLNDIIDYALYALDHNHESGRASIAMFLAHALQFRPILDRFDQRDGLRRLYNYISTLTVLQRIEEDVRSAQRRSHRAK

SEQ ID NO: 120926 - protein, 220 aa, Heterodera glycines
  Coding regions on vcDNA: vcDNA=SeqID_47349; Strand=-; Position=1 -46,94-118,496-639,955-1075,1219-1270,1510-1633,2059-2152,2563-2596
  Homolog annotation: Hit_ID=CAE59250.1; Match level="QueryCoverage =98%, HitCoverage=53%, E-value=4e-75, Identity=66%"; Hit description =Hypothetical protein CBG02576 [Caenorhabditis briggsae]
  Essential gene: C elegans homolog=C29H12.2; Phenotype=Gro
ERLISIIISVMMVITGSVNTLAAKSVNTLAAKWADSIVVDGVLFDHPYFQAFCMFIGEFSCLVVFVVAYLVKKRRWKNRNQYGDGGAIIEIGTDEEPTLPRFNPFVFLPPACCDVLGTSTMYVGLNLTTASSFQMLRGAVIIFTGLLSVSFLRAQLRGFKWLGMGLVAFGLVIVGVTDIMFDDNPKDDINGVITGDLLIVMAQIIVAIQMVEQKYLMQYD

SEQ ID NO: 120927 - protein, 113 aa, Heterodera glycines
  misc_feature (1)..(1): Xaa can be any naturally occurring amino acid
  Coding regions on vcDNA: vcDNA=SeqID_47350; Strand=+; Position=1 -219,448-566
  Homolog annotation: Hit_ID=AAT70232.1; Match level="QueryCoverage =94%, HitCoverage=55%, E-value=3e-56, Identity=78%"; Hit description =unc-87 [Heterodera glycines]
  Essential gene: C elegans homolog=F08B6.4a; Phenotype=Unc
XHSVSLDFDEEAPNATMETKVAGGGAAPKRVGRWTLSQLRQTDGIIPSQAGWNKGDSQKLMTNFGTPRNTTTKVKVENLAEIPEDILLKSHGEVRLQSGTNRFASQKGFVSFG

SEQ ID NO: 120928 - protein, 198 aa, Heterodera glycines
  misc_feature (15)..(15): Xaa can be any naturally occurring amino acid
  misc_feature (35)..(35): Xaa can be any naturally occurring amino acid
  misc_feature (190)..(190): Xaa can be any naturally occurring amino acid
  Coding regions on vcDNA: vcDNA=SeqID_47351; Strand=+; Position=1 -78,167-283,669-766,863-951,1403-1455,1550-1658,1839-1871
  Homolog annotation: Hit_ID=AAT70232.1; Match level="QueryCoverage =88%, HitCoverage=67%, E-value=2e-81, Identity=71%"; Hit description =unc-87 [Heterodera glycines]
  Essential gene: C elegans homolog=F08B6.4a; Phenotype=Unc
RFSTSPNIVVGSGRXSFHQLILLSVNILSNILSLXPLPEEKIRASDGIVRLQAGTNKFDSQKGMTLFGTGRRETTRMKDSKHPEYSHERDIDNTEIPLQMGTNKFASQKGMTGFGTNRRETTKMLDTSHPEYSHEQSIDQTSIPYQMGSNKSNKYASQKGMTGFGQPRWEVLDPSISYQNRKSQGKQAFXSVPNEFYS

SEQ ID NO: 120929 - protein, 537 aa, Heterodera glycines
  misc_feature (400)..(400): Xaa can be any naturally occurring amino acid
  Coding regions on vcDNA: vcDNA=SeqID_47352; Strand=-; Position=1 -144,206-308,369-510,561-674,730-763,824-917,984-1177,1338-1637,1683 -1746,1933-2067,2186-2301
  Homolog annotation: Hit_ID=T15822; Match level="QueryCoverage=98%, HitCoverage=29%, E-value=1e-130, Identity=50%"; Hit description =kinesin-like protein unc-104 - Caenorhabditis elegans
  Essential gene: C elegans homolog=C52E12.2a; Phenotype=Unc
SLQFANCFQLLVGGSRSVPDCRGGRDEDVLSLGLSPGTYLEFSMDDRVSFQEAAWDSSLHNSPLLVSFQEAAWDSSLHNSPLLNRVSGYGENVYMTISAYMEIAYMEIENCAQSAIITKDLGLIVYARDSKISAASRFCRSLIGGISKSAEMNRVPGVYLLTVMEDSDSAEMNRVPGVYLLTVMEDSDPGTARRKRRILDTSSTYVRGEVRGEENLGTWRPRGDSIILEHQLEPRGDSIILEHQLELEKLSKLQQVERMRLFLMATHRWEKSKNKYNYYFWKISPCSPKFPIPNSVKMSGKERKLATKVLELIRLKIPVNKDPPTGKKNANLFSQTMPKSVTLTADIRTKSRSFDDLNIEYGAMNESMTRSTSGNYVQNNGTLNNSRGASFMEIIKLINXQVTEERVGLVVSKKGHMHFLEGARQEWVRRWVVVRRWVVIRRPYILLYRDDKDLVIRGIINLAIAKIEYNDEQQENAPNTFTVCTSHRAFFMQALPGDDLFDWIAALNPLLAGQILKKNHNHSEGDQLTMSDQTIGN

SEQ ID NO: 120930 - protein, 208 aa, Heterodera glycines
  Coding regions on vcDNA: vcDNA=SeqID_47353; Strand=+; Position=1 -111,165-185,230-364,460-525,659-745,791-872
  Homolog annotation: Hit_ID=CAE58630.1; Match level="QueryCoverage =98%, HitCoverage=26%, E-value=4e-65, Identity=57%"; Hit description =Hypothetical protein CBG01798 [Caenorhabditis briggsae]
  Essential gene: C elegans homolog=Y67H2A.1; Phenotype=Emb,Lva
TMASDDNSDMFTFMPLGSGQEVGRSCHFMQFKSKKIMFDCGIHPFDCGIHPGMQGVDALPGMQGVDALPFVDFIDVEELDLLLITHFHLDHCGALPWLLEKTAFRGRCFMTHATKAIYRTLIGDCIKIAKYGSGGANESRMLYTEEDLERSMDKIEVLDFHEQKEVNGIKFWCYVARHKIEVLDFHEQKEVNGIKFWCYVARHVLGAC

SEQ ID NO: 120931 - protein, 650 aa, Heterodera glycines
  Coding regions on vcDNA: vcDNA=SeqID_47354; Strand=-; Position=1 -121,182-311,358-401,446-552,639-899,946-1093,1150-1444,1488 -1662,2012-2197,2499-2821,2863-3023
  Homolog annotation: Hit_ID=NP_741586.1; Match level="QueryCoverage =61%, HitCoverage=89%, E-value=2e-82, Identity=41%"; Hit description =fidgetin-like 1 (50.0 kD) (5J657) [Caenorhabditis elegans] gb|AAM29664.1| Hypothetical protein C24B5.2a [
  Essential gene: C elegans homolog=T01G9.5a; Phenotype=Emb
MGSKSAPATADVAYANYRLFDELNRKVRESLRKAIEADETRIAKSRVIGLYENVLKQINKALEIRHTSCPSHKQTEMQEQQKKLKAFVGQTKDRLEKLASIEPMALRATPLPLATVETGNNRARRMPCTSTDQRLVSNRQNLSKMSLLKSVDSKLGDEILATIVETTDIRLDDIEGNAMAKLALEESVVLPALNPKLFMGLRAPCTGILLFGPPGNGKTMLAKAVASECNSTFFSISAATIMSKWVGDGERLVKALFQVARNAQPSIIFIDEVDSMLCQRFEQENGAARRVKTEFLVQLDGCSSEKEANGHVLVLAATNRPQELDEGILRRFPQRIFIDLPDKKARFQMIRRTFKQSNTKLQLNDAELEKIAAMTDNYSYSDLKALCRAAALFPVQSARMENRDLRRCTAEQLRPVNVTDLENAIRSPIKCPVRLPCQHYFCRLCIADEKCCVICGHPIGCSELVEDKVLNYVLESSSEVTETCANCDQLRSRPICPQHNEPFILFCLDSKSLMCIECFNSSSLERRFSKLIKIRMNCIFTSGHFVNIELAHKICCDKLEKNALNLRIFQEELREQIELRKRLTDELSKNSENLREEIDHKCDVIIDRLNELRRHLLDRVVQEKAEKQRKLSAQLNKLLTLGSPISVNLL

SEQ ID NO: 120932 - protein, 188 aa, Heterodera glycines
  Coding regions on vcDNA: vcDNA=SeqID_47355; Strand=-; Position=1 -153,306-485,1247-1379,1655-1755
  Homolog annotation: Hit_ID=NP_498660.1; Match level="QueryCoverage =98%, HitCoverage=97%, E-value=1e-74, Identity=74%"; Hit description =ribosomal Protein, Large subunit (21.5 kD) (rpl-9) [Caenorhabditis elegans] gb|AAK84469.1| Ribosomal prot
  Essential gene: C elegans homolog=R13A5.8; Phenotype=Emb,Ste
MKLIESSDIVKFPDNVTFALNNRVVTVKGPRGTLKRDFRHLNIEIMRENPKLLRVRKWFGIRKELAAIRTVCSHIENMIKGVTVGFRYKMRSVYAHFPINITLQENNTVVEIRNFLGEKFVRRVGLPQGVSAVMSTKQKDELIIDGTDIQKVSQAAARIQQSTTVKNKDIRKFLDGIYVSEKVAIADE

SEQ ID NO: 120933 - protein, 354 aa, Heterodera glycines
  Coding regions on vcDNA: vcDNA=SeqID_47356; Strand=-; Position=1 -569,3842-3953,4717-4873,4941-5048,5103-5165,5212-5267
  Homolog annotation: Hit_ID=CAE58762.1; Match level="QueryCoverage =31%, HitCoverage=14%, E-value=3e-36, Identity=63%"; Hit description =Hypothetical protein CBG01954 [Caenorhabditis briggsae]
  Essential gene: C elegans homolog=C17G1.6; Phenotype=Bmd
HGRRTEEECQAETEETVRVKTETVDEPKQNEPEENAKRKREETVRVKTETVDEPKQNEPEENAKRKREETVKVKTETVDEPKQNEPEENAKRKWEEKVSVKTETVDEPKQNEPEENAKRKWEEKVSVKTETVDEQNDVELEQQLEEPSSSCGAEEEEDPALKELKRILEANGTKMEANIPLPLPRWVRGIPDGHRCAETYQTICDGCLIGFKLLGSTTKGTLRVLQRSLTCIRFAYYRDANDLVGRRDYMEYSRLSGCWSMVGRQGGSQIVSIGFGCETLGITVHETMHALGVWHEQSRTDQENYVTINYNNILSGTESNFYKRSPDTSDNLGQPYDLGSVMHYSNKAFARDFN

SEQ ID NO: 120934 - protein, 378 aa, Heterodera glycines
  Coding regions on vcDNA: vcDNA=SeqID_47357; Strand=+; Position=1 -141,194-226,476-722,770-839,1155-1302,1354-1421,1494-1564,1610 -1663,1708-1771,2978-3002
  Homolog annotation: Hit_ID=CAE59719.1; Match level="QueryCoverage =100%, HitCoverage=59%, E-value=5e-82, Identity=44%"; Hit description= Hypothetical protein CBG03152 [Caenorhabditis briggsae]
  Essential gene: C elegans homolog=K08F8.1a; Phenotype=Emb
TLQSSLCVCTPFLTRPRWWRRKKATHGRKLKLKEHPVTDEYKVSHEIVGIGESGKVMIVGIGESGKVMACFHKRRGEKCALKVLRDNARSRRELALHLSVVGHPHVVSIEDMFENSFDGLKCLLVVVEFMGGGDLLTIFEQNGRLAYSEKCVARIVSQIGSAVQYLHERNIAHEKCVARIVSQIGSAVQYLHERNIAHRDIKLENILCSSTVEKCTFKLADFGFAKRTEKGRLMESPCCTPAYVCPEILNRNHYDILNRNHYDKGCDIWALGVATYILCGYPPFYSMQGLPFSPGMRERIMEGMFAFPEDEWGTISHSTRIMEGMFAFPEDEWGTISHSTKNIIAAMLRKNIIAAMLRTDPTERITIEQVIAAAFALG

SEQ ID NO: 120935 - protein, 385 aa, Heterodera glycines
  misc_feature (333)..(333): Xaa can be any naturally occurring amino acid
  Coding regions on vcDNA: vcDNA=SeqID_47358; Strand=+; Position=1 -26,1319-2279,2397-2476,3977-4079
  Homolog annotation: Hit_ID=NP_500227.1; Match level="QueryCoverage =93%, HitCoverage=35%, E-value=4e-62, Identity=36%"; Hit description =predicted CDS, reverse transcriptase like family member (4D351) [Caenorhabditis elegans] gb|AAK68554.1| H
  Essential gene: C elegans homolog=ZK250.3; Phenotype=Clr,Lvl,Sck
MCRHHQRHIWKTSLVLPLFKNGDKNSKQYRPISITCSCCRIFERLIAKKITEFLLKNNLISEHQFGFLKSRSTTSQLISSLEDWYNAILRNQKIDIIYLDLQKSFDQVPHDLLIYKLKKTEQRNLLNWLRDFLLGRTFKVRINQKFSNEFPVKSGVPQGSVLGPILFLIFINDLPEEIPKEISIADDTKIYHCYSNESQRKVLETALISVFNWAETWGLNFSVKKSSVLYLGKNNKKIPYTIKNSTFPESKIIRDLDILIDNKLKFYEHVSIILQKAISKVELFKKIKTKTTNTWITVYKSYIRPLLEYATEIWNPRTKKEIKVLSQVKNKQXRKIYMKIKSRSINKMPQNFKNFTNRNNIKFNVVYCWRRKRSIKIKRIIIYSK

SEQ ID NO: 120936 - protein, 576 aa, Heterodera glycines
  misc_feature (1)..(1): Xaa can be any naturally occurring amino acid
  misc_feature (20)..(20): Xaa can be any naturally occurring amino acid
  Coding regions on vcDNA: vcDNA=SeqID_47359; Strand=-; Position=1 -145,194-392,435-524,614-721,919-1074,1121-1227,1270-1568,1611 -1752,1891-2070
  Homolog annotation: Hit_ID=AAH67307.1; Match level="QueryCoverage =98%, HitCoverage=64%, E-value=1e-149, Identity=52%"; Hit description= Mcm7-prov protein [Xenopus tropicalis] ref|NP_998877.1| Mcm7-prov protein [Xenopus tropicalis]
  Essential gene: C elegans homolog=F32D1.10; Phenotype=Emb
XVNSLSYTPLYNCPSKQCHXKQSGGRLEMQFRGSKFVKFQEMRIQELSDQVGVGSIPRSMTIYLSGENTRKSDQVGVGSIPRSMTIYLSGENTRKAIPGDVVEICGVLIPMLRTGFRQMAGGLVTELFLDAYVRFHFNRDTNEDLLDGELNAEEIELVSHEHFNRDTNEDLLDGELNAEEIELVSHENFYEHIAYSIYSIAPEIYGLSDVKKSLLLALIGGVNKNANGMKIRGALNILLMGDPGVAKSQLLTYVDRLAIRSQYTTGRGSSGVGLTAAVVKDQLTGEMSLEGGALVLADREMSLEGGALVLADRGICCIDEFDKMVDSDRTAIHEVMEQQTISIAKAGIMTSLNARTSIIEVMEQQTISIAKAGIMTSLNARTSIIAAANPAFGRYNPNKSIEENIQLPAALLSRFDLLWLIQDVPDRETDRKLADHITYVHRKGEQPQADFEPINMKLFRKYLSICKRKEPKYLSICKRKEPVVPNALKEVLVEKYVEMRCEAKNSSDSTFTSPRLLLAAIRMCTALARLRLADEVEMIDVKEALRLIDIARNSLHHTKAKRHLSENPFRLFLKRL

SEQ ID NO: 120937 - protein, 310 aa, Heterodera glycines
  Coding regions on vcDNA: vcDNA=SeqID_47360; Strand=-; Position=1 -660,1053-1325
  Homolog annotation: Hit_ID=NP_494224.1; Match level="QueryCoverage =67%, HitCoverage=50%, E-value=2e-20, Identity=31%"; Hit description =predicted CDS, putative cytoplasmic protein family member (2C560) [Caenorhabditis elegans] gb|AAB66195.1|
  Essential gene: C elegans homolog=F19G12.2; Phenotype=Unclassified
MAFHKIDSSSIDSITNAVDFFSIPPTNVTVSSSKVFEILPSNPLTDTPYHFKIHSSQNYIDLSKCYLLTEFRMRKLTPPNGEWGHLDTNDQVVPIQLIGHTFIRDMKIAINGREIFNSNSLMAYKTYLSHELSQSLEAKVSHLTAAGYDREDANNLQNSNSEGFKSRRQRYLGGRTAQYIAKIDADLFNVPQYLINHCEIDITIQPHDDNFLLIDTLDPPEALGFANSTYGNGIDYFSFLHTHCIYVFNMTNSGDDHGGLFDLIKKGCTAVNIKFKKPVPDGGITLIVMGEADSIYFLDKNRTIATDTTI

SEQ ID NO: 120938 - protein, 187 aa, Heterodera glycines
  Coding regions on vcDNA: vcDNA=SeqID_47361; Strand=+; Position=1 -71,131-217,265-335,388-425,507-610,658-708
  Homolog annotation: Hit_ID=NP_506005.1; Match level="QueryCoverage =100%, HitCoverage=32%, E-value=1e-49, Identity=57%"; Hit description= proteasome Regulatory Particle, ATPase-like, S7 (48.6 kD) (rpt-1) [Caenorhabditis elegans] emb|CAB01414.
  Essential gene: C elegans homolog=C52E4.4; Phenotype=Emb
EVQRTMLELVNQLDGFDSRGAIKVLMATVLMATNRPDTLDPALVRPGRIDRRIEFSLPDVKARKNILQIHTKRMSIEPDVKARKNILQIHTKRMSIERNIRYELIARLCPNTTGYELIARLCPNTTGADLRSVCTEAGMYALRARRKVITEQDFLKAVQKVVKGYAKFSSVKGYAKFSSTPSYLTHN

SEQ ID NO: 120939 - protein, 159 aa, Heterodera glycines
  misc_feature (41)..(41): Xaa can be any naturally occurring amino acid
  misc_feature (153)..(153): Xaa can be any naturally occurring amino acid
  Coding regions on vcDNA: vcDNA=SeqID_47362; Strand=+; Position=1 -229,297-463,1328-1389
  Homolog annotation: Hit_ID=CAC70157.1; Match level="QueryCoverage =62%, HitCoverage=4%, E-value=1e-26, Identity=56%"; Hit description =polybromodomain protein [Brugia malayi]
  Essential gene: C elegans homolog=C26C6.1; Phenotype=Lva,Lvl,Unc
FFLKNFYVSKFFLKNFSGGGGTSCSQLFPLKNCLQLNATVXPGQIYVYCCRWHQCDFQFDCQEGLTEHIWTSHTNQIVDGSENPVDGSENPFVCLWASCLKFRRETKPFPALQRLKRHLRERHLNTAGRVICPKQRTKLYIIPIVCKNANDSXKYGKIV

SEQ ID NO: 120940 - protein, 429 aa, Heterodera glycines
  Coding regions on vcDNA: vcDNA=SeqID_47363; Strand=+; Position=1 -1189,1780-1880
  Homolog annotation: Hit_ID=NP_508269.1; Match level="QueryCoverage =87%, HitCoverage=57%, E-value=1e-33, Identity=25%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTCPQKISDSSPLAINSGLNIFSVPPTNVSAVRSFFRQVLPLATITQESPYLFRLYSDNLWTDLSRVYLYLEVSIEKPGANDKWVAIEDGDTHVSAIQGIGQTFVQQLKVTVGNTEVYDSGNLYPFKAYITNELSFPINVKKNFLGSTGYYHTVNQDDSSDDGYKERCKIFKGGKNAQFLSRLDFDLGNQELYLLNNLDLLFTIYKAKDVFLLQTLKANDSTKYRLTVHDVKIYAKMVEVQPSLNMSLYKTLEKQPATYAVRKTEIKSSFISVGRYEFEYNVFSATIPRRVTIALVGNSAFHGDYKLSPFMFEPFDLREISVHAGGVVYPAVPYKLNFSNDHFVSAFVDMYEALGMANSERSFDISMTQFKKGWTFFVIPLTSTLDDSCGFELLRNDSFLFGHRRIEAALLQRAEREAEILRQYAENQQ

SEQ ID NO: 120941 - protein, 42 aa, Heterodera glycines
  Coding regions on vcDNA: vcDNA=SeqID_47364; Strand=-; Position=1-179
  Homolog annotation: Hit_ID=NP_728290.1; Match level="QueryCoverage =97%, HitCoverage=21%, E-value=9e-17, Identity=97%"; Hit description =CG12530-PB, isoform B [Drosophila melanogaster] ref|NP_523414.1| CG12530-PA, isoform A [Drosophila melano
  Essential gene: C elegans homolog=R07G3.1; Phenotype=Emb
MMQTIKCVVVGDGAVGKTCLLISYTTNKFPNEYVPTVFDNYA

SEQ ID NO: 120942 - protein, 144 aa, Heterodera glycines
  Coding regions on vcDNA: vcDNA=SeqID_47365; Strand=-; Position=1 -199,834-1036,1130-1162
  Homolog annotation: Hit_ID=CAE67815.1; Match level="QueryCoverage =58%, HitCoverage=16%, E-value=3e-10, Identity=42%"; Hit description =Hypothetical protein CBG13395 [Caenorhabditis briggsae]
  Essential gene: C elegans homolog=M176.2; Phenotype=Emb,Lva
MASINNGHAAVGAANGIQQKKLLQQAQGTNMAQLPLKANDYALAAVRNDAELKLLAEYAVDYAHSIGLVGRSGDDKYKHSNDVSVAPPIALLPSPFPRELYEQATDAQQSLNELYFRIACDHDFLMEAYKDVIKYVWWRILKNV

SEQ ID NO: 120943 - protein, 467 aa, Heterodera glycines
  Coding regions on vcDNA: vcDNA=SeqID_47366; Strand=-; Position=1 -213,280-447,530-622,855-979,1033-1110,1165-1257,1305-1396,1489 -1528,1613-1804,1885-2007,2058-2245
  Homolog annotation: Hit_ID=CAE68778.1; Match level="QueryCoverage =38%, HitCoverage=37%, E-value=5e-52, Identity=58%"; Hit description =Hypothetical protein CBG14721 [Caenorhabditis briggsae]
  Essential gene: C elegans homolog=T22B7.1a; Phenotype=Pvl,Stp
ASPSFDLLAALCAAGAHPSNQQQAALARQMAATAVMLGFPQPQATAAAMIHQAAAEFPPVQQFFSANASQSPFPRQFHPMHLNCSTDASPHLSAESAQLQHQQHQIHNHQRTPTTPKGRKRRQSSTRTERNHRQTPQNLMQSSADSPLNLSRFKVENDTQNSCSSSGKNSPNNFHNNSANSEKSNGDKSEAKNANNGKKSNGGNQQQRAGAKSPNHIKRPMNAFMVWARDERRKILKECPDMHNSNISKILGSRWKAMSNCEKQPYYEEQSRLSKQHMEQHPDYRYRPRPKRTCIVDGKKVRITEYKNMLKGGPNNGTTVAKDAPQKRQSLSTSSTPAEATSAGGGTSDAAPLSPTAVSEESNESPVTAGAIPAMLFSAAPANGSSPPAKSLMDHPFAGQFAQNPALAAAAWLSAAAVSGGAQRGGAGGVSALHQAMLLADQLQHNHHHHSAMPLDFGTAAGVVANA

SEQ ID NO: 120944 - protein, 205 aa, Heterodera glycines
  Coding regions on vcDNA: vcDNA=SeqID_47367; Strand=-; Position=1 -140,630-853,915-1081,1159-1245
  Homolog annotation: Hit_ID=CAE72664.1; Match level="QueryCoverage =73%, HitCoverage=28%, E-value=8e-15, Identity=32%"; Hit description =Hypothetical protein CBG19878 [Caenorhabditis briggsae]
  Essential gene: C elegans homolog=C55C3.5; Phenotype=Emb
MLSSTEANNVDDEDNDGITQLGAIGSWPVTNEWSTPPATELPELPNGHNRIAAEVENPTIGESGQKKTAIDLTLSLAVQLIPQVRDGIFHTQLNLKERKIDMKNKTAFPKQMKPVVEELLQDMIKDDVWPAVKRGIEPLIYVKGVELPANCGVDPKSAQLHFGHRKIGASAKLNIKEISLSHCVEQFKSKLPDPATLFKINGTSF

SEQ ID NO: 120945 - protein, 296 aa, Heterodera glycines
  Coding regions on vcDNA: vcDNA=SeqID_47368; Strand=-; Position=1 -91,144-283,382-628,864-1000,1068-1123,1188-1405
  Homolog annotation: Hit_ID=CAE60390.1; Match level="QueryCoverage =100%, HitCoverage=92%, E-value=2e-81, Identity=51%"; Hit description= Hypothetical protein CBG03991 [Caenorhabditis briggsae]
  Essential gene: C elegans homolog=Y74C10AR.1; Phenotype=Ste
MRPLALKGHERAITRVRLNREGDILFSASKVFIHCLRYTENGERIGTYEGHSGVVWDIDVSWDTQTMVSASGDQKVMVWDIETGVSKGFSEPGSVVRSIGLSYSGNLVVFTLNKPTTGGLPGIVVADLRDKMTQPILRDTFDDQCNACLFSHLDDHIVAGDHTGQLAMWDLRQPGAASNFTHPHKYQINDLQITADQTFIITASKDKTAQLHSAHDLQHLKTYKSNRPVNTASVSPSRDHIVLGGGEEHMEVTQTATTAEQFVARLYHLIFEEEFARFRGHFGPINSIIFDPTGDI

SEQ ID NO: 120946 - protein, 255 aa, Heterodera glycines
  misc_feature (237)..(237): Xaa can be any naturally occurring amino acid
  Coding regions on vcDNA: vcDNA=SeqID_47369; Strand=-; Position=1 -156,592-718,771-877,925-1025,1069-1180,1288-1338
  Homolog annotation: Hit_ID=CAE62536.1; Match level="QueryCoverage =93%, HitCoverage=27%, E-value=4e-67, Identity=56%"; Hit description =Hypothetical protein CBG06645 [Caenorhabditis briggsae]
  Essential gene: C elegans homolog=Y45G12B.1a; Phenotype=Lva
ANEIAGVPDLGSTGRGSDMQIGTYVEKLFASELSGNVIDLCPVGALTSKQYSFVARPWETRKTESVDVMDALGSNIVIAHRTGEILRIIPRMNDEVNEEWLSDKARFICDEVNEEWLSDKARFICDGLKRQRLLQPMLKNESEVLSPCNWPCNWEEALFTAAQKLRQITPNAIAGLAGGLVDAESLIALKDLLNQINSENSLIALKDLLNQINSENVFSEGELPILSGGTDLRLSFXFLRFLRGDHFYPEDLFLL

SEQ ID NO: 120947 - protein, 326 aa, Heterodera glycines
  Coding regions on vcDNA: vcDNA=SeqID_47370; Strand=-; Position=1 -198,244-361,742-756,803-880,925-961,1199-1238,1281-1451,1591 -1761,1813-1866,1908-2003
  Homolog annotation: Hit_ID=CAE67637.1; Match level="QueryCoverage =100%, HitCoverage=72%, E-value=1e-107, Identity=52%"; Hit description=Hypothetical protein CBG13195 [Caenorhabditis briggsae]
  Essential gene: C elegans homolog=Y47D3B.10; Phenotype=Dpy
MASKYRQSNEKLQTNIQSVSNPINAFRLIKRLSNAWKELQNEMRADVADEYLQNVTTDGHALFPTDEDLSGAAIGLLRLQDTYRLDTRDLANGFVQDIKIGNEMTESDVLEYLAFAMFKQGNLKRALVTTDRLAEIAPTHPRAKGNIKWNIYEALCRDEVPVSVKQTSKLYCYYKRDRPFLLLAPFKVEIVRFNPLAVLFRNVVTDEEIERIQELAKPKLARATVQNSQTGKLETASYRISKSAWLKGTEDEVVDRINKRLNLMTNLEMETAEELQVANYGIGGHYDPHYDFARKEETKAFSDLGTGNRIATALFYFSQPEKGGFT

SEQ ID NO: 120948 - protein, 518 aa, Heterodera glycines
  Coding regions on vcDNA: vcDNA=SeqID_47371; Strand=+; Position=1 -53,112-150,202-353,404-546,599-966,1162-1246,1295-1498,1592 -1867,2029-2109
  Homolog annotation: Hit_ID=AAP51177.1; Match level="QueryCoverage =99%, HitCoverage=99%, E-value=0.0, Identity=74%"; Hit description =fumarase [Ascaris suum]
  Essential gene: C elegans homolog=H14A12.2a; Phenotype=Emb,Gro
KMNSDNFRVERDTFGELRVPSDRYYVPSDRYYGAQTARSMQFFKIGGPEERMPLPSMQFFKIGGPEERMPLPVIHAFGYLKKAAATVNQDFGLNSKVAAAICEAADDVISGKLDEDVISGKLDEHFPLVIWQTGSGTQSNMNVNEVISNRAIEILGGELGSKTPVHPTPVHPNDHVNMSQSSNDTFPTAMHVAVAVEINTRLLPSLRLLHDELSKKSKEFEHIIKIGRTHTQDAVPLTLGQEFSAYVTQIGNGISRVDATLGRLYELAAGGTAVGTGLNTRKGFAEKVASKLAELTRLPFKTAPNKFEALAAHDALVEVHGALNVVATSLMVHGALNVVATSLMKIANDIRFLGSGPRCGLGELSLPENEPGSSIMPGKVNPTQCEALTMVAAQVFGNQVAVTVGASNGHFELNVFKPLIVRNVLQSVRLLADGAESFTKHCVIGIIANEENIKKLLNDSLMLVTALNPHIGYDNAAKIAKTAHKNGTTLKEEAVKSGLLTAEQFDQWVRPEQMISPK

SEQ ID NO: 120949 - protein, 114 aa, Heterodera glycines
  Coding regions on vcDNA: vcDNA=SeqID_47372; Strand=+; Position=1 -186,247-362,465-493
  Homolog annotation: Hit_ID=NP_505803.1; Match level="QueryCoverage =98%, HitCoverage=40%, E-value=3e-38, Identity=66%"; Hit description =putative protein, with 2 coiled coil domains, of eukaryotic origin (31.3 kD) (5L480) [Caenorhabditis eleg
  Essential gene: C elegans homolog=F53B7.3; Phenotype=Emb
KARNAEKAMTALARWRRMKEQEEKGPIAKRPNDVRECKKLGDAERFRRELIHDISKRITRIHNPRLNPRLGEFKIKDLNDQINRLLRIKLAWEGRIKELGGVYHRRIAPRELDG

SEQ ID NO: 120950 - protein, 772 aa, Heterodera glycines
  misc_feature (459)..(459): Xaa can be any naturally occurring amino acid
  Coding regions on vcDNA: vcDNA=SeqID_47373; Strand=+; Position=1 -275,339-471,521-751,828-979,1111-1237,1307-1417,1491-1761,2011 -2214,2573-2688,2744-2869,2914-2983,3164-3298,3355-3429
  Homolog annotation: Hit_ID=CAE69834.1; Match level="QueryCoverage =100%, HitCoverage=72%, E-value=0.0, Identity=61%"; Hit description =Hypothetical protein CBG16158 [Caenorhabditis briggsae]
  Essential gene: C elegans homolog=T20B5.1; Phenotype=Gro,Unc
PWPCVKLLHLLQYPPPEDPGNRARLLECLEGILNKAQDAPKSKKVQHANAKNAVLFEAIALIIHYDSEPGLLVRACNQLGTFLSHRETNLRYLALESMCLLATSEYLALESMCLLATSEFSHDAVKKHQETIINSLKNEKDVSVRQRAIDLLYAMCDRSNAENDLLYAMCDRSNAENIVAEMLTYLETADYAIREEMVLKVAILAEKYASDYTWYVDVILKLIRMAGDYVSDEVWYRVIQIVVNREDVQGYAIVVNREDVQGYAAKTVFEALQQPTCHENMVKVGGYVLGEFGNLIAGDPRSSPMVQFDILHSKYHLCSITTRCILLTTYVKLCNLFPEIKPHIQIVLRADHNLKNPIVLRADHNLKNPDAELQQRAVEYLQLSKVTSPDVLATILEEMPQFAEKILEEMPQFAEKESSLLAKLKKSKPQAEETDTQQIEKKQRPSAVMSPQKPSAVRXDIAVVTVFMLRLFFLKESSPATSTATKLVDLSGKIPIIRFVMKSNGVLYEDETIQIGCKMEKRANLARLGIFYGNKTNFKFSNFQTTVTCPGMLADEILCQAKAVDPDIDAGSQVQQLINVICLQFFTAPPIFNVSFTFSARDGSPQQFSRSFARDGSPQQFSRSFYLPVFISKFFEPSDMSSEQFFARWKQLSLPSQECQKIFATINPIDPSQECQKIFATINPIDSDQIRISLANLGAQILQNVDPNPENFVCAGILQTQAAQIGCLIRLEPNKQTKMFRLTIRSSMFRLTIRSSREGVAATLCELMGGNF

SEQ ID NO: 120951 - protein, 232 aa, Heterodera glycines
  Coding regions on vcDNA: vcDNA=SeqID_47374; Strand=+; Position=1 -159,209-526,634-855
  Homolog annotation: Hit_ID=CAE68436.1; Match level="QueryCoverage =98%, HitCoverage=17%, E-value=7e-65, Identity=51%"; Hit description =Hypothetical protein CBG14221 [Caenorhabditis briggsae]
  Essential gene: C elegans homolog=ZK377.2a; Phenotype=Unc
MPDAAALPSSPGQPKVLNVTENSIELEWASPERHGSSPITDYLLQYWSPELGESWRNILDVVAKSRFRITGLQPEHSYVFVIRAENSKGIGLPSSMSEIVSTKKSTEIEEGNYRSQRMNRLLDLETARQRLSSEQLVKLLEVRALNATTVLLAWKRQRNEPLVQGYYIKWRGPPLAQDHSWVNVTNPETDHVVINGLRPFNNYEFFVIPYHQTVQGMPSNSLDGTTAESRIL

SEQ ID NO: 120952 - protein, 94 aa, Heterodera glycines
  Coding regions on vcDNA: vcDNA=SeqID_47375; Strand=+; Position=1 -12,622-894
  Homolog annotation: Hit_ID=NP_500443.1; Match level="QueryCoverage =95%, HitCoverage=12%, E-value=8e-11, Identity=40%"; Hit description =predicted CDS, RNA-directed DNA polymerase  and c-type lectin family member (4E715) [Caenorhabditis elega
  Essential gene: C elegans homolog=ZK250.3; Phenotype=Clr,Lvl,Sck
MFKNVKIGEELSESFRIFSGVPQGSVLGPLLFLIFINDLPSFIANEASSVGIKMYADDAILYYTHENDDHSNQLDKAIEAMEKWSKINELSYFN

SEQ ID NO: 120953 - protein, 469 aa, Heterodera glycines
  Coding regions on vcDNA: vcDNA=SeqID_47376; Strand=+; Position=1-1410
  Homolog annotation: Hit_ID=CAE69591.1; Match level="QueryCoverage =93%, HitCoverage=34%, E-value=1e-157, Identity=60%"; Hit description= Hypothetical protein CBG15813 [Caenorhabditis briggsae]
  Essential gene: C elegans homolog=ZK1151.1b; Phenotype=Bmd,Lva,Lvl,Unc
MGLDAEPEQVLEGHLRDAYNAKAFVEESEQVEQQMQQQLDHLDREYSRTDFSLDDGEQMLRQLDSVREYIQQLHARLISLTDRCAQISPLWQRGERISKPLPVMALCEYKSKDKIHIRQGDECTLLDNHDQIQWRVRGMDGVEASVPSVVFRIPPPDPRLASFLSRLHNQFEKLRKLWDRTHHLVRYNMVLNTMRTVRAWDLDTFLSIPSDQRDEIIKALNEDVNKLLSEMDPNDPLAKRLKDELRMTNEHFYDLLARAQKEPEPDYSNQFDAACAELVRKFEEGWKQLNHRVQERVATNLEELERQIKEHKAFEDALQTLDVDVSNVKELYRQLPHPTPTQRAAHDNMVQRWQDIWELSRMYVERLKGLESVLNGLDEVTDIVRRHEITLASFDDMPAALERLRGVHAQLLELNMVLQQQENIVKKLNRDTATLRQHVARTRFGAANHPVLPVKPCRVSGFGLLSSDP

SEQ ID NO: 120954 - protein, 85 aa, Heterodera glycines
  Coding regions on vcDNA: vcDNA=SeqID_47377; Strand=-; Position=1-256
  Homolog annotation: Hit_ID=CAE69591.1; Match level="QueryCoverage =98%, HitCoverage=6%, E-value=2e-19, Identity=53%"; Hit description =Hypothetical protein CBG15813 [Caenorhabditis briggsae]
  Essential gene: C elegans homolog=ZK1151.1b; Phenotype=Bmd,Lva,Lvl,Unc
MLRQLDSVREYIQQLHARLISLTDRCAQISPLWQRGERISKPLPVMALCEYKSKDKIHIRQGDECTLLDNHDQIQWRVRGMDGVE

SEQ ID NO: 120955 - protein, 122 aa, Heterodera glycines
  Coding regions on vcDNA: vcDNA=SeqID_47378; Strand=+; Position=1 -75,128-232,443-532,589-684
  Homolog annotation: Hit_ID=NP_491890.2; Match level="QueryCoverage =99%, HitCoverage=27%, E-value=4e-38, Identity=49%"; Hit description =trehalase (66.9 kD) (tre-1) [Caenorhabditis elegans] gb|AAB96724.2| Trehalase protein 1 [Caenorhabditis e
  Essential gene: C elegans homolog=F57B10.7; Phenotype=Emb
MKLAIKRLHWNETDGIWYDYDLEREAHSNTYYVSNALPLYSKCYDDEDDVTPYKVFEYLKVVEAFRTSGDLSLMKAAEQMATQWLVVNYKGYVSTYAMFEKYNVSMINEEGVGGSGGEYEVQ

SEQ ID NO: 120956 - protein, 297 aa, Heterodera glycines
  misc_feature (174)..(174): Xaa can be any naturally occurring amino acid
  Coding regions on vcDNA: vcDNA=SeqID_47379; Strand=+; Position=1 -72,390-478,595-791,1565-1746,1859-1964,2143-2242,2300-2428
  Homolog annotation: Hit_ID=NP_502432.1; Match level="QueryCoverage =97%, HitCoverage=33%, E-value=2e-57, Identity=42%"; Hit description =RNA Binding Domain protein (98.0 kD) (rbd-1) [Caenorhabditis elegans] emb|CAB05631.1| Hypothetical protei
  Essential gene: C elegans homolog=T23F6.4; Phenotype=Lva
NAIKALDGAYIGGSKLTVLFCWTPEVDEEEDKEEGAEEADVDSIEKQILDTGRLFLRNLPFVCSEEQIRQLFEPFGPLAELECVVDAGKCKGYALCTFIFPEHAVAAWKALDGTVFMGRMLHIIAGEEKRVRTNGADDDSTNDGCQSAFQRERNEKRKANDAEGATEAATNNRXAKKACTWNALFLGTDAVAETLAENYEVEKRDLLLVDGKQSAAVRVAMAEARLVRETRKFLLDNGVRLDAFAQPKMRRSKTKMRRSKTTILVKNLDATREGKKEWLHSLFGRFGVVKTVLVPPE

SEQ ID NO: 120957 - protein, 384 aa, Heterodera glycines
  Coding regions on vcDNA: vcDNA=SeqID_47380; Strand=+; Position=1 -212,257-410,466-585,681-751,806-952,1054-1174,1220-1402,1475-1618
  Homolog annotation: Hit_ID=AAA68780.1; Match level="QueryCoverage =99%, HitCoverage=23%, E-value=2e-53, Identity=34%"; Hit description =Hypothetical protein C56C10.12 [Caenorhabditis elegans] ref|NP _495343.1| putative protein of bilaterial or
  Essential gene: C elegans homolog=C56C10.12; Phenotype=Clr,Slu,Unc
MAVLIERNPPLLGAVLRYIDRHVDHLDEYAVNILSTVPLGFCTVSAEDISDRLGKWLISRSIDHPASAIARRVLSSLNWDCQSPQPASLHKSSVTSVGSQPQSNRLCLSVEIHDLCAETLVKAHIVQCKQRNNLIAKSVNKAARMALKCPDLEQQFDRFCWDPNCPTPPNDLTAFYVFCVQKCLSSSNLFFEAGLPLFQELVNASCFKAAAVLLIRIVHAFPSSNHMQNFIANPTFCEVFERLLHADESAYAVQLLMGADKFPGPVLSLVSGGIIHQISIDAFHFEQRKVYAQAWVRLLTCDKRTHEWNSDKFVLYLLGCVAKCCHLFDPQDNFGMARHQAWRDTVRGPLSWFSSSSIPPPLIAQAQFTVSPWATFMLLRAEQE

SEQ ID NO: 120958 - protein, 126 aa, Heterodera glycines
  misc_feature (117)..(117): Xaa can be any naturally occurring amino acid
  Coding regions on vcDNA: vcDNA=SeqID_47381; Strand=-; Position=1 -78,148-282,764-885
  Homolog annotation: Hit_ID=NP_509342.1; Match level="QueryCoverage =92%, HitCoverage=44%, E-value=5e-34, Identity=64%"; Hit description =adaptor protein required for cell signalling, in particular during sex myoblast migration; functionally r
  Essential gene: C elegans homolog=C14F5.5; Phenotype=Gro,Lvl,Pvl,Unc
MEAVAEHDFNAGEPDELSFKRGQILKVLNKDEDPHWYKAEIVLNKDEDPHWYKAEINGVEGLIPSNYIRMMEHSWYLGSISRSDSELLLLKNGNPDGAFLVRRSESTPGEFSICVRXRKSGNSADM

SEQ ID NO: 120959 - protein, 1016 aa, Heterodera glycines
  Coding regions on vcDNA: vcDNA=SeqID_47382; Strand=+; Position=1 -27,368-769,834-1853,1910-2869,3070-3306,3915-4319
  Homolog annotation: Hit_ID=NP_491353.1; Match level="QueryCoverage =98%, HitCoverage=77%, E-value=1e-34, Identity=19%"; Hit description =nuclear anchorage protein 1 family member, abnormal nuclear ANChorage ANC-1 (anc-1) [Caenorhabditis elega
  Essential gene: C elegans homolog=ZK973.6; Phenotype=Gro
MLEKCSKTKERIAQNARKEQLRDRAVRLDDSLTALVKQAHDKLNESAAMPQCYEQLCNGLAEQIELAEQFGAENGITVGEERIAQAKEVREQLAQRWHHWDEFVRLRDLGTAQLDKARVAIDQTEQKTCRSVAEAESDHDNLLEAQGSLASLNATIDQLQQLADKLDPLATTHAEVRFLDVEFEQLEKHFGDVLDQMHNEIEQEKALMAETERAGRETDDMTAQLPTMANNLKALQHAQQTAIPALEAKVVMLQQQSEKEKPLRQYVLRSTAAPSPDELAQRLALSKGRAQEAAQQLVDTAVVRVQNVLLGTSQAAAELPSDEQIDECAKELQDNIPLEHPHNEQLRQQLEQLREKVMRRDAIRSHIDQHLATIGKELEGFSEQFISSSTTNGKKVPPSSKKEAKKKKGKGGEPEQQKRAEKMASREEHIDELRKALGRLESGILPALNTLHDEAVQQGIPLQPTEEHQHQLMRANQIVQSLKEDLDKSVAENERASVVINDIRLLKSIVDGTVVEAETAAEEATLQLLDVESVEQHKRDMEEAAKKLGEQLAKMAADAHQVSTSLEPEEQALMKRVEEEAGKKMDRLNSLNSVLQHQMEVLRDWARDKDRLEQHTCSLIDQLKRVQEEREEAGPAPAEEELAKLDALQSEVDEARDEMKRMQSWLVQKLPKCGRAAVELQLRPVEESLVKLNTDMDGTMEQLKKNVQIERRLLEERTALLNAANELDEQVQQAHAFEEPQEQISELDKLHNQLEQVEQQMRTVDQQSEQYPTPQKATTLSEQIAHVVHKTRTNIEDARHQLEERIAQNARKEQLRDRAVRLDDSLTALVKQAHDKLNESAAMPQCYEQLCNGLAEQIELAEQFGAENGITVGEERIAQAKEDLLTELGEIGAQIDQLEQSIWQGNDQQRIFVQSFDKKRLRILRERIEQLEKNIWGAFSELSEGPSTEAAEEQPKYDVDAAVEILSAIYPGREPLEVMREHGLDKLELDMNDDYGDGQTEGEEGEDGQKGEIGEF

SEQ ID NO: 120960 - protein, 86 aa, Heterodera glycines
  Coding regions on vcDNA: vcDNA=SeqID_47383; Strand=+; Position=1-261
  Homolog annotation: Hit_ID=XP_311118.1; Match level="QueryCoverage =86%, HitCoverage=12%, E-value=1e-23, Identity=66%"; Hit description =ENSANGP00000017376 [Anopheles gambiae]
  Essential gene: C elegans homolog=C32D5.5; Phenotype=Emb
RDQMAKNSGNSLVKHSPRKKRAQLWLGPGAYINHDCANCEFVPNKQQTATINVLRDIKAGAEINCFYGDNFFGDGNCNCECLTCER

SEQ ID NO: 120961 - protein, 103 aa, Heterodera glycines
  Coding regions on vcDNA: vcDNA=SeqID_47384; Strand=-; Position=1 -75,128-215,322-432,615-659
  Homolog annotation: Hit_ID=CAE58541.1; Match level="QueryCoverage =51%, HitCoverage=10%, E-value=6e-10, Identity=54%"; Hit description =Hypothetical protein CBG01700 [Caenorhabditis briggsae]
  Essential gene: C elegans homolog=ZK180.3a; Phenotype=Slu,Unc
VLLIFPPLLPWTIRVTGHMLAGQLVIRLVSFLLNFALLRLVDPSLLGFFNVKMTLLYTTICFLSREPIRRLCLSSDFPLHKVPSYASLSPVRCSPWPPFPSAV

SEQ ID NO: 120962 - protein, 259 aa, Heterodera glycines
  Coding regions on vcDNA: vcDNA=SeqID_47385; Strand=+; Position=1 -153,401-423,478-558,852-971,1023-1198,1249-1307,1373-1537
  Homolog annotation: Hit_ID=XP_314540.1; Match level="QueryCoverage =87%, HitCoverage=62%, E-value=3e-83, Identity=62%"; Hit description =ENSANGP00000016313 [Anopheles gambiae]
  Essential gene: C elegans homolog=M01F1.3; Phenotype=Emb
MTLHDFLPQNTKAIDFTDNGQKTETVQRRTADGRLRLPEWLKRDVVAKQSDEARCPNIGECLGGGPGRPSTAAIMLMGDTCTRGCRFCSVKTARRPPPPDPEEPLNTAKAVASWGVDYIVLTSVDRDDLSDGGAAHISATVRRLKEQCPHVLVECLVPDFAGVLPSVEQVAQSGLDVFAHNLETVRRLTPLVRDPRAKYDQSLRANPGVLTKSSLMLGLGEADAEVEEAMRDLRLVGVEALTLGQYMQPTKRHLAVSEW

SEQ ID NO: 120963 - protein, 117 aa, Heterodera glycines
  Coding regions on vcDNA: vcDNA=SeqID_47386; Strand=+; Position=1 -129,182-406
  Homolog annotation: Hit_ID=CAE59649.1; Match level="QueryCoverage =85%, HitCoverage=78%, E-value=8e-26, Identity=59%"; Hit description =Hypothetical protein CBG03063 [Caenorhabditis briggsae]
  Essential gene: C elegans homolog=C06A1.5; Phenotype=Emb,Ste
MADDEDYDGGEMDGDEFMEEEPIEDLDAEHQAGEEEEGAENVQVSDKVASSNRVTTPFMTKYERARVLGTRALQIAMGAPVMVEIEGESDPLEIARKELKVNKYSNFNNSEVPVNLT

SEQ ID NO: 120964 - protein, 292 aa, Heterodera glycines
  Coding regions on vcDNA: vcDNA=SeqID_47387; Strand=+; Position=1 -126,195-268,469-657,701-844,889-1027,1078-1284
  Homolog annotation: Hit_ID=NP_500161.1; Match level="QueryCoverage =99%, HitCoverage=27%, E-value=1e-113, Identity=66%"; Hit description= membrane Calcium ATPase (126.9 kD) (mca-2) [Caenorhabditis elegans] gb|AAD12806.2| Hypothetical protein
  Essential gene: C elegans homolog=R05C11.3; Phenotype=Gro,Unc
MASDGLRTFVRFVDSSYCKHLLLFSIALAYKDYVVEKGEANEIPLEGADVNWDDEQILREGMTAICVPGEDFLALEGKEFNARIRDSDGVVDQRKLDQIWPKLRVLARAQPTDKFVLVKGIIESKCTKNREVVAVTGDGTNDAPALKKADVGFAMGIAGTDVAKEASDIILTDDNFTSIVKAVMWGRNVYDSIAKFLQFQLTVNVVAVTIAFVGACATKDSPLRAVQMLWVNLIMDTLASLALATEMPTEDLLKRKPYGRTKSLISRTMVKNIIGHGIYQLAVLFGLLFFGH

SEQ ID NO: 120965 - protein, 290 aa, Heterodera glycines
  Coding regions on vcDNA: vcDNA=SeqID_47388; Strand=-; Position=1 -345,398-580,639-832,893-1042
  Homolog annotation: Hit_ID=NP_495799.1; Match level="QueryCoverage =99%, HitCoverage=56%, E-value=4e-69, Identity=46%"; Hit description =splicing factor SF3a60 (57.5 kD) (2I814) [Caenorhabditis elegans] emb|CAA91420.2| Hypothetical protein T1
  Essential gene: C elegans homolog=T13H5.4; Phenotype=Emb
MSKLCVKRNQLATEKLINAYKDEHGERSKEVQSIGGPNEFAEFYSRLKTLKDVHRKNPNDTARTLTIEFQEMANFIQDPDRLEKEMVRFTDEEGYGKFLDLHSLHEQYVNLKEVTRVDYISYLSKFDHLHELSREKTKKTGAYKTYVLSLEEYLRDFISRAKPLIDIVMELDRVDKDFEEKLKEGKVIGWSNEKPSGAMKKFAQPSAEIDVSNFNSPEELEELGADRLKAALIALGLKCGGTVKERAFRLFSTRSSDGSNAVNGNGKLTAEDTKEENRKYTLAKAEAHIL

SEQ ID NO: 120966 - protein, 80 aa, Heterodera glycines
  Coding regions on vcDNA: vcDNA=SeqID_47389; Strand=+; Position=1 -144,177-275
  Homolog annotation: Hit_ID=NP_504688.1; Match level="QueryCoverage =85%, HitCoverage=52%, E-value=8e-18, Identity=77%"; Hit description =SyNaptoBrevin related, synaptic vesicle-associated membrane protein (12.0 kD) (snb-1) [Caenorhabditis ele
  Essential gene: C elegans homolog=T10H9.4; Phenotype=Rup,Unc
MDSPAGAQPSNPNAQQQGGARPSNKRLQQTQAQVDEVVGIMKVVTVFRVNVEKVLERDQKLSQLDDRADALQVVVNSLTR

SEQ ID NO: 120967 - protein, 212 aa, Heterodera glycines
  Coding regions on vcDNA: vcDNA=SeqID_47390; Strand=+; Position=1 -147,210-431,559-825
  Homolog annotation: Hit_ID=AAO14563.2; Match level="QueryCoverage =55%, HitCoverage=16%, E-value=7e-50, Identity=85%"; Hit description =Hsp90 [Heterodera glycines]
  Essential gene: C elegans homolog=C47E8.5; Phenotype=Emb,Ste
AHDIENDPSKADKTWTIIDTGIDMTKADLVNNLGTIAKSGTKAFMEALQTGIVALMPGHFGAGFYSAFSVADRVTSKHNDDDCYQWESSAGGSFIIRNCADPEVTRGTKIVLYLKEDQTAYLQFRCWCWCCACSSVNAVWGERAAKQAVKGAAAGDQTMTAGGQAAERDRNGEEDVAAVAVVEKAMAAVVDEGGGGRGGRAPQHPQEADEEE

SEQ ID NO: 120968 - protein, 164 aa, Heterodera glycines
  Coding regions on vcDNA: vcDNA=SeqID_47391; Strand=-; Position=1-492
  Homolog annotation: Hit_ID=AAC95573.1; Match level="QueryCoverage =100%, HitCoverage=49%, E-value=2e-46, Identity=43%"; Hit description= orf 48 [Ateline herpesvirus 3] pir||T42963 hypothetical protein 48 - ateline herpesvirus 3 (strain 73) re
  Essential gene: C elegans homolog=T05A10.3; Phenotype=Ste
MKEEDKREEEEDKREEEEDKRDEEEDKREEEEDKREEEEDKRDEEEDKREEEEDKREEEEDKREEEEDKREEEEDKREEEEDKRDEEEDKREEEEDKREEEEDIREEEEDKREEEEDKREEEEDKREEEEDKRDEEEDKREEEEDKREEEEDKREEEEDKREEE

SEQ ID NO: 120969 - protein, 183 aa, Heterodera glycines
  Coding regions on vcDNA: vcDNA=SeqID_47392; Strand=-; Position=1 -288,1137-1262,1366-1503
  Homolog annotation: Hit_ID=AAH23301.1; Match level="QueryCoverage =92%, HitCoverage=40%, E-value=5e-38, Identity=40%"; Hit description =AAA-ATPase TOB3 [Mus musculus] gb|AAH58373.1| AAA-ATPase TOB3 [Mus musculus] gb|AAH60036.1| AAA-ATPase TOB
  Essential gene: C elegans homolog=F54B3.3; Phenotype=Emb,Lva
MLLISFVKICKKPQIFAATIEHELSLRHKYDLERIDADVRAKARAARDNRDVNLEMMRASEEERRKTVTEQIRTTAGVVGAGLSEFLSDRSKIMAAPSLESRLRDIAITTRNTKRNFGLFRNVLFYGPPGTGKTMFAKSLARHSGLDYAIMTGGDVAPMGRDGVSAIHKIFDWAQTSRKGWAI

SEQ ID NO: 120970 - protein, 128 aa, Heterodera glycines
  Coding regions on vcDNA: vcDNA=SeqID_47393; Strand=-; Position=1 -63,826-944,1129-1223,1676-1784
  Homolog annotation: Hit_ID=AAK60209.1; Match level="QueryCoverage =100%, HitCoverage=59%, E-value=6e-56, Identity=77%"; Hit description= vap-1 [Heterodera glycines]
  Essential gene: C elegans homolog=F49E11.9; Phenotype=Unclassified
SQRNGMGENLYMTSSSSISEADALKQACDTWWAELKQYGIQESLELDREQFNKGIGHWSQQAWATTAQIGCAMARCPSADWKTWVVCNYNTTGNRLDEVVYKKGTACASCSDYNGASCNSTSVLCILP

SEQ ID NO: 120971 - protein, 109 aa, Heterodera glycines
  Coding regions on vcDNA: vcDNA=SeqID_47394; Strand=-; Position=1 -58,192-315,356-457,549-595
  Homolog annotation: Hit_ID=CAE74733.1; Match level="QueryCoverage =80%, HitCoverage=37%, E-value=3e-34, Identity=67%"; Hit description =Hypothetical protein CBG22551 [Caenorhabditis briggsae]
  Essential gene: C elegans homolog=C44B12.2; Phenotype=Gro,Sma
LWLQQSNVRLAVPPLSPAFCENPSNAKIHLEYLGQCKQLDECTDELMSQFPGRMADWLFQVMKELKKRRELHNLEWEQLINEAEQDDEKRHVYPPHDKHVSHHGIDPDH

SEQ ID NO: 120972 - protein, 567 aa, Heterodera glycines
  Coding regions on vcDNA: vcDNA=SeqID_47395; Strand=-; Position=1 -16,78-217,273-468,518-801,858-1289,1442-1873,1919-2122
  Homolog annotation: Hit_ID=AAH44314.1; Match level="QueryCoverage =99%, HitCoverage=93%, E-value=3e-69, Identity=25%"; Hit description =Hdlbp-prov protein [Xenopus laevis]
  Essential gene: C elegans homolog=C08H9.2; Phenotype=Gro,Pvl,Slu,Unc
MNNEKVEDLMRRTGAKVNIPPPHANNETIIITGERDGVDEAAVEILKIFNEKKESVVSVEVTVPKAQHRYVIGQKRAGLEEIFRETEVLVELPPEDSDSETVILRGPKDKIGDAAGAVYQKASSNIAIELPYKEWMRRLLIGAKGQNLHNLVPNHDQLKIDFEDSVIYIEGPTDLVKQAQQQLSAEIARLESEPRFEAMRNAPDDTRPGEEREPQSKIQFNVDPKHHRHFIIRGAEVLKNIQKDFECQISFPKQETGDSLVTIRGRKELVEGAKARIEAIVEDMEAQAQIQIDVDPKHHRHFIIRGAEVLKQIQKESECQISFPKQETGDSLVTIRGRKEFVEGAKARIEAIVEDLEAQTQIQIDVDPKHHRHFIIRGAEVLKNIQKEFDCQISFPKQETGDSLVTIRGRKELVEGAKARIEAIVEDMEAQAQIQITVDPKYHRHFIMRGAEVLKQIQKEFKCQISFPKQETGDSLVTVRGRVDNVERAKSRIEEIIEELFDLYDESQYIVRRDDPPPPKAEPNDIEMVNAPWQIDSIEQFPGLSGDTVAAQQQKPVTATAVWGQRR

SEQ ID NO: 120973 - protein, 362 aa, Heterodera glycines
  Coding regions on vcDNA: vcDNA=SeqID_47396; Strand=+; Position=1 -231,829-1048,1108-1253,1333-1824
  Homolog annotation: Hit_ID=CAE66826.1; Match level="QueryCoverage =94%, HitCoverage=10%, E-value=7e-75, Identity=52%"; Hit description =Hypothetical protein CBG12193 [Caenorhabditis briggsae]
  Essential gene: C elegans homolog=T21E12.4; Phenotype=Emb
MDILSIALGSAEGFEQADKALHSTSRSGRWILLKNVHLATEWLTQLEKKFRLHNPHPHFRLILTAEIGSALPISMIQVLLDTLLDKLFTSNSFDADFILIENIGVNALNMPDETNSKDGLINWVINIKALQKPNWIGLPNNAEKVLIAERGQEFIRKMIKMSDDELAYEADDLERNKQAPTWMVQFSGQCKSWLDALPQQLQRLRRTKENVRDPLFRFFEREINLGARLLSDIRRDLNELLSICHGDQKQNNHSRELIAALVKRKRVPDNWLQFSVPKDVTALEWMRDFVQRMEQLKRLSLSENLRYEEVWLGGMFFPEAYITATRQLVAQTNGWSLEQMYMHITKTEEGQLKSTAFTLTGG

SEQ ID NO: 120974 - protein, 146 aa, Heterodera glycines
  Coding regions on vcDNA: vcDNA=SeqID_47397; Strand=-; Position=1 -164,214-351,1615-1685
  Homolog annotation: Hit_ID=CAE62009.1; Match level="QueryCoverage =97%, HitCoverage=46%, E-value=2e-20, Identity=37%"; Hit description =Hypothetical protein CBG06017 [Caenorhabditis briggsae]
  Essential gene: C elegans homolog=F01G4.2; Phenotype=Pvl,Stp,Unc
SSDDQVKKAMDATTEKFGGLNVLVNCAGIAFAQRLYNPSSRAQMDLDKIRRLIDVNIFGTINVIRHALPLLIDNVPDVNIFGTINVIRHALPLLIDNVPDENDQRGVIINTSSIAAFEGQMGQPSFAQSLASIQVLLRLLARKIGA

SEQ ID NO: 120975 - protein, 359 aa, Heterodera glycines
  Coding regions on vcDNA: vcDNA=SeqID_47398; Strand=+; Position=1 -291,321-1109
  Homolog annotation: Hit_ID=NP_508269.1; Match level="QueryCoverage =95%, HitCoverage=53%, E-value=8e-47, Identity=30%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MSIKKFDSATNKYIILKNNEQVATINMIGSTWIKNLKIIVQGREIYDSNSLYAYKAYFDAELSYSKDVKHSHLQASGYYKDSDNQDGTDNKAPKDLITVQFIAKLDADVFNQDRYMVNGIEIDIQITPNDNDFMIMAASDDKYKVEITSCKLYVKSLEIVDGLALDLQKKLESKEAKYAHRKTLIKSVFISENRTEFNGTLFTGQLPKRVILGMVENSAYVGSQKKSPFNFKPFNLRSVSLIANGKQWPAAPFELNFDKNLYTRAFHEMNESLGMNSTTDSNGITLEKYRSGWTIFVFNMTNSMEENECIDLITEGTTTVSVQFRKPVQSGGITLIAMSEMDSILILDKNRTVMTDTSV

SEQ ID NO: 120976 - protein, 660 aa, Heterodera glycines
  Coding regions on vcDNA: vcDNA=SeqID_47399; Strand=-; Position=1 -302,349-571,616-803,860-1063,1148-1365,1416-1690,1744-1959,2004 -2192,2249-2414
  Homolog annotation: Hit_ID=CAE63310.1; Match level="QueryCoverage =92%, HitCoverage=30%, E-value=1e-175, Identity=49%"; Hit description= Hypothetical protein CBG07699 [Caenorhabditis briggsae]
  Essential gene: C elegans homolog=W09B6.1a; Phenotype=Emb
TVQIPTIEWSGSGLVAPEQNADNSTAELEIPKDLYLKACVTSVKEGLQSMDDKNITYPVMIKASEGGGGKGIRKCLSDEDFRLNFRRVQAEVPGSPIFIMKCMVNARHIEVQLIADQYGQVIPIFTRDCSIQRRCQKIIEEAPAGIVPQEIQRQMQMDAVNLAKKVGYVSAGTVEYMYLPSEQKYYFLELNPRLQVEHPCTEMVANINIPAVQLQIAMGIPLHRITEIRLFFGMDRYGTSPLPEEQCRTDTNISVIAARITSEDPAEGFRPASGAVEVLNFQSNQNVWGYFSVSSTGKVHEFADSQYEAISALLCALKELELRATFTSQVNYLVGLLHDKEFECNNFHTGWLDARIASRVQASVEYPPHISVAIGATLIGHARITEVFSKFQSALEKGQILPKSGLVETWEFELVHNNTKYSVMVNRFGPINFLVRLNESIVCTVVRELGNGTLLVTHEDQAYTCHLEEESERFKVIIGKTLTIFEKENDPSMLRSKNAGRFLQYLKKDGQYVTIGEVFGEMESMKMVINLEIRKAGGRLVQVAQPGQVLFPGTLIARLEDQEDIAVSKPVNFTGPMEEWDSTREKELQSRNQIRMNTRFEDLIQACNNILSGYAMPEPYFRDQTARLIDDLFVVMDNPRLPYVLFKVMLNAVENRINRN

SEQ ID NO: 120977 - protein, 93 aa, Heterodera glycines
  Coding regions on vcDNA: vcDNA=SeqID_47400; Strand=-; Position=1 -136,194-337
  Homolog annotation: Hit_ID=NP_493356.1; Match level="QueryCoverage =100%, HitCoverage=26%, E-value=3e-24, Identity=50%"; Hit description= cytochrome oxidase protein (1N981) [Caenorhabditis elegans] emb|CAB02698.1| Hypothetical protein C01A2.3
  Essential gene: C elegans homolog=C01A2.3; Phenotype=Gro
MLSNGQSVLDELGLWTWWKPSSWMRWVMEYAHLTLDIPWWGTIIATTVTLRLLCFPIPVNMRRMMALHQKYAPELKEFTDKMQKASREGNNAL

SEQ ID NO: 120978 - protein, 354 aa, Heterodera glycines
  Coding regions on vcDNA: vcDNA=SeqID_47401; Strand=-; Position=1 -33,200-451,626-846,892-1138,1307-1464,1518-1671
  Homolog annotation: Hit_ID=NP_506579.1; Match level="QueryCoverage =95%, HitCoverage=71%, E-value=2e-96, Identity=55%"; Hit description =dihydrolipoamide S-acetyltransferase (53.5 kD) (5O926) [Caenorhabditis elegans] emb|CAB01163.1| Hypotheti
  Essential gene: C elegans homolog=F23B12.5; Phenotype=Emb,Gro
MQKKEGDQVSELLCIIVEKQEDVNAFKDFKGEESVPETIEAKGTPETTKLTQKTLPTAQPEQSQPSPQNVMSDQSRVKASPYAKKLADEKGIDLSSFSGSGPSGRILAADLSKAEGEFPSRGTQSSASSFIDIPLSNMRKTIAKRLSEAKSTIPHYYLTSEMQIDKLLEVRKKLNILLEREAKKKGEKMPSKLSINDFIIKASALACLRVPEANSSFMGSFVRQHSSVDVSVAVSTDVGLITPIIFDAHTKGGTFTVSNLGMFGSVDHFTAIINPPQSCILAIGAARRMLVPMEEEDKSDSNERFRAVTSLKVTLSCDHRVVDGAVGAVWLQNFKQFMEEPFTMILWGTPGNVF

SEQ ID NO: 120979 - protein, 253 aa, Heterodera glycines
  Coding regions on vcDNA: vcDNA=SeqID_47402; Strand=-; Position=1 -159,208-810
  Homolog annotation: Hit_ID=NP_508269.1; Match level="QueryCoverage =96%, HitCoverage=39%, E-value=3e-31, Identity=30%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
GGKRAQFLSRLDFDLGNQELYLLNNLDLLFTIYKARDTFIMQTLKANNTTKYRSSLNLSIYKTLEKQPATYAVRKTEIKSCFISEGRFEIDYNVFSATIPRRMTIALVANGAFNGNYALSPFNFKPFDIRDIAVYAGGMIYPIVPYKLDFAKDIFVRPFVDMYEALGMANSERSFDITKEQFKSGWTFFVIPLTSTLDDSTGYELLRSGTTSIRATFNSAIPEGGVEMIVLGEFDQMIMIDYNRHIVSDSKLS

SEQ ID NO: 120980 - protein, 533 aa, Heterodera glycines
  Coding regions on vcDNA: vcDNA=SeqID_47403; Strand=+; Position=1 -334,516-1783
  Homolog annotation: Hit_ID=NP_508269.1; Match level="QueryCoverage =81%, HitCoverage=66%, E-value=8e-47, Identity=27%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MVHQIFDPNSVSFDDFVVVEQIGSGEAFNYFRGIPPYQRGYGRQRGGGVGDVLRFLWRALLPKLKSAGTLLGREALDTGTRVLDTIEKAETPNKQAIINEVKKGMDNVLEKALSIFTLPPTNVSVSSSSVREYLPLNPLTDIPFHFKIHPTASFFDLNKCYILTEMSIKKLDSDTNKYVNLKVNEQAATINMIGATWIKNLKITVQGREIYDSNSLYAYKAYLDAELSYSKNVKESDLQASGYYVDSENQDGTDITQQGFDLRRKLFSQSQTAQFITKLDADIFNQDRYMVNGVEIDIQLTPNDNEFMVMAAADDKYRIEITACKLYVKTLEVVDGLALDIQKKLESKEAKYAHRKTLIKSTFISENRTEYNGTLFTGQLPKRVILGMVENAAYVGNQKKSPFNFKPFDIRSVTLIANGKQWPAAPFELNFSKNLYTRAFHEMNEALGMASSTDSNGISLEKYRKGWTIFAFNMTNSMEDNEGIDLITEGTTTVCIQFRSPVPSGGITLIAMSEMDSILILDKNRTVMTDTTI

SEQ ID NO: 120981 - protein, 157 aa, Heterodera glycines
  Coding regions on vcDNA: vcDNA=SeqID_47404; Strand=-; Position=1 -112,257-618
  Homolog annotation: Hit_ID=NP_508269.1; Match level="QueryCoverage =76%, HitCoverage=18%, E-value=2e-12, Identity=33%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MIDVQSSLNLSIYKTLEKQPATYAVRKTEIKSCFISEVYAGGMIYPIVPYKLDFAKDIFVRPFVDMYEALGMANSERSFDITKEQFKSGWTFFVIPLTSTLDDSTGYELLRSGTTSIRATFNSAIPEGGVEMIVLGEFDQMIMIDYNRHIVSDSKLS

SEQ ID NO: 120982 - protein, 174 aa, Heterodera glycines
  Coding regions on vcDNA: vcDNA=SeqID_47405; Strand=+; Position=1 -121,343-464,523-588,637-852
  Homolog annotation: Hit_ID=A48463; Match level="QueryCoverage=97%, HitCoverage=98%, E-value=8e-80, Identity=71%"; Hit description=Ras -like GTP-binding protein - nematode (Brugia malayi) sp|P38542|RAN _BRUMA GTP-binding nuclear protein Ran (G
  Essential gene: C elegans homolog=K01G5.4; Phenotype=Emb
MNQEQDNIPTFKLVLVGDGGTGKTTFVKRHLTGEFEKKYIGQCAIVMFDVTARVTYKNVPNWHRDLVRVCENIPIVLVGNKVDVKDRKVKAKSITFHRKKNLQYYDISAKSNYNFEKPFLYLARKLIGDPNLEFVAMPALAPPEVQMDPALAAKYEQEVAEAASAELPDDDEDI

SEQ ID NO: 120983 - protein, 319 aa, Heterodera glycines
  Coding regions on vcDNA: vcDNA=SeqID_47406; Strand=-; Position=1 -88,180-233,423-661,716-775,886-1100,1143-1446
  Homolog annotation: Hit_ID=NP_497962.1; Match level="QueryCoverage =68%, HitCoverage=91%, E-value=3e-31, Identity=33%"; Hit description =DNaJ domain (prokaryotic heat shock protein) (29.3 kD) (dnj-18Co) [Caenorhabditis elegans] emb|CAA84728.1
  Essential gene: C elegans homolog=T04A8.9; Phenotype=Emb
DATFASLKELFCTDHALDPAKTRFLLGSIEMIADDETPNSLGLEDGDSRLLEMSNVRVPSLPFSFYPEKCTHCLIGLYIHRCLSFSHSTSNNRHNDVAAHKNHYQTLGVSRDASAKDIKTAFFELTKKHHPDMNPTDKTKAAEAFQNITDAYEVLGSEEKRQIYDTLTAPKPQAHFGRTPNFRRTRSNHINMGPAGGHKDWTDLDIDFRDFEHFQRENRSRQTFKDWARANTKSEFYWSSHQSSKSYKSPLALERENLEKKMHDEVMERRRRSATIPMFDELQRDKQKREQEERKKRMKNYIIFLPIALFILLFIADRR

SEQ ID NO: 120984 - protein, 170 aa, Heterodera glycines
  misc_feature (16)..(16): Xaa can be any naturally occurring amino acid
  Coding regions on vcDNA: vcDNA=SeqID_47407; Strand=-; Position=1 -158,251-345,548-808
  Homolog annotation: Hit_ID=NP_499295.1; Match level="QueryCoverage =98%, HitCoverage=20%, E-value=1e-38, Identity=46%"; Hit description =putative protein, with a coiled coil-4 domain, of ancient origin (3L490) [Caenorhabditis elegans] emb|CAA
  Essential gene: C elegans homolog=M03C11.2; Phenotype=Emb
KKGTKFKNGKTVEPYXFVFKPSQQQIWPAFCESARSREGAVLFAVVGGKLSEGINFSDELGRCVLMVGLPYANRNSAELSERIRYLDQHMPGAGTRFYEQLCQQAINQAIGRAIRHRVDFAGIVLLDERYARDTIAASLPGWIRQRLTRAVPLPEALRRLDNFFSVHNCE

SEQ ID NO: 120985 - protein, 238 aa, Heterodera glycines
  misc_feature (17)..(17): Xaa can be any naturally occurring amino acid
  Coding regions on vcDNA: vcDNA=SeqID_47408; Strand=-; Position=1 -635,1244-1344
  Homolog annotation: Hit_ID=NP_508605.1; Match level="QueryCoverage =97%, HitCoverage=86%, E-value=2e-33, Identity=35%"; Hit description =predicted CDS, RNA-directed DNA polymerase family member (XE132) [Caenorhabditis elegans] gb|AAA96082.1|
  Essential gene: C elegans homolog=ZK250.3; Phenotype=Clr,Lvl,Sck
INDLPSFYTNEGHQLAXKYADDVKLYYAHVMAIRKSNGFEKWSKINGLEISTEKCFVLYLGKNNIKKEYFINSKKISESDNVRDFGIIMHSKLNFSEHISKIIRNAYLRSFQILRVLKTREIKTLTAAYKTFVRPQLEYATEVWNPNLKKDIDKIERVQKFFTRKAFRKCGFVYKKYMERLKIIHKLEERRKINDLTTAFKIIKGAFSLFPLALLSNFAQCSQPFLFNLTKYLKAQIN

SEQ ID NO: 120986 - protein, 145 aa, Heterodera glycines
  Coding regions on vcDNA: vcDNA=SeqID_47409; Strand=-; Position=1 -81,623-856,1296-1418
  Essential gene: C elegans homolog=C56G2.6; Phenotype=Lva
MVGMGQPKWINPERFDEKSTKLLSERTSFIVHLSEILRKEFASDCPGIAIQTVCPMVVATKLTQRSSRDGLSSLLAASPTEFARQAIQTVGLVPETSGCLSHQIQVELLFSLLLTFVPNSLFDFFVRLEAHLHKSVLNTTSKQHD

SEQ ID NO: 120987 - protein, 89 aa, Heterodera glycines
  Coding regions on vcDNA: vcDNA=SeqID_47410; Strand=-; Position=1 -149,205-277
  Homolog annotation: Hit_ID=CAG10141.1; Match level="QueryCoverage =96%, HitCoverage=57%, E-value=2e-23, Identity=66%"; Hit description =unnamed protein product [Tetraodon nigroviridis]
  Essential gene: C elegans homolog=F28C6.7a; Phenotype=Emb,Lva,Ste
MKLNPFVSSSARKSRKRHFNAPSHIRRRIMSAPLSKDLRNKHGVRSTPIRIDDEVTVTRGHYKGNIDDEVTVTRGHYKGNAGRIMRVYR

SEQ ID NO: 120988 - protein, 265 aa, Heterodera glycines
  Coding regions on vcDNA: vcDNA=SeqID_47411; Strand=-; Position=1 -95,242-382,626-724,776-811,873-1062,1109-1279
  Homolog annotation: Hit_ID=CAG06262.1; Match level="QueryCoverage =95%, HitCoverage=80%, E-value=4e-46, Identity=41%"; Hit description =unnamed protein product [Tetraodon nigroviridis]
  Essential gene: C elegans homolog=T20D3.5; Phenotype=Emb
GCIETCLLFPQTKLIFRQQLHNVLAVDAIKQLRREGLHLLYRGLLPPLIQRTTTRSIMYFWTEFYLKNAIFRFGTFEKTQTLLQTSKHFDKFKNTGEAFRIMYRNYAPKECYRGFSVIVLRNGYRGFSVIVLRNGCSNVMFFTCSNVMFFTLREPFREFVPESRTKTQHLCANFLSGAILGACISTIFFPFNVIKSRMQSNIGIDFCTSNIGIDFCTPWFMFKKILAERHGSIRALYRGAQLNFSRSLLTWGITNSLYELLMYEL

SEQ ID NO: 120989 - protein, 451 aa, Heterodera glycines
  misc_feature (253)..(253): Xaa can be any naturally occurring amino acid
  Coding regions on vcDNA: vcDNA=SeqID_47412; Strand=-; Position=1 -188,261-350,399-537,757-1031,1219-1423,1557-1986
  Homolog annotation: Hit_ID=XP_314273.1; Match level="QueryCoverage =83%, HitCoverage=62%, E-value=1e-102, Identity=51%"; Hit description= ENSANGP00000018635 [Anopheles gambiae]
  Essential gene: C elegans homolog=Y32F6A.3; Phenotype=Emb,Lva
EKTADLHKVEDAFVPLIKLRYDGIELDILFARLALKEIKEDQELSDDNLLKNLDEKSIRSLNGCRVADEILRLVCRVADEILRLVPNRLNFILVLRAVKLWAKNHGIYSHGIYSNVLGFLGGISWAILVARTCQLYPNATPSVLLQKFFLVFSAWDWPHPVILKDVDATPLIDMIWDPRTRASDRYHLMPIITPAFPEQNSTFNVTRSTRQVMTNEFKEGGQSEGIKGGTQAKSKRHSAMVWCPTVRVSFAVXCLTENEEDHLNFCGLVESKIRHLVASFERNSCVNLCHVNPRQYKPHTNWSSTSITIHSLLRNPVCTLWFIGLDLNKQLTKKIDLTEELQGFTDTVYKSASVLKDFKETMRIHPSYTRQRNLIKWLLFEKLFLAVPNINSFLLMCHGFASNCRLSKEDLDRGRRAERRCSAAAASPRVSMLNNSLDSTGKSLDTSGSNS

SEQ ID NO: 120990 - protein, 456 aa, Heterodera glycines
  Coding regions on vcDNA: vcDNA=SeqID_47413; Strand=-; Position=1-1371
  Homolog annotation: Hit_ID=NP_508269.1; Match level="QueryCoverage =97%, HitCoverage=64%, E-value=5e-39, Identity=25%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MSVIKKIHKDSVEGLEGSLSLFSLPPTKVAINRTNVRELLPLSALNQTGPYLFRLFSDSQYCDLSKTYMYLLSSIERKNAAGEWVPTSDAEPEDKRVGVTQNFGSSFVRSLKINISGIEVFDSSIYYHYRDYIMKELGYSHEIRKTFHEAACYYTDEDDCQDSATNEGFIARAARFSNGKQCETMVRLNFDLAHQSALMLNNQDVIFTIHRNSDSFLLLTPPGKKADGTLQENSKEYRIRVHDLRLYVRTVDVTPSLNLAISRQLESTSAKYPLRKIEMRSIFLGKGRTELAHNVFTSTLPRRLICCFVSTDAYSGDRKLSPFKFEHANVRAISAEANGQSFPSTPYLLSFDGAQQRFVRAFVDMYAGLGLDDSDTKTVSIGMQRFLSGWAFFVIPMTSTLDDTPGFELIRQGTCTLKVQFEKPIKEDGYEMLILGEFDSVLSINADRVLSTDGSV

SEQ ID NO: 120991 - protein, 287 aa, Heterodera glycines
  Coding regions on vcDNA: vcDNA=SeqID_47414; Strand=-; Position=1 -117,334-458,691-889,965-1229,1404-1561
  Homolog annotation: Hit_ID=CAE72716.1; Match level="QueryCoverage =91%, HitCoverage=96%, E-value=1e-82, Identity=56%"; Hit description =Hypothetical protein CBG19953 [Caenorhabditis briggsae]
  Essential gene: C elegans homolog=F41H10.8; Phenotype=Gro
MASTSAAELSTPNTFLGVSLASPFDYAAAREYTAYTQGPAIWITTAYVVTIFGIQWYMKDRKPMQLTLSLRLWNLWLAMFSIAGCLVTSYALLREIGTYGLVSSYTNCRDFFEGFTGLWTWWFCMSKFAELGDTYFIVLRKKPLMFLHWYHHVATLNYGLMSYVDNTAFNTWIVWLNFSVHAVMYTYYFLAACRIRLPAWFAQCLTTSQITQFLITLAILAHVGVRLLVGSHVDTTPMTYVYCLLMEISYVVLFGNFFYHSYIAGGGKKFQKEKQMKQQNGEAVKSE

SEQ ID NO: 120992 - protein, 115 aa, Heterodera glycines
  Coding regions on vcDNA: vcDNA=SeqID_47415; Strand=-; Position=1 -22,334-489,993-1131,1572-1600
  Homolog annotation: Hit_ID=CAE61487.1; Match level="QueryCoverage =95%, HitCoverage=13%, E-value=1e-28, Identity=54%"; Hit description =Hypothetical protein CBG05382 [Caenorhabditis briggsae]
  Essential gene: C elegans homolog=Y73B6A.5a; Phenotype=Ste
KKQQKKNPLIDRFFQAPEVIRMDGPEPYSTRSDVYSFGICVYELLTSRLPYEEIKNRDQILWMVGSGRLRPSIADLRTDTPKQLRHVFEQCTRFQRDERPEFRIVLERDRDLNTD

SEQ ID NO: 120993 - protein, 142 aa, Heterodera glycines
  misc_feature (7)..(7): Xaa can be any naturally occurring amino acid
  Coding regions on vcDNA: vcDNA=SeqID_47416; Strand=-; Position=1 -153,196-250,311-460
  Homolog annotation: Hit_ID=NP_492066.2; Match level="QueryCoverage =95%, HitCoverage=29%, E-value=5e-20, Identity=41%"; Hit description =mitochondrial substrate carrier (42.4 kD) (1H881) [Caenorhabditis elegans] emb|CAA95794.4| Hypothetical p
  Essential gene: C elegans homolog=F13G3.7; Phenotype=Age
LVIFDPXGFWVQMPHGVSFIYSTIENFRNVLHVNANIQSAPVVSALAGGFSSIFTQIIFVGFSSIFTQIIFVPTDIISQHMMIYNNPAKFLGQHMMIYNNPAKFLGSAKNVAVLDFVRTDGKSGRLTFGLRIVRAVYHIDGL

SEQ ID NO: 120994 - protein, 107 aa, Heterodera glycines
  Coding regions on vcDNA: vcDNA=SeqID_47417; Strand=+; Position=1 -76,191-236,491-687
  Homolog annotation: Hit_ID=CAE59023.1; Match level="QueryCoverage =96%, HitCoverage=33%, E-value=2e-34, Identity=66%"; Hit description =Hypothetical protein CBG02300 [Caenorhabditis briggsae]
  Essential gene: C elegans homolog=F33G12.2; Phenotype=Unclassified
SVDLPSKLVQCFDCRQGAIRAVRFNVDGNYCMTAGSDKSVKLWNPYRRVHLKTYSGLGQEVLDVAGSSDNSLILAGGRDKQPTVFDVESGKMVKRWQSHGGAVNAVA

SEQ ID NO: 120995 - protein, 117 aa, Heterodera glycines
  Coding regions on vcDNA: vcDNA=SeqID_47418; Strand=+; Position=1 -138,646-861
  Homolog annotation: Hit_ID=NP_503129.1; Match level="QueryCoverage =93%, HitCoverage=29%, E-value=2e-15, Identity=38%"; Hit description =predicted CDS, putative protein family member, with at least 4 transmembrane domains (5A526) [Caenorhabdi
  Essential gene: C elegans homolog=R08F11.2; Phenotype=Unclassified
MDLYLFHADRYQQLYNCSYDVNQVPFEDRQHIALGTMFITLAGIMELLYIPCTFAIWKHRENGCYKIMFYIAITDMMAMLMNGIATGWLAIIGAVFCTHPNLTYILGAYGMCKRSNF

SEQ ID NO: 120996 - protein, 341 aa, Heterodera glycines
  Coding regions on vcDNA: vcDNA=SeqID_47419; Strand=+; Position=1 -174,234-608,673-852,906-1022,1081-1260
  Homolog annotation: Hit_ID=AAP94888.1; Match level="QueryCoverage =95%, HitCoverage=98%, E-value=3e-74, Identity=46%"; Hit description =P34 [Ascaris suum]
  Essential gene: C elegans homolog=R90.1; Phenotype=Lva,Unc
MEELVALSPGIRVGRWTITKKLGAGAFGAVYLCVNDQGEQAALKTEPVNTPHPLLVMEAHVMTKLDTLRDGDGKHFCRCLDLGRDEQQDQQSGQMKKFNYIVMSLVGRGLDGVVKDAGGRLSLGSAVGVSIQMLAALRGLHTVGYLHRDIKPGNSTIGRPESNEIRLLYLIDFGMARKYTRDDGSQHRPRVATNFRGSPRYAAISAHLGREYSRKDDIESWFYCMIELFKGALPWASVGGMKEIGEAKVKRQKKQPEAVRRQAIADLLSGCPNEFGQVLKYIDDMKYTDKPDYDWIIATLRSSLSNAGVQEFPYDWETGKRNAAPGAGGGGGGGGGDSYFN

SEQ ID NO: 120997 - protein, 499 aa, Heterodera glycines
  Coding regions on vcDNA: vcDNA=SeqID_47420; Strand=+; Position=1 -96,156-354,459-552,601-685,732-876,946-1126,1179-1328,1387-1520,1567- 1695
  Homolog annotation: Hit_ID=NP_504635.1; Match level="QueryCoverage =99%, HitCoverage=65%, E-value=1e-120, Identity=45%"; Hit description= WD domain containing protein like, GAstrulation Defective GAD-1 (69.0 kD) (gad-1) [Caenorhabditis elegan
  Essential gene: C elegans homolog=T05H4.14; Phenotype=Emb
DLSHTKGHTAPINSLCWHPFVKSEFLSCSDDGSLRIWDTNDFKVITSLRIWDTNDFKVITKCINTQRKLIKTKNATGKRAIPTTCCYSWDGKMIAAGCDDGSIQIWNNAKIFVNTAFLNRSAHSGPVTRLEFSPDGQRIVSRSLDDTLKDDTLKLWSLKDFKKPFRMANGLDTVFPQTDCGYSPHAEFIYTTTNAKDKGFPQTDCGYSPHAEFIYTTTNAKDKGGGERGALLFFDAESLELLYKIEYPKQGCIRAFWHPKIGCIRAFWHPKINQILVGLSDGTSKIYYDPSISLRGALQCVSKPMKRSRESEMVREELVLSPLTLEMFQPRGEDLTLEMFQPRGEDGEEKEVTEWRIRKFLRMQSKQKRPQFRQPAAMPMSGPSAGGAGGRIRQTGGTLHSYIAKEMGMSRNKEFMQHEDIRSSILRHADEAEKNPQFVAMAYKRTQPNPVFQETEAEKNPQFVAMAYKRTQPNPVFQETAEENEEGEEEPVYKVPKLG

SEQ ID NO: 120998 - protein, 410 aa, Heterodera glycines
  misc_feature (315)..(315): Xaa can be any naturally occurring amino acid
  Coding regions on vcDNA: vcDNA=SeqID_47421; Strand=-; Position=1 -186,318-449,1040-1132,1189-1241,1720-1788,1841-1882,2281-2449,3604 -3784,4454-4562,4631-4731
  Homolog annotation: Hit_ID=CAE72568.1; Match level="QueryCoverage =99%, HitCoverage=38%, E-value=3e-97, Identity=45%"; Hit description =Hypothetical protein CBG19753 [Caenorhabditis briggsae]
  Essential gene: C elegans homolog=ZK270.1; Phenotype=Unc
PLQKTKTFFPFQQVLSEIGPAVLISTLTNIFADGCGWYTSSPELGALCLGNMVSMFVAFIYQMTFYAGLMSLVGRYEIATERRERRELQESIACRRNGRCRHGTGLQRQHSKFHEHTKHYISESIQTYVSIVANKFVAMLIVVLAMLIVVLYFVYLGMSIWGVTQMEVKLSIQQLFTSDSPLLKVDELRVGYQVVDELRVGYQVPHFMSSTVLVFNPGNLSDPERLAKMNKFVAEMEAINGSWGIGTKYFVRDFIAYELRDEGEHNLSSRWRRDGNGTDHTNAKRTYREEDLRAFLRWPESEEWKAYIRLDNDTXAFLIMLFEIERFFFTTGYHGDQLKIWTERGHMLNQWRAIVDKYANFNASVYYDDSIFLDLIFNASVYYDDSIFLDLIDNMPTDTLQSVIGTLVSV

SEQ ID NO: 120999 - protein, 684 aa, Heterodera glycines
  misc_feature (195)..(195): Xaa can be any naturally occurring amino acid
  Coding regions on vcDNA: vcDNA=SeqID_47422; Strand=+; Position=1 -120,179-316,411-517,579-832,876-978,1023-1181,1232-1367,1417 -1506,1556-1649,1692-1790,1868-2008,2073-2195,2241-2307
  Homolog annotation: Hit_ID=NP_741400.1; Match level="QueryCoverage =100%, HitCoverage=52%, E-value=1e-136, Identity=42%"; Hit description=metabotropic glutamate receptor mGluR7 (4G215) [Caenorhabditis elegans] gb|AAM97973.1| Hypothetical pro
  Essential gene: C elegans homolog=Y4C6A.2a; Phenotype=Unclassified
TGSYGERGMHSFRGAATELGICIEGEVHKISRRWTDDQFEELLIELLIRMRNSKARGVVMFVDEDNLRRFLSNLKRLAEGKQPELSNYFWFVASDSFVASDSWGMKGSVVKGFEHIVNGAITVAPKVRFLNGFDDYFASLSFDDYFASLSPSNTFLSEYWQSMNCSERFHHNFGLCFQSKGFSSPFAFANSSFCXRYRFVQEAYVPFVHDAVQLVARALHNSIQEECGLEGQWEECPLSSVGFDGQRLQQEECGLEGQWEECPLSSVGFDGQRLQRSYRNMSLFGGQPPLIGPDGDGTGQGQPPLIGPDGDGTGQYNIFQLDSRGAYRRVGGWMDSGQQLNVAEIRLGLQVVSDFVPSDFVPLSVCSSPCPRGQYRAYQDQNCCWTCIPCDTATSIVPNQTSCVQCPLGEVPNSDLTVCRPIMPSCVQCPLGEVPNSDLTVCRPIMPSHLHWDSPWALVPALFSSVGLLATSWALVPALFSSVGLLATSFVTLVFLRFNYTPVVMASGRELCYCMVMASGRELCYCMLAGIALCYSMTFVLVSRPSELICTFTRLLPGLSMICTFTRLLPGLSMATVYAAILVKTNRLARVFKPNNALRPKWIGPTPQVFFCTVFFCTGLASVQLAIASVWLWLEPPGTAIQYPSRVEAVLTCKATISQLLVSATISQLLVSLFYCLLIIACTI

SEQ ID NO: 121000 - protein, 128 aa, Heterodera glycines
  Coding regions on vcDNA: vcDNA=SeqID_47423; Strand=+; Position=1 -203,447-534,601-696
  Homolog annotation: Hit_ID=XP_510031.1; Match level="QueryCoverage =89%, HitCoverage=95%, E-value=6e-23, Identity=48%"; Hit description =PREDICTED: similar to enhancer of rudimentary homolog [Pan troglodytes] gb|AAH86103.1| Unknown (protein f
  Essential gene: C elegans homolog=F35G12.11; Phenotype=Emb
MTHTILLIQSSSKVDSRTWQDFMILLSCSNSLILLRSDYETLTDFMEAVCKIYEEHLKKLNPDVPCIQYDISALFKFIDRLADLSCMVLDKSVYVPKGEDFIKEQIFILLRGQAASNAAKKCPAEGSL

SEQ ID NO: 121001 - protein, 185 aa, Heterodera glycines
  Coding regions on vcDNA: vcDNA=SeqID_47424; Strand=+; Position=1 -165,229-288,715-884,1364-1526
  Homolog annotation: Hit_ID=CAE67815.1; Match level="QueryCoverage =88%, HitCoverage=32%, E-value=6e-18, Identity=34%"; Hit description =Hypothetical protein CBG13395 [Caenorhabditis briggsae]
  Essential gene: C elegans homolog=M176.2; Phenotype=Emb,Lva
MSLLYFRVSRDIDFLKMVYKDVIDSDLSIRNYLKICEDVHNEGIKQPISIYLQRSDYMVHVSESDDGEKKYELKQIEVNGGSIGGANGIPPRITKIHERMLEKAGFPNFPEDVLPRSTKAESASAQMLLTAWKKFKNPKAIIVSLVVKEKSKWHFCKRFDEYEIDRITNKKVKVYYLSMEEAVKM

SEQ ID NO: 121002 - protein, 155 aa, Heterodera glycines
  misc_feature (146)..(146): Xaa can be any naturally occurring amino acid
  Coding regions on vcDNA: vcDNA=SeqID_47425; Strand=-; Position=1 -41,388-515,641-756,812-852,961-1067
  Homolog annotation: Hit_ID=AAT37524.1; Match level="QueryCoverage =94%, HitCoverage=18%, E-value=1e-39, Identity=56%"; Hit description =epidermal growth factor receptor pathway substrate 8 splice variant B [Caenorhabditis elegans]
  Essential gene: C elegans homolog=Y57G11C.24a; Phenotype=Emb
YLIYFRLHSMAARDQNTLNRCFDDIERFVARVQSVALAQRELEMQKNDGKQRKSKKAKEAAKAAQNGILHLRSQMPTQDEFVDIFQKFKLCFNLLAKLKNHIHEPAKLKNHIHEPSSPELIHFLFTPLTVLLDACHWGLGQQVINXLINLLLLIE

SEQ ID NO: 121003 - protein, 623 aa, Heterodera glycines
  misc_feature (126)..(126): Xaa can be any naturally occurring amino acid
  misc_feature (165)..(165): Xaa can be any naturally occurring amino acid
  misc_feature (188)..(188): Xaa can be any naturally occurring amino acid
  misc_feature (239)..(239): Xaa can be any naturally occurring amino acid
  misc_feature (322)..(322): Xaa can be any naturally occurring amino acid
  misc_feature (352)..(352): Xaa can be any naturally occurring amino acid
  misc_feature (363)..(363): Xaa can be any naturally occurring amino acid
  Coding regions on vcDNA: vcDNA=SeqID_47426; Strand=+; Position=1 -109,1745-1881,1955-2445,2635-2694,2744-3109,3164-3220,3266-3313,3356- 3454,3506-3537,3602-3712,3772-3862,4009-4056
  Homolog annotation: Hit_ID=NP_494974.2; Match level="QueryCoverage =99%, HitCoverage=80%, E-value=1e-108, Identity=39%"; Hit description= Adenosine/AMP deaminase (85.4 kD) (2F499) [Caenorhabditis elegans] gb|AAO21474.1| Hypothetical protein C
  Essential gene: C elegans homolog=C34F11.3a; Phenotype=Lva
FVLFSFFPISNCPNDEKKRRAHNTIQIVNYPLIRSEISEISQQKTAKKTETVAQNALELASPRHFEMHTFRDAIDVNYQRMCLNGEELSGVPLDDLLRLRSEYMERIGSHFPKTTCNFLNGESRSXLKKHFGKIFVLGKYPGGLHAERRKGGAQPCKCLDDIIFXSNYTYEPILKEVALIFLSVPDSXLVNYCIYLTFLVTFQQPQCHHHRLPRTIGDSVPHRDFYNIRKVDGHAHPRXVMFNSLLFPFIKKKMRTDADEVVPINFIITVIMAQLFDKLDVGPHVPINFIITVIMAQLFDKLDVGPHDLSVDRLEVRADDTXTAKFCCLFYNFNSDSTSTWHGGPGHDVSEXISKNLISANLXLIEMRFLIIGHSFNLFSQVWSPNARWIIQVPRLFDIYRANKILKTFKILKTFDDFLDNLFTPLFEVTNDPNTHPELHVTNDPNTHPELHRFLKHVSGIDSVDDESKPENVAFTKDRFLKHVSGIDSVDDESKPENVAFTKDSPEPADYDNDQNPSYSYYLYYMNPSYSYYLYYMYANLTALNAFRRMRGLNTFALRPHCGEAGAVSHLSVSYLTYLTSESIAHGLLLRKVPVLQYLFYLAQIGIAMSPVSNDCLFIKNKK

SEQ ID NO: 121004 - protein, 172 aa, Heterodera glycines
  Coding regions on vcDNA: vcDNA=SeqID_47427; Strand=-; Position=1 -272,808-918,1514-1593,1660-1714
  Homolog annotation: Hit_ID=CAE67206.1; Match level="QueryCoverage =25%, HitCoverage=18%, E-value=4e-09, Identity=65%"; Hit description =Hypothetical protein CBG12642 [Caenorhabditis briggsae]
  Essential gene: C elegans homolog=C55B7.9; Phenotype=Dpy
ICFRIPSLLSCPFIFHAAQQSVSIAVECLRRWHWQRSFGTFRRCQRPFRHRFFRVRSSAPGQPISEHGVRAVRQHFQRSERPTDPTAEGSRRALSRLSKCKCAVVSKWTLCIGTAVTCPNPRHTLRRDVVVRKVIDSLIHSTDMMSFVKSLGLRMEYEYIANGFLFTKGDIR

SEQ ID NO: 121005 - protein, 490 aa, Heterodera glycines
  Coding regions on vcDNA: vcDNA=SeqID_47428; Strand=-; Position=1 -68,171-294,491-520,568-620,675-848,987-1042,1100-1180,1227-1314,1364- 1473,1651-1847,1967-2044,2145-2271,3886-3911
  Homolog annotation: Hit_ID=CAE58366.1; Match level="QueryCoverage =98%, HitCoverage=80%, E-value=1e-157, Identity=59%"; Hit description= Hypothetical protein CBG01491 [Caenorhabditis briggsae]
  Essential gene: C elegans homolog=Y48B6A.4; Phenotype=Emb,Lva,Lvl
AFLWTLFDCEFFPILASHDERRLYEDLLRDYNNLERPVEYHAKPVIVHLKVSLQQLIDVDEKNQIVHISAWLDYLWNDYKLRWDSSEYGNILWNDYKLRWDSSEYGNISNVRFPVGKIWRPDVLLYNSVDSNVRFPVGKIWRPDVLLYNSVDASFDSTFPTNMIVYNDGNVSWVPPGIFKISCKIDITWFPFDEQRCFFKFGSWTYSGFYVDLQPAEGGFDTSEYLPFYVDLQPAEGGFDTSEYLPNGEWALPMTTVARTEKFYDCCPNEPTTVARTEKFYDCCPNEPYPDLTFFLHMRRRTLYYGFNLIMRTLYYGFNLIMPCLLTTTMSLLGFTLPPEAGEKITLQITVLLSICFFLSILSEMSPPTSEAVPLLGLFFSSCMLIVTASTVFTVYVLNLHYRTPETHEMGTKARALLLYWLPWVLRMERPGVVLCWVTLKSFRVLQSKKHSESLMRNVKDCESGARSVQFPNDSLLCPSLMVQQITKGT

SEQ ID NO: 121006 - protein, 226 aa, Heterodera glycines
  Coding regions on vcDNA: vcDNA=SeqID_47429; Strand=-; Position=1 -96,161-251,337-579,653-903
  Homolog annotation: Hit_ID=CAE61350.1; Match level="QueryCoverage =96%, HitCoverage=37%, E-value=1e-88, Identity=76%"; Hit description =Hypothetical protein CBG05190 [Caenorhabditis briggsae]
  Essential gene: C elegans homolog=F48E8.5; Phenotype=Emb
MTTTAPIATEEGEDSLYPIAVLIDELRNEDVQLRLNSIRKLSTIALALGVERTRKELIQFLTDTIYDEDEVLLALAEQLGNFTPLVGGPEYVHCLLPPLENLANIEETVVRDKAVESLQKIAEKHSAAQLEEYFIPMVLRLSAGDWFTSRTSACGLFSVAYARANPAQKTELRAAFRCLCRDDTPMVRRAAASKLGDFAKVQEEDYLKNEITQMFEDLAKDEQVKN

SEQ ID NO: 121007 - protein, 155 aa, Heterodera glycines
  Coding regions on vcDNA: vcDNA=SeqID_47430; Strand=+; Position=1 -94,210-345,484-666,712-786
  Homolog annotation: Hit_ID=CAE66343.1; Match level="QueryCoverage =81%, HitCoverage=19%, E-value=2e-10, Identity=30%"; Hit description =Hypothetical protein CBG11595 [Caenorhabditis briggsae]
  Essential gene: C elegans homolog=T01C3.1; Phenotype=Gro,Pvl,Rup,Unc
MALNNCFTENRYPNECILSYGSIAVSDPLDAFVCCRFSIHEHQENICAFGTEYGRVVICDVTAPIKGEDFIKHRFATGKNAVFDLCFIPDRPNLLLSLCGASNLELLDIERSSSIFLLGHRDTVRCASVWPENPFCVLTGSRDGDILLWDLREKP

SEQ ID NO: 121008 - protein, 229 aa, Heterodera glycines
  Coding regions on vcDNA: vcDNA=SeqID_47431; Strand=-; Position=1 -59,263-519,1162-1420,1463-1577
  Homolog annotation: Hit_ID=NP_499296.1; Match level="QueryCoverage =53%, HitCoverage=23%, E-value=2e-25, Identity=43%"; Hit description =histone (3L496) [Caenorhabditis elegans] emb|CAA88954.1| Hypothetical protein M03C11.4 [Caenorhabditis el
  Essential gene: C elegans homolog=M03C11.4; Phenotype=Emb
AQQSLALCSLARLSMPAFAARLYPKQTNKEQQQQGGGPSNGFHDITSIGGGGGGGSALFHSSNGTAAAGLSSSSGSSPTILQQQQHRQFSSAISQQKSLTPPPLSVSYTDNDDHRYFNYFLFAVRPSSDGDGSSVHRFAGYVNLYRFYHHPDKERVRIAQILVPPTYRRIGLGPRLLRAVYNDLCRAERVTAESPSDAFLFMRDYVDCANCAKLSDFAPEKLRKGFSDE

SEQ ID NO: 121009 - protein, 186 aa, Heterodera glycines
  Coding regions on vcDNA: vcDNA=SeqID_47432; Strand=-; Position=1 -19,468-1009
  Homolog annotation: Hit_ID=BAA88337.1; Match level="QueryCoverage =76%, HitCoverage=14%, E-value=2e-14, Identity=36%"; Hit description =ORF2 [Platemys spixii]
  Essential gene: C elegans homolog=ZK250.3; Phenotype=Clr,Lvl,Sck
MANIISEHISKIVRNAYLRTFQILRVLKSKEIKTLTAAYKTFVRPQLEYATEVWNPNLKKDIDKIERVQKFFTRKAFRKCGFVYKKYGERLTITDLHKLEERRKINDLTTAFKIIKGFTSLDAGKSFFFSERPRRPLLLRVKRHTAKTQNNFFNRIVKSWNNLPVVAVQINKAKEFRGLLKAMSSE

SEQ ID NO: 121010 - protein, 366 aa, Heterodera glycines
  misc_feature (39)..(39): Xaa can be any naturally occurring amino acid
  misc_feature (43)..(43): Xaa can be any naturally occurring amino acid
  misc_feature (58)..(58): Xaa can be any naturally occurring amino acid
  misc_feature (352)..(352): Xaa can be any naturally occurring amino acid
  Coding regions on vcDNA: vcDNA=SeqID_47433; Strand=+; Position=1 -216,611-676,721-824,880-938,983-1126,1316-1380,1464-1805
  Homolog annotation: Hit_ID=CAE58662.1; Match level="QueryCoverage =92%, HitCoverage=61%, E-value=4e-53, Identity=35%"; Hit description =Hypothetical protein CBG01831 [Caenorhabditis briggsae]
  Essential gene: C elegans homolog=C39E9.10; Phenotype=Emb,Gro,Lva,Ste
GQKCAWLRRRWQWGIRVTPLLGFFCIITLLLFVKEPVNXLINXMENNSKKAIKILINXIAGEGTIRTKCRTFVWSTLAYTAVVFVTGTLSWWGPTAMWGPTAMEHAKAMDEHLNDTSKLRPAEKNQIALIFGVITCVAGIFGVSLVITCVAGIFGVSLGSLIAQHWKTGKFCFAHHRSERADPHWKTGKFCFAHHRSERADPIVSAVGSFVAAPLMFVAFSLITTDQLLSWFVVFLTILCLCLNWAINVDMLMSIIVPERRSIASAIQILFSHLFGDASGPYLVGAISDFVRGSSDLPTDRFHSLIVAFYLPNALLFLSGAAFLGAAYSLPADLKRMEAEKAAAESERREEXKLKGRGREVMRERM

SEQ ID NO: 121011 - protein, 140 aa, Heterodera glycines
  Coding regions on vcDNA: vcDNA=SeqID_47434; Strand=-; Position=1 -266,346-501
  Homolog annotation: Hit_ID=NP_498584.1; Match level="QueryCoverage =100%, HitCoverage=63%, E-value=3e-33, Identity=50%"; Hit description= ribosomal Protein, Large subunit (24.3 kD) (rpl-6) [Caenorhabditis elegans] gb|AAK29850.1| Ribosomal pro
  Essential gene: C elegans homolog=R151.3; Phenotype=Emb,Lva
LNGRSTNKRTLFLFMLNVLKYFKFLGPMKLNATPLRRIAQAFVIATKTKLDISTVNVPEHLDDKYFKRQSGKVADKSKGGIFAEGANKYAVTDQRKEDQKTVDLQVMEVVRKHPEKKLLFAYLGSRFHLAKGMYPHKITF

SEQ ID NO: 121012 - protein, 300 aa, Heterodera glycines
  Coding regions on vcDNA: vcDNA=SeqID_47435; Strand=+; Position=1 -251,300-393,447-713,771-1061
  Homolog annotation: Hit_ID=NP_496466.1; Match level="QueryCoverage =99%, HitCoverage=100%, E-value=1e-69, Identity=47%"; Hit description= transcription initiation factor TFIIE, beta subunit (33.0 kD) (2L832) [Caenorhabditis elegans] emb|CAA91
  Essential gene: C elegans homolog=F54D5.11; Phenotype=Dpy,Emb,Lva,Unc
MDPALLRQRQEFMKQAIKSMGVAQQIKNDRNEQQIPTSSAASSAMPKKKKKKPVQTAAAGQFGTEFAANATTAEDSAQNATNFSIMAKIVDYMKKRHLNSQPWALSLKEILEEMQVYDVNRKSMLWLQEALPRNPRLQSEADDTKFVYKPLYKVKNRVTLLALLKKFHTEGKGGILLSDLNDCVNSAELLVKALGNQVIAIPTQINKRKDIVYFYNDTETDREIDDEFVQLWRTAGVEHLDENKIEEYLQKHGLETARDLAPRKPNANLGPKRKQPRQRVPQRLHNVHLEGVLEDYKTDD

SEQ ID NO: 121013 - protein, 203 aa, Heterodera glycines
  Coding regions on vcDNA: vcDNA=SeqID_47436; Strand=+; Position=1 -165,516-625,691-1026
  Homolog annotation: Hit_ID=NP_499084.1; Match level="QueryCoverage =98%, HitCoverage=46%, E-value=1e-38, Identity=40%"; Hit description =predicted CDS, protein phosphatase (3K555) [Caenorhabditis elegans] emb|CAC35809.1| Hypothetical protein
  Essential gene: C elegans homolog=B0464.9; Phenotype=Emb,Lva
MNDFSPLNWDEFFDRKECVKTGDDKFNVYVKGSNGPLFFLLHGGGYTGLTWAVLSEQLSSVIECRILAPDLRNHGETEVKDGDDMAAESQVNDLCNIYQHFYGHDSSKYPPTILIGHRQVKREGARDSTMAVLKMPQNEFNPALFSMGGAIAIRAAASGRLPNVLVVSAIDVVEGSAMSSLCFMQQFLRSRPQHFPSIERSVE

SEQ ID NO: 121014 - protein, 355 aa, Heterodera glycines
  Coding regions on vcDNA: vcDNA=SeqID_47437; Strand=-; Position=1 -63,107-427,475-573,617-698,762-835,886-921,964-1096
  Homolog annotation: Hit_ID=NP_508479.1; Match level="QueryCoverage =100%, HitCoverage=42%, E-value=2e-83, Identity=48%"; Hit description= immunoglobulin-like, possibly N-myristoylated (68.5 kD) (XD318) [Caenorhabditis elegans] pir||T16777 hyp
  Essential gene: C elegans homolog=T02C5.3; Phenotype=Unclassified
AVELPPVDANPSWTGATIICQAAVNGGTKDSPPAAVNGGTKDSPPSVVDVQYLRGVHVVDSNGQGPVHIPNQGFRFYVECVRGTDGQCQQSAARRKTLHCAVQANPAANSFRWLKNGGPSGNGPEFMIGTDMIGHSLQCAANNGLYGCAANNGLYGEELQSPAVYIDSYTAARLIQDNFQQVQSSAPFQQGNRVEMGQRVQVQSSAPFQQGNRVEMGQRVQMSCVVEGNPRPAVFWKLRNPRPAVFWKLRRSNGQVVDAPCPQGLNGQYREVPGLNGQYREVPPTAQQSNSLIRLQAICDLQVANYSFSPTAQQSNSLIRLQAICDLQVANYSFSGQYWCSACSYVSQGLPECSP

SEQ ID NO: 121015 - protein, 573 aa, Heterodera glycines
  misc_feature (90)..(90): Xaa can be any naturally occurring amino acid
  misc_feature (363)..(363): Xaa can be any naturally occurring amino acid
  misc_feature (430)..(430): Xaa can be any naturally occurring amino acid
  Coding regions on vcDNA: vcDNA=SeqID_47438; Strand=+; Position=1 -45,1713-2056,2100-2255,2296-2527,2577-3126,3172-3235,3280-3334,3385 -3437
  Homolog annotation: Hit_ID=CAE67142.1; Match level="QueryCoverage =93%, HitCoverage=53%, E-value=4e-49, Identity=29%"; Hit description =Hypothetical protein CBG12565 [Caenorhabditis briggsae]
  Essential gene: C elegans homolog=T08B2.5a; Phenotype=Ste
SGEIMSRRNSIARGARQQRDSSSSRSSDSWSRKSRSRSRASSPSRSSSSPHDRDWRFRSRSGERNKRRCRHSRQSPPPRKRERSRTPVNXEQKCINLKNSNQFSRRRSPNETKPSNKVILTSLPNYADNIKLNILLAKQGFHPIDNIKLNILLAKQGFHPIDIRVVRRNTDSGSVRIFGFVEFSDVETAEDWIRHNQGFLKMDDGFQVGFLKMDDGFQVRLEYSREELNRESNPLTSDWTCSKCTINNFNRRTNCFKCGTSRKDSEALDARGYGMVGVSPCDTLLIRELPSSVTEESIRTLLIRELPSSVTEESIRTSLSQFSGLTIQRIQLASSRLYAFVQMKSAEQASYLLNFQQSCTVRXQLCRCFFINDFVISLFVKNNYLFASVSQSNFDHGECQFAKHKAELAAQTFKKVKIRFAPVFCISKNXPTNSAAQLAQNAIRLAQMGKAVPGAVPPIAHMEGPARQSISTPFGYLPTYTTPDTNLFQYEPSSGTPDTNLFQYEPSSGYLWDVNTGFYYDQKTGYYYSSNTSNGFYYDQKTGYYYSSNTSNWMFWWMFWSSKFSTYITAKEV

SEQ ID NO: 121016 - protein, 91 aa, Heterodera glycines
  Coding regions on vcDNA: vcDNA=SeqID_47439; Strand=-; Position=1 -148,773-900
  Homolog annotation: Hit_ID=NP_649909.1; Match level="QueryCoverage =54%, HitCoverage=8%, E-value=4e-13, Identity=66%"; Hit description =CG8228-PA [Drosophila melanogaster] gb|AAF54403.1| CG8228-PA [Drosophila melanogaster] gb|AAM51046.1| SD10
  Essential gene: C elegans homolog=C44C1.4a; Phenotype=Gro,Lvl,Sma,Unc
MYLNFGDIGQNIKGLMNEYQRKAKTHQQLESIADMKKFVEQYPQFKKISGLKGVENIYTQHEPFILQLIDLASRGKLPESVYPSTDLANLK

SEQ ID NO: 121017 - protein, 409 aa, Heterodera glycines
  Coding regions on vcDNA: vcDNA=SeqID_47440; Strand=+; Position=1 -448,527-639,1373-1522,1561-1851,1908-2133
  Homolog annotation: Hit_ID=CAE57457.1; Match level="QueryCoverage =59%, HitCoverage=48%, E-value=5e-61, Identity=68%"; Hit description =Hypothetical protein CBG00421 [Caenorhabditis briggsae]
  Essential gene: C elegans homolog=Y116A8C.32; Phenotype=Emb,Lva
PPPQSQEEQELQQDPEKKNDALSAALAAAAMVAQKLGKGGLISGAGAAVVSSIDLLNRVPQATQKATPLAETVLAKEIGEFVYFGYFTTVDKHETVKREPSEQNDQLTEEQRQRELRRKSRWSTTKSFVPGMPTILPSDIDENQRQVYLLQMEIEETTRRLRQSDFGQNVDPAERSITQKYVALIIITGAKIIIRGKGSIKEGKLANRTGPLPGENEPLHAYVTSTDREAIKRGCDKIREIINAALMIPDGQNELRKLQLRELALLNGTLRPEDVLSGARCTNCGSDQHKTWECMEAPNVTANVICTACGGAGHIARDCKNPRPGFDGAVMDAEYSALMAELGEKPPISLEAGTAPPLVGGKPIPGFPGSGLRPRFALPAPTPIVRVNLAKQQNTPQQQSVSGGGYPGW

SEQ ID NO: 121018 - protein, 173 aa, Heterodera glycines
  Coding regions on vcDNA: vcDNA=SeqID_47441; Strand=+; Position=1 -97,145-317,452-576,926-1052
  Homolog annotation: Hit_ID=NP_490666.2; Match level="QueryCoverage =47%, HitCoverage=18%, E-value=2e-14, Identity=46%"; Hit description =putative phosphatidylglycerophosphate synthase, similar to silencer -associated factor (51.7 kD) (1A527) [
  Essential gene: C elegans homolog=Y48G1C.4; Phenotype=Emb,Sck,Stp
LGSLVFTLPHFFAEPYTTSYQIENAGLSRCMKGAQSLRCAGPRQITAIGFDLGAVGCNLAIIIFVPNFMCGKCLHTVVFGLSGFDANGYQVHLFHMPKFCGFLKSALPERTNEIVWLQHMKFIVFDDTVLISANLSDQNFVNHQESLFADRDCPLLTDFFVDLFRLVDNPSGG

SEQ ID NO: 121019 - protein, 189 aa, Heterodera glycines
  Coding regions on vcDNA: vcDNA=SeqID_47442; Strand=-; Position=1 -24,116-335,661-986
  Homolog annotation: Hit_ID=AAQ94575.1; Match level="QueryCoverage =92%, HitCoverage=46%, E-value=2e-13, Identity=31%"; Hit description =polyA polymerase alpha [Danio rerio] ref|NP_991321.1| polyA polymerase alpha [Danio rerio]
  Essential gene: C elegans homolog=Y32F6A.3; Phenotype=Emb,Lva
MRFGTAANNEKVGSLKKMPFAYLPLVGLEFDGIQFDVLFVSIPTSDSLPKNGPLSRKEVMALIRKLAGQKEADEKMIKSLAANFIYEPKLGFFNGISLATMATKVMLLYPNASIPFLLDKFFLTFALWYLNNRLNVLITCPPRDWPIPLRLEEYVPDELQTFSWTPKDEEQKRNSPLLMPIITPGKGDK

SEQ ID NO: 121020 - protein, 231 aa, Heterodera glycines
  Coding regions on vcDNA: vcDNA=SeqID_47443; Strand=-; Position=1-698
  Homolog annotation: Hit_ID=NP_741939.1; Match level="QueryCoverage =100%, HitCoverage=24%, E-value=2e-91, Identity=75%"; Hit description= DYNamin related (94.4 kD) (dyn-1) [Caenorhabditis elegans] emb|CAC42251.1| Hypothetical protein C02C6.1b
  Essential gene: C elegans homolog=C02C6.1a; Phenotype=Emb
LNLTLIDLPGLTKVPVGDQPPDIEQQIRDMIGTYISRETCLVLAVTPANSDLATSDALKLAREVDPQGLRTIGVLTKLDLMDEGTDARDILENKVFPLRRGILWAFWMPFSSFSECFSLPMPSLPLFCLGYVGVINRSQKDIVGRKDIRQALDAERKFFLSHQQYRHMADRLGTPYLQKALNQQLTNHIKDTLPTLRDNLQKKLYSMEKEVAEYKNFQFNDPSRKTKALMQ

SEQ ID NO: 121021 - protein, 242 aa, Heterodera glycines
  Coding regions on vcDNA: vcDNA=SeqID_47444; Strand=-; Position=1 -55,109-356,501-705,2087-2306
  Homolog annotation: Hit_ID=NP_498931.2; Match level="QueryCoverage =51%, HitCoverage=33%, E-value=4e-48, Identity=65%"; Hit description =SMAll body size SMA-2, dwarfin; affects body size and the arrangement of peripheral sense organs in the m
  Essential gene: C elegans homolog=R13F6.9; Phenotype=Sma
MSLENFGNGFMRRLGWKQGDEDEGWSKKAVDSLLKKLQKQHNKEGLTLLENALRTEGKEPSECVTIPRSLDGRLQISHRKALPHVIYCRVYRWPDLQSHHEDVCINPYHYERVDSSNLLPPVLVPRFSDSPPKRQPGGEHRVLLGHDPIPFVPCQHWATISYYELSTRVGHRLRMFFFALFRGDIATSSPKGVTAFCSSIVVPNLDESTVMNELNPSIEETANTRPSGVQAIEVNLSYWRFS

SEQ ID NO: 121022 - protein, 190 aa, Heterodera glycines
  misc_feature (7)..(7): Xaa can be any naturally occurring amino acid
  Coding regions on vcDNA: vcDNA=SeqID_47445; Strand=-; Position=1 -311,389-532,601-660
  Homolog annotation: Hit_ID=AAH67963.1; Match level="QueryCoverage =76%, HitCoverage=23%, E-value=3e-46, Identity=60%"; Hit description =Hypothetical protein MGC69251 [Xenopus tropicalis] ref|NP_998844.1| hypothetical protein MGC69251 [Xenopus
  Essential gene: C elegans homolog=C14B9.4a; Phenotype=Emb
SLAPLNXKCQFPPHLSQLQYTERNNTAHFYGANKYPQALEKKITLLKFFRSYMNEHLMKAGANIKMRDGDELARLPCLNTWFRTKSAIVLHLSNGTLQINFFQDHSKLDHSKLIVCPLMSAATYIDQQKNVFTCKFQYLEKYGCPKDLCQRLKYTKVMVERLIARHENPNVMVERLIARHENPNAMTAKS

SEQ ID NO: 121023 - protein, 207 aa, Heterodera glycines
  Coding regions on vcDNA: vcDNA=SeqID_47446; Strand=-; Position=1 -27,347-519,772-963,1086-1316
  Homolog annotation: Hit_ID=NP_497599.2; Match level="QueryCoverage =99%, HitCoverage=58%, E-value=3e-75, Identity=44%"; Hit description =myotactin, LEThal LET-805 (479.6 kD) (let-805C) [Caenorhabditis elegans] gb|AAK21414.2| Lethal protein 80
  Essential gene: C elegans homolog=H19M22.2a; Phenotype=Lvl,Ste
DSVGIRRMTTTESLLTVEWEGIQSGDHPDSSIRGFIVEYRAEKESQWNVHSGMIPYKGPNHQYRVQIPKLPTGISYFVRIKVLGDKGEVLVETPEIRARNEIVSIKCEPDEISEPGDVDVKERAQFSVALAWQPPECGSIGEYQIELRGLGSQQFDVHRQTVAQPSASITGLLSGTEYAVKIRAVDRAHIVGPWNAELFTVSTKGEA

SEQ ID NO: 121024 - protein, 375 aa, Heterodera glycines
  Coding regions on vcDNA: vcDNA=SeqID_47447; Strand=+; Position=1 -87,133-271,313-433,483-610,656-794,872-964,1088-1198,1247-1302
  Homolog annotation: Hit_ID=CAE69954.1; Match level="QueryCoverage =89%, HitCoverage=51%, E-value=1e-67, Identity=43%"; Hit description =Hypothetical protein CBG16343 [Caenorhabditis briggsae]
  Essential gene: C elegans homolog=C06G1.1; Phenotype=Lon
QVMRSREREVSISASSTRGNVFGILRQGKGKTRINDFRLPIGKTRINDFRLPILPQPMVPSNSKSAAKRMVVFQLSNYTLSSLFFWMDQYRKFDYEISKTDQYRKFDYEISKTTVKDKEIAAYLKTECGPKDICAGTLFPALAQNFPNGLVSIKSRLAQNFPNGLVSIKSRTLTYPTILIERNRINVQVESRIDAFANYSDHNRRFLTATMRAKLQYSDHNRRFLTATMRAKLQLQNTTFVNYVFSAELSIDTFDITNVVSLVDGIDAGDGIDAGSIEFLVNALNELIIADDMRHKLKEGVRLPVLLDFEQFAGDVHLEDGSLVLSADLCFDELCSNTMSNVDMDANYYDSVKGLCSNTMSNVDMDANYYDSVKG

SEQ ID NO: 121025 - protein, 373 aa, Heterodera glycines
  Coding regions on vcDNA: vcDNA=SeqID_47448; Strand=-; Position=1 -222,285-501,544-702,748-886,1635-1819,2777-2976
  Homolog annotation: Hit_ID=EAA21462.1; Match level="QueryCoverage =78%, HitCoverage=40%, E-value=6e-16, Identity=25%"; Hit description =poly(A) polymerase III [Plasmodium yoelii yoelii]
  Essential gene: C elegans homolog=Y32F6A.3; Phenotype=Emb,Lva
MYKNSIKSNGAAQLYISGSLLLGTRTFSSDIDLICIAPGKIIKLANFFGEENVFCKKNECTTEQNDSLFCKFCQNKGVKNLIKTPFGKVFLIRFLLNGIDFDLTFVSIPAKRILPFVLSDDQIGKYINNFKSERNFAHKNMLRALSSYRSIFYLANLFQENHANCAIPLSENKFKVEKFQNKKAKKFQALVLFMKIWAKENHIYSTAYGFLNGPMLAIMAAKVILLYPSASLPFLIERFFIFYLLRPIRVPVQLAKLKLEENFDVNENWDLFFVRKPDEQEMPVYTPMFPEQNVAWHLTHSAARVIRPCQIVPTLLYKTIICFVPLAFSWPRNQWLNLATFLSRPISLFESNYLEFNRQIIFKISKMGEDGRE

SEQ ID NO: 121026 - protein, 302 aa, Heterodera glycines
  Coding regions on vcDNA: vcDNA=SeqID_47449; Strand=-; Position=1 -165,313-829,871-1097
  Homolog annotation: Hit_ID=CAE75463.1; Match level="QueryCoverage =99%, HitCoverage=99%, E-value=1e-141, Identity=75%"; Hit description= Hypothetical protein CBG23461 [Caenorhabditis briggsae]
  Essential gene: C elegans homolog=F23H12.4; Phenotype =Bmd,Dpy,Emb,Lva,Unc
MTESDSRIRAYKFVAYSAVTFSIVAVLSVVVTLPMVYNYVAHVRRQMQHELGFCKGSAKDIYVEVNHMKSTPDMDMRSNRTARQTGGGYGPVVNAAPACGDCCLPGQPGPQGPPGRPGKPGKPGAPGNPGTPGKPPNAPCEPTTPPPCKPCPQGPPGPPGPPGPPGEPGEAGTPGRPGSDAPNGEPGPRGPPGPPGEAGPQGPPGEPGVPATPEAPVPGETGEQGDQGPPGPPGPPGAPGADGPPGPPGPKGPAGPDGAPGADGQPGPAGPPGPPGTSGEKGICPKYCAIDGGVFFEDGTRR

SEQ ID NO: 121027 - protein, 359 aa, Heterodera glycines
  Coding regions on vcDNA: vcDNA=SeqID_47450; Strand=-; Position=1 -58,107-213,532-687,732-889,1073-1115,1684-1790,1867-2175,2231-2369
  Homolog annotation: Hit_ID=CAE75501.1; Match level="QueryCoverage =98%, HitCoverage=59%, E-value=7e-58, Identity=36%"; Hit description =Hypothetical protein CBG23510 [Caenorhabditis briggsae]
  Essential gene: C elegans homolog=W04D2.6a; Phenotype=Gro
MAFPPPFPNPLLPRLPNQSVQFPGQKFGFFSPQRQSILPGIPLLRPRFRPNFIPRKCGSVCNWKRLQDSGGKFKAFGFCDFMYPDGAKKALSVLKDFPIGDKRLNVKADEQTEKLLDEFSKNKLIAANEESDDAVRASIRKFLEDEAADLVDMPTDEGFRHRVLDLFVFFGQLVASNKEGRQSRSSSVASHRHKKKRSQKSPNRKKLANGTSSTESRRIKRKKNAKRKSLSSAEDSDEAEEKRKLKKEVKEKEESYQARLKKWEEREKRMAKLYDKEREEEKQRQKTLQKEAKKLRQFLEDYVDERDDPKYYRGSALFQRKRNYEREREADAKDRHEERAELEEIRRSILEEEVVSKKE

SEQ ID NO: 121028 - protein, 204 aa, Heterodera glycines
  misc_feature (198)..(198): Xaa can be any naturally occurring amino acid
  Coding regions on vcDNA: vcDNA=SeqID_47451; Strand=+; Position=1 -42,1825-1963,2020-2247,2299-2396,2601-2620
  Homolog annotation: Hit_ID=AAO42469.1; Match level="QueryCoverage =91%, HitCoverage=99%, E-value=1e-78, Identity=75%"; Hit description =putative polyubiquitin [Arabidopsis lyrata]
  Essential gene: C elegans homolog=F25B5.4a; Phenotype=Emb
PPPPPRYALGKYTIMQIFVKTLTGKTITLEVEASDTIENVKAKIQDKEGIPPDQQRLIFAGKQLEDGRTLADKQLEDGRTLADYNIQKESTLHLVLRLRGGMQIFVKTLTGKTITLEVEASDTIENVKAKIQDKEGIPPDQQRLIFAGKQLEDGRTLADYNIQKESKQLEDGRTLADYNIQKESTLHLVLRLRGGKNXFTKIGR

SEQ ID NO: 121029 - protein, 198 aa, Heterodera glycines
  misc_feature (97)..(97): Xaa can be any naturally occurring amino acid
  misc_feature (184)..(184): Xaa can be any naturally occurring amino acid
  Coding regions on vcDNA: vcDNA=SeqID_47452; Strand=-; Position=1-613
  Homolog annotation: Hit_ID=AAC60281.1; Match level="QueryCoverage =100%, HitCoverage=20%, E-value=4e-27, Identity=33%"; Hit description= unknown [Gallus gallus]
  Essential gene: C elegans homolog=ZK250.3; Phenotype=Clr,Lvl,Sck
DVKLYYTHENDDPLNQLDKAIEAMEKWSKINGLEISTEKCFVLYLGKNNMKKEYFINSQRISESDNVRDLGIIIDSKLNFSEHISKIIRNAYLRIFXILRVLKSREIKTLTAAYKTFVRPQLEYATEVWNPNLKKDIHKIERVQKFFTRKARGFVYKYGERLKITGLLTLEERRKITDLTTAFXIIKGFISLDAGKIF

SEQ ID NO: 121030 - protein, 309 aa, Heterodera glycines
  Coding regions on vcDNA: vcDNA=SeqID_47453; Strand=-; Position=1 -204,937-1027,1082-1231,1275-1576,1620-1802
  Homolog annotation: Hit_ID=NP_506079.1; Match level="QueryCoverage =61%, HitCoverage=51%, E-value=3e-28, Identity=40%"; Hit description =putative mitochondrial translation elongation factor Ts, with ubiquitin associated domain (34.1 kD) (5M75
  Essential gene: C elegans homolog=F55C5.5; Phenotype=Lva
MVAVTLGTFLQGSIGTAVVIELKDETALEGSVDSVDPKSLNTQLSNVVLYRRRQKGLKPAHLPSFFCKVTELVNALRNCASELLPLPDEAQKLTLKNIEHDKFRMMDGRTADEAIVATVSKVGENIQLARASVISSSPGTLFGQTHPKEEFNGVQLGRFISLVSLGHKSDESVSDFPTAQLGQVLCQHIIGMAPESLGEPRKKGAKRATQMEIVDNGEGTEKERSANAENESDGGEEEDLNASQVDQSELTRMDGEETQLLHQPFMLNPEQTVNEYLEAHGANIADFLRIEMGQEHTKTNDLSVCSLLV

SEQ ID NO: 121031 - protein, 402 aa, Heterodera glycines
  Coding regions on vcDNA: vcDNA=SeqID_47454; Strand=-; Position=1 -198,244-357,420-539,586-813,856-1002,1146-1301,1356-1600
  Homolog annotation: Hit_ID=CAE72572.1; Match level="QueryCoverage =84%, HitCoverage=22%, E-value=9e-31, Identity=28%"; Hit description =Hypothetical protein CBG19759 [Caenorhabditis briggsae]
  Essential gene: C elegans homolog=F39B2.4a; Phenotype=Adl,Egl
MTFLYETLHTLDSFNRDSPIGRQTIRKFVVNIVLKLEQEEGTHSTRAGAGYHSKLLTPEFVLHHHNMPPIRFCRVLVERIVQASTYTHQPPQFVHRDWRFAEYPPAGQALTSAWVELLASQHTPAAIVDALVDLAIRRPIFRPQDTLNALGLLLTGLPSSFQAFFLDRIEESFDWPQIASVDADPSQLFESLSHEVYLHSESRILSMLALIHSFCQHGGNNSLSIIPDFVINRLAHKVDNEAQLVYFLRIVVPYLQRIHEKERNKHMPEIISIYKVLGDLVKKVGQLHYEDTICDLLYQFKYMFVGYTLKEQTEIFILNFPDSMREKLKFLFTHSSTAAAAVENQQQMLQQQQQQLVGIGFAFGQQLSFPMESATHQQQQQQVLPFHHSQQQQQQQPAALIG

SEQ ID NO: 121032 - protein, 559 aa, Heterodera glycines
  Coding regions on vcDNA: vcDNA=SeqID_47455; Strand=+; Position=1 -153,207-284,669-747,791-843,884-993,1034-1256,1319-1414,1457 -1645,1687-1744,1788-2058
  Homolog annotation: Hit_ID=CAE64981.1; Match level="QueryCoverage =94%, HitCoverage=63%, E-value=1e-141, Identity=55%"; Hit description= Hypothetical protein CBG09816 [Caenorhabditis briggsae]
  Essential gene: C elegans homolog=Y54E10A.9a; Phenotype=Emb
SFTFWFCLGGPRDERLEAELFTGVNSGINFDKYEEIPVEATGVECPPPIQSDTNLNLHPWIEENIRKSGYDRQSDTNLNLHPWIEENIRKSGYDRPTPVQISPTRELSLQIYNESRKFAYRTPIVSALLYGGLLYGGRENYRDQINKLRLGVHMLIATPGRLIDLGVHMLIATPGRLIDVIQNGLIGMEACRFLVLDEADRMLDMGFEPQIRQIVQMSCMPQKGERDRMLDMGFEPQIRQIVQMSCMPQKGERITAMFSATFPRDIQILAQDFLMPEYVFLAVGRVGSTSENISQKVVWVEEHNKRHFLMDLHNKRHFLMDLLDASEPEALTLIFVETKRGCGDLSYMLQQEGYHCVAIHGDLKQMERGDLSYMLQQEGYHCVAIHGDLKQMERERHLENFRNGTAPILVATAVAARGLDIPNVKHVINYDLPNDIDEYVNDIDEYVHRIGRTGRVGNIGMATSFFNDKNRNIMATSFFNDKNRNISHELTSLIVEANQELPDWLEEMARDSGRHGGVGGRSHLGAGSKRGGGGNRRGKATFYSHYYGIFYCQRPSCSN

SEQ ID NO: 121033 - protein, 207 aa, Heterodera glycines
  misc_feature (10)..(10): Xaa can be any naturally occurring amino acid
  Coding regions on vcDNA: vcDNA=SeqID_47456; Strand=-; Position=1 -39,270-433,489-558,648-771,822-979
  Homolog annotation: Hit_ID=NP_505950.1; Match level="QueryCoverage =94%, HitCoverage=32%, E-value=3e-68, Identity=69%"; Hit description =mammalian SKi Interacting Protein homolog (60.2 kD) (skp-1) [Caenorhabditis elegans] emb|CAA98552.1| Hypo
  Essential gene: C elegans homolog=T27F2.1; Phenotype=Egl,Lva,Mlt,Pvl
KVVLALSNYXNSFAAALPVQHAKKTAPAQYIRYTPSQQSGLNAGGAQQRIIRLVEEQKDPMEPPRFQINQKIPRINQKIPRAPPSPPAPVMHSPTRKVSAKEQADWKIPPCISNWKNPKGYTVALDKRLAADGRGLQQVHINENFAKMAEALSIAHINENFAKMAEALSIAERKAREAVETRAQMERRIAQNKKCEGGKANARVAQN

SEQ ID NO: 121034 - protein, 384 aa, Heterodera glycines
  Coding regions on vcDNA: vcDNA=SeqID_47457; Strand=-; Position=1 -103,173-289,419-1353
  Homolog annotation: Hit_ID=NP_508269.1; Match level="QueryCoverage =89%, HitCoverage=50%, E-value=2e-35, Identity=29%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MSTLKKIDKASEDGLEGGLSLFDIPPTNVAINKSNNQFCDLNKTFLYLSTSIERKDKSNWIPITKDSEADQHVEDVKKGLCEASCYYVDDVDQDDYTNSGFKNRASRFADGAKCETMVKLNFDLARQPNLLLNNSDVIFSIHRNTDDFLIMAPPYVSGNAVIANPHTYRINIHDIRIYVKTVDITQSLNNVISNQLQTTPAKYPVRKIEIRSLFIPRGTSDLSHNVFTSIVPRRLIVGFVSTGAYTGNPKESPFVFEHAKIRSISVEANGNIFPGSPYSLNFDRNKYIRAFVDMYTGLGMDDGERTMSINIQKFVNGWCFFVIPMTSTLEDTPGFELIRNGTTSIKVQFNEPIKDGGYEMIVLGEFDSILSINANRVLSSDGSI

SEQ ID NO: 121035 - protein, 189 aa, Heterodera glycines
  Coding regions on vcDNA: vcDNA=SeqID_47458; Strand=-; Position=1 -320,368-618
  Homolog annotation: Hit_ID=XP_321040.1; Match level="QueryCoverage =100%, HitCoverage=4%, E-value=1e-26, Identity=34%"; Hit description =ENSANGP00000022463 [Anopheles gambiae]
  Essential gene: C elegans homolog=T21E12.4; Phenotype=Emb
RELIAALVKRKRVPDNWLQFSVPKDVTALEWMRDFVQRMEQLKRLSLSENLRYEEVWLGGMFFPEAYITATRQLIAQTNGWSLEQMYMHITKTEEVQLKSTAFTLTDLRAIGVLCEADEIKLTDEVHVGVPRLQFTWTLEGHSPASVVVPVYLYSNRAKFLFGLNLLPIGFDHSMLSQRGVAFVSNCSL

SEQ ID NO: 121036 - protein, 336 aa, Heterodera glycines
  Coding regions on vcDNA: vcDNA=SeqID_47459; Strand=-; Position=130 -419,476-743,810-946,1098-1413
  Homolog annotation: Hit_ID=NP_491278.1; Match level="QueryCoverage =50%, HitCoverage=49%, E-value=1e-25, Identity=38%"; Hit description =CD45 family member (1E541) [Caenorhabditis elegans] gb|AAB52356.1| Hypothetical protein F47B3.1 [Caenorha
  Essential gene: C elegans homolog=K07F5.8; Phenotype=Stp
MSGRSGRSGKRRQDGPGRPSRSRQQQHTQRGVQSAYQGPREPPEQPTVRGWEDTRDFCSALKIFVNETTRRNVKELVNEYTELNAMPRPETSPEFTRHMDCNRYRDVICAEQGRVRLDNGRYIHANWITALGEQRFICTQGPLETTCADFWTMIVQENIESIVMLCDTVEQNKTKCHQYWPTPDKKQLHFANKTITVHFIEETALEPDLYRTKLAVLFPNGSMRVHHFHWRRNRTDWNTGGAAHCLQYSAAWTSAQHPHVGAQPPSASGPKCADPGPIPLHILRDFAVGFLFEFVCLNNHPPPPLSYAQNKAAKLNIDERALTTFLREMDERMTRS

SEQ ID NO: 121037 - protein, 301 aa, Heterodera glycines
  Coding regions on vcDNA: vcDNA=SeqID_47460; Strand=-; Position=1 -143,207-474,541-775,828-993,1049-1142
  Homolog annotation: Hit_ID=NP_491278.1; Match level="QueryCoverage =82%, HitCoverage=72%, E-value=4e-46, Identity=40%"; Hit description =CD45 family member (1E541) [Caenorhabditis elegans] gb|AAB52356.1| Hypothetical protein F47B3.1 [Caenorha
  Essential gene: C elegans homolog=K07F5.8; Phenotype=Stp
NSTLCSAFQPQRTQQTRITSPRTVQDLVSEFTELNAAPQPVPSPEFTRNVECNRYRDVICTEINRVRLHTGRYIHANWITTFGENRFICTQGPLETTCDDFWTMIVQENIESIVMLCDTIEQNKTKCHQYWPTPDKKQLHFANKTITVHFIEETALEPDLYRTKLAVLFPNGSMRVHHFHWRRWPDRGVPQNDLAPLRLLFHVQQFRRSVVHCSAGIGRTGTLVALHIAYDTLQRGHRLNILALARNLRQHRAQSVQTLDQYLYIYYVILRYAQNKAAKLNIDERALTTFLREMDERMTRS

SEQ ID NO: 121038 - protein, 211 aa, Heterodera glycines
  misc_feature (23)..(23): Xaa can be any naturally occurring amino acid
  misc_feature (37)..(37): Xaa can be any naturally occurring amino acid
  Coding regions on vcDNA: vcDNA=SeqID_47461; Strand=+; Position=1 -338,743-875,945-1032,1329-1356
  Homolog annotation: Hit_ID=CAE57679.1; Match level="QueryCoverage =77%, HitCoverage=26%, E-value=2e-52, Identity=64%"; Hit description =Hypothetical protein CBG00673 [Caenorhabditis briggsae]
  Essential gene: C elegans homolog=K01C8.9; Phenotype=Lva
SSISKKNSPPPPSKNFFASLPQXNFISHFLKINPTLXKNFPICQVLDARDPLGSRSAQIEQLVLDSGKRLVLLLNKIDLVPRDNLLKWLAHLRRQLPTIAFKASTQQQTQKLGQYQSANLSGTFSAKCIGADLVMKLLANYCRNKDIKTSIRVGIVGFPNVGKSSVINSLKRRFPNVGKSSVINSLKRRKCCQTGAMPGLTSFLKTNVLNN

SEQ ID NO: 121039 - protein, 218 aa, Heterodera glycines
  Coding regions on vcDNA: vcDNA=SeqID_47462; Strand=+; Position=1 -329,385-566,1057-1202
  Homolog annotation: Hit_ID=NP_504166.2; Match level="QueryCoverage =65%, HitCoverage=39%, E-value=1e-37, Identity=57%"; Hit description =RNA polymerase (41.2 kD) (5E681) [Caenorhabditis elegans] gb|AAL38961.1| Hypothetical protein H43I07.2 [C
  Essential gene: C elegans homolog=H43I07.2; Phenotype=Lva
MQLPNLLFVFFESVSKGKKKRGKGGNVSQKEGQQQIGSGSDSEEGAVGAKASGGCIRERGGSGNWVVYTSAFGWKPSGEQRTQIAKDPPRLVHGDIILAKLRPGQEIEASCHCVKGIGRDHAKFSPVATATYRLLPQIKLKKDNFDEEQAARLQSSFSTGVIGRDEQTGRVYVRDARADTSSRNVFIHDDLKDAVEMGKKKTHFICKANTKLFALKCS

SEQ ID NO: 121040 - protein, 171 aa, Heterodera glycines
  Coding regions on vcDNA: vcDNA=SeqID_47463; Strand=-; Position=1 -233,288-382,721-908
  Homolog annotation: Hit_ID=NP_497587.1; Match level="QueryCoverage =79%, HitCoverage=81%, E-value=7e-12, Identity=31%"; Hit description =lung cancer metastasis-related protein like (3D691) [Caenorhabditis elegans] gb|AAF36035.1| Mediator prot
  Essential gene: C elegans homolog=Y71H2B.6; Phenotype=Emb
MRVFPSYAFIQMVLLCLFSHIALAQSQLLGSDDLIALFDLSGAYNRYCGVKKPREDLASFLPHVCAGSHINKKADSQCSLRKLIEDPPIMGREINNLNASQMVGFKLTPEVERKAKKAKSGGAEENGGREKEKKRKKEKKKKKKDREKRTEDEGTKRSGGETKRETVMPFF

SEQ ID NO: 121041 - protein, 172 aa, Heterodera glycines
  Coding regions on vcDNA: vcDNA=SeqID_47464; Strand=+; Position=1 -172,218-375,1066-1254
  Homolog annotation: Hit_ID=AAR16088.1; Match level="QueryCoverage =59%, HitCoverage=12%, E-value=6e-36, Identity=72%"; Hit description =phosphofructokinase [Ascaris suum]
  Essential gene: C elegans homolog=Y71H10A.1a; Phenotype=Emb
MPSAQMVDNIKQSANGSKRRVFLIETMGGHCGYLATVSAIATGADNAYIFEEKFTVDDIKEDVKVISQKMQKGVQRYLIVQSEGASHNYDTTFVQKLFSEEGKGEASAINSTGLLSSILDGKAELTEQQQEISRSINAITADEVLVKEFLELMNEVEKKKCRRSNSETPLVT

SEQ ID NO: 121042 - protein, 555 aa, Heterodera glycines
  Coding regions on vcDNA: vcDNA=SeqID_47465; Strand=+; Position=1 -150,204-277,318-441,563-663,727-856,907-1102,1151-1278,1616 -1696,1736-1825,1872-2155,2220-2526
  Homolog annotation: Hit_ID=NP_506193.1; Match level="QueryCoverage =99%, HitCoverage=50%, E-value=1e-103, Identity=36%"; Hit description= yeast mitotic condensin subunit SCC homolog (124.8 kD) (scc-3) [Caenorhabditis elegans] emb|CAA99836.1|
  Essential gene: C elegans homolog=F18E2.3; Phenotype=Emb
MKLSSSIVDVVVELVELKDKNAIQIDTEKARIVHGTTNERLERLLQAKNELDNKIDELSSMLQYIFKCVFVHRYRDQVADFRIICISELGVWIRIYPALFLDDSYLKYIGWSLFDKLFTHKFKDRLVSMVLDTDVEVATKTCQLMTHIYRAFPALLDPGACVPLYELVYCNNRQLATAAGEFVNAKLFSTAADNSLLTSSTSLLTPPAENRQLIKDLVTFFIDGAVHRHPAYLVDSLIDICPMLKDWSTMVDILLSDEFDQFDTQLISIMCAAVKHAATGEHPPNRIVVSIRRGPGAGTEKKDLRMLHDGRVHLSEVFIPKLPRLLQKFIADQEKVRDLIGLFLYFELEIYSVSRHDQPLYDLMMLLERIVEQYSNDEIASNIASVFQFISTNMTLARSTETNRCRIVDGVVQNLRQQLQVFLANEEDEDQQLDEEDEAALLSAFRKMVAFASTIDVPVNVEFWDMCMALFQNSHRFRSADLVEKAMLLCFLLLSWEMKRFVAAQEHGEVNSARFYSFLFILTDKETIETLKKKRDQFLRTTKSILRDFAIGVET

SEQ ID NO: 121043 - protein, 401 aa, Heterodera glycines
  Coding regions on vcDNA: vcDNA=SeqID_47466; Strand=-; Position=1 -94,1503-2638
  Homolog annotation: Hit_ID=NP_498506.1; Match level="QueryCoverage =98%, HitCoverage=68%, E-value=6e-69, Identity=38%"; Hit description =RNA-directed DNA polymerase family member (3I9) [Caenorhabditis elegans] gb|AAA21080.1| Hypothetical prot
  Essential gene: C elegans homolog=ZK250.3; Phenotype=Clr,Lvl,Sck
FSVPLSVLFHFLFSSISFSVPLFVSLSLPLHHATKSKHSNHYHRLACLHPFNFLFFFLLFGNTDQKCLSSLFRALRTRTQTTLVSFESQEFVDVHKTRIYIDFQKAFDSVPHNLLLYKLEKIGIRGKLLMWIKSFLSNRTFHVKIGDALSSNKKVGSGVPQGSVLGPLLFLVYINDLPDALPSGVKIKLYADDVKLYISDTEIMHKALHNLFEWANKWQIKVSIQKTFVLYLGSKNPKETYKFDGNTINAVDTIRDLGVNIDNKLQFSDHINQITRNAYLRMRSLFRIIKSKSSKIWITLYKTYIRPLLEYAPEVWNPSLQKNIKKIEKCQKYFTKRVFFKCSLPPIPYQNRLEYLQLPTLENRRKLFDLFMAHKIVYGRTDLKLFSIFNPSTRFNIPFYR

SEQ ID NO: 121044 - protein, 327 aa, Heterodera glycines
  Coding regions on vcDNA: vcDNA=SeqID_47467; Strand=+; Position=1 -145,205-269,1330-1617,1673-1778,1827-2004,2079-2280
  Homolog annotation: Hit_ID=CAA79619.2; Match level="QueryCoverage =98%, HitCoverage=79%, E-value=6e-45, Identity=33%"; Hit description =Hypothetical protein F02A9.4b [Caenorhabditis elegans] sp|P34384|YLPD_CAEEL Hypothetical protein F02A9.4b
  Essential gene: C elegans homolog=F02A9.4b; Phenotype=Lva
MDNALIVQALTDKSYFTRNDLDDEAMGDDGPLTTEVARDKSNDQLVEKGMPLFRHIVLTYLRAHWPLAPEEFIIAVATRIAPTSALAELATQLGLHHVVRTAEFPPTQQTLQSTLLALIGAMDVAKARDFVRRFVLPRLYEVPLEDVLPFRHPFAVLGDYLRKWQGATDIEPRTIGSGAVMTATPFYEVAIYVDKQQIVGQSGGEFPWVALDLAAQNGLLRLWRVADHPRVFPFKFEEVYATRFEQAQQRNHRLSDVCGENTDLSLYTPEELARDPIDMVDMCNQYYTKIRPDVGIPLRRRQRHKFSRGTISRLSRRFLVKPTIFNI

SEQ ID NO: 121045 - protein, 183 aa, Heterodera glycines
  Coding regions on vcDNA: vcDNA=SeqID_47468; Strand=-; Position=1 -10,100-206,260-451,808-1050
  Homolog annotation: Hit_ID=NP_495454.1; Match level="QueryCoverage =82%, HitCoverage=25%, E-value=2e-61, Identity=71%"; Hit description =lysyl (K) tRNA Synthetase (krs-1) [Caenorhabditis elegans] gb|AAK68395.1| Lysyl (k) trna synthetase prote
  Essential gene: C elegans homolog=T02G5.9a; Phenotype=Emb,Lva
MTLEARDFFDRIATEHGVDCTQPRSCARLLDKLIGEFIEPKLINPTFLTGHPQIMSPLAKWHRSRPGLTERFELFACTKELCNAYTELNDPLRQRELFEQQAKAREAGDDEAQAVDENFCTALEYGLPPTAGWGMGIDRLTMMLTDSHNIKEAKIIFENEKFVKKNFIEILQKKKKNYVGFEF

SEQ ID NO: 121046 - protein, 320 aa, Heterodera glycines
  Coding regions on vcDNA: vcDNA=SeqID_47469; Strand=-; Position=1 -81,137-382,433-679,733-971,1023-1172
  Homolog annotation: Hit_ID=AAO85519.1; Match level="QueryCoverage =97%, HitCoverage=94%, E-value=1e-77, Identity=46%"; Hit description =putative serine/threonine phosphatase [Oesophagostomum dentatum] gb|AAO85518.1| putative serine/threonine
  Essential gene: C elegans homolog=W09C3.6; Phenotype=Ste
MAVPFSLQVDGLIYRVRNSTYGQFPLDVTEHDLRQLCDATMDVFRQQQTLVRIQPPVNVCGDIHGQFTDLLRIFSTLGPPPEKKYLFLGDYVDRGPQSLETVVLLFCYKVKYPESVTLLRGNHECSNINRVVSRATFNWQRMALIQPCFRYGFYSEIEQRYHQADTRRLFDMFNQTFAWMPYVGLIGDRILCMHGGISDRITSLQQLNELRRPLLTLPSPSLEMDLLWADPMLDIRGVEPSPRGAGVVFGEDVVFRICELLNLNYIIRAHELVHEGIEYFADERLVTVFSVPRYHNQMNTGAALTIAEDLSHDVTFFPPN

SEQ ID NO: 121047 - protein, 320 aa, Heterodera glycines
  Coding regions on vcDNA: vcDNA=SeqID_47470; Strand=+; Position=1-962
  Homolog annotation: Hit_ID=EAA16908.1; Match level="QueryCoverage =96%, HitCoverage=63%, E-value=1e-44, Identity=37%"; Hit description =Drosophila melanogaster CG8797 gene product-related [Plasmodium yoelii yoelii]
  Essential gene: C elegans homolog=M88.5a; Phenotype=Sck
MPGAPFHKVTKENYVIEQVHSVMMQLSVINIKQVVESGPKLVTTTRIVYPPAQQQPLGAQPQTQQIPRQQQNQPKGQWQAKPEQQQQQQQRKIQPQQDGQAQQQQQRQPPPQVPFKTQHQKMAQPTQPPQRQEQYAVQQQPQQHEQYPMQQQPKQQQQAQQYSIQPQLQQPVQQVQKPQNFAKQHQYVHQQVQFQQPQPQQQYEHPQHATEREQHQQAQQYVMKQQQQTQQKQPQRVQIVGQMQLGQIEQQQQRGGGGQQPEQQQKQAVVGQQQQQKENGQAKQQPKQGQFGQEEEQQYNKQKSNRNGTTAQQMNNPIRS

SEQ ID NO: 121048 - protein, 206 aa, Heterodera glycines
  misc_feature (3)..(3): Xaa can be any naturally occurring amino acid
  Coding regions on vcDNA: vcDNA=SeqID_47471; Strand=-; Position=1 -226,275-406,884-947,1028-1195
  Homolog annotation: Hit_ID=NP_496208.2; Match level="QueryCoverage =86%, HitCoverage=85%, E-value=2e-38, Identity=45%"; Hit description =mitochondrial 40s ribosomal protein s14 (23.4 kD) (2K532) [Caenorhabditis elegans] emb|CAA88746.2| Hypoth
  Essential gene: C elegans homolog=T01E8.6; Phenotype=Lva
CMXLHSCFFNLMEMTLNHETVPCLKASSSASGGPPPPSLEAAAEFPSASDETEEPLQAERKRYDYNSETLRELGYDKYPYYVERAYDKYPYYVERAWWKEGHRMTFWPHWRQLADIKRRRLVAEWGPMRMRYKAMKTNNILPRVIIDEFQERMDNMPRRAHPVLIIQMCQFTSKRRGKLNKFRVSRHCFRDIADRGGLSGIQRGIW

SEQ ID NO: 121049 - protein, 165 aa, Heterodera glycines
  Coding regions on vcDNA: vcDNA=SeqID_47472; Strand=+; Position=1 -173,636-960
  Homolog annotation: Hit_ID=CAE66853.1; Match level="QueryCoverage =75%, HitCoverage=12%, E-value=9e-19, Identity=41%"; Hit description =Hypothetical protein CBG12225 [Caenorhabditis briggsae]
  Essential gene: C elegans homolog=C25A1.7; Phenotype=Gro
MASVRWIGPPAVSTRARPVHVYAMVWTTTPWTLPMNNAVAVNRAVEHYALVDFPKDRRFRIIRDLYIVAVEMVPHIAAEFGHEIAVLGTVSGAQLADSGLFYSNAWANNIQALPVLAAPFVSPSAGTGLVHVAYAHGQDDFEAIIFSLFGGEWRKIQAPPLEIEK

SEQ ID NO: 121050 - protein, 150 aa, Heterodera glycines
  Coding regions on vcDNA: vcDNA=SeqID_47473; Strand=+; Position=1 -150,473-597,776-839,1188-1307
  Homolog annotation: Hit_ID=CAE66853.1; Match level="QueryCoverage =90%, HitCoverage=14%, E-value=9e-38, Identity=55%"; Hit description =Hypothetical protein CBG12225 [Caenorhabditis briggsae]
  Essential gene: C elegans homolog=C25A1.7; Phenotype=Gro
DSGLFYRTWANNIQALPVLAAPFVSPSAGTGLVHVAYAHGQDDFEAIIEGKQYIQCFVDERGRYTREMGHELCWKEVLGDGQRAALKRLQFDVLHQSEYVHSYPYDWRTNQPVIIRCCPQWFIDVKEVNKRCLAATDDAPAVQIASGCQG

SEQ ID NO: 121051 - protein, 58 aa, Heterodera glycines
  Coding regions on vcDNA: vcDNA=SeqID_47474; Strand=-; Position=1 -54,642-764
  Essential gene: C elegans homolog=K04G7.4a; Phenotype=Lva
MANRADWTSPDFCSLLIYSSIAKELADALGFYYMPAFKMDDILVDRYNNDMRDYYHLV

SEQ ID NO: 121052 - protein, 475 aa, Heterodera glycines
  misc_feature (92)..(92): Xaa can be any naturally occurring amino acid
  Coding regions on vcDNA: vcDNA=SeqID_47475; Strand=-; Position=1 -63,173-550,842-1061,1104-1187,1230-1552,1593-1686,1782-1819
  Homolog annotation: Hit_ID=CAE71465.1; Match level="QueryCoverage =89%, HitCoverage=76%, E-value=8e-61, Identity=33%"; Hit description =Hypothetical protein CBG18383 [Caenorhabditis briggsae]
  Essential gene: C elegans homolog=D2045.9; Phenotype=Gro,Rup,Stp,Unc
QNNNLLLLQILTLFFTVLCLISGFPPGEGDYRHLYPRLCVTIKINDHKHVLSYFMGMVEDFRWPKVRLSEKYIYAFTNCQLFLGSDAHSFLXRKTNFNFGVRSAKVHNFSFLIFRDGKIPSRFLSTDFAQRQIRNWREESLLFGRPTLINLNKMDSSYLTFDQGNIVNYHGNGHPIDVFAFSAYAMNIPIFFSNLHNYGYFISPNSLSKSEQMAVVCHLADWVSNVGPMPFPVSSVLQPWYPVPLADWVSNVGPMPFPVSSVLQPWYPVPIKFGFDQVYLINLRRRPQKLEKMREVIKFGFDQVYLINLRRRPQKLEKMREVLHLVGLDFTHFEAVDGQNLTEHELSAIHFLPGFEDPYYKRPMKRGEIGCFLSHFKIWEEIVRNGHQRAVVLEDDVRFSPNGTLILQKTMEDLTKTRLDWDLIYLPNGTLILQKTMEDLTKTRLDWDLIYLGRKRIGTDETFMVLENRFLSTVA

SEQ ID NO: 121053 - protein, 70 aa, Heterodera glycines
  Coding regions on vcDNA: vcDNA=SeqID_47476; Strand=+; Position=1-315
  Homolog annotation: Hit_ID=NP_498774.1; Match level="QueryCoverage =100%, HitCoverage=43%, E-value=6e-13, Identity=51%"; Hit description= ribosomal Protein, Large subunit (18.3 kD) (rpl-21) [Caenorhabditis elegans] gb|AAA27951.1| Ribosomal pr
  Essential gene: C elegans homolog=C14B9.7; Phenotype=Emb
RVEHVKPSGSRLEFLQRCKANDLQKKQHKEGNAPFVALKRKPKEPRGAHLVKVKSTKVERLAPVKFEIVA

SEQ ID NO: 121054 - protein, 88 aa, Heterodera glycines
  Coding regions on vcDNA: vcDNA=SeqID_47477; Strand=-; Position=1 -146,197-286
  Homolog annotation: Hit_ID=P02269; Match level="QueryCoverage=94%, HitCoverage=58%, E-value=5e-29, Identity=79%"; Hit description =Histone H2A pir||HSSF2 histone H2A - starfish (Asterias rubens)
  Essential gene: C elegans homolog=T23D8.6; Phenotype=Emb
PVYLAAVLEYLASDVLELAGNASRDNKKTRINPRHLQLAVRNDEELNKLLSGVTISQGLLSGVTISQGGVLPNIQAVLLPKKTQHGES

SEQ ID NO: 121055 - protein, 240 aa, Heterodera glycines
  Coding regions on vcDNA: vcDNA=SeqID_47478; Strand=+; Position=1 -193,329-451,806-931,983-1068,1139-1333
  Homolog annotation: Hit_ID=EAL26506.1; Match level="QueryCoverage =92%, HitCoverage=19%, E-value=4e-26, Identity=33%"; Hit description =GA18068-PA [Drosophila pseudoobscura]
  Essential gene: C elegans homolog=D1007.7; Phenotype=Emb
MTIVGKRGSAVNAISRSPFGDDKDSRRSVSPPGTKRVRNGGGGGDDDSARRNDRDSKRSGGRRERTARHDEEERDRSDRDRERDHQERERRRIGLPGKPKSDHVLIGSRTLWFGRIPSGATESDIIDSVKEIGLPEKVSLVFGRGCAYVTMPDRKLAFKILDRLAKNIRVQSKNVKVDWATIPYLKDNMQLMDAYWDLKQGYAQIPFSKLPDGTVDSLMDGAWLELDTLPAHLRGENFQV

SEQ ID NO: 121056 - protein, 469 aa, Heterodera glycines
  Coding regions on vcDNA: vcDNA=SeqID_47479; Strand=+; Position=1-1410
  Homolog annotation: Hit_ID=NP_508269.1; Match level="QueryCoverage =97%, HitCoverage=64%, E-value=1e-39, Identity=25%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MSIIKKIDKDSVEGLEGSLSLFNLPPTNVAINKTSVRELLPLSALNQTGPYLFRLFSDSQYCDLSKTYMYLLTSIERKNAAGEWVPTDDAIEEDKHVGVIQNFGSSFVRSLKVNISGVEVFDSSIYYHYRAYIMQELGYSHEIRKAFHEAGCYYPDENSQDSYSNKGFTSRAQRFSNGKQCETMVKLNFDLARQNTLLLNNQDVVFTIHRNSDPFLLLTPKWKTVTDAVKDAQGNIITAARVTWHDNTAEYRIRLHDIRLYVRTVDVTSSLNIAISRQLESTPAKYALRKVEMRSIFLGMGRTELSHNVFTSTLPRRLICAFVSTDAYSGARHLSPFNFEHANVRSISAEANGLTFPSTPYLLSFGNQKKFVRAFVDMYAGLGLDDSDNKTVSISMARFLSGWAFFVIPMTSTLDDTPGFELIRQGTCTVKVQFEQPIKADGYEMLILGEFDSVLSINADRVLSTDGSV

SEQ ID NO: 121057 - protein, 117 aa, Heterodera glycines
  Coding regions on vcDNA: vcDNA=SeqID_47480; Strand=-; Position=1 -127,174-288,789-899
  Homolog annotation: Hit_ID=NP_499882.1; Match level="QueryCoverage =90%, HitCoverage=32%, E-value=3e-23, Identity=44%"; Hit description =farnesyltransferase (38.5 kD) (4A992) [Caenorhabditis elegans] gb|AAB94144.1| Hypothetical protein R02D3.
  Essential gene: C elegans homolog=R02D3.5; Phenotype=Pvl,Rup,Unc
MNSSSVGYIPLLYRDRPEWRDVTPIYNSAEENAVVRIATSEEFDDAFAYLRAVMNANELSERTLELTQTCIAQNPANYSVWHNRKTLVDESGIYAAELPFIAQQLHDEPKNYHAWQH

SEQ ID NO: 121058 - protein, 335 aa, Heterodera glycines
  Coding regions on vcDNA: vcDNA=SeqID_47481; Strand=+; Position=1-1012
  Homolog annotation: Hit_ID=NP_510671.1; Match level="QueryCoverage =87%, HitCoverage=29%, E-value=3e-52, Identity=37%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
KIDIIYLDLQKAFDQVPHDLLIYKLKKTGITGNLLNWLQDFLLGRTFKVRINQKFSNEFPAKSGVPQGSVLGPILFLIFINDLPEKIPKEISIKLFADDTKIYHCYSNESQRKVLETALISVFNWAETWGLYFSVKKSSVLYLGKNKKKIPYTIKHATIPESKIIRDLGILIDNKLKFNEQFSIILQKAYLKSRILFKKIKTKSTKTWITVYKSFIRPLLEYATEIWNPRTKKEINRLENFQKNFTKNVFRKCCLPYISYSERLKFLKLSKLETRRKYLDIITAFKIIKNTTHLNPKNLYNFSNRKITFILVTKRKITKTEHSFTNRTTKHLQEI

SEQ ID NO: 121059 - protein, 96 aa, Heterodera glycines
  Coding regions on vcDNA: vcDNA=SeqID_47482; Strand=+; Position=1 -82,129-151,210-392
  Homolog annotation: Hit_ID=CAE59707.1; Match level="QueryCoverage =94%, HitCoverage=22%, E-value=5e-26, Identity=63%"; Hit description =Hypothetical protein CBG03139 [Caenorhabditis briggsae]
  Essential gene: C elegans homolog=F36A2.3; Phenotype=Egl,Unc
MALPIYSHGLNRLCIYIEDVASGVKGDGEPKVLKQKGATAWVDGCDLLGAVVGNFCTELAIKLAKEHGIGWVVCKRSNHYGICQHYAKKIANAGLL

SEQ ID NO: 121060 - protein, 155 aa, Heterodera glycines
  Coding regions on vcDNA: vcDNA=SeqID_47483; Strand=+; Position=1 -157,549-751,874-981
  Homolog annotation: Hit_ID=CAE63049.1; Match level="QueryCoverage =21%, HitCoverage=25%, E-value=3e-09, Identity=82%"; Hit description =Hypothetical protein CBG07320 [Caenorhabditis briggsae]
  Essential gene: C elegans homolog=C31E10.7; Phenotype=Gro,Lvl,Unc
MKRPFASQFRIGTRPSLPHSLPFAPLQNRMACRIWRSVERSGTEVARANPSRCLPAHGPNGNGVAANQRQQEEEASQFGSKCSFLGFEIQAESTGYIIGGAVVVGVLIVVFAIFAIVVFGVYDVTKFLDEHPGGMEVLMEKAGEDRTEAFEDIGK

SEQ ID NO: 121061 - protein, 129 aa, Heterodera glycines
  Coding regions on vcDNA: vcDNA=SeqID_47484; Strand=+; Position=1 -114,168-284,363-521
  Homolog annotation: Hit_ID=NP_500466.1; Match level="QueryCoverage =79%, HitCoverage=42%, E-value=6e-31, Identity=59%"; Hit description =proliferating Cell Nuclear Antigen homolog (29.0 kD) (pcn-1) [Caenorhabditis elegans] pir||T28761 hypothe
  Essential gene: C elegans homolog=W03D2.4; Phenotype=Emb,Ste
MFEAKFTNAALLKKIVEAIKELVSEAPFDCTENSMCLQAMDGSHVALISLKLDIGLFEVFRCDRTIALGLSMGELSKDTLMIRFEDSEQDMVTFTFEDTKGRKQDMGGNSSAVSPILLAAVYHTFHQQK

SEQ ID NO: 121062 - protein, 155 aa, Heterodera glycines
  misc_feature (104)..(104): Xaa can be any naturally occurring amino acid
  Coding regions on vcDNA: vcDNA=SeqID_47485; Strand=-; Position=1-633
  Homolog annotation: Hit_ID=BAA88337.1; Match level="QueryCoverage =96%, HitCoverage=15%, E-value=6e-19, Identity=36%"; Hit description =ORF2 [Platemys spixii]
  Essential gene: C elegans homolog=ZK250.3; Phenotype=Clr,Lvl,Sck
KTIIRMYKTYVRPQLEYAVEIWNPNLKKDIERIEKVQKFFTRKAFKKCGLLHRSYSERLEICQLIELAKRRNIADLTTAFKIMKGFTSLDASKLFTFSDRPHSXPLLLRMRRTTTKSKNNFFNRIAKNWNKLPIVPIQADKANQFRALLKAMYEF

SEQ ID NO: 121063 - protein, 89 aa, Heterodera glycines
  Coding regions on vcDNA: vcDNA=SeqID_47486; Strand=+; Position=1 -118,941-1093
  Homolog annotation: Hit_ID=NP_500627.1; Match level="QueryCoverage =98%, HitCoverage=48%, E-value=1e-23, Identity=63%"; Hit description =inner mitochondrial membrane (4F508) [Caenorhabditis elegans] gb|AAB92039.1| Hypothetical protein E04A4.5
  Essential gene: C elegans homolog=E04A4.5; Phenotype=Emb,Lva
LLNIAREVRMRSPVTGSQFAAWGGMFSVIDCGLVYMRRKEDPLNSIAAGGLTGGLLCARMGWKTALVSAGFGAVILTMIEGVGILMNRD

SEQ ID NO: 121064 - protein, 223 aa, Heterodera glycines
  Coding regions on vcDNA: vcDNA=SeqID_47487; Strand=+; Position=1 -188,296-427,511-623,710-945
  Homolog annotation: Hit_ID=CAE60343.1; Match level="QueryCoverage =71%, HitCoverage=23%, E-value=1e-42, Identity=54%"; Hit description =Hypothetical protein CBG03935 [Caenorhabditis briggsae]
  Essential gene: C elegans homolog=C30F12.1; Phenotype=Unclassified
MPCAFRGGRRIVCHDDRYILKTAAEKQAVIVSNDEYRDLVRENPRWRAVVENLLLMYSFVDGKFMPPDDPLGRRGPKLDQFLTFAHTPLNAQLCPYAKKCTYGNKCKYFHPERVNGVWISATERLASRIANGIGIENSKQLLAARPSMIAEHSQRQNASSSSSSLLPTTVRHNNVGRTRSLNCGGGVTVAPPLLVGLASPTTAQMEDEQRSKQREENQQTSIT

SEQ ID NO: 121065 - protein, 118 aa, Heterodera glycines
  Coding regions on vcDNA: vcDNA=SeqID_47488; Strand=+; Position=1 -8,408-588,642-809
  Homolog annotation: Hit_ID=NP_498605.1; Match level="QueryCoverage =96%, HitCoverage=56%, E-value=1e-38, Identity=64%"; Hit description =snare protein Ykt6 (23.2 kD) (3I376) [Caenorhabditis elegans] gb|AAK18869.1| Hypothetical protein B0361.1
  Essential gene: C elegans homolog=B0361.10; Phenotype=Lva
MCRYQSRVAFTLLNKVLSDFAERILELEWKRMSGESDCSYSELPGFLTRWQNPREADALTRVQDEVEETKAVLHTTMQAVLERGEKLDDLIKASENLSDQSKMFYTQARKMNKCCSYT

SEQ ID NO: 121066 - protein, 95 aa, Heterodera glycines
  Coding regions on vcDNA: vcDNA=SeqID_47489; Strand=+; Position=1 -50,103-206,250-383
  Homolog annotation: Hit_ID=CAE69444.1; Match level="QueryCoverage =85%, HitCoverage=82%, E-value=8e-32, Identity=77%"; Hit description =Hypothetical protein CBG15632 [Caenorhabditis briggsae]
  Essential gene: C elegans homolog=C09G4.3; Phenotype=Emb
MSNEFYYSNKYEDDEYEYRHVHVTKEVAKQVPHNRLMSESEWRSLGIQQSPGWVHYLIWPAERHILLFRRPKPKVNGAQKTMMKTTANPSQVRVG

SEQ ID NO: 121067 - protein, 355 aa, Heterodera glycines
  Coding regions on vcDNA: vcDNA=SeqID_47490; Strand=-; Position=1 -169,214-266,329-1174
  Homolog annotation: Hit_ID=AAC95573.1; Match level="QueryCoverage =54%, HitCoverage=33%, E-value=6e-14, Identity=27%"; Hit description =orf 48 [Ateline herpesvirus 3] pir||T42963 hypothetical protein 48 - ateline herpesvirus 3 (strain 73) ref
  Essential gene: C elegans homolog=Y55B1BR.3; Phenotype=Emb
MIFLLVKCDEMLYRSIIDEMWAKLEELKRNDRRGIQDVTLIWPFVKEFVEEIGAWRERQQQSKKDFFIRRAFQETKNASPPVLVTIASPDLVDDEPKSLTALRKRRSVEAQQSPNSSVLFVGSVGGCTPKMLNWTLKREEKRCENEQSKKRRTEDETEQRKNKTEKAVKQEVIEVDEQNKEETATKEAAGKELTSATHSQLNVGMASKAVTLDMDKWTEKATRGEEIEKGGIEEEDDSDVYTLSFGDKTMFEIVEDSPQNEPKTDETQPLKEVKREPEESGRKEDENRTEDEPGRGEEEEEMNSEEEDEEEGEEQSDEEEGEGTGSERTGASPPPPPTPADKTLARPYSPIKSPG

SEQ ID NO: 121068 - protein, 142 aa, Heterodera glycines
  Coding regions on vcDNA: vcDNA=SeqID_47491; Strand=+; Position=1 -117,1611-1919
  Homolog annotation: Hit_ID=CAG07630.1; Match level="QueryCoverage =97%, HitCoverage=10%, E-value=7e-14, Identity=33%"; Hit description =unnamed protein product [Tetraodon nigroviridis]
  Essential gene: C elegans homolog=T05A10.3; Phenotype=Ste
MLKECEENIKAAEEAMEKQRLYEENVRLGRVKKKGRRSLAELKRDKKEAKKRARQQQKEQRKREREERRQQRKLAAATTAQNGVGTGAETEEMAERRRQRKEQRREAKLAEREERRRHKMQQQQQKQRHKEEKQQHQQQRTK

SEQ ID NO: 121069 - protein, 111 aa, Heterodera glycines
  Coding regions on vcDNA: vcDNA=SeqID_47492; Strand=+; Position=1 -63,290-397,626-790
  Homolog annotation: Hit_ID=CAG17417.1; Match level="QueryCoverage =47%, HitCoverage=34%, E-value=3e-10, Identity=60%"; Hit description =Histone [Cotesia congregata virus]
  Essential gene: C elegans homolog=ZK131.1; Phenotype=Unclassified
MFGCINGGKRRGKGGVKGFCKTGRHNIQGITKPVIRRLARCGGAKRIPGMNYDEIHTADYDNIQGITNMTIKNFARLDGANDIFNMIDEQIWPNDSNFGTVNISWFSESKN

SEQ ID NO: 121070 - protein, 91 aa, Heterodera glycines
  Coding regions on vcDNA: vcDNA=SeqID_47493; Strand=+; Position=1 -127,287-435
  Homolog annotation: Hit_ID=AAL56459.1; Match level="QueryCoverage =40%, HitCoverage=8%, E-value=1e-11, Identity=81%"; Hit description =similar to retinoblastoma binding proteins 4 and 7 [Oikopleura dioica]
  Essential gene: C elegans homolog=K07A1.12; Phenotype=Emb
MDGWEARELTLASSGTDRRLHIWDLSKIGDEQSPEDAEDGPPDLADGGQHLQRGGVGPGDGGKCCGRKRRRSDGPTTLNTPEHIQTNSEAN

SEQ ID NO: 121071 - protein, 232 aa, Heterodera glycines
  Coding regions on vcDNA: vcDNA=SeqID_47494; Strand=+; Position=1 -167,241-367,401-582,642-714,929-981
  Homolog annotation: Hit_ID=NP_741452.1; Match level="QueryCoverage =48%, HitCoverage=17%, E-value=6e-29, Identity=61%"; Hit description =IMP cyclohydrolase (67.4 kD) (4I663) [Caenorhabditis elegans]
  Essential gene: C elegans homolog=C55F2.1a; Phenotype=Ste
ISPLAPQGVRSKSSPPPRGSAIACCQHSHFDDSICGRFMRRNRYLAPHSAETANAGGTSVRKTAGSSWRPTPVLIATDGHANKRCQKWTKERKMPISVLNGSPGYINILDGLNAWQLVSELKMPISVLNGSPGYINILDGLNAWQLVSELADATGQPAAASFKQFSPAGAAIGVPLNDAEAQALMVSDLPVSDLPLDFRRHSLAVALARARGQFRFSQRLDIFCLAGVCLFY

SEQ ID NO: 121072 - protein, 322 aa, Heterodera glycines
  Coding regions on vcDNA: vcDNA=SeqID_47495; Strand=-; Position=1 -16,116-304,416-588,656-847,957-1325
  Homolog annotation: Hit_ID=XP_391894.1; Match level="QueryCoverage =92%, HitCoverage=33%, E-value=1e-92, Identity=43%"; Hit description =similar to ENSANGP00000025395 [Apis mellifera]
  Essential gene: C elegans homolog=F28B3.1; Phenotype=Emb
LTVRMIIDVSIIDVSKAVALLSNGTLIKLLRSKELSHRVNAKAWPTILDIEDAPSLSVARSKVRKAGSSTAAVDFAVSTTGQLSGIVVTAVGAAKQCKSLKMACELYPSRTVTVCLDPYSGLGFTLWCLCSVYSGHVYSGHQSILIPPLELEQNPLVWMQTLSQHRSRDTFCTYSVLELCLKELATQVGQLREKSVNLSSLRNCVVVAEERPRVQLCNAFIKVFAPLGLSPRAVSTSFGCRVNPAVGMQGAASPDPTVVYVDARALRNDRVTLVEKGAPHSIALMESGKLLPGVKVEGGKEQNAQNNTVRRPQTLISLLLNK

SEQ ID NO: 121073 - protein, 305 aa, Heterodera glycines
  Coding regions on vcDNA: vcDNA=SeqID_47496; Strand=+; Position=1 -117,155-446,490-727,779-1049
  Homolog annotation: Hit_ID=CAB88203.1; Match level="QueryCoverage =99%, HitCoverage=99%, E-value=1e-145, Identity=77%"; Hit description= putative cuticular collagen [Globodera pallida]
  Essential gene: C elegans homolog=C15A11.6; Phenotype=Emb
MQETHIVLGIASLCSLLAIIATVVTLPSLYSEMSQLNNKNTVIYYRIPKAFRVNTDSAWTDLMDVQVVVAPPSKARDNPFSSIFRAKRQLPGHCNCGPPQRPNCPPGPPGPAGPPGQPGQPGGAGLQGQPGAPGQPAPPCPPQNIPCPRCPAGPPGSPGGQGPPGQQGAPGQPGAPAPGGGQGPPGPSGPQGQPGQPGRSGTPGQPGQPGNNAVIFNTIPGPRGAPGAPGQPGSPGSQGQPGQSGGQGPPGPPGAPGLPGLSGNSGQPGQPGAPGQPGKDSGYCPCPPRSSAMALKKKMAAVKKA

SEQ ID NO: 121074 - protein, 491 aa, Heterodera glycines
  misc_feature (6)..(6): Xaa can be any naturally occurring amino acid
  Coding regions on vcDNA: vcDNA=SeqID_47497; Strand=-; Position=1 -116,202-369,534-725,774-953,1023-1143,1320-1370,1422-1553,1639 -1800,1866-2075
  Homolog annotation: Hit_ID=CAE67815.1; Match level="QueryCoverage =97%, HitCoverage=89%, E-value=3e-56, Identity=31%"; Hit description =Hypothetical protein CBG13395 [Caenorhabditis briggsae]
  Essential gene: C elegans homolog=M176.2; Phenotype=Emb,Lva
TEKNKXNFRSDVAEITPFSLFPTPFPRNLFRLAEKVQKAFNLLYFAFNLLYFRISNDFDFLSETFEPVAKTNENVRRMLNILKQVHDEGIKQTKTVVLARSKINKNYFIFQIEMNAGQIGGLSVSSRITEMHRRTLWRAGIDATKDQVPDNEAGLGAAEVLYKAWKAFADPNAIILFVAKAFADPNAIILFVASRTSKNRYGQRHIEYDIKEEGEALQIVRLSLPECAKMYKDGNDHSLQLEGLTVDHSLQLEGLTVGVVYKLEPPKYSEHDWETLLLFERSTTIMSPTIALDLATQKKVQQILAKPGMVEHYLEDQILAKPGMVEHYLEDQLEIVPLVRSTFAGLWSLTDKDEDTQKAINDAIDAIVHPENYVIKPNLEGGGHNFFDEKLREKLQQFTDEEREAHILMQKLSAMRVKNFMIRNFMIRGHKKPQFGEMTTELGIFGFLLGDKGKVLHNVQRGHFMRTKLAEVNEGGVSHGTGVFDSAFLVP

SEQ ID NO: 121075 - protein, 341 aa, Heterodera glycines
  Coding regions on vcDNA: vcDNA=SeqID_47498; Strand=-; Position=1 -113,508-1420
  Homolog annotation: Hit_ID=NP_494224.1; Match level="QueryCoverage =87%, HitCoverage=72%, E-value=7e-34, Identity=32%"; Hit description =predicted CDS, putative cytoplasmic protein family member (2C560) [Caenorhabditis elegans] gb|AAB66195.1|
  Essential gene: C elegans homolog=F19G12.2; Phenotype=Unclassified
MVHIVFDPNIIGYDEYMQYGSGIESEDYFRGSSPFQRGANSITNALDFFRIPPTNVSVSSSKVFELLPSNPLTDTPYHFKLHSSQNFIDLSKCYLQSEFRIRKENEHGQLVDLTADEVAPIQMIGQTFIRNIKMSINGREVFNSNSLMAYKTYFSHELSYSNTAKDSHLNAAGYYRDIGGSLETGDGCIARRNLFAGSRTAQFIAKIDADLFNQPLYLINFCELDIEILPNDNEFVLITTPAVAQGAAAAPRYRFEVVSLKMYVKKVSLMDGLALDIARKLEVKPARYAVRKTLMKSMFISHGRFEFTANLFMDQIPRRITMGLVANSDYIGTISRSPFNF

SEQ ID NO: 121076 - protein, 236 aa, Heterodera glycines
  Coding regions on vcDNA: vcDNA=SeqID_47499; Strand=+; Position=1 -165,553-935,1276-1437
  Homolog annotation: Hit_ID=NP_491304.1; Match level="QueryCoverage =99%, HitCoverage=80%, E-value=7e-14, Identity=30%"; Hit description =putative protein of bilaterial origin (24.7 kD) (1E706) [Caenorhabditis elegans] gb|AAK85463.1| Hypotheti
  Essential gene: C elegans homolog=E01A2.6; Phenotype=Emb
MTCGLAVKRPLDLGQDGSLVDVKRPRHGGASPQCSPFRPQLGILATSLMQSVPPKVPSPPAFTGTASAGVGPIGNPSSPFADVSGRCRLSSTQLDSYLRAEIQALKRRRLIPRRQGNFPEEGFPLSTTNVVVNANKGTATAVAASTGGIVGTPVSSTSGNAFRKATSPSSSNVSGAIVKTGFYPQDSEGEAMRTGNADEEKRAMLEALYQNPQFSLRQVKLICERLLKEQEMRLRY

SEQ ID NO: 121077 - protein, 357 aa, Heterodera glycines
  Coding regions on vcDNA: vcDNA=SeqID_47500; Strand=+; Position=1 -152,216-318,379-520,695-808,864-897,958-1051,1118-1436
  Homolog annotation: Hit_ID=CAE66009.1; Match level="QueryCoverage =96%, HitCoverage=19%, E-value=1e-93, Identity=56%"; Hit description =Hypothetical protein CBG11201 [Caenorhabditis briggsae]
  Essential gene: C elegans homolog=C52E12.2a; Phenotype=Unc
PINSLQFAFYCFQLVVGRIRSCPDWSGGEDEDVLSLGLFPGTYLEFSMDDRVFFQVFFQFEAAWDSSLHNSPLLNRVSGYGENVYMTISAYMEIENCAQAYMEIENCAQSAIITKDLGLIVYARDSKISAASRFCRSLIGGISKSAEMNRVPGVYLLTVMEDSDPGTARRKRRILDTSSTYVRGEENLGVRGEENLGTWRPRGDSIILEHQLELEKLPRGDSIILEHQLELEKLSKLQQVERMRLFLMATHRATHRWEKSKNKYLIIIFKISPCLPKFPIPNSVKMSEKERKLATKVLELIRLKIPVNKDPPTGKKVGNKCKWKNTYSISSDFSRRDDSNTFIHNKRQKSKENDELI

SEQ ID NO: 121078 - protein, 382 aa, Heterodera glycines
  Coding regions on vcDNA: vcDNA=SeqID_47501; Strand=-; Position=1 -262,564-1450
  Homolog annotation: Hit_ID=NP_508269.1; Match level="QueryCoverage =78%, HitCoverage=45%, E-value=5e-21, Identity=24%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MHVDFDPLQVDWSTFSSEYVQFGGYNIYRGLPYQRGAGVGAVFRSLMRYLLPIGKQIGSAIGRQGMESGNRVLTNVLEGKDLKDSLVIPPTNVYVVRSFFRQVLPLATITQESPYLFRLYSDNLWTDLSRIYLYLELYIEKPGANDKWVAIEDADTSVSAIQGIGQTFVQQLKVTVGNTEVYDSGNLYPFKAYITNELSFPINAKKNFLGSTGYYHTLNQDDSTDEGFKERCKIFKSGKNAQFLSRLDFDLGNQELYLLNNLDLLFTIYKAKDVFLLQTLKANDATKYRLAVHDVKIYAKMVEVQPSLNMSLYKTLEKQPATYAVRKTEIKSSFISVGRYEFEYNVFSATIPRRVITALVGNSAFHGDYKLSPFMFEPFDLR

SEQ ID NO: 121079 - protein, 333 aa, Heterodera glycines
  Coding regions on vcDNA: vcDNA=SeqID_47502; Strand=-; Position=1 -907,1226-1320
  Homolog annotation: Hit_ID=NP_508269.1; Match level="QueryCoverage =85%, HitCoverage=43%, E-value=3e-17, Identity=22%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTCPQKISDSSPLAINSGLNIFSVPPTNVSVVRSFFRQVLPLATITQESPYLFRLYSDNLWTDLSRIYLYLELSIEKPGANDKWVAIEDADTSVSAIQGIGQTFVQQLKVTVGNTEVYDSGNLYPFKAYITNELSFPINAKKNFLGSTGYYHTLNQDDSTDEGFKERCKIFKGGKNAQFLSRLDFDLGNQELYLLNNLDLLFTIYKAKDVFLLQTLKANDATKYRLAVHDVKIYAKMVEVQPSLNMSLYKTLEKQPATYAVRKTEIKSSFISVGRYEFEYNVFSATIPRRVITALVGNSAFHVGGVEMIVMGEFDQMIMVDYNRHIVTDSKLG

SEQ ID NO: 121080 - protein, 337 aa, Heterodera glycines
  Coding regions on vcDNA: vcDNA=SeqID_47503; Strand=+; Position=1 -324,387-694,917-1024,1097-1200,1290-1399
  Homolog annotation: Hit_ID=AAM81127.1; Match level="QueryCoverage =82%, HitCoverage=22%, E-value=4e-56, Identity=41%"; Hit description =Egg laying defective protein 27, isoform b [Caenorhabditis elegans]
  Essential gene: C elegans homolog=C04A2.3a; Phenotype =Bmd,Emb,Lva,Rup,Unc
YCKRALVFLYLAFNFNAIPFSFLQLSLCSLQADVPSCSTAAVSDEADRDELLYRPGYLCAETEVKYVKMARAFRTFSLDHHQTLTTLEKATRQAICADDALLRCIRETYKTSFPAETYKTSFPAQMGNDEHLTSDSSFMSADDVKKFGKGIKTYGKAFNKINRDLLPHHRREQLVAFYYLWKKSRDATRPKPLSNAMKRNQAALIAAGTAAARRITLDDLMDYESASEIEAEQMESAGRACHHCFGIKSKDWHHVGHERLLSKDWHHVGHERLLMCTDCRLFYKKYGQLRPVDRPRTVPPCLLSRTVPPCLLSNTPARTTTTSPTTTRNRRHKHCPS

SEQ ID NO: 121081 - protein, 166 aa, Heterodera glycines
  Coding regions on vcDNA: vcDNA=SeqID_47504; Strand=+; Position=1 -86,141-242,306-401,460-534,612-679
  Homolog annotation: Hit_ID=AAB47542.1; Match level="QueryCoverage =96%, HitCoverage=75%, E-value=1e-37, Identity=41%"; Hit description =nucleic acid binding protein [Trypanosoma equiperdum]
  Essential gene: C elegans homolog=K08D12.3a; Phenotype=Unc
TTMSSMECYRCHETGHIGRDCPNSGGGGPLGGDSVCYNCNEPGHFLGGDSVCYNCNEPGHFSRECPQGRGGGGGGSRGGGGDIVCYNCNESGHFSRDCTQPRGGGGGGSRGGGDSVCFNCNKGDSVCFNCNKPGHFSRECPNGRSGGGGGGSVCYLHKGHFSRVPG

SEQ ID NO: 121082 - protein, 412 aa, Heterodera glycines
  misc_feature (397)..(397): Xaa can be any naturally occurring amino acid
  Coding regions on vcDNA: vcDNA=SeqID_47505; Strand=+; Position=1 -100,795-913,956-989,1079-1203,1295-1396,1507-1604,2482-2584,2674 -2821,3207-3551
  Homolog annotation: Hit_ID=NP_505122.3; Match level="QueryCoverage =98%, HitCoverage=15%, E-value=4e-97, Identity=45%"; Hit description =fibronectin, type III and protein kinase family member (5I710) [Caenorhabditis elegans] gb|AAN84864.1| Ro
  Essential gene: C elegans homolog=C16D9.2a; Phenotype=Emb,Unc
RTVDGTRAIIDLFWDEPKEWNGDQLGYTVNCTIDVAKYVLYNISEFKPLIRLFAIDSTDNLVAIQNWTIESVNRKRRQIAHTVKNRKRRQIAHTVKIQYQAMTYVGGELYAIRKEPEMSQLALVKLDINQVDTVIFKASLLGEASLLGEFSQIDAMAADWVANRLLLVSKRELMTVNLQDSPSTVLLKKLFQLSLGAQDAKQLVFDPFTNTAYLLTKNGSLFSLDLNKGIESNLELTTGCLRQKTITSITITSIVGEFIWNKATSPQLYALTWNGLIELKLNSDNNCPDINVNWSLFGESGLKAISLFTVADKVLVFATPTDLLVYDRQAAAVSQFPSPSPPIRQLLAVSQSSQPFPDRYCFQLPPTNQINFNVKNEGINAIYQENASVSATIIQEXCSPQKQKSVVWCLRR

SEQ ID NO: 121083 - protein, 156 aa, Heterodera glycines
  Coding regions on vcDNA: vcDNA=SeqID_47506; Strand=-; Position=1 -102,248-298,359-473,689-877
  Homolog annotation: Hit_ID=EAL34309.1; Match level="QueryCoverage =100%, HitCoverage=30%, E-value=3e-33, Identity=47%"; Hit description= GA10344-PA [Drosophila pseudoobscura]
  Essential gene: C elegans homolog=C30C11.2; Phenotype=Emb
PESASNSDWARWFYYLGRIEALKGTDAETYKAAEVALRKAPQNGAVGFKQEVNKVNKWVVLVKLLIGEIPERSLFHTAELRHVLAPYLLLTQTVRLGDVAGFDQTKREHGPIFVKDRTAALVERIHQSVIRTAIRKISTTYSRIYVSDVATKLNVD

SEQ ID NO: 121084 - protein, 438 aa, Heterodera glycines
  Coding regions on vcDNA: vcDNA=SeqID_47507; Strand=-; Position=1-1317
  Homolog annotation: Hit_ID=NP_508269.1; Match level="QueryCoverage =99%, HitCoverage=66%, E-value=7e-51, Identity=31%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MAFHKIDNDSVNSITNALDFFRIPPTNVSVSSSKVFELLPSNPLTDTPYHFKLHSSQNYIDLSKCYLLSEFRIRKENANGQLVDLAADEVAPIQLIGHTFIRNIKMSINGREVFNANSLMAYKSYFSHELSYSTAAKDSHLNAAGYYRDTGGVLEVGDGCTARRNLFVGSRTAQFIAKIDADLFNQPLYLINFCELDIEILPNDNDFVLITPPGVAAATRYHFEVVGLKMYVKKVSLMDGLALDIARKLELKPARYAVRKTLMKSLFISHGRFEFTSNLFMDQIPRRITMGLVANADYVGTVSRSPFNFQPFNVREISIIANGRSYPQAAYDLDYPNGKYVRPFNDMNEAVGFANSSESNGITLAQFGTTHCIYVFNLTSSGDDQAALFDLIKNGTTAVSIKFNQAVPAGGIMLVVMGECDSLVMLDKNRSISTDITI

SEQ ID NO: 121085 - protein, 373 aa, Heterodera glycines
  Coding regions on vcDNA: vcDNA=SeqID_47508; Strand=-; Position=1 -75,119-385,428-646,692-1140,1327-1435
  Homolog annotation: Hit_ID=CAE73776.1; Match level="QueryCoverage =100%, HitCoverage=50%, E-value=1e-128, Identity=59%"; Hit description=Hypothetical protein CBG21320 [Caenorhabditis briggsae]
  Essential gene: C elegans homolog=T10F2.1a; Phenotype=Emb
VKDKQTGACFRADHLVKNQVETLIRDKKTDEKAKSELMNVLVMLDGMSCDDLHEVIKKFNFKSPLTGGDLSEPVSFNLMFPTEIGPTCDQRAFLRPETAQGIFINFKRLLEFNQGRLPFAAAQVGSGFRNEISPRQGLIRVREFTMCEIEHFVDPTDKRHPKFEKIAHLELTLFPACNQMESKNPQKISIGNAVKLGIVNNETLGYYMARTHLFLLSVGISPDKLRFRQHLSNEMAHYAQVVNHIVSFICPCFLKDCWDAECFTSYGWIECVGNADRACYDLHQHQKASGVKLVAEKKLGAPKQIEVVEAVPNKQLLGKEFKSDSKQVHISIQFKGSKYRLSLREGKTFELNSSMVEVKRFEKTVHVEEVTPS

SEQ ID NO: 121086 - protein, 225 aa, Heterodera glycines
  Coding regions on vcDNA: vcDNA=SeqID_47509; Strand=-; Position=1 -197,284-504,561-723,772-868
  Homolog annotation: Hit_ID=CAE66929.1; Match level="QueryCoverage =87%, HitCoverage=20%, E-value=2e-12, Identity=24%"; Hit description =Hypothetical protein CBG12321 [Caenorhabditis briggsae]
  Essential gene: C elegans homolog=C16C10.3; Phenotype=Lva
MTFSASGLTDRGANEITFMMESQQTNLVQYYDQKYNRRLRYPRLQCVIHRRGSQESFFPMEVLQIIDGQRVSLDKQTPKLTEQMIRKCQVLPIDLPRGIETQRDKGMIQNANPFFRAHEVRVETNMMQAEAQHLYPPALDSNLALIVGLSFLVLDFRLADRGQPLPRRYSLPCEFPKVWAVVIVQSAVRKDQCRQFCESLVRCAQARGVQMGMPPRVDHFEDTSL

SEQ ID NO: 121087 - protein, 437 aa, Heterodera glycines
  Coding regions on vcDNA: vcDNA=SeqID_47510; Strand=-; Position=1 -153,206-254,305-339,389-566,606-626,667-758,814-883,939-970,1208 -1281,1333-1450,1758-1875,1926-2000
  Homolog annotation: Hit_ID=CAE75188.1; Match level="QueryCoverage =93%, HitCoverage=72%, E-value=1e-101, Identity=51%"; Hit description= Hypothetical protein CBG23132 [Caenorhabditis briggsae]
  Essential gene: C elegans homolog=Y71D11A.5; Phenotype=Emb,Ste
RAAKGIHWRRLEENFLSSHQVLEKLWTPNSCFINSKVAQIHNSPFQNIFLMLYPNGTIWVNYFQNIFLMLYPNGTIWVNYRVRVKGPCRVRVKGPCAMDLTNFPMDIQMCHLIYESFNYTNFPMDIQMCHLIYESFNYNNQEVRMRWNSLNPTPVYPINTILLPDFNLVNIQAYLVVEPYPAGMWPYPAGMWDELHVKLDELHVKLSFERRYVWYFMQAYVPTYLTIFISWVSFSLGSKAIPARTMLGWVSFSLGSKAIPARTMLGVNALLAMIFQFGNIMRAMIFQFGNIMRNLPRVSYVKAIDVWMLGAMFFIFCSLLELLLELAIVGFKVRKCPRRTRNKRTPPAGLIKCKKRWEEKAENREQRKAGLAFQFAQINFVFQKVSRIAFPTMFALFNIVYWSYYGRKAAETIVYWSYYGRKAAETSAELHSSGGMM

SEQ ID NO: 121088 - protein, 113 aa, Heterodera glycines
  Coding regions on vcDNA: vcDNA=SeqID_47511; Strand=+; Position=1 -209,480-612
  Homolog annotation: Hit_ID=AAD03339.1; Match level="QueryCoverage =61%, HitCoverage=8%, E-value=3e-30, Identity=92%"; Hit description =elongation factor [Caenorhabditis elegans] pir||A40411 translation elongation factor eEF-2 - Caenorhabditis
  Essential gene: C elegans homolog=F25H5.4; Phenotype=Emb,Lva
MDRALLELQLGQEKLFQTFQRIVENINVIIATYEDDDGPMGPIQVDPSIGNVGFGSGLHGWAFTKQFAEMSCVCWQSRHWDESAYPRAELCGRQEGGPLREDHPTVYNNTFPT

SEQ ID NO: 121089 - protein, 315 aa, Heterodera glycines
  Coding regions on vcDNA: vcDNA=SeqID_47512; Strand=+; Position=1 -39,96-160,213-351,406-504,550-623,667-901,951-1247
  Homolog annotation: Hit_ID=NP_498192.2; Match level="QueryCoverage =99%, HitCoverage=27%, E-value=1e-124, Identity=67%"; Hit description= rna polymerase (129.1 kD) (3G653) [Caenorhabditis elegans] gb|AAA50695.2| Hypothetical protein F09F7.3 [
  Essential gene: C elegans homolog=F09F7.3; Phenotype=Emb,Lva
MAAPLDIVRHMRQDLITNGLVNALATGNWTIRRFKMERHGVTQVLSRLSYISVLGMMTRINSTFEKTRKVSGPRSLQSSQWGMICPADTPEGESCGLVKNLSLLSHITTDSDEAPILQLLYNFGVQDVRPLKFSVVHERRYHIVFLNGSIVGITDDVEKIIGTVRLMRRRGHLGAFVSVSFNTSTNALYLASDGGRLCRPYVIVENGRPCLTQSQIQEVRDGQKTFDHLLAEGCIEFLDVNELNSTRIAVYEHQILPQTTHLEIEPFSLLGVVSGLIPYPHHNQSPRNTYQCAMGKQAMGTIGYNQQKRIDSVHL

SEQ ID NO: 121090 - protein, 336 aa, Heterodera glycines
  Coding regions on vcDNA: vcDNA=SeqID_47513; Strand=-; Position=1 -45,105-235,308-413,475-582,638-757,826-902,963-1032,1090-1233,1296 -1394,1654-1764
  Homolog annotation: Hit_ID=NP_507514.1; Match level="QueryCoverage =94%, HitCoverage=89%, E-value=1e-70, Identity=43%"; Hit description =ubiquitin specific protease 8 (5S413) [Caenorhabditis elegans] emb|CAC14405.1| Hypothetical protein Y59A8
  Essential gene: C elegans homolog=Y59A8B.2; Phenotype=Gro,Sma
MSAQRIASNSEWKKTPLGQTGLFNMGNTCFMNATLQPLFHTPGFSQLFQEKSAQRFVNGNNSFGTNGMISGSFSALIDLIWSGKFNALRPTTFLEFFARRVNTEMADRRQHDAQEFQLYLLDALHEDTNRVNKRQSFEQNYDDTDLGASASDFNERSKLFSSSPVNDLFNLTNISMVQCSTCNTTSVRFEVVNQLSLELPTNTDDLTLKDCLEAHFSSASLEDKWDCPKCKSKQPATRSTKIWEIPKVLIVHLKRFSLNDGHYVKNNVEVTFDVAELDLAPFLHEKSPHHNTALSLYGITSKHAFLLYYKRMNSKAERDNNANANPSVLSDEENNG

SEQ ID NO: 121091 - protein, 346 aa, Heterodera glycines
  Coding regions on vcDNA: vcDNA=SeqID_47514; Strand=-; Position=1 -137,196-259,436-570,819-990,1154-1233,1339-1481,1623-1782,2139-2286
  Homolog annotation: Hit_ID=CAE64385.1; Match level="QueryCoverage =100%, HitCoverage=75%, E-value=1e-122, Identity=58%"; Hit description=Hypothetical protein CBG09073 [Caenorhabditis briggsae]
  Essential gene: C elegans homolog=F01F1.8a; Phenotype=Emb
MASIACLNPKAELARHAAALEMNISGAKGLQEVMKTNLGPKGTLKMLVSGSGDLKVTKDGNVLLHEMQIQHPTASLIAKACTAQNDVTGDGTTSTVLLIGELLKQAENYVSEGVHPHLVTEGFQLAHDHLLQLLAASKKTLPIDRPLLIEVARTTLRTKLDQKLADHVTECVVDAVLAIRRDENDTEPDLHMIEIQQMEHEMETDTQLIRGLVLDHGGRHPDMPKSVRNVHILTCNVSLEFEKTEVNSGLFYKTAAERERLLQAEREYITRRVLKIVELKETVCAGGDQGFVVINQKGEDKYTFVEECKSPKSVTLLLKGPNRHSIMQLKDAIYDGQRAVANALKD

SEQ ID NO: 121092 - protein, 349 aa, Heterodera glycines
  misc_feature (187)..(187): Xaa can be any naturally occurring amino acid
  misc_feature (216)..(216): Xaa can be any naturally occurring amino acid
  misc_feature (344)..(344): Xaa can be any naturally occurring amino acid
  Coding regions on vcDNA: vcDNA=SeqID_47515; Strand=+; Position=1-1083
  Homolog annotation: Hit_ID=NP_510671.1; Match level="QueryCoverage =97%, HitCoverage=35%, E-value=7e-56, Identity=35%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
FIDFQKAFDSVPYELLLYKLEKIGIKGKLLMWIKGFLSNRTFRVKIGDTLSSSKVTSGVPQGSVLGPLLFLIYINDLPDALPSGVKIKLYADDVKLYISDTEIMHKALHNLFEWANNWQIKVSIQKTFVLYLGSKNPKETYKFDGNTINAVNAIRDLGINIDNKLQFSDHVNQITRNAYLRMRSLFXIIKSKSSKIWITLYKTYIRHLLEYAPEVXNPSLQKNIIKIEKCKKFTKRVFKCSLPPIPYQNRLEYLQLPTLENRRKLFDLFMAHKIAYGRTDLKLFSIFTQRALTSPFTDLTQNINWAKNSFPLLGGTKLWNQLDKELIKTNSLNQFKIKLKSLGXSVRPG

SEQ ID NO: 121093 - protein, 107 aa, Heterodera glycines
  Coding regions on vcDNA: vcDNA=SeqID_47516; Strand=-; Position=1 -43,285-361,697-834,1063-1129
  Homolog annotation: Hit_ID=EAA57175.1; Match level="QueryCoverage =100%, HitCoverage=52%, E-value=8e-37, Identity=65%"; Hit description= hypothetical protein MG08144.4 [Magnaporthe grisea 70-15] ref|XP _362561.1| hypothetical protein MG08144.4
  Essential gene: C elegans homolog=W03C9.3; Phenotype=Unclassified
MSDRRKVLLKIILLGEAGVGKSSLMNQYVNRQFVSAYKATVGCDFLTKTITVDGTEVKMQIWDTCGQERFQSLGNAFYRGSDACILVFDVTNATSWGAESWLDEFLV

SEQ ID NO: 121094 - protein, 266 aa, Heterodera glycines
  Coding regions on vcDNA: vcDNA=SeqID_47517; Strand=-; Position=1 -57,109-318,367-596,730-931,1276-1376
  Homolog annotation: Hit_ID=RGKWB; Match level="QueryCoverage=87%, HitCoverage=68%, E-value=1e-128, Identity=95%"; Hit description=GTP -binding regulatory protein beta chain - Caenorhabditis elegans emb|CAA35532.1| G-protein [Caenorhabditis e
  Essential gene: C elegans homolog=F13D12.7; Phenotype=Emb
MSELDQLRQEAEQLKSQIREARKQANDTTLASVAANLEPNGRIQLRNRRTLRGHLAKIYAMHWASDSRNLVSASQDGKLIVWDSYTTNKVHAIPLRSSWVMTCAYAPSGSFVACGGLDNICSIYSLKTREGNVRVSRELPGHTGYLSCCRFLDDNQIVTSSGDMTCALWDIETGQQVTAFTGHTGDVMSLSLSPDMRTFISGACDASAKLWDIREGMCKQTFPGHESDINAVSLDSPLFQTTSFSAQETNTRAAFVAQKAKEMCHD

SEQ ID NO: 121095 - protein, 128 aa, Heterodera glycines
  Coding regions on vcDNA: vcDNA=SeqID_47518; Strand=+; Position=1 -198,296-482
  Homolog annotation: Hit_ID=NP_509586.1; Match level="QueryCoverage =92%, HitCoverage=55%, E-value=7e-27, Identity=47%"; Hit description =golgi snap receptor complex member 2 (XK58) [Caenorhabditis elegans] emb|CAA86311.1| Hypothetical protein
  Essential gene: C elegans homolog=M03E7.5; Phenotype=Emb
QSAAQLDGLDRLVNKEPSGKRHTSKYRFEQLRHDYNALEMAINSLQNRLTTKWRTAAEREELLTMRFKPNETHLDFEGTELLVNDRLKQSHNAVDDLIAHGNSVLTSLRHQHLRLKDVKRKMLDIGQV

SEQ ID NO: 121096 - protein, 77 aa, Heterodera glycines
  Coding regions on vcDNA: vcDNA=SeqID_47519; Strand=-; Position=1 -80,477-630
  Homolog annotation: Hit_ID=NP_492363.1; Match level="QueryCoverage =100%, HitCoverage=15%, E-value=5e-28, Identity=72%"; Hit description= pre-mRNA factor (55.9 kD) (1J310) [Caenorhabditis elegans] emb|CAB02270.1| Hypothetical protein C36B1.5
  Essential gene: C elegans homolog=C36B1.5; Phenotype=Emb,Lva
ELLYQEGHSKSVFDLDFHADGSLMLTGGLDCYGRVWDLRTGRCIMFLEGHQKGIHTVCWHQNGFLMVTGSADNTCKV

SEQ ID NO: 121097 - protein, 105 aa, Heterodera glycines
  Coding regions on vcDNA: vcDNA=SeqID_47520; Strand=+; Position=1 -138,379-558
  Homolog annotation: Hit_ID=CAE63008.1; Match level="QueryCoverage =94%, HitCoverage=18%, E-value=6e-13, Identity=36%"; Hit description =Hypothetical protein CBG07248 [Caenorhabditis briggsae]
  Essential gene: C elegans homolog=C11H1.3; Phenotype=Dpy,Gro,Pvl,Unc
VGRAGGGYSSGFYRLEFVFDCDVSCFVQIHFCAREQIDEQQPQLLQIVSRQPQFEHSERFHFPVGANQHFSHFTFKPHRYDMKMMHWDGGPVFPVVIEIRSVSDQ

SEQ ID NO: 121098 - protein, 386 aa, Heterodera glycines
  Coding regions on vcDNA: vcDNA=SeqID_47521; Strand=-; Position=1 -758,1519-1597,1783-1947,2061-2216
  Homolog annotation: Hit_ID=CAE71097.1; Match level="QueryCoverage =34%, HitCoverage=83%, E-value=2e-55, Identity=75%"; Hit description =Hypothetical protein CBG17948 [Caenorhabditis briggsae]
  Essential gene: C elegans homolog=C35D10.16; Phenotype=Emb
MNSTEFLWHDKETTHVVGSHMLRSFHWIRTCDPPTSVSQSSGLNSPTFQSMGLNLSSIPITGTQFYSILHHSHSRDSISPAFQSLGPILHYSKNWNSISRILRHRNHRDSILLHSNHWDSNLRHSNHWDLTSPGPSASQSSGLNSATFQSPGLNSTQFSIIPITGTQLTCIPIAGTQLTSIPIAGTQFSGIPITGTQFSGIPINGTQLSGIPINGTQLSGIPITGTQSFTIPNNELNFMDSSTCQSPGLNSDLTTLQPYLDAVRRSLEAALCLQQFGSQVEVRTSKELLLTPVMVCRNKQEAVLIEPSINSVRMSIRVKQADEIEKILCNKFTRFMCQRADNFIILRRKPMPGFDISFLITATHTQVMYKHKLIDFLIHFMQEIDK

SEQ ID NO: 121099 - protein, 169 aa, Heterodera glycines; identical to SEQ ID NO: 119536
  Coding regions on vcDNA: vcDNA=SeqID_47522; Strand=+; Position=1 -201,274-394,452-639
  Homolog annotation: Hit_ID=AAR85527.1; Match level="QueryCoverage =95%, HitCoverage=64%, E-value=5e-39, Identity=48%"; Hit description =14-3-3b protein [Meloidogyne incognita]
  Essential gene: C elegans homolog=M117.2; Phenotype=Emb

SEQ ID NO: 121100 - protein, 351 aa, Heterodera glycines
  Coding regions on vcDNA: vcDNA=SeqID_47523; Strand=-; Position=1 -181,224-277,318-488,761-910,965-1137,1225-1548
  Homolog annotation: Hit_ID=NP_508838.2; Match level="QueryCoverage =88%, HitCoverage=45%, E-value=5e-38, Identity=32%"; Hit description =patterned Expression Site PES-22, patterned expression site protein 22 (pes-22) [Caenorhabditis elegans]
  Essential gene: C elegans homolog=C10E2.6; Phenotype=Lva
MEERIVLKKNIWLILEGKSLLVCNKFHEDSCSECCIEENNLLPDNNSEFQSNYSINELPAGYLLKGDLIINQLPTPPDGGFGWVIVAAAFVCNFVVDGVSNSFGSFMSAYQAAFHTTKAATSVIGSLLIGVYLLAGIGFSFIYLPAIVIVSQYFESKRALATGISVAGSGFGTFLIPLILKFFLEAFGWQMALYVTALLTLSCAFCGILFRPLPMPTFDLEKQNKLNEELKQQALIAALQQVESESNVSEEEEEANNGGISPPRRSGATRTSSECTDGQPLLMANGVELGAVGEHAEEANEADSSPITPHNRPPLSPILERVVRRLSKKRGGSQHHNPHHQQQQQQQQQSG

SEQ ID NO: 121101 - protein, 373 aa, Heterodera glycines
  misc_feature (33)..(33): Xaa can be any naturally occurring amino acid
  misc_feature (37)..(37): Xaa can be any naturally occurring amino acid
  Coding regions on vcDNA: vcDNA=SeqID_47524; Strand=-; Position=1 -176,223-412,473-588,636-761,804-957,998-1085
  Homolog annotation: Hit_ID=CAE72788.1; Match level="QueryCoverage =89%, HitCoverage=48%, E-value=3e-82, Identity=51%"; Hit description =Hypothetical protein CBG20050 [Caenorhabditis briggsae]
  Essential gene: C elegans homolog=F52H2.2; Phenotype=Unclassified
GKADSNKLKKEFSKSTEEEFENSGRISHLSNNXTCNXHVSRCIIGSGIFLSPTGVQKDAGSIGLSLLIWLFCGLAGSIGLSLLIWLFCGLFVGLGSYCYAELGTLIKKSGGDYAYIMEAFGPFLAFVRLWVEAFVVRPCTCTIVALTFAKPCTCTIVALTFAKYILHPFFSNCKTPDGSAQIIAAALIIFLTALNCLSVKLATFIQDFLTALNCLSVKLATFIQDTFTLAKIFALIFIIITGFYLLIQGDPQYRVNFRNVFENSETNVGKVLIQGDPQYRVNFRNVFENSETNVGKVSIAFYSGLFAYQGWNYLNFIVEELQNPKRNLPLAILISTVSVTVIYVNLPLAILISTVSVTVIYVLTNIALYVVIS

SEQ ID NO: 121102 - protein, 285 aa, Heterodera glycines
  misc_feature (264)..(264): Xaa can be any naturally occurring amino acid
  misc_feature (273)..(273): Xaa can be any naturally occurring amino acid
  Coding regions on vcDNA: vcDNA=SeqID_47525; Strand=-; Position=1 -179,282-361,414-583,908-983,1036-1093,1191-1434
  Homolog annotation: Hit_ID=AAF00540.1; Match level="QueryCoverage =88%, HitCoverage=70%, E-value=1e-115, Identity=82%"; Hit description= casein kinase I [Ancylostoma caninum]
  Essential gene: C elegans homolog=C03C10.1; Phenotype=Emb
RHPQLLYESKVSFLLQGGVGIPHIRYYGIERDYHCLVMDLLGPSLEDLFNFCCRRFTMKTVLMLADQMIGRIEYMHVKNFIHRDIKPDNFLMGIGRHCPDNFLMGIGRHCNKLFIIDFGLAKKYRDSRTRIHIPYRDNKNLTGTARYASINAHMGIEQSRRDDMESLGYVLMYFNRGNLPWQGLKWQGLKAANKKQKYEKISEKKMSTPVEMLCKGFPSEFSMYLNYCRGLRFDEAPDYMYLRQLFHYDIRTAKQKRTIGRYFXHKPSKFAKXHNSYSKKSAHQK

SEQ ID NO: 121103 - protein, 71 aa, Heterodera glycines
  Coding regions on vcDNA: vcDNA=SeqID_47526; Strand=-; Position=1 -30,79-261
  Homolog annotation: Hit_ID=Q8BK63; Match level="QueryCoverage=53%, HitCoverage=11%, E-value=6e-10, Identity=86%"; Hit description =Casein kinase I, alpha isoform (CKI-alpha) (CK1) sp|P48729|KC1A _HUMAN Casein kinase I, alpha isoform (CKI-alph
  Essential gene: C elegans homolog=C03C10.1; Phenotype=Emb
MAAVVTNNSKTINSQFFISENDYKNVLRHSLKISLKEFIVGVKYKLKRKIGSGSFGDIYLAINIQNGEEVA

SEQ ID NO: 121104 - protein, 447 aa, Heterodera glycines
  Coding regions on vcDNA: vcDNA=SeqID_47527; Strand=+; Position=1 -102,156-309,364-983,1044-1196,1377-1542,1838-1917,2016-2081
  Homolog annotation: Hit_ID=CAE59952.1; Match level="QueryCoverage =88%, HitCoverage=34%, E-value=8e-89, Identity=44%"; Hit description =Hypothetical protein CBG03440 [Caenorhabditis briggsae]
  Essential gene: C elegans homolog=C47E12.5; Phenotype=Emb
MFISADARGLFSYAFVDLGDEFVVNDSDGETCKEVLVEYIDCESGDMMTLEGAFHQLEDGDHVVFTDFEHAELNELPPVPVTLKGSNVFNIGNALAAFSGAVQGPVSRGRVQQVKVPKKMSFKPLSLALAEPDFMIWDFAKFDEPAQLHALWQALYSFEATVRHSGHFPFVWVFLSEKLQPFAPFRCRRKIVKGNAAKRCARNAGLTALQLLLPGPFCAFFNFEFLPRLKACGNLQPIASLIGGLVAQEAMKAVTHHTTPLKQFLYTDSLEALPGADSTFDAAKLEKNDCAPRNNRYDGQAAVFGWAFQEALQQQKWFIVGAGAIGCELLKNMVSHLLPIVIKKKKSEVAARSVKAFNSTIHINPMSEIVAESTEHIFGDDFFARLNGVSNALDNVEALVGKVPFKKFTDYFTSVAETVNQYLDNIEVLSTLERALVVEYPKNAEEC

SEQ ID NO: 121105 - protein, 684 aa, Heterodera glycines
  misc_feature (115)..(115): Xaa can be any naturally occurring amino acid
  misc_feature (380)..(380): Xaa can be any naturally occurring amino acid
  misc_feature (411)..(411): Xaa can be any naturally occurring amino acid
  Coding regions on vcDNA: vcDNA=SeqID_47528; Strand=+; Position=1 -156,203-548,598-747,796-840,894-956,1004-1102,1463-1604,1689 -1871,1906-2045,2100-2334,2550-2667
  Homolog annotation: Hit_ID=NP_495041.2; Match level="QueryCoverage =99%, HitCoverage=38%, E-value=5e-92, Identity=33%"; Hit description =encoding in order receptor tyrosine-phosphatase isoforms, negative regulator of the Fibroblast growth fac
  Essential gene: C elegans homolog=F56D1.4a; Phenotype=Bmd,Rup,Stp,Unc
ARVDRDQKLHSSTHRPEHSSSLAPNRQIKVGLDSARWRRQLTNLDPAYGFSGYFQPVSLKINYFQPVSLKINGTGGISPLEIFLISFFLLTFLALSTTIVIYFMHVNFVSNLNSXWRGIIKQFCPSKNGSHDLLRPGIPPAPIRSDDLPAEYILKHRDSDYQFAQEFEALFWINLDHTISERKENARKNRYNNLDHTISERKENARKNRYNDIKACDATRVRLRRVPGDPNSSDYINANFIKGYKGKKCFIATQGGYKGKKCFIATQGPLECTIGDFWRMIWEQGSRMIIECTIGDFWRMIWEQGSRMIIMVTNLRERGREQCVKYWPDDDEPPLMVTNLRERGREQCVKYWPDDDEPPLVFRTLEVASFSIHSKSSHEXVDCLNIGALLVFIRPFNDGGTIRNMPTLRAXFGPKKRRVLQFHFTSWNDYKAPECTVALLKVMYKLRKMDEYNHSPVVVHCRFAFDYDSLCLGVSLSAGVGRTGTLVAIDFVMDQMLDCLGVSLSAGVGRTGTLVAIDFVMDQMLDTGIADVYNCVADMRQQRNLMVQSVEQYVFIYKALAEFQLFGDEQYVFIYKALAEFQLFGDTDLTIAAFRRHFGRLRQPLQTLRERHLSLGCVSSRSSSVQLGESSTLARGQSVSLNEKGKDLSITLEKPKSTEWAHKEENLVLNRLFEAVPYNFNRVV

SEQ ID NO: 121106 - protein, 179 aa, Heterodera glycines
  Coding regions on vcDNA: vcDNA=SeqID_47529; Strand=+; Position=1 -120,718-923,1013-1068,1469-1624
  Homolog annotation: Hit_ID=AAH77670.1; Match level="QueryCoverage =85%, HitCoverage=61%, E-value=1e-21, Identity=40%"; Hit description =MGC89796 protein [Xenopus tropicalis] ref|NP_001005132.1| MGC89796 protein [Xenopus tropicalis]
  Essential gene: C elegans homolog=Y53C12B.2; Phenotype=Pch,Stp
MSEKKSEGCAEKKSGGFNTQKFMLDLASGGTAAAASKDRTTDRKRKSAEETETALEANYPSAQLVAEKRAKMEADIRRVAVPPHRYQNLKRQWAKVTAPIVNELKLQIRFNLRTRCVEIRCPDEKAAGITKRISSSIEIIGSLMFQIFVHAFLLGFEVDDAIALIRLDHLFLESFEVND

SEQ ID NO: 121107 - protein, 56 aa, Heterodera glycines
  Coding regions on vcDNA: vcDNA=SeqID_47530; Strand=-; Position=1-291
  Homolog annotation: Hit_ID=AAQ63317.1; Match level="QueryCoverage =100%, HitCoverage=100%, E-value=7e-20, Identity=73%"; Hit description=40S ribosomal protein S29 [Hippocampus comes] gb|AAK95214.1| 40S ribosomal protein S29 [Ictalurus puncta
  Essential gene: C elegans homolog=B0412.4; Phenotype=Dpy,Emb,Ste
MVHENIHWSRPRKFGPGSRSCRVCFNHHGLIRKYSLNVCRRCFREYASDIGFKKLD

SEQ ID NO: 121108 - protein, 186 aa, Heterodera glycines
  Coding regions on vcDNA: vcDNA=SeqID_47531; Strand=-; Position=1 -123,182-286,334-480,614-797
  Homolog annotation: Hit_ID=NP_871831.1; Match level="QueryCoverage =83%, HitCoverage=19%, E-value=9e-17, Identity=36%"; Hit description =putative nuclear protein, with 2 coiled coil-4 domains, of bilaterial origin (75.2 kD) (1I114) [Caenorhab
  Essential gene: C elegans homolog=C26C6.5a; Phenotype=Emb,Gro,Stp,Unc
MEVNEHASTLSQQQCISSLKRKLKRKLEDGQELDQYDCKFGIRLDPEGDVVMMSDESEISSLNEADVTDLRERYENTQRQEVPKEVMVQREMQIRELESILRLEEAKLMMLKKLQQSQQKAAQKTQQQQNQQQQQQQENVRRLAPGVVQNSTGQAYKPKVAVVNPSQHQTGNTSKTNGTTPQHGKK

SEQ ID NO: 121109 - protein, 352 aa, Heterodera glycines
  misc_feature (88)..(88): Xaa can be any naturally occurring amino acid
  Coding regions on vcDNA: vcDNA=SeqID_47532; Strand=+; Position=1 -99,534-607,669-773,1037-1139,1192-1287,1329-1482,1525-1607,1650-1817
  Homolog annotation: Hit_ID=NP_495918.1; Match level="QueryCoverage =76%, HitCoverage=57%, E-value=6e-55, Identity=44%"; Hit description =RNA processing factor 1 (45.2 kD) (2J285) [Caenorhabditis elegans] emb|CAA90124.4| Hypothetical protein F
  Essential gene: C elegans homolog=F44G4.1; Phenotype=Lva
DAQGRIATFDAVELRLPQNEQKHIGVELTKRREKFKQQHKARFGSHRSLFPHTFLIFFVPNKHVNLLLFVKVPNKHVNLLLFVKLRQXKRKKKLKNLKKKKGERKDKGEDAVPKQVPRTIENTQEADDTFVGSDDEEVLEDMDNDAMAHFFEGSANPVLEDMDNDAMAHFFEGSANPKVLITTSPRAKLKTFKLCFELKKVIPKTFKLCFELKKVIPNAEIVSRKNVAIKRVVRQAIERGFSDLMVVHEDRKKPNGIVFCHLPGIVFCHLPNGPTAFFKINSLQYSKQIKQDVGEATQDVGEATEHYPELILTNFNTRLAKTVSRMFACLFPQKADYGGRRVVTFHQRDYVF

SEQ ID NO: 121110 - protein, 269 aa, Heterodera glycines
  Coding regions on vcDNA: vcDNA=SeqID_47533; Strand=-; Position=1 -101,542-796,844-1084,1147-1314,1403-1447
  Homolog annotation: Hit_ID=CAH93369.1; Match level="QueryCoverage =81%, HitCoverage=28%, E-value=7e-49, Identity=47%"; Hit description =hypothetical protein [Pongo pygmaeus]
  Essential gene: C elegans homolog=C24H11.7; Phenotype=Emb,Lva,Unc
MAAENALAEMCRYLFASIQTFEQDIRPGLKELMKFLIALCNPHDDTNKSSMILMGLHLLTVAFETGDDFLRTTASLHALLKDELSHTLLQLLSTQKLPIFAAANRVCFLLLQTLRPQLKFQMESYFLKLGQLISTEQLAESVSISSAGSPLAAKAAVCYELRELALEALVDMWRLPGLVAELYLNYDCSLYCSNLFEDLIRTLLYNAFPNGPLLFSTHILSLDTVLAVVELIETNCAAKQLKGFTGKGQIGIEEEGEKRCGCGKRPAPI

SEQ ID NO: 121111 - protein, 216 aa, Heterodera glycines
  Coding regions on vcDNA: vcDNA=SeqID_47534; Strand=+; Position=1 -111,163-231,277-455,507-612,1880-1955
  Homolog annotation: Hit_ID=CAF93183.1; Match level="QueryCoverage =96%, HitCoverage=68%, E-value=1e-31, Identity=39%"; Hit description =unnamed protein product [Tetraodon nigroviridis]
  Essential gene: C elegans homolog=ZK856.10; Phenotype=Lva
MFVLSILKHTVKIEPTALGRDFTEALVERLNRQFANYVIPNVGLCITVIPNVGLCITFYDFKKYGASYILPGDASTHTPVLFPGDASTHTPVLFRYVVFQPMINEILEGNILRSNQEGITISMQFFSDITVAPDKLPAISKFFSDESVQVWRWEYQNFSDESVQVWRWEYQNENGDITLYMDPGKRVRFVILRPQFVGGRPSAPRAEEVGGPGARA

SEQ ID NO: 121112 - protein, 102 aa, Heterodera glycines
  Coding regions on vcDNA: vcDNA=SeqID_47535; Strand=-; Position=1 -192,242-267,319-438
  Homolog annotation: Hit_ID=NP_501917.1; Match level="QueryCoverage =43%, HitCoverage=19%, E-value=4e-09, Identity=68%"; Hit description =HIRA interacting protein like, LiPid Depleted LPD-8 (lpd-8) [Caenorhabditis elegans] emb|CAA94609.1| Hypo
  Essential gene: C elegans homolog=R10H10.1; Phenotype=Lpd
MFKFRAVLSNLSLCCSSSLLQIQRHFVTASILRKYPSSTKQFANAHRCISRTRSLFMFIQVQETPNPLSLKFLPGQKVLSEPGRTYEFTSARDAAKSSPLGR

SEQ ID NO: 121113 - protein, 441 aa, Heterodera glycines
  Coding regions on vcDNA: vcDNA=SeqID_47536; Strand=+; Position=1-1326
  Homolog annotation: Hit_ID=NP_498735.1; Match level="QueryCoverage =95%, HitCoverage=100%, E-value=2e-47, Identity=30%"; Hit description= predicted CDS, putative cytoplasmic protein family member (3J53) [Caenorhabditis elegans] gb|AAK84536.1|
  Essential gene: C elegans homolog=F19G12.2; Phenotype=Unclassified
MTFHKIDASSIDSITNAVDFFSIPPTNVTVSSSKVFEILPSNPLTDTPYHFKIHSSQNYIDLSKCYLLTEFRIRKLTPPNGEWGHLDASDQVVPIQLIGHTFMRDLKIAINGREIFNSNSLMAYKTYLSHELSQSLEAKVSHLTAAGYDREDASNLQNANSEGFKSRRQRYLGGRTAQYIAKIDADLFNVPQYLINHCEIDITIQPHDDNFLLIDTLDPPGQPYSIELVGLKLYCKKVSLMDGLALELAKKLEMKPARYAVRKTMMKALFISPGRYEFNANLFMDQVPRRVTMGLVANSDYVGNTKRSPFNFQHFNVRELSVVANGRSYPQAPYDIDYENWKFVRPYNDMQEALGFANSTYGNGIDYFSFLHTHCIYVFNMTNSGDDHGGLFDLIKKGCTAVNIKFKKPVPDGGITLIVMGEADSIYFLDKNRTIATDTTI

SEQ ID NO: 121114 - protein, 96 aa, Heterodera glycines
  Coding regions on vcDNA: vcDNA=SeqID_47537; Strand=-; Position=1 -191,621-720
  Homolog annotation: Hit_ID=NP_493465.1; Match level="QueryCoverage =94%, HitCoverage=77%, E-value=4e-23, Identity=54%"; Hit description =nadh dehydrogenase (1O705) [Caenorhabditis elegans] emb|CAA21708.1| Hypothetical protein Y63D3A.7 [Caenor
  Essential gene: C elegans homolog=Y63D3A.7; Phenotype=Lva
MASSIRLAGGALRELRIHLCQTTAASNGVREFIQKDYVDLKQNNRDFPILVRECSGITPRIWARYEHGVETSVSVENQPRQKIMEVIKEMATKKID

SEQ ID NO: 121115 - protein, 291 aa, Heterodera glycines
  Coding regions on vcDNA: vcDNA=SeqID_47538; Strand=-; Position=1 -156,284-477,519-653,700-1010,1066-1142
  Homolog annotation: Hit_ID=NP_501727.1; Match level="QueryCoverage =99%, HitCoverage=90%, E-value=1e-133, Identity=62%"; Hit description= adenine nucleotide family member (4K472) [Caenorhabditis elegans] emb|CAA92472.1| Hypothetical protein K
  Essential gene: C elegans homolog=T27E9.1a; Phenotype=Emb
MSENKSEGGAEKKKSGGFNTKKFLLDLASGGTAAAVSKTAVAPIERVKLLLQVQDASIHITADKRYKGIIDVLVRVPKEQGFLSLWRGNLANVIRYFPTQALNFAFKDTYKRVFTQGVDKEKQFLKFFAMNLASGGAAGATSLCFVYPLDFARTRLAADVGKADAREFKGLADCIMKILKSDGPIGLYRGFFVSVQGIIIYRAAYFGCFDTAKMLFSPEGKQMNFFVNWAIAQVVTVSSGVLSYPWDTVRRRMMMQSGRKDIMYKNTLDCAIKIIKNEGLLKGMFKGALSN

SEQ ID NO: 121116 - protein, 237 aa, Heterodera glycines
  Coding regions on vcDNA: vcDNA=SeqID_47539; Strand=-; Position=1 -273,332-478,532-716,970-1076
  Homolog annotation: Hit_ID=NP_492650.1; Match level="QueryCoverage =84%, HitCoverage=50%, E-value=9e-54, Identity=53%"; Hit description =polyA+ RNA export protein, Nuclear Pore complex Protein NPP-17 (npp -17) [Caenorhabditis elegans] emb|CAB0
  Essential gene: C elegans homolog=F10G8.3; Phenotype=Gro,Pvl,Rup,Stp
MYLGFFNSCELLLHLLQLARLSLFSKVPQAPDDTVQAMKFNPLVAGSPIFLAAGSWDNTCRIWQVNENGMVEPKAMQNVGAPILSLDWSEVDGSKIFIAGADKQAFAWDLGSNQMAVVGTHNEPVRSCHWIATPQYSVLACLMTGSWDRTLRFWDMRQLPTQNSLATIQLPERVYCSDMVFPLMVVALADRHIKMYKLDGTPTSGDSMFAAKGPEGQFHFQMPSVSRTHQQLPGDLP

SEQ ID NO: 121117 - protein, 169 aa, Heterodera glycines
  Coding regions on vcDNA: vcDNA=SeqID_47540; Strand=+; Position=1 -192,424-512,557-717,831-898
  Homolog annotation: Hit_ID=CAE56191.1; Match level="QueryCoverage =84%, HitCoverage=28%, E-value=9e-26, Identity=42%"; Hit description =Hypothetical protein CBG23814 [Caenorhabditis briggsae]
  Essential gene: C elegans homolog=K09C4.5; Phenotype=Unclassified
MDKPGLVGSVLFHALFFGFGDLESNVLNYLSVPLREFFADSLQRHYAIEPDSEQFELAYSAIASSFFVGAIIASLMMAWCMDRYGRKGTAVYIRSSLGIIAALAMLMAKWLGMAELFVLGHLLAGAISALKTVVFIYVAECAPDQARVRLGIIRFETARVLDDFLNSRI

SEQ ID NO: 121118 - protein, 143 aa, Heterodera glycines
  Coding regions on vcDNA: vcDNA=SeqID_47541; Strand=-; Position=1 -31,105-197,240-364,1053-1235
  Homolog annotation: Hit_ID=NP_494884.1; Match level="QueryCoverage =98%, HitCoverage=81%, E-value=3e-20, Identity=33%"; Hit description =glutathione S-Transferase (gst-8) [Caenorhabditis elegans] gb|AAB37847.1| Glutathione s-transferase prote
  Essential gene: C elegans homolog=R05F9.5a; Phenotype=Unclassified
MEEWEKTYKPKFFYGKAPVLEVDGKPLAQSSAILRYLAEKFDLAGKDEWEKAKANEIIDFLKDATTDLLPYLMVKMGRQEGDLYRTINTVTIAGFQQVANFLYMFTKLEPDTINAYPELIKYVDRVHALPQLQKYLKQRPQDR

SEQ ID NO: 121119 - protein, 149 aa, Heterodera glycines
  misc_feature (72)..(72): Xaa can be any naturally occurring amino acid
  Coding regions on vcDNA: vcDNA=SeqID_47542; Strand=+; Position=1 -91,307-410,581-799,1070-1104
  Homolog annotation: Hit_ID=NP_740829.1; Match level="QueryCoverage =99%, HitCoverage=42%, E-value=3e-48, Identity=60%"; Hit description =poly U binding factor 68kD like (rnp-6) [Caenorhabditis elegans] gb|AAM81102.1| Rnp (rrm rna binding doma
  Essential gene: C elegans homolog=Y47G6A.20a; Phenotype=Emb,Gro
FDVFEDQIREAFLVFGPIKTINMSIDPSTNHHKGFCFIEFELPEAAFIARDTMNGRMFGGRNIKVNDKHVYXVGRQDTMPQAQPIIDMVMSEARQYNRVYVSSVHPDISEQDLRSVFSAFGDVTKCQLARQPSGRGHRMIGYNYFQSLI

SEQ ID NO: 121120 - protein, 52 aa, Heterodera glycines
  Coding regions on vcDNA: vcDNA=SeqID_47543; Strand=-; Position=1-159
  Essential gene: C elegans homolog=R53.1; Phenotype=Gro
YNLDLVELSGQMKHGLALYKEKQSHIVATMMGTRSTDPIGKYMKSNIQWTDG

SEQ ID NO: 121121 - protein, 374 aa, Heterodera glycines
  misc_feature (21)..(21): Xaa can be any naturally occurring amino acid
  misc_feature (348)..(348): Xaa can be any naturally occurring amino acid
  Coding regions on vcDNA: vcDNA=SeqID_47544; Strand=+; Position=1 -77,258-436,531-711,766-833,892-971,1025-1089,1155-1303,1471-1651
  Homolog annotation: Hit_ID=NP_741190.1; Match level="QueryCoverage =100%, HitCoverage=37%, E-value=1e-60, Identity=37%"; Hit description= A kinase anchor protein 1 (96.4 kD) (3H455) [Caenorhabditis elegans] gb|AAM22053.1| Hypothetical protein
  Essential gene: C elegans homolog=C56G2.1a; Phenotype=Emb
LKVGGRGRDGRELAKVNLTDXIFDHHMNISVKIDQIISVPLRRCLHMIRLRFPPCRFPDLNLKPVFPPPLAAPTKPTTASTDNSLALPVGVPCEVYVSAHVDAGHFFVQLPTHPSFSSLALLDSYMLSVYTQPGGAPDLPKPCNIGVLCAAPAYNGWFRAITGVLCAAPAYNGWFRAITLAYDQDQDEMLVRFVDYGGFADQDEMLVRFVDYGGFARLPRADLRQIRTDFVTLPLQGITDFVTLPLQGIECYLANVQPADGSLHWSDGSLHWSDKANELFQQLCVSKIIQAALVGYCKTDGIPCVELFVMDSANKKFQTVRIDQILLERGLAKQMDPTLIVRTPMLVXKGTSETSTTTTKPTSGRQLKFTKVIC

SEQ ID NO: 121122 - protein, 362 aa, Heterodera glycines
  misc_feature (43)..(43): Xaa can be any naturally occurring amino acid
  misc_feature (53)..(53): Xaa can be any naturally occurring amino acid
  Coding regions on vcDNA: vcDNA=SeqID_47545; Strand=+; Position=1 -413,476-558,717-966,1002-1269
  Homolog annotation: Hit_ID=CAE58637.1; Match level="QueryCoverage =91%, HitCoverage=69%, E-value=2e-73, Identity=44%"; Hit description =Hypothetical protein CBG01805 [Caenorhabditis briggsae]
  Essential gene: C elegans homolog=JC8.6a; Phenotype=Gro,Pvl
VPSDKGNRLIFVRLMVQRITQSLAGLSLPSFLNKPPKSLKGKXSKAFLLRSSXINLVCVIFSRKINKRKPCNCTKSMCLKLYCDCFSNGEFCLDCNCKDCHNNLEHDAERSRAIKQSLERNPSAFKPKIGHPSNSSIDMERLHQRGCHCKRIDMERLHQRGCHCKRSNCLKNYCECYEAKVPCTDRCKCQSCRNTEHDRHNKFKDKFTTTAGGLAQLAAAAAAESHARAGTPLSEDDTSDICVGEDETTRQANPKTANRMFPWFYMTEDVIEATTMCLVPWFYMTEDVIEATTMCLVSQAQELVNEKQKMSIQEQSLSEEALEKSVLREFGRCLEQIIESANSCLPQKSNGAPQHFHLTPIE

SEQ ID NO: 121123 - protein, 76 aa, Heterodera glycines
  Coding regions on vcDNA: vcDNA=SeqID_47546; Strand=-; Position=1 -135,299-355,400-438
  Homolog annotation: Hit_ID=AAH77277.1; Match level="QueryCoverage =100%, HitCoverage=100%, E-value=2e-27, Identity=76%"; Hit description=MGC80050 protein [Xenopus laevis]
  Essential gene: C elegans homolog=C01F6.9; Phenotype=Gro
MARGHQKALSQQKNQQKQQQQKKGQGNDQRAAAAKALTFKCSVCMSLMPDPKTYKQHFESKHPKNELPPELVGVEA

SEQ ID NO: 121124 - protein, 67 aa, Heterodera glycines
  Coding regions on vcDNA: vcDNA=SeqID_47547; Strand=-; Position=1-204
  Homolog annotation: Hit_ID=NP_499360.1; Match level="QueryCoverage =100%, HitCoverage=38%, E-value=1e-19, Identity=65%"; Hit description= mitochondrial ribosomal protein L7L12 (18.4 kD) (3L797) [Caenorhabditis elegans] emb|CAB07857.1| Hypothe
  Essential gene: C elegans homolog=W09D10.3; Phenotype=Lva
VRLAKFDDAKKIALIKEVRSVIPGMNLVQTKKLIESAPVEIKGDMGKTEADELKALLEKHGAECEVI

SEQ ID NO: 121125 - protein, 102 aa, Heterodera glycines
  Coding regions on vcDNA: vcDNA=SeqID_47548; Strand=-; Position=1 -123,465-647
  Homolog annotation: Hit_ID=NP_492860.1; Match level="QueryCoverage =78%, HitCoverage=18%, E-value=3e-25, Identity=68%"; Hit description =kin protein like (46.4 kD) (1L626) [Caenorhabditis elegans] emb|CAA21720.1| Hypothetical protein Y52B11A.
  Essential gene: C elegans homolog=Y52B11A.9; Phenotype=Gro,Rup,Stp,Unc
MGGTEANGGNSEGEEGGEEARECGEEKETADGKEQREEKEKAKGLQKLKWFCQMCQKQCRDQNGFKCHMMSESHQRQLLLFAENQNSYLRQFSREFEANFMH

SEQ ID NO: 121126 - protein, 119 aa, Heterodera glycines
  Coding regions on vcDNA: vcDNA=SeqID_47549; Strand=+; Position=1 -160,1292-1491
  Homolog annotation: Hit_ID=NP_498349.1; Match level="QueryCoverage =44%, HitCoverage=21%, E-value=5e-18, Identity=79%"; Hit description =ribosomal Protein, Small subunit (27.3 kD) (rps-3) [Caenorhabditis elegans] gb|AAF99870.1| Ribosomal prot
  Essential gene: C elegans homolog=C23G10.3; Phenotype=Emb
MESNARGCEIVVSGKLRGQRAKAMKFVDGVMIHSGNPVTEYIQEAVRHVQMRQATHKQIPLNIFRCSSRSKRYFIRVAKSNTNSGPKFASISSPDSSKVTNGKRNAQSADREIENAVES

SEQ ID NO: 121127 - protein, 258 aa, Heterodera glycines
  Coding regions on vcDNA: vcDNA=SeqID_47550; Strand=+; Position=1 -219,488-790,863-1117
  Homolog annotation: Hit_ID=CAE74484.1; Match level="QueryCoverage =92%, HitCoverage=73%, E-value=1e-81, Identity=61%"; Hit description =Hypothetical protein CBG22235 [Caenorhabditis briggsae]
  Essential gene: C elegans homolog=B0041.4; Phenotype=Emb,Ste
MCRGGRMFAPTKVYRRWHRRVNVAQRRYAIVSAIAASAVPALVQARGHVIDQLNEIPLVISDKIESFTKTKEAVYKSKRFRAGKGKRRNRRYKQKLGPLVIYNNDGGIVRAFRNVPGVTLLSVSHLNLLKIAPGGHLGRLVVWTESAFRQLDPLFGTWTRQSNVKKGFTLPRAKMTNSDFARIIRSEEITKVLRPTMARKVRRVAKIHGNPLKKPSLMAKLNPYAAVLRRAAVLASSKVKKAEANESEGKQKQPKQQK

SEQ ID NO: 121128 - protein, 386 aa, Heterodera glycines
  misc_feature (377)..(377): Xaa can be any naturally occurring amino acid
  Coding regions on vcDNA: vcDNA=SeqID_47551; Strand=+; Position=1 -95,1280-2370
  Homolog annotation: Hit_ID=NP_510671.1; Match level="QueryCoverage =99%, HitCoverage=39%, E-value=4e-63, Identity=34%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
TGFLSSFSITFLKLNKIFEILQINNKHIDYTYIDNSKAFDSVPIELLLQKLKNIGINGKIHKFIENFLNDRSFRVKISERINSKNIYSGVPQGSVLGPLLFLIFINDPPEQLPKNVGIKMFADDIKIYIEHKNDISSALEAINKWSKNNGIKISIEKTMVLYFGENNTKFIYFLDGEPLPETKCVRDLGILIDQKLSFSNHINKILKNSYFSCFQLLRALKTRKLETLILAYKSYIRPVLEYATEIWNPLKKENVHKIEAVQKFFTRKAFNKCGLVPMPYEKRLMFCGIKTLEIRRKINDITTTFKIIKKHTHLKPSNFFAVAKRAIRKPFLLQNRIYITKTKNNFFNRVINSWNLLPKNIMEINDPKKFSCRRNNXAIMHIFPIE

SEQ ID NO: 121129 - protein, 552 aa, Heterodera glycines
  Coding regions on vcDNA: vcDNA=SeqID_47552; Strand=-; Position=1 -115,215-313,365-1760
  Homolog annotation: Hit_ID=NP_500227.1; Match level="QueryCoverage =99%, HitCoverage=55%, E-value=7e-80, Identity=31%"; Hit description =predicted CDS, reverse transcriptase like family member (4D351) [Caenorhabditis elegans] gb|AAK68554.1| H
  Essential gene: C elegans homolog=ZK250.3; Phenotype=Clr,Lvl,Sck
MGQIPFPITVSDINEKYCIFTTELKKRFDKNVPMKLLKLKIKYKILCREYKKHIHKLYCENEAKFISNGRNTLIDERGQIIFRNKQKCTLIDERGQIIFRNKQKCILLADVFQKSFLYKENNNDLLSHENPNQITDIEFNVYNIWNLLKKLPRRNSTSPDGIPYILLKECALPLAPILTELFRIILDSSKIPEIWKTSICRVMEKIIKLEILKFLNKNQFFSPFQFGFRRQRSTTTQLLSTLNDFYISIENKSCVDVIYIDISKAFDSVPIELLLQKLKNIGINGKIHKFIKNFLNNRSFRVKISEQYSNSKNIYSGVPQGSVLGPLLFLIFINDLPNNLPKNVGIKMFADDIKIYIEHKNDKNRENLSSALEAINKWSKNNGLKISIEKTMVLYLGENNTKFIYFLDGEPLPETKCVRDLGILIDQKLSFSNHINKILKNSYFSCYQLLRALKTRRLETLILAYKSYIRPQLEYATEIWNPLKKENVHKIEAVQKFFTRKAFKKCGLVARMKKDKFCGIKTLEIRRKINDITTTFKIIKKHTHLKPSNFFE

SEQ ID NO: 121130 - protein, 276 aa, Heterodera glycines
  Coding regions on vcDNA: vcDNA=SeqID_47553; Strand=-; Position=1 -54,189-467,881-1378
  Homolog annotation: Hit_ID=CAG86810.1; Match level="QueryCoverage =63%, HitCoverage=37%, E-value=2e-11, Identity=34%"; Hit description =unnamed protein product [Debaryomyces hansenii CBS767] ref|XP _458671.1| unnamed protein product [Debaryomy
  Essential gene: C elegans homolog=ZK945.9; Phenotype=Gro
MISNCRHCSRDWLGFSVLSGELYLREVPDQLFGRQRAEFRAHLTALDGHWADAVVVVDLNLPPKSGSVGTGAGVGGGDESVPKAATIGHKKHHQQQLATPSGIEIAESSDQASRTVAPTETKIGSLKPAAAASSPRSTPVTSSRSTFATRRKTATTVSPTTVSTSSQQPNRFSSTMSTRATTTVANVFSSTPPSTTSSSTTSRTAASADHSSNAKSTNISDQSSSVDQSDQSSSSSSRSRAPVVGVDQQQQQNEVHFASDQYRAMLPEAIKFKFFD

SEQ ID NO: 121131 - protein, 143 aa, Heterodera glycines
  Coding regions on vcDNA: vcDNA=SeqID_47554; Strand=+; Position=1 -78,421-524,573-621,863-1060
  Homolog annotation: Hit_ID=NP_504559.1; Match level="QueryCoverage =100%, HitCoverage=91%, E-value=3e-69, Identity=88%"; Hit description= AdaPTin or adaptin-related protein (18.6 kD) (apt-2C) [Caenorhabditis elegans] gb|AAB65902.1| Adaptin or
  Essential gene: C elegans homolog=F29G9.3; Phenotype=Emb,Lva,Lvl,Unc
MINYMLLFSRQGKLRLQKWYVAYPDKAKKKITRELVTTILSRKPKMCAFLEYKDTKVVYKRYASLYFCCAIEQTDNELLCLEVIHRYVELLDRYFGSVCELDIIFNFEKAYFILDEFLLAGEIQETSKKQVLKAISAQDLLQD

SEQ ID NO: 121132 - protein, 176 aa, Heterodera glycines
  Coding regions on vcDNA: vcDNA=SeqID_47555; Strand=+; Position=1 -28,73-165,413-537,1043-1327
  Homolog annotation: Hit_ID=NP_496357.1; Match level="QueryCoverage =88%, HitCoverage=73%, E-value=4e-21, Identity=35%"; Hit description =glutathione S-Transferase (gst-5) [Caenorhabditis elegans] emb|CAA86859.1| Hypothetical protein R03D7.6 [
  Essential gene: C elegans homolog=R05F9.5a; Phenotype=Unclassified
MVEVFRKVIKFIYGPVPVLEVDGKQLAQPAAIMQYLAEKFELAGQNAWETAKALEITCYVNDIITELVPYLGATIGFLPGDEAALRSDVFLRCVKKAFPLLIAQLDQSKSGFMLPSGLSYADFVVSCAFEMLCQLDAAADFLPNEYPSLAKLTERVKALPQLQKYFSTGKNQKHKM

SEQ ID NO: 121133 - protein, 589 aa, Heterodera glycines
  Coding regions on vcDNA: vcDNA=SeqID_47556; Strand=-; Position=1 -503,552-803,856-1159,1212-1506,1553-1741,1822-2045
  Homolog annotation: Hit_ID=CAE68806.1; Match level="QueryCoverage =64%, HitCoverage=35%, E-value=1e-79, Identity=44%"; Hit description =Hypothetical protein CBG14758 [Caenorhabditis briggsae]
  Essential gene: C elegans homolog=F13D11.2; Phenotype =Dpy,Emb,Lva,Lvl,Pvl,Unc
MISNMSAPAPASLSVSDNVTPNSQQHHQFTETSVPNSSIKIETISSSPTTQNITSCTNNGTKSSVVLSPSASVNVTVCAATSSNDDNILQQNTTEHIATGETIVNNGRIEPLPQLHQRNTGRTFFRAPGLEAPDENSGDFPTNALVCPDCGFSCSSKFHYNSHRNTHSTHQCPICKFETRTEGRLKKHMLQSHKREQRLAAGINIQSPPPTPTTLKQNSPPSNGDLSGDKCLSQKILASQGMPPDGISILNSMLSAGDNSNGTLALESIQSMLTNTNSVAFSNSTDALLKICTDVIANNGPNKKMLNSSPQVGDFGHIPLEQLRALTERHTALLNTSTAGTLNIAELQIGPEASLIGSDAIHQQNAAQNGSDEKQDTPRRSGKPKQYKCKTCQNISRSKEEQWAHARLHIPKQKQLTCELCDFVTEYKHHLEYHYRNHNGQKPFKCSICDYTCVNKSMLNSHMKSHTPVYQFRCQDCTYQTKYCHSLKMHLKKYSHKRAPGPSGFVDSSDSHGEDRPENASSSSIGREDTASFENGAPIGTLQSDGHSEGTELIGALATTIHQHHLNGPPPGDTAEMELTSHRLLLQQQ

SEQ ID NO: 121134 - protein, 334 aa, Heterodera glycines
  Coding regions on vcDNA: vcDNA=SeqID_47557; Strand=-; Position=1 -152,278-365,415-546,2979-3196,3252-3365,3433-3631,3689-3789
  Homolog annotation: Hit_ID=CAD29445.1; Match level="QueryCoverage =97%, HitCoverage=66%, E-value=1e-140, Identity=71%"; Hit description= protein disulfide isomerase 1 [Ostertagia ostertagi]
  Essential gene: C elegans homolog=H06O01.1; Phenotype=Sma
MNSVLSISILFLLSQVLSTVSSSDVLEYTDASFDSGMQQHDIALAEFYAPWCGHCKKLAPEYEKAATKLKNNDPPIPLIKVDCTAEKETCDKFGVSGFPTLKIFRKGHVSSEYDGPRDAEGIVKYMRGQAGPSSKELKSISDFDKFVDGDDVSVIGLFEGESKLKDSFHKVADTERDRFRFAHSSNPDLLKKTGYTDDIVVFVSKKLHNKFEPNEFHYDGNYDTDKIKNFLLYETNGLAGIRTQGNLFQFTHRPLVVVYYTVDYLKDPKGSNYWRNRVLKVAQDYKRKVHFAVSDKEEFAQEVEQNGLADRKESDKPLVAAITVDGKYPMNKEF

SEQ ID NO: 121135 - protein, 132 aa, Heterodera glycines
  Coding regions on vcDNA: vcDNA=SeqID_47558; Strand=-; Position=1 -75,373-702
  Homolog annotation: Hit_ID=CAI10832.1; Match level="QueryCoverage =100%, HitCoverage=39%, E-value=1e-28, Identity=47%"; Hit description= ubiquitin carboxyl-terminal hydrolase L5 [Homo sapiens] emb|CAH92490.1| hypothetical protein [Pongo pygma
  Essential gene: C elegans homolog=C08B11.7; Phenotype=Emb,Lva
LSNSEFRKLHNSFTREHFVELDVVTKAKAEDNFHFITYVPVDGKIYELDGMREAPICLADIEQESWVDTLRPFIQRRIQKLANSKCQNWQKKKQFLLVLRYTEGEIHFNLMALVPNLKTKYEQRVAELSAVL

SEQ ID NO: 121136 - protein, 236 aa, Heterodera glycines
  misc_feature (1)..(1): Xaa can be any naturally occurring amino acid
  misc_feature (6)..(6): Xaa can be any naturally occurring amino acid
  Coding regions on vcDNA: vcDNA=SeqID_47559; Strand=-; Position=1 -114,357-443,507-647,688-738,784-858,1025-1171
  Homolog annotation: Hit_ID=NP_494919.1; Match level="QueryCoverage =87%, HitCoverage=83%, E-value=2e-52, Identity=57%"; Hit description =RiboNuclease H (2F287ANDrnh-1) [Caenorhabditis elegans] gb|AAG01563.2| Hypothetical protein T27F7.1 [Caen
  Essential gene: C elegans homolog=T27F7.1; Phenotype=Unclassified
XSITKXFFKVRELLRKLRLENSRLNRQIGAIQREEEKVKREIKTAAKKGDREVCILLAKSIVNSRKSVSKLHGTSVSKLHGTIAQINSINMNMQHQLATIRMAGTLKQSTEVMKVMQQLLKVPEVMQVMVPEVMQVMRDMSKEMTKMGIIEEIIEETMESTEMGIIEEIIEETMESTEPDNMEELAQEEVDKILWEVTAGELGKAPAAVRDELGEKKRQKEAAIATANAFIAEQMG

SEQ ID NO: 121137 - protein, 433 aa, Heterodera glycines
  misc_feature (73)..(73): Xaa can be any naturally occurring amino acid
  Coding regions on vcDNA: vcDNA=SeqID_47560; Strand=-; Position=1 -48,110-198,391-478,547-657,703-813,866-940,1000-1113,1161-1330,1380 -1471,1518-1641
  Homolog annotation: Hit_ID=CAE59376.1; Match level="QueryCoverage =99%, HitCoverage=46%, E-value=4e-49, Identity=31%"; Hit description =Hypothetical protein CBG02729 [Caenorhabditis briggsae]
  Essential gene: C elegans homolog=C07E3.2; Phenotype=Unclassified
FGCVARVGEGKGQLKYLIPPILVFDGIIRLCFKLIPPILVFDGIIRLCFKSVGKCLFKLLHPRPEEEGINSLXTLAKYGALTKSFLSAVQIFLMEVDSVQVLFLMEVDSVQVLLSTLRVVTDLVDLFLHFPKLCKSLIKVLTHFWSRKTEEIRCIAFVVLTHFWSRKTEEIRCIAFVALCKIARLDSECFPAVYKNCYTANCYTAYVANCKTIDDETLPFIHFMQCSLAELTFVHPSQAYQYAFVCSLAELTFVHPSQAYQYAFVYIRQFAIHLRNAMIAKRKQDLIQTVQDLIQTVYNWQFVKGLQLWVLVICEASSDKSASWFYELVHPLVEVINSLWRLFPSTKFFPLRIHLFPSTKFFPLRIHSIQMLLDIQRESEVFVPIFPFLCQLFPFLCQLLDELAQIDAKRPTAGKGRTREPNAERMLRLSGEH

SEQ ID NO: 121138 - protein, 212 aa, Heterodera glycines
  Coding regions on vcDNA: vcDNA=SeqID_47561; Strand=+; Position=1 -105,365-678,2702-2921
  Homolog annotation: Hit_ID=AAB96733.2; Match level="QueryCoverage =59%, HitCoverage=33%, E-value=6e-53, Identity=80%"; Hit description =G protein, subunit alpha protein 1 [Caenorhabditis elegans] gb|AAG32094.1| heterotrimeric G protein alpha
  Essential gene: C elegans homolog=R06A10.2; Phenotype=Pvl,Rup,Stp,Unc
MFDVGGQRDERRKWIQCFNDVTAIIFVCASSSYNLVLWEDNTQNRLRESLALFKNIWNNRWLKSISVILFLNKQDMLAEKIKEGRHRLETYFPDFANYQLPQDERVPPDEDIGVYRAKCYIRGEFLVSPFGANWASYRGGRRDQQGQQPHAHLLPALHLRGGHGEHPPGVQRLSRHHSAHSPETVRVTVALATPTRLPYAAPMGPTVCAATD

SEQ ID NO: 121139 - protein, 184 aa, Heterodera glycines
  Coding regions on vcDNA: vcDNA=SeqID_47562; Strand=+; Position=1 -114,258-335,405-535,775-832,941-1015,1540-1603
  Homolog annotation: Hit_ID=CAE57982.1; Match level="QueryCoverage =89%, HitCoverage=49%, E-value=3e-43, Identity=53%"; Hit description =Hypothetical protein CBG01045 [Caenorhabditis briggsae]
  Essential gene: C elegans homolog=F10C1.5; Phenotype=Egl,Pvl,Rup,Unc
QHSPPSLSSASYASSTASSCSEQEKKYFCQRCLNHGEEHPRKGHKPFCRYRECQCIECQMVEQRRVLNNALNPRKRRVLNNALNPRKTNGESAKKGANQQGPKPRDPKCARCSAHGEQAALRGHKKALCPFLECACAKCALVEQRRRLMADQIKLRRQQKKARDGNALKKAYEKKPTYPSTISS

SEQ ID NO: 121140 - protein, 69 aa, Heterodera glycines
  Coding regions on vcDNA: vcDNA=SeqID_47563; Strand=-; Position=1 -188,790-811
  Homolog annotation: Hit_ID=AAC05784.1; Match level="QueryCoverage =92%, HitCoverage=30%, E-value=4e-24, Identity=81%"; Hit description =homeotic protein [Pristionchus pacificus]
  Essential gene: C elegans homolog=C07H6.7; Phenotype=Vul
TARGEKRQRTAYTRNQVLELEKEFHFNKYLSRKRRIEIAHSLILTERQVKIWFQNRSGEQRKEQREKER

SEQ ID NO: 121141 - protein, 87 aa, Heterodera glycines
  Coding regions on vcDNA: vcDNA=SeqID_47564; Strand=+; Position=1 -61,192-394
  Homolog annotation: Hit_ID=AAH72374.1; Match level="QueryCoverage =88%, HitCoverage=7%, E-value=7e-20, Identity=53%"; Hit description =MGC84516 protein [Xenopus laevis]
  Essential gene: C elegans homolog=R05D3.11; Phenotype=Pvl,Stp
MKLDEFCEYFGEDFTYLIDADSCDPNCHVQHCLVDTHDLRMPWCAFFTKKLVKAGEELCWDYAYEIGSVERQVNCKCGTTVCRGRLL

SEQ ID NO: 121142 - protein, 257 aa, Heterodera glycines
  Coding regions on vcDNA: vcDNA=SeqID_47565; Strand=-; Position=1 -195,550-614,677-801,857-1095,1156-1305
  Homolog annotation: Hit_ID=NP_491237.1; Match level="QueryCoverage =75%, HitCoverage=62%, E-value=2e-53, Identity=52%"; Hit description =protein phosphatase 1A (34.6 kD) (1E406) [Caenorhabditis elegans] gb|AAB42233.1| Yeast glc seven-like pho
  Essential gene: C elegans homolog=W09C3.6; Phenotype=Ste
MAREDYCFDATAAAEQSRPSTTSSTLVHAPTGTTARWEGDGLSSSFVDAIIRKVRQSPVQRFTDEVKYPANFMLLRGNHECANINRVYGFFDEVNRRYQRPGPRRLYDLFNQTFAWMPYVGLIGDKILCMHGGLSDQINSLEQLSHLNRPQIDPPLRTLEIDLLWADPARGVRGVIPNTRGAGIAFGEDVVERVCDMLCLDYIIRAHQVVMDGVEYFAGRRLITLFSAPRYTGRNNTGATLTIAPNLSHSITRFPPA

SEQ ID NO: 121143 - protein, 449 aa, Heterodera glycines
  misc_feature (439)..(439): Xaa can be any naturally occurring amino acid
  Coding regions on vcDNA: vcDNA=SeqID_47566; Strand=-; Position=1 -190,943-1180,1244-1382,1432-1632,1712-1816,2371-2535,2682-2800,2933 -3066
  Homolog annotation: Hit_ID=NP_497675.1; Match level="QueryCoverage =88%, HitCoverage=87%, E-value=2e-94, Identity=48%"; Hit description =nadh dehydrogenase (48.3 kD) (3E332) [Caenorhabditis elegans] gb|AAF59528.2| Hypothetical protein Y53G8AL
  Essential gene: C elegans homolog=Y53G8AL.2; Phenotype=Emb,Lva
MIISSKAVQLLTCYRNRITRKLQYSTTENVPVNVPEPVISSSNMAQFRKGAGGRSSFSGNVITVGNTGFTGRRVVNRLARHANQLILPYRCDSYFLRELKVPCDLGQVLFFPFQLDDDESIRKAVKYSNVVINMIGTYVDTPYSIYDANVEGAWRIARICREMGVERLIHVSALNADPSYKTQFIKNGAFLKSKGMAEQAVRAEGAFLKSKGMAEQAVRAEFPSATIIRPSVMYGDIDRLIYNLITRWRVDPFGNVYTFNAGEGIYKMPLFVNDFVNDFADGVNRVAMDSSTAGKTYEFVGPHCYEMCELFDFIFIKGGLVADITSRYRRVGIPIWFLFTSFLCHSYTKIYRRPGVINWEWFDFMEATSDVLSAGDTYLLKDLGVSLTDFEDMGGYYAMQISFQRPYQPRMADYPQCPLPLRSPPLYKRNRSLLRSKIXSLSKGRSDFE

SEQ ID NO: 121144 - protein, 117 aa, Heterodera glycines
  Coding regions on vcDNA: vcDNA=SeqID_47567; Strand=+; Position=1-518
  Homolog annotation: Hit_ID=NP_498045.1; Match level="QueryCoverage =69%, HitCoverage=19%, E-value=3e-13, Identity=44%"; Hit description =mitochondrial ribosomal protein L3 (3G25) [Caenorhabditis elegans] gb|AAA21160.2| Hypothetical protein C2
  Essential gene: C elegans homolog=C26E6.6; Phenotype=Lva
NSRKLSLSPYETFHLIPGVSNPPDCTQNQYSFEASKRIGLIGRKIGMTLQWLKDGTRCLCTLIHVPVNHVLSANDPETWYRHSLTGKQKAFRGILTIDQCAPPMWSVSLIKSNCVLP

SEQ ID NO: 121145 - protein, 349 aa, Heterodera glycines
  misc_feature (316)..(316): Xaa can be any naturally occurring amino acid
  Coding regions on vcDNA: vcDNA=SeqID_47568; Strand=-; Position=1 -52,101-221,322-513,570-655,725-878,943-1106,1153-1292
  Homolog annotation: Hit_ID=CAE71306.1; Match level="QueryCoverage =100%, HitCoverage=75%, E-value=7e-76, Identity=43%"; Hit description= Hypothetical protein CBG18195 [Caenorhabditis briggsae]
  Essential gene: C elegans homolog=C26E6.6; Phenotype=Lva
SKRIGLIGRKIGMTLQWLKDGTRCLCTLIHVPVNHVLKDGTRCLCTLIHVPVNHVLSANDPETWYRHSLTGKQKAFNAKLPLNAKLPLFQQMVGVEDYDSPFLTNEYRALFERAGVPCKKFLAGFMVSSDAVVKPGTRMDVRHFKVGQWGQWITASGRTIDWGFQGVMHRWGMKGQMSKGPTKAHRRVGKGPTKAHRRVGAIGTKGEAKVWPGRCLPGHMGYEWRKMVGIKVLRINPIKQVIYVRGNVPGDINEWILLKDCFAKKKRVEEPPFPTFYPTEEDEEEMKCCRDRTICQTLLGVFRQTLLGVFRLELFXFQFSQPSVLYTEADETKRTERDRSRAKTAKVKK

SEQ ID NO: 121146 - protein, 273 aa, Heterodera glycines
  Coding regions on vcDNA: vcDNA=SeqID_47569; Strand=-; Position=1 -39,113-250,302-400,782-959,1011-1378
  Homolog annotation: Hit_ID=NP_492356.1; Match level="QueryCoverage =63%, HitCoverage=28%, E-value=1e-23, Identity=41%"; Hit description =TATA box binding protein-Like Factor, transcription initiation factor TFIID required to activate RNA poly
  Essential gene: C elegans homolog=F39H11.2; Phenotype=Emb,Lva,Unc
MDHNYWQAHPNNPLVNRPERNGTTEQNGAMSSCSHPQRASGEPNQLNVVLVDGTEVVVKIHNVLCCYELPMHIDLRQVAYGSINVDYNRAKGVSNILATCRMPFDIRIQELGRKHREALYEPELMVGLQWNLKEPKANLRIHTTGTVTVTGATSEANVVASIRKIYPFLKEFSSQRASVDVVNLDSIDSAWFSDTLRNRRRRRPPQTNRDYALPNDTDNRSRPIPAKRSRYQQIQGSGFYNNAIHNSDEEDLDFAGDYEDDDYEEEREEEDDE

SEQ ID NO: 121147 - protein, 69 aa, Heterodera glycines
  Coding regions on vcDNA: vcDNA=SeqID_47570; Strand=-; Position=1-207
  Homolog annotation: Hit_ID=NP_505508.1; Match level="QueryCoverage =100%, HitCoverage=7%, E-value=2e-24, Identity=63%"; Hit description =glucosidase (103.7 kD) (5K206) [Caenorhabditis elegans] emb|CAB54240.1| Hypothetical protein F40F9.6b [Ca
  Essential gene: C elegans homolog=F40F9.6a; Phenotype=Emb,Lva
LFGIAYHQCRWNYNDQDDLLSVNRAFDEHDIPVDVLWLDIEHTDGKKYFTWDPVKFPNSLEMIQEIESK

SEQ ID NO: 121148 - protein, 250 aa, Heterodera glycines
  Coding regions on vcDNA: vcDNA=SeqID_47571; Strand=+; Position=1 -51,97-120,201-441,500-585,631-676,726-772,895-1149
  Homolog annotation: Hit_ID=NP_491824.1; Match level="QueryCoverage =94%, HitCoverage=46%, E-value=2e-44, Identity=41%"; Hit description =IMportin Alpha, nuclear localization sequence receptor (59.2 kD) (ima-2) [Caenorhabditis elegans] gb|AAB3
  Essential gene: C elegans homolog=F26B1.3; Phenotype=Emb
MSSENLAKLYKNTGKSEDSRRRRTETSVELRKKKCNEEMMKRRNINLECADDSATSAEEVVTDGEIGEPTGRLSPEMLSLEDAVEVLQKEQNAERFRLAFESVRRVLSRSKCPPIDKVITLGFPCALVQALHYDDDKVKFEAAWCITNIVSGTSEQTMTMVNAGAAVWCIANMAGDGVQLRDLLISEGILPLLVGLADRADTLGISFVRILTWAFSNLCRHKKPQVPLQMLAVMAPSISKLIKYEVDISD

SEQ ID NO: 121149 - protein, 181 aa, Heterodera glycines
  Coding regions on vcDNA: vcDNA=SeqID_47572; Strand=+; Position=1 -141,437-572,670-788,1084-1233
  Homolog annotation: Hit_ID=NP_503738.1; Match level="QueryCoverage =86%, HitCoverage=56%, E-value=3e-25, Identity=34%"; Hit description =putative protein family member, with at least 5 transmembrane domains (5D196) [Caenorhabditis elegans] gb
  Essential gene: C elegans homolog=R08F11.2; Phenotype=Unclassified
MEVFFFEPVEYERLYNCSSYNIDQIPLEKRQNLVIGAIFMPISIILELMFYISITDMMCLLMCGIVTGYLAIVGAVFCSAPSFIYIFGAYGFALWATETTAEMFLAINRCVELCSTWLAELLFYGKRIYLWMVFPTVYGLYAFIFTEPILFSGLHITWFLNPHIGYLNDGTIVKKILLFLI

SEQ ID NO: 121150 - protein, 152 aa, Heterodera glycines
  Coding regions on vcDNA: vcDNA=SeqID_47573; Strand=+; Position=1 -226,311-373,970-1139
  Homolog annotation: Hit_ID=XP_516128.1; Match level="QueryCoverage =76%, HitCoverage=80%, E-value=2e-18, Identity=46%"; Hit description =PREDICTED: similar to Collagen alpha 4(IV) chain precursor [Pan troglodytes]
  Essential gene: C elegans homolog=F01G12.5a; Phenotype=Lva,Unc
MQLIVPILLLLTFVVSLPICHGMNGLPGEKGEPGYPGMPGMKGEKGQTGEPGAPSYPGLPGWPGEKGDPGYPGLPGLPGPIGEPGPNSMKRTQLIFGVCAENCDRTKRQGAENQWAGIAGTISERSAKLEAELSQIKERLSKLEKAEEIPNE

SEQ ID NO: 121151 - protein, 78 aa, Heterodera glycines
  Coding regions on vcDNA: vcDNA=SeqID_47574; Strand=-; Position=1 -52,339-523
  Homolog annotation: Hit_ID=CAE59329.1; Match level="QueryCoverage =98%, HitCoverage=65%, E-value=3e-23, Identity=70%"; Hit description =Hypothetical protein CBG02671 [Caenorhabditis briggsae]
  Essential gene: C elegans homolog=T28D9.10; Phenotype=Emb,Lva
MTVRGREQISLDTLSIRGNNIRYIVLPDSLPLDTLLIDDEPRKKPTQRRFGGRGGRGGPRGRGRGRGGPPRGGGGGRR

SEQ ID NO: 121152 - protein, 687 aa, Heterodera glycines
  Coding regions on vcDNA: vcDNA=SeqID_47575; Strand=-; Position=1 -84,166-463,597-849,909-1131,1179-2152,2237-2467
  Homolog annotation: Hit_ID=NP_493474.2; Match level="QueryCoverage =60%, HitCoverage=64%, E-value=4e-35, Identity=31%"; Hit description =PolyRaY PRY-1, axin/conductin like (66.0 kD) (pry-1) [Caenorhabditis elegans] gb|AAL77082.1| PRY-1 [Caeno
  Essential gene: C elegans homolog=C37A5.9; Phenotype=Mig
MDIGNSENKCRNWAVRLEEVLNDFDALQCFQSWLGVDDDSTEHPLRLHFAIIAFREMSASGDARSFQLAKEIFTKFLLPRVGLCDFIGASIRERIGQRLKREQADEDLFDECLAPLDTFLRRQHAVFVQSQEFLDFFNEFCFRNQQKPSTSADEQMMPMLSSPLPATIWHQNSIRRSRRRDSAGKAPQPLTADSLLRSQWEREAIIPVGGAGLFKPVSKFPYMGQTNASKKDSAVSSSFSSEANRRGVAAGANVPGGGGTHSMRQLREGQRRANQQQKTHLLSAFPKPDIFLRENSAGMPPNCHETAQGRREFAEKLAQKLRHVELQHQQDESVNRQIDRINSARQRDTKTSTRELIIAGVAADPLLLDATAADDADDDVENYFRRRMMDSSSNNSAQQSPPPLILSARKTRRKSRGSCSPTAADNRTGPPAEQQRHCSQVGDMPLSSAELGTSQPGMSRPGMSQLGMSQPGMSRTGMSQSCYHPSLNQQQHFDLHFAPPQNGVQKGRQFSLALPFSSPTFSVPPLAPCQLRSPFAALPGMPSSSSPRLLPSSHHHNSVPPPPHSSALSQSVHLAGPSAFPAPALPKKSSPVNPTKQMTRQAGTSRRVPLPVYCDNDGDTSGIGSMTTTHSGNSARGDNDRQRAAMFRRARELSSGGRSERSGAHQQQGLTRTARREQPQMADGKPS

SEQ ID NO: 121153 - protein, 308 aa, Heterodera glycines
  Coding regions on vcDNA: vcDNA=SeqID_47576; Strand=+; Position=1 -255,466-552,601-681,833-897,941-1045,1099-1222,1439-1647
  Homolog annotation: Hit_ID=NP_492588.1; Match level="QueryCoverage =98%, HitCoverage=68%, E-value=1e-98, Identity=56%"; Hit description =protein phosphatase 1 regulatory, GEI-4(Four) Interacting protein GFI-2 (53.7 kD) (gfi-2) [Caenorhabditis
  Essential gene: C elegans homolog=K02A11.1a; Phenotype=Emb,Gro,Sma
MTVAMDHQALIDELPEVEKMPAQQRIALARERREQQLRLCQQREGHLPQPAPRRPRLRFSSDIALLETTVRGDAQEGALSYNISIHNSNLVELMLMDGVNPNSHNEDGLTPLHQCAIDNNERIVRLLLRFGADVNAKDTENWTPLHAAACCGYIEIVRLLIKHSADLLAVNADGNMPYDICDDEQTLDLIESEMAGQGITQEMIDERRQLPEREMLSDMKLLHQQGIPLDQRMPDESTYAASWNQPDLIELLCEYGADISAKTRNGETPLDLTEDPQTQLVIRTIAQTEARRKRIGHFGVRDSRRQSR

SEQ ID NO: 121154 - protein, 194 aa, Heterodera glycines
  Coding regions on vcDNA: vcDNA=SeqID_47577; Strand=-; Position=1 -134,430-520,572-657,975-1162,1654-1739
  Homolog annotation: Hit_ID=CAE65161.1; Match level="QueryCoverage =94%, HitCoverage=45%, E-value=6e-27, Identity=34%"; Hit description =Hypothetical protein CBG10030 [Caenorhabditis briggsae]
  Essential gene: C elegans homolog=F58A4.4; Phenotype=Emb
MESGDFEQLIMEQGWLDSADQWNSTILAHWADQSLAELLDKSFSRLQTPKLRWESMKLRFDDATRINARGIKLPPTPSDEAKRCFISLVMKFAYPQLDANVTVGLNHLLKSPFSVHPENGNIAVPLSAKEIRAFDPNVVPRIDKLLAQLASLRESSQENKENQRSIVYRQTSLAPHIAVFEQWTAQILNSEAQN

SEQ ID NO: 121155 - protein, 37 aa, Heterodera glycines; identical to SEQ ID NO: 120099
  Coding regions on vcDNA: vcDNA=SeqID_47578; Strand=+; Position=1-111
  Homolog annotation: Hit_ID=NP_999958.1; Match level="QueryCoverage =100%, HitCoverage=17%, E-value=1e-12, Identity=81%"; Hit description= ribosomal protein S8 [Danio rerio] gb|AAH76163.1| Ribosomal protein S8 [Danio rerio] gb|AAS66962.1| ribo
  Essential gene: C elegans homolog=F42C5.8; Phenotype=Lva,Ste

SEQ ID NO: 121156 - protein, 138 aa, Heterodera glycines
  Coding regions on vcDNA: vcDNA=SeqID_47579; Strand=+; Position=1-3,46- 210,547-795
  Homolog annotation: Hit_ID=XP_392223.1; Match level="QueryCoverage =63%, HitCoverage=10%, E-value=6e-11, Identity=30%"; Hit description =similar to FtsJ homolog 1 isoform b; cell division protein; rRNA (uridine-2-O-)-methyltransferase [Apis m
  Essential gene: C elegans homolog=C16C10.2; Phenotype=Lva,Lvl
MPGNETIRGHLEKRKDWIRRTRDHQEKSADIKKLKRSARERNPDEFHFHMLRSQIGKIEKLKAVLHFCDETEKPQNKHIIFAEDEEEGKGKREEPKGRKDEQIQHAISTLGNISTLPNNSWHGLSIDQSKATRGKASA

SEQ ID NO: 121157 - protein, 441 aa, Heterodera glycines
  Coding regions on vcDNA: vcDNA=SeqID_47580; Strand=+; Position=1-1326
  Homolog annotation: Hit_ID=NP_508269.1; Match level="QueryCoverage =95%, HitCoverage=63%, E-value=7e-43, Identity=26%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTCPQKISDNSPLAINSGLNIFSVPPTNVSVVRSFFRQVLPLATITQESPYLFRLYSDNLWTDLSRIYLYLELSIEKPGANDKWVAIEDADTSVSAIQGIGQTFVQQLKVTVGNTEVYDSGNLYPFKAYITNELSFPINAKKNFLGSTGYYHTLNQDDLTDEGFKERCKIFKGGKNAQFLSRLDFDLGNQELYLLNNLDLLFTIYKAKDVFLLQTLKANDATKYRLAVHDVKIYAKMVELQPSLNMSLYKTLEKQPATYAVRKTEIKSSFISVGRYEFEYNVFSATIPRRVIIALVGNSAFHGDYKLSPFMFEPFDLREISIHAGGIVYPAVPYKLNFSKDHYVYAFVDMYEALGMANSERSFDISMTQFKKGWAFFVIPLTSTLDDSCGFELLRSGTTNVRATFNSPIPVGGVEMIVMGEFDQMIMVDYNRHIVTDSKLG

SEQ ID NO: 121158 - protein, 191 aa, Heterodera glycines
  Coding regions on vcDNA: vcDNA=SeqID_47581; Strand=-; Position=1 -89,529-1015
  Homolog annotation: Hit_ID=NP_871671.1; Match level="QueryCoverage =63%, HitCoverage=20%, E-value=1e-10, Identity=35%"; Hit description =putative cytoplasmic protein, with a coiled coil-4 domain, of bilaterial origin (69.2 kD) (3J854) [Caenor
  Essential gene: C elegans homolog=PAR2.4a; Phenotype=Emb
MPTEDQQQQQQQQRTVPDNNNYPALPLHGHLLLLDQIAHLATHWPNFNRSLTVSPLLSELDVRALLEHFVHVQIGQLDAEIEGIERQLEAEFDEAERGWPIGFVGTAGHQPVPNRFQAPVWQLFNADGTHLFGNDPDRNVERADQALRDELALVIELAKQKAEEANGGGAAGDLLISGGHFKAGRVRQGYR

SEQ ID NO: 121159 - protein, 181 aa, Heterodera glycines
  Coding regions on vcDNA: vcDNA=SeqID_47582; Strand=+; Position=1 -28,420-559,947-1195,1388-1460,2292-2347
  Homolog annotation: Hit_ID=CAE56369.1; Match level="QueryCoverage =64%, HitCoverage=35%, E-value=2e-15, Identity=34%"; Hit description =Hypothetical protein CBG24044 [Caenorhabditis briggsae]
  Essential gene: C elegans homolog=F09F7.4a; Phenotype=Emb
MFFRGLSSRTVSKSYKANDPDRIFQQFFLEEYQLNHLIGSLSRPYVAFIDGITMGGVESAKLQQVQDELLALPSPTKKDIEQLLRSHGPSDVASFVLDPHLELIDECFAAESVETIIERLMRRNDSDFAREQCEILAKMVFPIEYRLTQRFMAANDFHEGCRASTFQQQSIGIAIPTPKSV

SEQ ID NO: 121160 - protein, 121 aa, Heterodera glycines
  Coding regions on vcDNA: vcDNA=SeqID_47583; Strand=+; Position=1 -23,82-176,330-457,518-637
  Homolog annotation: Hit_ID=CAE67774.1; Match level="QueryCoverage =60%, HitCoverage=19%, E-value=5e-29, Identity=84%"; Hit description =Hypothetical protein CBG13349 [Caenorhabditis briggsae]
  Essential gene: C elegans homolog=C08B11.5; Phenotype=Emb
MTALIRLVFFASIVCAMETAALGRRSVNSSAAEPTNEQPVNKSSANEKNMDVGANLFVGNLDPEVDEKLLFDTFSAFGVILQPPKIVRDVETGSSKGHAFINFASFEASDAGRLIYFSIKI

SEQ ID NO: 121161 - protein, 546 aa, Heterodera glycines
  Coding regions on vcDNA: vcDNA=SeqID_47584; Strand=-; Position=1 -65,122-209,257-335,388-485,541-746,1339-1389,2052-2206,2420 -2502,2548-2680,2749-2916,2978-3136,3252-3281
  Homolog annotation: Hit_ID=NP_741259.1; Match level="QueryCoverage =96%, HitCoverage=47%, E-value=1e-155, Identity=57%"; Hit description= V-ATPase a subunit; ATP-dependent proton pump involved in the acidification of intracellular compartment
  Essential gene: C elegans homolog=ZK637.8a; Phenotype=Emb
FTHCLFLPKEEGMDSIHRSEEMCLTQLFLQKEACLTQLFLQKEAAYSCVAELGELGLVQFRDLNEKVNLNEKVNIFQRKFVTEVRRCDEMERKLRFLETEIKKDGIPMLDTGENPEARFLETEIKKDGIPMLDTGENPEAPAPREMFDLEAIFEKLENELRAIFEKLENELREVNQNEEMLKKNFAELTELKHILRKTQQFFDEVPFKRPLILGGAFGFKSLSSSRFYSKPLLGPAEFVDTGGSRLRIERTTFNLRFIAGVILRERLPTFERLLWRACRGNVFLRQAEITEALSDTVTGLAVQKAVFIIFFQGDQLKSRIKKICEGFRASIYPCPETPQERREMSIGVCEGFRASIYPCPETPQERREMSIGVMTRIEDLKTVLGQTQDHRHRVLVSAAKNVRMWLAKVTVSAAKNVRMWLAKVTKIKAIYHTLNLFNLDQKCFVAECWCPVSELDRIQRALKTGSDESGSTVPSILNRMDTADESGSTVPSILNRMDTAESPPTYNRTNKFNQGFQSIVDAYGIANYREINPGNYTFVSFSPLHN

SEQ ID NO: 121162 - protein, 311 aa, Heterodera glycines
  Coding regions on vcDNA: vcDNA=SeqID_47585; Strand=+; Position=1 -132,188-358,433-537,606-801,851-1179
  Homolog annotation: Hit_ID=NP_499535.1; Match level="QueryCoverage =81%, HitCoverage=52%, E-value=4e-80, Identity=57%"; Hit description =NOT-like, component of CCR4/NOT complex, CCR4-associated Factor family (ntl-3) [Caenorhabditis elegans]
  Essential gene: C elegans homolog=Y56A3A.1; Phenotype=Emb
MEKMNEANSDNQREKFQDDLKKEIKKLQRLRDQIKGWQNSSEIKDKDSLSKFRKLIEQRMEIFKDVERENKTKPHSKQGLSAEDKLDPREKEKCETIEWLNDEIDRTESKLETMSSMADSNRKRGKKDEAKKNEKEKSEELRKHLERVKFHLLNLEVCMRMINNEKLEIKVVLGKLKEPLEMYIDALDPENDDDPESLDPEDIYEELNFGTYLSQLGGIITTTSVDEEKGPLPNDNGCSSGSPQISGKEKQPQLNLSSPTIAAAPIVTSPESASADITTSVGTASATTAQEDVFLFNGTEAQPRKSKEPQE

SEQ ID NO: 121163 - protein, 248 aa, Heterodera glycines
  Coding regions on vcDNA: vcDNA=SeqID_47586; Strand=+; Position=1-747
  Homolog annotation: Hit_ID=NP_508269.1; Match level="QueryCoverage =99%, HitCoverage=36%, E-value=5e-27, Identity=29%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MDVLFTIYRAKDAFLLQSLAAAAAAAAGQHYALYLHDIKLYVKMVEVQPSLNLSIYKTLEKQPATYAVRKTEVKSVFLTAGRTEMDHNIFSAAIPRRLTIALVANGAFNGQLALSPFNFKPYAIREISVHAAGHVYPAVPHRMDFSGCAYIRPFVDMYEALGMANSERSMDITLEQFHDGWTIFVVPMTSTLDDSCGFELLRSGTTSIRLAFNEAIPAGGVEMVVLGEFDQLIMIDYNRHIVSDSKIA

SEQ ID NO: 121164 - protein, 217 aa, Heterodera glycines
  Coding regions on vcDNA: vcDNA=SeqID_47587; Strand=-; Position=1 -212,461-577,1259-1442,1562-1703
  Homolog annotation: Hit_ID=AAL87379.1; Match level="QueryCoverage =95%, HitCoverage=58%, E-value=1e-37, Identity=36%"; Hit description =AT3g45100/T14D3_40 [Arabidopsis thaliana] gb|AAK62657.1| AT3g45100/T14D3_40 [Arabidopsis thaliana] ref|NP_
  Essential gene: C elegans homolog=D2085.6; Phenotype=Him
KENTVLRAGVAPQRVFVIPNAIDSALFTPDPALFACQKRTTVVVLSRLVYRKGADLLVEVIPDICERHPTVQFLIGGDGPKRVDIEEMRERCRLHERVKTLGTIPHDTVAIAIGLLDAIRRRENGELPCPLKKHRQVAEMYNWADIAQRTELVYGNSMEEPEDSIDHKLRNQLNAGFWFGLIWAWVTAVNVLFASLLDWVDPRDGIETVDNKAKANN

SEQ ID NO: 121165 - protein, 209 aa, Heterodera glycines
  Coding regions on vcDNA: vcDNA=SeqID_47588; Strand=-; Position=1 -165,401-438,522-690,1346-1471,1800-1928
  Homolog annotation: Hit_ID=NP_495550.1; Match level="QueryCoverage =99%, HitCoverage=52%, E-value=5e-50, Identity=46%"; Hit description =speckle-type POZ protein (43.9 kD) (2H687) [Caenorhabditis elegans] gb|AAK31400.1| Hypothetical protein C
  Essential gene: C elegans homolog=C07D10.2a; Phenotype=Ste
LNGYFEYIRRDLLINHIMPQDEIQLLLNLTIVSDTITKNSQNTINQAMPEPRPCELAKDLEVMFGQNRHTDFKIVCRGEGKEMHELSAHKVVLAARSPVFSAMLEPHTEEAQKSEVFYEDIDFEVMREMLFYMYSGRSPLLQQMALDLLAVADRFQLIGLKEMADQVLRAGLSTDNVCRNLVLADMHNALDLKADALRFIAQYSNNVIM

SEQ ID NO: 121166 - protein, 132 aa, Heterodera glycines
  Coding regions on vcDNA: vcDNA=SeqID_47589; Strand=+; Position=1 -151,198-347,408-505
  Homolog annotation: Hit_ID=NP_632069.1; Match level="QueryCoverage =89%, HitCoverage=32%, E-value=2e-13, Identity=38%"; Hit description =hypothetical protein MM0045 [Methanosarcina mazei Go1] gb|AAM29741.1| hypothetical protein [Methanosarcin
  Essential gene: C elegans homolog=F35D6.1a; Phenotype=Stp
MKFALLGAARAGYLEVCRLLVNGWAADVNQQTIDGTTALMRASGRGHVDVVNFLVEHGADLDHTDFDGYNALMCAVKNRRTETALHLVTIGANTDQIGIDGKRARDLAEESGLAEMIDIFRAAAEQRENADG

SEQ ID NO: 121167 - protein, 199 aa, Heterodera glycines
  Coding regions on vcDNA: vcDNA=SeqID_47590; Strand=+; Position=1 -167,198-413,470-590,738-833
  Homolog annotation: Hit_ID=CAE60852.1; Match level="QueryCoverage =91%, HitCoverage=63%, E-value=1e-45, Identity=53%"; Hit description =Hypothetical protein CBG04561 [Caenorhabditis briggsae]
  Essential gene: C elegans homolog=C47E8.4; Phenotype=Emb
MPFNLCVGNSFFTVAASIKAKFTTNIDEQEEKFKERTVGLVTLDEVKERQNEIFYRKFSGPSLKFSNEDRPKFEKAIQKRVLSFGAFDDDDDEEDEALIPITKKRHGMDPTVDTSFLPDRERDEQLQRERERIAKEWQEMQEREKNEEITVAFCYWDGSSHRKDSKTKTFRKEFLELKLATVDNLMFVKEDLIIPHFYT

SEQ ID NO: 121168 - protein, 557 aa, Heterodera glycines
  misc_feature (17)..(17): Xaa can be any naturally occurring amino acid
  Coding regions on vcDNA: vcDNA=SeqID_47591; Strand=+; Position=1 -276,324-470,521-710,927-1027,1077-1216,1260-1518,1563-1700,1778-1932
  Homolog annotation: Hit_ID=H89052; Match level="QueryCoverage=93%, HitCoverage=90%, E-value=1e-154, Identity=50%"; Hit description =protein C18C4.10 [imported] - Caenorhabditis elegans
  Essential gene: C elegans homolog=M7.2; Phenotype=Emb
YHFVGKNLTINTIHIQXKIKFRKMLSQEEIFRNTRTVAQGLDALREENEAIKNKLLVGMDVLTPDERQLIDEKASIVEKNLENIQLGLEESQVMLALASHLQNLEAEKVMLALASHLQNLEAEKQKYKAQVRRLCQENAWIRDELNSTQQQLRQCEQDKAQLEEENKDKAQLEEENKHLKFMNSIKKFDEGSENEENTSEQLRSNEVNTSTTLQELGFGPDEDDDLHASHFSQPTPANAMAASTSAGYDIPQRLKTLHNLVIQYAVIQYAAQGRYEVAVPLCKQALEDLEKNNGHDHPDVATMLNILALVYRDQRKYKEAAALLNEALAIRERCLYRDQRKYKEAAALLNEALAIRERCLGEDHPAVAATLNNLAVLYGKRGKYKEAEPLCKRALEIREKVLGNDHPDVAKQLNNLALICQNQGMYDEVEKYYRRALEIYESKLGPQNQGMYDEVEKYYRRALEIYESKLGPDDSNVAKTKNNLSSAFLKQGKYKEAEMLYKQILTEAEMLYKQILTRAHERQYGRVTDENKPIWMIAEDREDSKSGQRNLPREFAS

SEQ ID NO: 121169 - protein, 239 aa, Heterodera glycines
  Coding regions on vcDNA: vcDNA=SeqID_47592; Strand=-; Position=1 -134,180-306,349-484,557-742
  Homolog annotation: Hit_ID=CAE70919.1; Match level="QueryCoverage =97%, HitCoverage=18%, E-value=3e-36, Identity=36%"; Hit description =Hypothetical protein CBG17718 [Caenorhabditis briggsae]
  Essential gene: C elegans homolog=F20D12.2; Phenotype=Unclassified
DITQQMLNNEMALDLVEKCARLHIFCIFWTCELEADLFDHKMNTENLSKSLQTLRHMYDDLAKKQLFCVENLSKSLQTLRHMYDDLAKKQLFCVNESEFRSYDILLNLSDFNLLSQVLSLLSQVLSVRANPQVQLALSLSSALQNNNYIRFFRLVRLQTTFLQACLHHFFPLIRSNALACLHHFFPLIRSNALKVICMPNIFPIETFVEYLSFDSIDEAMKFIRQFNLEMDATDPNLIK

SEQ ID NO: 121170 - protein, 91 aa, Heterodera glycines
  Coding regions on vcDNA: vcDNA=SeqID_47593; Strand=+; Position=1 -145,367-496
  Homolog annotation: Hit_ID=EAA04924.2; Match level="QueryCoverage =93%, HitCoverage=95%, E-value=2e-34, Identity=80%"; Hit description =ENSANGP00000018702 [Anopheles gambiae str. PEST]
  Essential gene: C elegans homolog=W01D2.1; Phenotype=Gro
MTKGTSSFGKRHNKTHTLCRRCGRSSYHIQKHTCSSCGYPEKRKRFRWSVKSIRRRTTGTGRMRHLKLVHRRFRNGFREGVTAPRKGGVKA

SEQ ID NO: 121171 - protein, 210 aa, Heterodera glycines
  Coding regions on vcDNA: vcDNA=SeqID_47594; Strand=+; Position=1 -99,313-576,672-941
  Homolog annotation: Hit_ID=CAE67177.1; Match level="QueryCoverage =77%, HitCoverage=16%, E-value=2e-46, Identity=59%"; Hit description =Hypothetical protein CBG12609 [Caenorhabditis briggsae]
  Essential gene: C elegans homolog=ZC308.1a; Phenotype=Emb
MRSPTTVTKQSPEWTWFVHKGPTIFEGGKMMEMLSERIRDFHYNEDQTHAQLNRKLQLRDQLYYAISPIFPSTIELFLINEAQNAPFCCSVCGLYIVGSSLNGFGTKRSDLDLCLMITNRDIDQRTDAVVVLSSVMRTLESNQIVAEQNLILAKVPILRIKFIGTFHDITVDLNVNNSVAIRNTHLMCYYSSCELSSLNGFLSIPERPVF

SEQ ID NO: 121172 - protein, 149 aa, Heterodera glycines
  Coding regions on vcDNA: vcDNA=SeqID_47595; Strand=+; Position=1 -111,168-291,341-415,696-780
  Homolog annotation: Hit_ID=NP_495709.1; Match level="QueryCoverage =85%, HitCoverage=22%, E-value=1e-43, Identity=66%"; Hit description =zinc finger protein REF-2 family member (51.8 kD) (2I438) [Caenorhabditis elegans] emb|CAA88310.1| Hypoth
  Essential gene: C elegans homolog=F10B5.3; Phenotype=Stp
TKKASGSVANDQTHERMCFSPLGWCRNKKYIQIVKKGYRCLVCNKYRCLVCNKVYGRYNSVSYHVTIYHRNPPIRCEEEGCQFTTREARYIHFHKYEARYIHFHKYYRHQIALPESIDLGNRKCPLLGCKHVSKSPAMLDKHIHRHVAD

SEQ ID NO: 121173 - protein, 518 aa, Heterodera glycines
  Coding regions on vcDNA: vcDNA=SeqID_47596; Strand=-; Position=1 -273,330-748,995-1079,1216-1443,1519-1770,1871-2168
  Homolog annotation: Hit_ID=Q95Q95; Match level="QueryCoverage=86%, HitCoverage=18%, E-value=5e-37, Identity=26%"; Hit description =Target of rapamycin homolog (CeTOR) (Lethal protein 363) pir||T25444 hypothetical protein B0261.2 - Caenorhabd
  Essential gene: C elegans homolog=B0261.2a; Phenotype=Lva
MTFCQALSCARTISACLGSHVHLILPPILSVLDDRKTEEKVRTSALDTLLELARRHSIEDYALPVMQTWLRCIGIKSQQPRLMELLGIIVRKWTQFSVYKENVNAALVRCRVEPMLCHEYQEQLALLQAPSYARQQQQQQQNAVGSGGGVYQQQQGTFSASTSSPLFARQVSFLPPTQNGGATTDTSPLPDTNNGIVGFLPGPGGSSADMSRVHRMSSGKANRKMPGRMVGELFNAAFMSVWTELPEREQNELTNQLIDGPLPIKHRMLSESAEKTRAYAKALRYKEMEILSTRGNGEPNADDCQTMIMLFNKLNLEEGAAGIVQYAKRHNMEISGRWYEKLGEWEKALEMYQNDMTTLPDEQLSWKSISSHSEPQLLPTNREELDQSKPTANAGLGDDAAVSASASTNRIATPQQQNGALGQWSQLDRICETALAEEESNQYNSNFNSATEKQQPQRQLLRKRSSRRSGARLPQLHAPRQPTPLVDAVAAEFLNATLSEVAKRQKIATIGARGCWAV

SEQ ID NO: 121174 - protein, 807 aa, Heterodera glycines
  misc_feature (52)..(52): Xaa can be any naturally occurring amino acid
  Coding regions on vcDNA: vcDNA=SeqID_47597; Strand=+; Position=1 -126,408-593,661-754,804-884,947-1047,1105-1212,1263-1325,1369 -1424,1469-1572,1619-1698,1749-1829,1896-1947,2008-2116,2177 -2782,2825-2964
  Homolog annotation: Hit_ID=NP_509669.2; Match level="QueryCoverage =98%, HitCoverage=84%, E-value=1e-112, Identity=34%"; Hit description= metalloprotease precursor family member (85.2 kD) (XK564) [Caenorhabditis elegans] emb|CAB01675.2| Hypot
  Essential gene: C elegans homolog=C17G1.6; Phenotype=Bmd
FSPFFALGRCVAHPMIIIIIITVYVISDNSSTEMTLLVAFSKKNLLFYLQKXDPTRERARQRIRDKVAINDGTEATVNRAVADDLFENDILLTLPQAKQILEESNKRRGRRQANPTPSSISNKRRGRRQANPTPSSIWGNVNIPYLFQVSQTNWQNNIRKNWQNNIRKGHRHIEWALAISQPSDSFRDYLQYFRGSGCWSQVGKTGGRQPISIGYGCESLGIVAHETLLGIVAHETLHALGLWHEQSRLDRDSFVRINYDSILPGTESNFEKRTPDTSDNGTESNFEKRTPDTSDNLGQPYDLGSAMHYGNRAFASDFRSLGQPYDLGSAMHYGNRAFASDFRSFTILTVDFTILTVDRMYQQTIGQRGGLSFKDAKMINTRYCSEICKTKLDCDNGGYTDPTICKTKLDCDNGGYTDPTDCERCRCPDGYAGDYCQRIPSSSGYAGDYCQRIPSSSINKIINYTLAFVSLKTSSLKTSSLVPRASCYWRIHHRTHRVVIHRTHRVVINIEKLDMPCKDSCASFLELKYKKDKIATGARLCCGNATTIARLCCGNATTIYADIGTDVLVILMSDNNLEAKYTGFELSYKSGKISGRPKETIISKFTEGTSDSNFTNGNSEADNCYNEKAAENIDQHYAKDNNRNNAKDNDNDGHNPRITTETSPRTTTETSLKTTTTSEQRPKRRRNQLPQKKKRQVTWISRLKETLKTDEQGIWSKWGGWSGCSASCGACGHRRRVRTCFKGKCKCRGESGQMERCAFGICRGESGQMERCAFGICPLAKQRTRCQGRLVMPFNGMESLEFGTVIN

SEQ ID NO: 121175 - protein, 702 aa, Heterodera glycines
  Coding regions on vcDNA: vcDNA=SeqID_47598; Strand=-; Position=1 -211,258-384,431-572,620-893,1050-1288,1378-1519,1559-1852,1999 -2184,2262-2517,2568-2605
  Homolog annotation: Hit_ID=NP_497205.1; Match level="QueryCoverage =97%, HitCoverage=66%, E-value=0.0, Identity=50%"; Hit description =TPR repeat containing protein associated to myosin B, UNCoordinated locomotion UNC-45 (107.4 kD) (unc-45) [
  Essential gene: C elegans homolog=F30H5.1; Phenotype=Gro,Prz,Unc
EALNGDSAETLKEKGNKFYQNEDFTSCIEVYTKALELKPDDKLRLVIYKNRAMAKLKTDDFEGAESDCNNALELNPSDPKSYYLELNPSDPKSYYRRALAREKLDKIGSAFNDAKEAIRLRPGDTVLVELCSRLLKINAVLVELCSRLLKINAERLKQVESVENRAEEMLKIAFGEQQSDKEKHIKAMNNLLVLCRDSAMNNLLVLCRDSNSGAMRVWQNGQIVAQLLGVIKGNASDEEALCAVRILDELAKSRERMPFLVLNYVHFSRSLHYFCKIMHRGRVIFVEAASAVIQRVFNGLAAMDLSKEIKPDSEVVERNKVAILRLILELEEILTDPQYSATAREISIDLLLKNLMHMSGGLPRGWSWRFVEDRGLFKILHIATQLPEQCDYPVTSETRHHVSVFLAQLYDDMIFDQRRAIYKERVDQIFIFDQRRAIYKERVDQIFGGLMSDLNDPKNRINLAALLITLLQGPVDVGVNLVTNDQITEVMLQMASSDDFLQQSVAAELIVLSVSKYERATNMIKQGLPVLKKLFLSSDPNVRVRALVGLCKCASSAGDDCSKQPMDDESRMKLANTCHKFLIETENFSVDVRRFACEGLSYLSLDAEIKEYIVGKSELLKALVDLAKNAGGCVFTMATIYVNCANAYEKPKMDEEMVKLAQFAKHHVPQTHPKDTEECVDKRIRKMTEECVDKRIRKMIEL

SEQ ID NO: 121176 - protein, 340 aa, Heterodera glycines
  misc_feature (297)..(297): Xaa can be any naturally occurring amino acid
  Coding regions on vcDNA: vcDNA=SeqID_47599; Strand=+; Position=1-1046
  Homolog annotation: Hit_ID=NP_510671.1; Match level="QueryCoverage =98%, HitCoverage=34%, E-value=8e-59, Identity=37%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
ELLLYKLEKIGIQCKLLMWIKDFLSNRTFRVKIGDALSSSNVGSGVPQGSVMGPLLFLIYINDLPDALPSGVKIKLYADDVKLYICYSKNRNSMHKALHNLSEWANKWQIRISIKKTFVLHLGNKNPKEIYKIDGNIINVVDTIRDLGINIDNKLQFSNHVTQIIKNAYLRMRSLFRVIKSKSSRIWIILYKTYVRPLLEYAPEVWNQSLLKNIKKIEKCQKYFTKRVLFKCSLPPIPYQQRLEYLQLPTLESRRKLSDLFMAHKIIYGRTEIPLKYSNLLNALTFPFIDLTRNINXAKKPFAGRVTKIWNQLDKRLIEKLLNQFKNKIKSRIINSLNKK

SEQ ID NO: 121177 - protein, 286 aa, Heterodera glycines
  Coding regions on vcDNA: vcDNA=SeqID_47600; Strand=-; Position=1-875
  Homolog annotation: Hit_ID=NP_498506.1; Match level="QueryCoverage =95%, HitCoverage=45%, E-value=2e-39, Identity=35%"; Hit description =RNA-directed DNA polymerase family member (3I9) [Caenorhabditis elegans] gb|AAA21080.1| Hypothetical prot
  Essential gene: C elegans homolog=ZK250.3; Phenotype=Clr,Lvl,Sck
PLLFLMYINDLPDALPSGVKIKLYADDVKLLKQEPTQKMHKALHNLFEWANKWQIKVSMQKTFVLYLGSKNPKETYKFDGNTINAVDTIRDLGVNIDNKLQFSDHINQITRNAYLRMRSLFRIIKSKSSKIWITLYKTYIRPLLEYAPEVWNPSLQKNIKKIEKCQKYFTKRVFFKCSLPPIPYQNRLEYLQLPTLEKRRKLFDLFMAHKIVYGRTDLKLFSIFNPSARFNIPFYRFNTKYKLGKKFIPFAGRVTKLWNQLDKELIKTNSLNQFKIKKFTRVICKT

SEQ ID NO: 121178 - protein, 306 aa, Heterodera glycines
  Coding regions on vcDNA: vcDNA=SeqID_47601; Strand=-; Position=1 -57,415-538,602-782,1406-1478,1661-1783,1834-1962,2407-2502,3058-3195
  Homolog annotation: Hit_ID=CAE67637.1; Match level="QueryCoverage =95%, HitCoverage=72%, E-value=8e-55, Identity=45%"; Hit description =Hypothetical protein CBG13195 [Caenorhabditis briggsae]
  Essential gene: C elegans homolog=Y47D3B.10; Phenotype=Dpy
MGSVVKHMTTPKGSAVGKMDTYQLKSGDLANGYVGGENVGTGLNAHDCFEVGRAAYNQKAKLFLHFAMDARSFRAPAEPRVGSGHHRVLGLRALPAGEPRQSVGIHPTLGIFGTEPSEGGCLCRGEFEIPPENVTQLNCYYKKDKPFLKLAPHKVEIVRFEPLVVLFRGVISDAEISVIKELATPKLRRATVHDPATGQLVFASYRISKSAWLKDEEHEVVARVNKRISDMTNLNLDTAEELQVANYGIGGHYDPHFDFSRAACPVLTGVKWVSNKWIHERGQEFIRPCPLKKEYNEKYVGDVRPF

SEQ ID NO: 121179 - protein, 209 aa, Heterodera glycines
  Coding regions on vcDNA: vcDNA=SeqID_47602; Strand=-; Position=1 -385,2389-2596,2745-2781
  Homolog annotation: Hit_ID=NP_494135.1; Match level="QueryCoverage =40%, HitCoverage=27%, E-value=1e-10, Identity=36%"; Hit description =predicted CDS, POL-like family member (2C233) [Caenorhabditis elegans] gb|AAB71072.1| Hypothetical protei
  Essential gene: C elegans homolog=ZK250.3; Phenotype=Clr,Lvl,Sck
MITEAIINSEQLKEMSTRAVIEKLPEAMDGRALAEQIAEECGVKDKLSPDIHRHPRTRPEGGTKKDRILKVPFLDKFSRDQFLYKFRNALKKFPNLPQFIKVRRDMTQSELKILYSLRQQAYQANIAAGVPQGSVLGPLLFLIFINDLPSVITNEAASVGIKMYADDVKLYYAHENDDHSNQLDKAIEALEKWSKINGTHKQNYTKRIS

SEQ ID NO: 121180 - protein, 292 aa, Heterodera glycines
  Coding regions on vcDNA: vcDNA=SeqID_47603; Strand=+; Position=1 -154,204-296,353-730,774-1028
  Homolog annotation: Hit_ID=CAE66017.1; Match level="QueryCoverage =91%, HitCoverage=26%, E-value=2e-62, Identity=50%"; Hit description =Hypothetical protein CBG11210 [Caenorhabditis briggsae]
  Essential gene: C elegans homolog=ZK1127.9a; Phenotype=Ste
AEKEREKLKLEQQQQQQLQQKQPKQPLPIQVEKPIDPAIQAELDAQKEREKVPLEERIKQFRQLLEDKKVSATSSWEKELSKIVFDQRYLLLSTVERKAAFEAYCRERAEIERAEKKKRAKEAKDGFLKLMEEAKLHGKSAFQLQIMAQCLDFFNILRSTFASFSTKWVKDARFKAVEKMRDREAYFKDYVEELYKKEKEEKRKEREKAKDEFKALLSEQNDLRRNSIWAIVKKRLDKEARYKNKHLDSETRQRLFEEHVKDCPEPTEVIKLMNIPRKQFVGRGGGSQTVGG

SEQ ID NO: 121181 - protein, 101 aa, Heterodera glycines
  Coding regions on vcDNA: vcDNA=SeqID_47604; Strand=-; Position=1 -165,607-744
  Homolog annotation: Hit_ID=AAH74666.1; Match level="QueryCoverage =98%, HitCoverage=53%, E-value=2e-27, Identity=58%"; Hit description =MGC69249 protein [Xenopus tropicalis] ref|NP_001004848.1| MGC69249 protein [Xenopus tropicalis]
  Essential gene: C elegans homolog=C48B6.2; Phenotype=Lva,Lvl
MVRTLKFHEKKLLKKVDFINWPAELDNSLHENKIMRRYHVEKREHYTLYNKLSREIREMAKRIRELDDKNPNKLVLARMLLGKLFDMGVIPTADTLERCDK

SEQ ID NO: 121182 - protein, 201 aa, Heterodera glycines
  misc_feature (32)..(32): Xaa can be any naturally occurring amino acid
  misc_feature (47)..(47): Xaa can be any naturally occurring amino acid
  Coding regions on vcDNA: vcDNA=SeqID_47605; Strand=+; Position=1 -177,267-314,358-408,461-548,594-683
  Homolog annotation: Hit_ID=AAS84611.1; Match level="QueryCoverage =91%, HitCoverage=35%, E-value=2e-47, Identity=62%"; Hit description =cathepsin L-like cysteine proteinase I variant form precursor [Heterodera glycines]
  Essential gene: C elegans homolog=T03E6.7; Phenotype=Emb,Gro,Unc
SRVPIMNLNSDLPNSEARIRSAAIDENDSDDXIVLIMIGQRASDVRXTTGRMSGLRYMIERGERGFSDWNAYKQKHGKAYADQEVENERMLAYADQEVENERMLTYLSAKQFIDKHNEAYKEGKVSFAKQFIDKHNEAYKEGKVSFRVGETHIADLPFSEYQKLNGFRRLMPFSEYQKLNGFRRLMGDSLRRNASTFLAPM

SEQ ID NO: 121183 - protein, 269 aa, Heterodera glycines
  Coding regions on vcDNA: vcDNA=SeqID_47606; Strand=-; Position=1 -353,636-774,1008-1187,1253-1390
  Homolog annotation: Hit_ID=XP_310802.1; Match level="QueryCoverage =75%, HitCoverage=27%, E-value=1e-43, Identity=44%"; Hit description =ENSANGP00000007994 [Anopheles gambiae]
  Essential gene: C elegans homolog=C17H12.1; Phenotype=Emb,Lva
MDDNKRELLKLDRKIVAAASIGILGQQHKALQQHQQQQQQLTSNGTITAGGGRPVCAIEFSTIFPELVAVCHDRDKDEPLAPDSVINVWNTRFKTASPECVSVLVLLLYNDDDCPWQGMTFTSSSRVMSMTWDMFNANIIFGACYSGQICIWDTRVNKRMPVCKTPLTAKAHTQPLLCMRMVGTANAHDLVTISTDGRMCSWSIDNLQSPIEATELTCNRTKKPICALSMAFLHNSINNYVLGTEEGELYIGDRHAASGESSRSIAGGW

SEQ ID NO: 121184 - protein, 500 aa, Heterodera glycines
  Coding regions on vcDNA: vcDNA=SeqID_47607; Strand=+; Position=1 -89,145-369,610-731,779-1057,1105-1279,1696-1926,1985-2368
  Homolog annotation: Hit_ID=NP_493745.1; Match level="QueryCoverage =66%, HitCoverage=62%, E-value=8e-77, Identity=47%"; Hit description =protein beta-transducin family (52.4 kD) (2A772) [Caenorhabditis elegans] gb|AAC78176.1| Hypothetical pro
  Essential gene: C elegans homolog=W07E6.2; Phenotype=Lva
GESDGNEQRSVAVRLFSEDGKEIGQAPVVLLASTTAEQLQVLYHQLLRSEKQQNGECGDDGDFDEGTAPVQFRTVADEKSGGKGTEIVDSLLDSLPSERLFLEKPLELVCLPQAVFRVRPVTRCTASLPGHGEPVLSVQFSPDGSCLASGSGDRTVRLWDLHTNLPKQTLTGHNDWVLCIGWSPDGRALASACKSGVIRVWDARSGAQRRVLNGHQKWVNALAWQPLHEATSDAQCRPLLASAGWDKTIRIWDILLGGTVRVLSGHTASVGNWAKSYYQLVNLFGLIVSLSGDSSSDRTVKVWRAEDGTLCRTLTGHGHWINTLSLSCDYVLRVGYFSAEAQSKGQPTLSPFSDGISTEKVFHFCKFISYQCPGTRPTVAGTARVGLGRLHNVFVGAGRKEAANCADDRPPTVGQSGGPTQPKHGETKCQTTVECSNLNRSNLRPTRGPSPPPLLTSQLNCGTDAPAHSSPLCAATWAPCTKLAGPLTADCSSPALPTRH

SEQ ID NO: 121185 - protein, 271 aa, Heterodera glycines
  Coding regions on vcDNA: vcDNA=SeqID_47608; Strand=+; Position=1 -186,235-322,434-529,573-637,692-922,969-1005,1181-1293
  Homolog annotation: Hit_ID=NP_491446.1; Match level="QueryCoverage =74%, HitCoverage=71%, E-value=1e-14, Identity=28%"; Hit description =replication protein A2 32kDa family member (32.0 kD) (1F339) [Caenorhabditis elegans] gb|AAK71380.1| Hypo
  Essential gene: C elegans homolog=M04F3.1; Phenotype=Rup,Stp,Unc
MDASFDQFGGGGWGDQGEQEFAASQFQKNIYDKVPVPVAIDVLISMTGDEEKYVLGNFSFNTVQLMGKVANVSEVDQCTTYELCDAMATDIHEVFTIGQLVQVIGKLRLYNNRLSAVCFNIREVEIDEIAIHKLECKLAKIYFEKNLTEFSLGIVENDTIFHGKVSNQRPGSSIGHSFAGNMATPNRKLSGTTTQMTANRPQMYQQKQQLNFPTHWTHQQQKIYEFIKHNAIGEAGVHKDVIRNALGLNASCNTDLAILSNEGSIYATIGN

SEQ ID NO: 121186 - protein, 160 aa, Heterodera glycines
  Coding regions on vcDNA: vcDNA=SeqID_47609; Strand=-; Position=1 -142,193-427,474-577
  Homolog annotation: Hit_ID=XP_419303.1; Match level="QueryCoverage =53%, HitCoverage=4%, E-value=5e-14, Identity=40%"; Hit description =PREDICTED: similar to anaphase promoting complex subunit 1; anaphase- promoting complex 1 (meiotic checkpoi
  Essential gene: C elegans homolog=W10C6.1; Phenotype=Mei,Ste
MAYLNYDQVQCPCMRANNVVGPRMGGANSSLGRAYTPGGGGIEGVVESANHNNGGTSGQSTARHADHSGIGQPCSSHVRELPTLNTHLTSPAAAVALGLIYLRTGDCWIRETLAIADTFYEIDQIRPDMLMIRTFSRCLVDFEDIKCTREWVDAQIPQII

SEQ ID NO: 121187 - protein, 1378 aa, Heterodera glycines
  Coding regions on vcDNA: vcDNA=SeqID_47610; Strand=-; Position=1 -204,324-386,436-600,644-795,850-940,993-1236,1287-1479,1526 -1572,1622-1662,1709-2527,2569-2695,2734-2981,3033-3215,3260 -3400,3448-3593,3703-3784,3825-4184,4228-4412
  Homolog annotation: Hit_ID=NP_498913.2; Match level="QueryCoverage =99%, HitCoverage=92%, E-value=0.0, Identity=51%"; Hit description =adenylyl Cyclase Homolog, flightless I homolog, related to gelsolin actin-binding proteins and leucine-rich
  Essential gene: C elegans homolog=AC7.2a; Phenotype=Lin,Lvl
GSTGVLCFLKGVDFSRNDFSADRFPDEVIEMTQATWLKLNRAQMERLPDVLSNLKHLEHLQMARNKLQNVHGELSDLPLLRSIIVRYNQIKTSAIPTDIFRMKDLTIIDFYNQIKTSAIPTDIFRMKDLTIIDFSNNLLRDVPSNLEYAKCAIVLNLSGNNIENVPNQIFSNLIDLIYLIFSNLIDLIYLDLSNNRLEVVPPQLKRLTNLQVLKLSNNPLTHLQLKQLPGSKSKKLRVLILRNTHRTLSNIPYSFEDVLNLQELDLSMNELQSLPDSELDLSMNELQSLPDSLYALKQLRKLDLSFNKISKIEFPSSVFTQLETLNVSGNNLTSLPAKIVNCQKLQRLYASYNKLKFEGLPASFGQLLQLQVLFLLPASFGQLLQLQVLFLSDNDLELIPEGIGRCVKLRKIKLDNNRLITLPDGIYLLPDLKELDLHNNPDLVMPPKPSDKEKANPDLVMPPKPSDKEKAMAFYNMAFYNIDFSLSNQLRLAGQSPGSSVDSLRLAGQSPGSSVDSLSPNKSQQKDYMQRKKDFIRRRRCQADQDRASKVIQGMSKMAQDAHEMNQSVEKENDANLRPVIGWKEKMEQHKPRLDYSDVFDAVAGADAGLWVWEIENFYPVLVDSGFHGQFYEADCYLVLKTTRETNGALTHAIYYWIGEKTSLDKAMCAAVHAVNLRNHLGASCRTIREEMNEETDEFLEMFSEEIVYYDGARTQSGFYAVEKVAFSNKLYRAFVNGPSVEMEAVPLNAESLDPRFVFLLDCDKVIWIWSGARSRVTIANKVRLFAVKMNKRDKKGKAEIERVTIANKVRLFAVKMNKRDKKGKAEIESCNQLKTPEEFWLALTGSSKRPDEPIFSSKRPDEPIFEHILEDRKPERKRLYEVQLGMGFLELPQVELRNGVLHKELLKPKGVFLLDCTSELFLWVGKNANRLTKMAGQKIASEIHRMIEKIASEIHRMIERPDFCVICRENEDEESTIFRSKFAAWDDIVPFDFTMTADTVQRRGADIKVVIMERDKLKTDLVALVIMERDKLKTDLVALFLDRLPAMPHSDTEKIIEDFNMDLEVIESFVLEGKKFVRLPQNEFEGKKFVRLPQNEFGIFHSMDCYVFLCRYIDDDDEEEEGAEDEKEANDVDFKCVVYFWQGRDASNMGWLHFTFSLQKKFESLFKDKLEVVRMNQQQENHKFLQKKFESLFKDKLEVVRMNQQQENHKFLSHFKCKLVIRYGKRNPSHNLSQAVPELFHMRANGTSICTRTIQVDCNATRLNSAFCFILRVPPSDLQTDEEGIGNVFVWIGSKSDPYFHKLAEEVASELIGRDSVASELIGRDSDFAVQRIEEGNEPLLFWKALGGKKKYDRDADFMEYTRLFRCTNDKGYFSVS

SEQ ID NO: 121188 - protein, 245 aa, Heterodera glycines
  Coding regions on vcDNA: vcDNA=SeqID_47611; Strand=-; Position=1 -55,270-371,604-818,871-984,1026-1160,1203-1319
  Homolog annotation: Hit_ID=AAK18957.1; Match level="QueryCoverage =99%, HitCoverage=99%, E-value=1e-119, Identity=67%"; Hit description= Yeast glc seven-like phosphatases protein 2 [Caenorhabditis elegans] pir||T16476 phosphoprotein phosphata
  Essential gene: C elegans homolog=F56C9.1; Phenotype=Mei
MTDADKINLDNIISRLLEGDVHGQYYDLLRLFEYGGFPPESNYLFLGDYVDRGKRRYNIKLWKTFTDCFNCLPVAAIIDEKIFCCHGGLSPDLQSMEQIRRLMRPTDVPDQGLLCDLLWSDPDKDVTGWGENDRGVSFTFGPEVVSKFLHKHDLDLICRAHQVVEDGYEFFAKRQLVTLFSAPNYCGEFDNAGSMMTVDETLMCSFQILKPSDKKGKFSYTGAGQNRPVTPPRATPAEQNKKAKK

SEQ ID NO: 121189 - protein, 332 aa, Heterodera glycines
  Coding regions on vcDNA: vcDNA=SeqID_47612; Strand=-; Position=1 -68,111-347,393-450,497-852,1037-1160
  Homolog annotation: Hit_ID=CAG03778.1; Match level="QueryCoverage =100%, HitCoverage=38%, E-value=1e-86, Identity=54%"; Hit description= unnamed protein product [Tetraodon nigroviridis]
  Essential gene: C elegans homolog=H39E23.1a; Phenotype=Spo
KFRQVSAVQYLHSKNVIHRDLKAENLLLDADMNAENLLLDADMNIKIADFGFSNTFSPGNKLDTFCGSPPYAAPELFQGKKYDGPEVDVWSLGVILYTLVSGSLPFDGQNLKELRERVLRGKYRVPFYMELRERVLRGKYRVPFYMSTDCENLLKKFLVLNPIRRGTLEMISTDCENLLKKFLVLNPIRRGTLEMIMRDKWMNMGYEEDELKPYTEPTKDVRDERRILKLQAFGYTLQQIHESLERERFDEIFGTYLLMKEAKKHDAQGQSLGGSGPNATAESPFNQSMGPTPTNFGNSTSDSFSSKTNCSGTSDVQNGTKTSRQPSQRSTT

SEQ ID NO: 121190 - protein, 447 aa, Heterodera glycines
  Coding regions on vcDNA: vcDNA=SeqID_47613; Strand=-; Position=1-1344
  Homolog annotation: Hit_ID=NP_498735.1; Match level="QueryCoverage =91%, HitCoverage=97%, E-value=1e-46, Identity=30%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MAFHKIDSSSIDSITNAVDFFSIPPTNVTVSSSKVFEILPSNPLTDTPYHFKIHSSQNYIDLSKCYLLTEFRMRKLTPPNGEWGHLDATDQVVPIQLIGHTFIRDMKIAINGREIFNSNSLMAYKTYLSHELSQSLEAKVSHLTAAGYDREDASNLQNANSEGFKSRRQRYLGGRTAQYIAKIDADLFNVPQYLINHCEIDITIQPHDDNFLLIDTLDPPGQPYSIELVGLKLYCKKVSLMDGLALELAKKLEMKPARYAVRKTMMKALFISPGRYEFNANLFMDQVPRRVTMGLVANSDYVGNIKRSPFNFQHFNVRELSVVANGRSYPQAPYDIDYENWKFVRPYNDTQEALGFANSTYGNGIDYFSFLHTHCIYVFNMTNSGDDHGGLFDLIKKGCTAVNIKFKKPVPDGGITLIVMGEADSIYFLDKTERSRPTQPFKSFLKC

SEQ ID NO: 121191 - protein, 75 aa, Heterodera glycines
  Coding regions on vcDNA: vcDNA=SeqID_47614; Strand=-; Position=1 -75,581-733
  Homolog annotation: Hit_ID=NP_510290.1; Match level="QueryCoverage =96%, HitCoverage=6%, E-value=2e-09, Identity=41%"; Hit description =kinase (XO299) [Caenorhabditis elegans] emb|CAB03829.1| Hypothetical protein C04A11.3 [Caenorhabditis eleg
  Essential gene: C elegans homolog=C04A11.3; Phenotype=Gro,Unc
METALWELEEAQLAEKHALLTQQFRRTHMLARHAKEQEHVRRINQSKEEQLLRALTADRKALPQSVAQRGEERGR

SEQ ID NO: 121192 - protein, 230 aa, Heterodera glycines
  misc_feature (112)..(112): Xaa can be any naturally occurring amino acid
  Coding regions on vcDNA: vcDNA=SeqID_47615; Strand=-; Position=1 -257,859-1020,2129-2231,2903-3037,3652-3688
  Homolog annotation: Hit_ID=CAE67016.1; Match level="QueryCoverage =96%, HitCoverage=23%, E-value=4e-61, Identity=46%"; Hit description =Hypothetical protein CBG12417 [Caenorhabditis briggsae]
  Essential gene: C elegans homolog=F36F2.3; Phenotype=Emb
MFSVHYKFKATLEYKTLTFDGLHIGVDELKKAICDKENIRTESFDLLLTNAHTKREYAVGELVPRNSSVVVQRIPRENAQKLPKVQAALNKSLVNILFSKFLFKFNSFSYFXEEFAGMSEEQRLAHIKRVSTEKYSSTNYQRRSGGIMTGPPPATYVCNRCGQPGHWYKSCPLLNLRRTAGITMEELMETDRDDPLAMLHPSGKFVKPIMHHQARMQRLTRKNMKNKFNF

SEQ ID NO: 121193 - protein, 244 aa, Heterodera glycines
  Coding regions on vcDNA: vcDNA=SeqID_47616; Strand=+; Position=1 -128,587-669,737-821,1107-1279,1718-1785,1840-1941,1990-2084
  Homolog annotation: Hit_ID=NP_496709.1; Match level="QueryCoverage =97%, HitCoverage=26%, E-value=1e-71, Identity=51%"; Hit description =tre oncogene-related protein (2N15) [Caenorhabditis elegans]
  Essential gene: C elegans homolog=Y46G5A.1a; Phenotype=Sck,Stp
NGEPLEPPQAFATASTSEDSFEEDQEFLELQEREQIVDKYERGPDQNDVDPWENPDFELYKITDRYGFMQANRRAEEGTKRVEARAEMVKDAQGMGAAIWKRLTGADTMKANSREKLYKELLARARLVSRDIKQIDLDINRTYRDNLAFRRRYDVKQQSLFNVLTAYAMLNTEVGYCQGMSQIAALFLMYMDEEEAFWSLHGLLVNRKYGMHGFFVPGFPKLHRFQNHYDKVLLKYLPRVKSHL

SEQ ID NO: 121194 - protein, 154 aa, Heterodera glycines
  Coding regions on vcDNA: vcDNA=SeqID_47617; Strand=-; Position=1 -124,187-330,735-930
  Homolog annotation: Hit_ID=NP_498386.2; Match level="QueryCoverage =97%, HitCoverage=47%, E-value=2e-38, Identity=52%"; Hit description =DeHydrogenase, Short chain, complex, LEThal LET-767 (34.3 kD) (let -767Co) [Caenorhabditis elegans] gb|AAA
  Essential gene: C elegans homolog=C56G2.6; Phenotype=Lva
ASINNQTNVNIVSVNNVGMSYEYPERLDRIEGGLQRVSDITVINTLPTTVLSAFVLKQMRERGRGVVVNLASSAAYFNWFYLAAYSASKKYVCWLSSILRMEYADTDIVIQTVCPMMVATKMAKIRKASFFTPSPEEFAAQALRSIGLVDETTG

SEQ ID NO: 121195 - protein, 84 aa, Heterodera glycines
  Coding regions on vcDNA: vcDNA=SeqID_47618; Strand=-; Position=1 -120,413-544
  Homolog annotation: Hit_ID=NP_498386.2; Match level="QueryCoverage =90%, HitCoverage=24%, E-value=1e-15, Identity=51%"; Hit description =DeHydrogenase, Short chain, complex, LEThal LET-767 (34.3 kD) (let -767Co) [Caenorhabditis elegans] gb|AAA
  Essential gene: C elegans homolog=C56G2.6; Phenotype=Lva
MSFLVTLAGYLTIAIFLQKLFRSLYNVVFPYLFAVPQNIKVLAGAEWAVVTGSTDGIGKAYALELAKKNFNVVLISRSMDKLNA

SEQ ID NO: 121196 - protein, 355 aa, Heterodera glycines
  Coding regions on vcDNA: vcDNA=SeqID_47619; Strand=+; Position=1 -108,174-335,586-812,937-1257,1574-1658,1867-2031
  Homolog annotation: Hit_ID=NP_741768.1; Match level="QueryCoverage =57%, HitCoverage=41%, E-value=6e-23, Identity=29%"; Hit description =Platelet-Activating Factor acetylhydrolase (43.4 kD) (paf-2) [Caenorhabditis elegans] gb|AAL65779.1| Paf-
  Essential gene: C elegans homolog=C52B9.7a; Phenotype=Emb,Ste,Stp
MDANLLQNVTTDNNNERQIGQQQILLGQTFDWAQFKNRLALDRCVCMGHSFGAASSLSACAEYPSLFNACVLLDAWLYPVERRMYPATVQPVLMLNASKWQWPRNVRRMQRLLAKATTSTNDDKTATETTTTTAPQQQSQDGAATTAATAQPSVTNTDSRMMFTIKDIVHQSFSDFGFLVPGRVARYIGVQGDLDPLLTGTAVLEMVLQFLESQFLHQQQQKEDEEDTEDEEGEEDELEEKEEEGEKESKERGGGGQRDVRTEQGEQDEVARSNASALDRLRRLVAEKYAAFVVEGTDIPQVKLDEVAPLVEAEQQQAVSAEEERNVANDSGVDTPPTTETTTEEAAENNNQPSS

SEQ ID NO: 121197 - protein, 145 aa, Heterodera glycines
  Coding regions on vcDNA: vcDNA=SeqID_47620; Strand=-; Position=1 -45,413-547,813-928,993-1134
  Homolog annotation: Hit_ID=CAE64139.1; Match level="QueryCoverage =99%, HitCoverage=30%, E-value=2e-34, Identity=47%"; Hit description =Hypothetical protein CBG08755 [Caenorhabditis briggsae]
  Essential gene: C elegans homolog=Y105E8A.17; Phenotype=Emb,Gro,Unc
MPTQTKKGFSLAKAQLGKRPVRKWLWCPFENEARKDGLALKHWEREDKHSTPYSFVQFNKQLDVPSFTDEEYEEHLVDPRWTREQTQHLLELCKQFDLRWPIIEDRFDQELCRNRKSMEDMKERYYGLGHTLNDVRNVQADPIGL

SEQ ID NO: 121198 - protein, 106 aa, Heterodera glycines
  Coding regions on vcDNA: vcDNA=SeqID_47621; Strand=+; Position=1 -130,190-233,874-1018
  Homolog annotation: Hit_ID=CAF89815.1; Match level="QueryCoverage =80%, HitCoverage=7%, E-value=6e-22, Identity=47%"; Hit description =unnamed protein product [Tetraodon nigroviridis]
  Essential gene: C elegans homolog=ZK930.1; Phenotype=Unclassified
LTSRAAILCRPFYKSTLYDRLSTRPYLTGIEKRWIAFQLLKALAQLRIAMVRHGDIKSDNPSDFTFFFDTNRRRHCYLAPERFRDSEELEARAAVAAGMEFPNFYE

SEQ ID NO: 121199 - protein, 311 aa, Heterodera glycines
  Coding regions on vcDNA: vcDNA=SeqID_47622; Strand=-; Position=1 -109,160-319,478-625,697-903,1053-1361
  Homolog annotation: Hit_ID=NP_501859.1; Match level="QueryCoverage =99%, HitCoverage=96%, E-value=1e-132, Identity=72%"; Hit description= guanine nucleotide-binding protein -like (35.8 kD) (4K941) [Caenorhabditis elegans] emb|CAA93514.1| Hypo
  Essential gene: C elegans homolog=K04D7.1; Phenotype=Gro,Slu
MGEQMKLEGSLRGHNGWVTQIATNPLYKNMLVSASRDKTIIVWMLDESGSVLNGKPIKSLHGHGHFVSDVVMSSDGQYALSGSWDKTLRLGQTTRQFVSHTQDVLSVAFSADNRQIVSGSRDKKIKLWNTLAQCKHTIVEECHSDWVSTVRFSPSHANPVIVSAGWDKIVKVWNLATCRLKTNHFGHTGYINSVTVSPDGSLCASGGKDGSAMLWDLNDGKHLYTLGGNDVINALAFSPNRYWLCAAVGPVVKIWDLENKTVVDELKLDIASTSAANPMRVSKKSCPQCISLAWSTDGQTLFAGYTDNMIR

SEQ ID NO: 121200 - protein, 85 aa, Heterodera glycines
  Coding regions on vcDNA: vcDNA=SeqID_47623; Strand=-; Position=1 -49,240-448
  Homolog annotation: Hit_ID=CAE65221.1; Match level="QueryCoverage =95%, HitCoverage=16%, E-value=3e-32, Identity=80%"; Hit description =Hypothetical protein CBG10097 [Caenorhabditis briggsae]
  Essential gene: C elegans homolog=T26G10.1; Phenotype=Lva
MTSQTLSLAKRPHIIVATPGRLVDHLENTKGFDLRTVKFLVLDEADRILNMDFEVELDKILKVLPKARKTYLFSATMTQKVLDFV

SEQ ID NO: 121201 - protein, 1023 aa, Heterodera glycines
  Coding regions on vcDNA: vcDNA=SeqID_47624; Strand=+; Position=1 -12,222-407,464-1049,1112-1657,1711-1923,1989-2198,2246-2415,2675 -2863,3104-3321,3402-3646,3799-3919,4115-4376,4428-4488,4550-4602
  Homolog annotation: Hit_ID=NP_497853.1; Match level="QueryCoverage =99%, HitCoverage=87%, E-value=0.0, Identity=70%"; Hit description =splicing factor (147.3 kD) (3F354) [Caenorhabditis elegans] emb|CAA90777.1| Hypothetical protein T08A11.2 [
  Essential gene: C elegans homolog=T08A11.2; Phenotype=Emb
MTCSEKIENELAEKQQHGELNQSAKMSKPFVAGTDLTSVASEDVENTPSQLVRKKRIVLSENVISAEKTPNVARWEETPAHIGAGDATPAAGKQWDATPSQTPRRNRWDETPKESVRDGGMTPGWGSETPRDIKVDMSERSEETPGASKRRSRWDLTPAQTPAVGSETPLNGMDAPTPAHFTPKIQNGGMTPSLLTPGGSTPIGTPAMGMKTPAVPFVPMTPEQAAIYKWEKEIDDRNRPLSDEELDALIPPGYRILAPPSGYIPIRTPARKLLSTPTPMTGVGGFMIPPTPERGGAGDKGVGGILDTQPKDPELPALKPEDIQYFDKLLQDVDESTLTKAEKNEREIMGYLLKIKNGAPPQRKSGLRKITENARRLGAGPLFNQILPLLMSPTLEDQERHLMVKVIDRILYKLDDLVRPYVHKILVVIEPLLIDEDYYARVEGREIISNLAKAAGLATMISTMRPDIDNVDEYVRNTTARAFAVVASALGIPALLPFLKAVCKSKKSWQARHTGIKIVQQIAILMGCAVLPHLKSLVEIVESGLVDDQQKVRTITALCIAALAEAATPYGIEAFDSVLKPLWKGIRTHRGKGLAAFLKAIGFLIPLMDAEYASYYTKEVMLILIREFVSPDEEMKKIVLKVGSVEIISRIVDDLKDENEQYRKMVMETIENIVALMGASEIDSRLEEQLIDGILYAFQEQTQEIAKIAPVMNICQEEKLMGHLGVVLYEYLGEEYPEVLGSILGALSAIVSVIGMTKMTPPIKDLLPRLTPILKNRHERVQENCIELVGKIADRGSEFVSAREWMRICFELLELLKAHKKSIRRAAINTFGYIAKAIGPHDVLATLLNNLKVQERQLQINVQNGVLKALSFMFEYIGEMAKDYIYAVTPLLVDAMMERDVVHRQIAIDAVAHLTLGVHGFGCEDALMHLLNFVWPNMLENSPHVIQRFVFACDAMRVSLGPIKVLQYCLQALWHPARKVREPTWKVYNNLILGSQDAVVAGYPRIANTDRNHYTRYELDYVL

SEQ ID NO: 121202 - protein, 446 aa, Heterodera glycines
  Coding regions on vcDNA: vcDNA=SeqID_47625; Strand=+; Position=1 -75,894-958,1007-1151,1198-1301,1387-1544,1610-1784,1852-1942,1989 -2100,2142-2290
  Homolog annotation: Hit_ID=CAE71891.1; Match level="QueryCoverage =83%, HitCoverage=86%, E-value=3e-90, Identity=46%"; Hit description =Hypothetical protein CBG18949 [Caenorhabditis briggsae]
  Essential gene: C elegans homolog=W01A11.2; Phenotype=Emb
FRLALRQILGKIILKITLKDNLTNKMFLKFNHPFHQMLQFIAVFHFFFLWVVLPLLSVFVPFYLFFYTKFFFLWVVLPLLSVFVPFYLFFYTKFWWIVCLYFIWFLYDFDTPRRGSRNWLWYKNSFVWKHFADYFPIKLLWYKNSFVWKHFADYFPIKLIKTADLPPNNNYILGCHPHGVFSTASFVHLCTSATGFGQLFPGLKSNILTLNGQFWFPFRREIGIGLGGVGVESSSHSLKFLLNNPGRGRLIGIVIGGAEEVLDAHPGKHHLNIMGRRGFCRFALKTGTTPLVPSYSFGENDLFDQLPNPRGSLLRTVQSTIKRKCGFCIPIINGSTIKRKCGFCIPIINGCCGISDRGLLPRRRSITTVIGAPIEVKRIGSPTPAQVDQLHLRYVIGAPIEVKRIGSPTPAQVDQLHLRYCNALNELFEEHKSKYGVPNDKHLTVH

SEQ ID NO: 121203 - protein, 232 aa, Heterodera glycines
  Coding regions on vcDNA: vcDNA=SeqID_47626; Strand=-; Position=1-699
  Homolog annotation: Hit_ID=NP_508269.1; Match level="QueryCoverage =87%, HitCoverage=30%, E-value=2e-09, Identity=23%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTCPQKISDSSPLAINTGLNIFLVPPTNVSVVRSFFRQVLPLATITQESPYLFRLYSDNLWTDLSRIYLYLELSIEKPGANDKWVAIDDADTSVSAIQGIGQTFVQQLKVTVGNTEVYDSGNLYPFKAYITNELSFPINAKKNFLGSTGYYHTINQDDSTDEGFKERCKIFKGGKNAQFLSRLDFDLGNQELYLLNNLDLLFTIYKAKDVFLLQTLKANDDSLRCQDLCQNG

SEQ ID NO: 121204 - protein, 49 aa, Heterodera glycines
  Coding regions on vcDNA: vcDNA=SeqID_47627; Strand=+; Position=1 -37,360-472
  Essential gene: C elegans homolog=ZK863.6; Phenotype=Dpy,Slu
MTIVPILLQALSALAKERPSDPIEFVANYLLKEKPRFNGAANASATNEH

SEQ ID NO: 121205 - protein, 264 aa, Heterodera glycines
  Coding regions on vcDNA: vcDNA=SeqID_47628; Strand=-; Position=1 -321,532-725,842-1121
  Homolog annotation: Hit_ID=NP_509805.2; Match level="QueryCoverage =69%, HitCoverage=9%, E-value=3e-53, Identity=57%"; Hit description =phospholipase C, putative effector of Ras (212.9 kD) (plc-1) [Caenorhabditis elegans] emb|CAB60298.3| Hypo
  Essential gene: C elegans homolog=F31B12.1a; Phenotype=Ste,Stp
MTLWEIMQARSTLFVHKIFNRSARPSQSLFDQSAIPGNDASRSSRNTSYSSSTTCSSIRNSAGGILCGAEPITLFRLELERLQYILHFPEEVAFQASDPNAFPTEAGLWILFGFVGCDLANISAQDNPSPVKNLVKRLSEVSSWITHIIISQPTHEERKSCLAAIMRVMDTCWNIGNFNATIEILLGLKSPRLRPFWLSLKQEERQRFDEFAAILVPPTNQKQQNQIPTNGCAYQQMNGGGTAHWTPHPAYIEVAKGVGNSSKL

SEQ ID NO: 121206 - protein, 1100 aa, Heterodera glycines
  misc_feature (153)..(153): Xaa can be any naturally occurring amino acid
  misc_feature (164)..(164): Xaa can be any naturally occurring amino acid
  misc_feature (1098)..(1098): Xaa can be any naturally occurring amino acid
  Coding regions on vcDNA: vcDNA=SeqID_47629; Strand=-; Position=1 -37,129-367,419-530,596-714,1015-1372,1415-1575,1637-2103,2152 -2348,2410-2601,2646-2793,2861-2990,3053-3098,3322-3450,3499 -3606,3652-3766,4165-4269,4313-4568
  Homolog annotation: Hit_ID=NP_492222.2; Match level="QueryCoverage =99%, HitCoverage=42%, E-value=0.0, Identity=50%"; Hit description=j -domain containing protein, required for endocytosis, Receptor Mediated Endocytosis RME-8 (259.2 kD) (rme-
  Essential gene: C elegans homolog=F18C12.2a; Phenotype=Emb,Lva,Unc
KNLFKNNHLTRILFKLSLDKFKLSLDKQNVRELISANLISLFIDIAVLAHLHTNRAKLHGQTNVIEATKEHCEETEPKEWYYNDRQGQRQGPISFKKMKRLYRDGVLFMKRLYRDGVLFEKSEIWAEGLDKWCHLSSVSQFRWTVCNRKKGRXTNDTNRKKGRXTNDTADGPNLTDLCSLILDTLIQMCTFFPSRDETDAVIRPMPRIKKVLSEPVLLYQLVQLLLTYDPSIVQRVATLVNDVMQDNPYISRLYLSGIFFFILMYNGSNILPVARFLKDTHLRQAFRSTLSKSELASRSVLCPMLPEANIFYLEEYGAEKYAEVFLGEEYGAEKYAEVFLGEFENPECIWNSEMRRNMIEKIALHVSDFSSRLSSNVKALYRYCPIPPIDYPQLKEELFCHFYYLRHLTDNHRFPNWPIREPVDFLRACLSAWHDEITRKPAKMSVEQACERLGLSTTDSRWKDASAVRRAYFKLAQKYHPDKNPDGREQFEQINYAYEFLTSTLVRANSSSTPDMNRIVIIIRAQSIVYKRNLQVLSPYKYAGLSPYKYAGYTQLIKTIDLESSDDTLFARNGGQLLVAAVELCHWTLRSSSLNAEQLRRDGGLDALYALYKTFERCVPMITAGSLESEMPVQVCTHVCNCFATAARFDACREKIAEMKTLFQSICQLLRFESLHRLACAAAECVCAFSVCTLLQTESLHRLACAAAECVCAFSVCTLLQTQLFQAGVIWQLLPHLFRFDYTLDEGGVAHSEKTNHQAVVAHSEKTNHQAVLNRLARNCCEALACLAGFRPDTPDNDGVQKSLRAMLTPFLRAMLTPFICRQMQLCRNDFVLKLLNANTEDPYLIWDNSTRAELLDFVDKQRNSHENVSEMFGAEFKLSIYATELVVGSEMFGAEFKLSIYATELVVGEIFVRIYNAQPEFRLLEPKRTCMDFEPKRTCMDFLDYLSKHVEELLIGEGVVRPAAVKQKPITIGTVNLNGASGGRFPLQERVRMVLEALRNVLMMNPGIELLLIGHIELLLIGHFSAIFAFLRVHSLSAIQLKALQIISIAANNKECVSDIACSIQLPLLLTLLSKLHKGRENFTELISKKSSNFKMXFF

SEQ ID NO: 121207 - protein, 498 aa, Heterodera glycines
  Coding regions on vcDNA: vcDNA=SeqID_47630; Strand=-; Position=1 -138,191-382,448-696,753-1339,1388-1718
  Homolog annotation: Hit_ID=CAE73451.1; Match level="QueryCoverage =91%, HitCoverage=47%, E-value=0.0, Identity=67%"; Hit description =Hypothetical protein CBG20900 [Caenorhabditis briggsae]
  Essential gene: C elegans homolog=Y48B6A.3; Phenotype=Emb,Lva,Lvl
MGVPAFFRWLSRKYVSIIVDAVEQRRREIDGVKIPIDATQPNENYQEFDNLYLDMNGIIHPCTHPEDRPAPKTEEEMFILIFEYIDRLFSIVRPRKLLYMAVDGVAPRAKMNQQRSRRFRAAQEAAEKRELIENVRKRLESEGIPLPPPRKEEEHFDSNCITPGTPFMARLSVALRYYVHKRITYDPAWQKIQVILSDANVPGEGEHKIMDYVRRQRASPAHDPNTVHCLCGADADLIMLGLATHESNFNIIREEFLPNQPRPCELCGQYGHEVEHCEGLARAETGPDQADPLKKEKNFIFIRLPVLREYLERELSMPNLPFPFDLERAIDDWVIQSKVSILKLRYSQVMMCFFVGNDFLPHLPSLEIRENAIDRLVKLYKDMVYQAGGWLTENGIVNIERVKKIMGGLGKVEDEIFKQRQVGPEIKQKWQTQKQLKLKELRFKESKKQRKQQQRQAMAKIMPYNANLIAPMPLGQQKRMSGEEMRRLAAGDRQEVAF

SEQ ID NO: 121208 - protein, 123 aa, Heterodera glycines
  Coding regions on vcDNA: vcDNA=SeqID_47631; Strand=+; Position=1 -205,250-500
  Homolog annotation: Hit_ID=NP_497138.1; Match level="QueryCoverage =70%, HitCoverage=43%, E-value=2e-10, Identity=40%"; Hit description =nuclear localization signal containing protein deleted in velocardiofacial syndrome like (21.8 kD) (3A705
  Essential gene: C elegans homolog=F54C4.1; Phenotype=Lva
MISGHRSVGRCLLSLPQFASRLIPIYGHVQAQCFHFMKKQVTVDPEIAKLREGRKRRKLTKAIKKLAEYSKKPVPVEEIEVDLRHQATKGQRERTDNGVQGRDEKKEAYGRKKLLKQYAQSRA

SEQ ID NO: 121209 - protein, 136 aa, Heterodera glycines
  Coding regions on vcDNA: vcDNA=SeqID_47632; Strand=+; Position=1 -124,201-487
  Homolog annotation: Hit_ID=CAE57494.1; Match level="QueryCoverage =47%, HitCoverage=34%, E-value=3e-12, Identity=52%"; Hit description =Hypothetical protein CBG00465 [Caenorhabditis briggsae]
  Essential gene: C elegans homolog=F54C4.1; Phenotype=Lva
MWIKRSIDAQENALEVLKQLSPTLYEAAVQLDERLFYTQIQGPPISPPIDNYNCPDGEYQDVTKKWELPMLEELEKKFGTGRLIKMPEFKKKQIQMMRQKAEEEEEKMAIKDPWLKKDTSCAVEEQNETEVQLAKA

SEQ ID NO: 121210 - protein, 81 aa, Heterodera glycines
  Coding regions on vcDNA: vcDNA=SeqID_47633; Strand=+; Position=1 -128,868-983
  Homolog annotation: Hit_ID=CAE71538.1; Match level="QueryCoverage =48%, HitCoverage=8%, E-value=7e-11, Identity=71%"; Hit description =Hypothetical protein CBG18478 [Caenorhabditis briggsae]
  Essential gene: C elegans homolog=T01B11.2a; Phenotype=Emb
MSDWMGRDISTISASIFSLRQDETHPGKGTNKGQQRSGRTNWGSKCQTFYADEPILVTRASMQFLFDENGRRFLDCISNVQ

SEQ ID NO: 121211 - protein, 163 aa, Heterodera glycines
  Coding regions on vcDNA: vcDNA=SeqID_47634; Strand=-; Position=1 -164,423-498,545-683,738-847
  Homolog annotation: Hit_ID=AAR07614.1; Match level="QueryCoverage =100%, HitCoverage=34%, E-value=3e-63, Identity=63%"; Hit description= UNC-18 [Haemonchus contortus]
  Essential gene: C elegans homolog=F27D9.1a; Phenotype=Unc
MTQDLLNIENDVYRYETGGAESVDKEVLLDENDDLWADNRHKHIAVVSQEVLNMGTHFHLAEECMNRYKHGVDKLCKVEQDLAIGMDADGERIKDPMKLMVPLLIDPSVKLEDRLRLILLYIFHKNGITDENLNKLLQHANIPQTERETLTNAALLGLNIVID

SEQ ID NO: 121212 - protein, 352 aa, Heterodera glycines
  Coding regions on vcDNA: vcDNA=SeqID_47635; Strand=+; Position=1 -288,331-623,667-982,1349-1508
  Homolog annotation: Hit_ID=CAE61660.1; Match level="QueryCoverage =99%, HitCoverage=33%, E-value=1e-121, Identity=64%"; Hit description= Hypothetical protein CBG05596 [Caenorhabditis briggsae]
  Essential gene: C elegans homolog=Y59A8B.6; Phenotype=Emb,Gro,Stp,Unc
MATTIPGSLVNKTKKHFLGMTAPAGYVAGVGRGATGFTTRSDIGPARDSTDVPMDAAMASAAAAAAAPAPGPPPKKQRNDDDHDEAEDLNDANYDEFEGYGGSLFAKDPYDKDDEEADEIYHAVDMRQDERRREYRERKYKEAVESYRKERPKIQQQFSDLRRQLATVKEEEWAAIPEVGDSRNRAKRNPRGEQLTPVPDSVIASAMSYNQMNTMLDKNVQNGISTPYSGFQSTLGGFQSTFGFQSTFGFQSTLGGFHSVLNGGQMTPGWKTQTGSSTDLDLRKIGQAKNRIMDIRLNQVSDSVSGQTVVDPKGYLTDLQSMIPQFGADMQDIKKGRMLLKSLRETNPEKPQ

SEQ ID NO: 121213 - protein, 538 aa, Heterodera glycines
  misc_feature (512)..(512): Xaa can be any naturally occurring amino acid
  Coding regions on vcDNA: vcDNA=SeqID_47636; Strand=+; Position=1 -101,153-254,302-344,394-435,482-661,716-862,909-980,1026-1198,1245 -1381,1427-1482,2458-2617
  Homolog annotation: Hit_ID=NP_496429.3; Match level="QueryCoverage =93%, HitCoverage=46%, E-value=9e-64, Identity=32%"; Hit description =voltage gated CLC-type chloride channel subunit, with CBS domain (92.9 kD) (clh-2) [Caenorhabditis elegan
  Essential gene: C elegans homolog=B0491.8a; Phenotype=Emb,Sck,Ste
SQFFLSVTLVAFSLTHFPEDAFEPEELPFFALIGVFCGFIGAGVFCGFIGAGFIFFYRNVVMFLRQNSFIRRNIQKNWLLYPVVIAFLVGVWLLYPVVIAFLVGVLTYPRGYGRLTYPRGYGRFLSGRYKFTRTVLDFFSNCTWSKGVYKFTRTVLDFFSNCTWSKGVHHSVLAPHGCPSELLGTWTNHEDGPYNVFLVLSLFTFTFLVLSALCNTMPIPCGMFMPLFVLVLSALCNTMPIPCGMFMPLFVVGAAFGRLMGEIVSSMFPDGITGGTDQPIFPGIYAVVGAAALTGAPIFPGIYAVVGAAALTGAVTHSVSVAMICCEITGQLIYIIPLMVAMICCEITGQLIYIIPLMIAVIIANAICAYFQPSLYDVMIGIKNLPYLPDIPPSNAEVHHCTVHHCTAENIMVSKVRFLCRLTQFKEIRSLLIEMPKLRSFPVVDDPASMMLLGSISRRTMVELLKASMMLLGSISRRTMVELLKVHLRHKETEERADYDLTEDEVIRETKXEESNWGRESKKRRVNRINSLGKEKPS

SEQ ID NO: 121214 - protein, 97 aa, Heterodera glycines
  Coding regions on vcDNA: vcDNA=SeqID_47637; Strand=+; Position=1 -111,160-342
  Homolog annotation: Hit_ID=CAE65731.1; Match level="QueryCoverage =95%, HitCoverage=36%, E-value=2e-13, Identity=39%"; Hit description =Hypothetical protein CBG10814 [Caenorhabditis briggsae]
  Essential gene: C elegans homolog=Y110A7A.11; Phenotype=Emb,Lva,Unc
MDEEAKQENLAKELLKLTSSLKQNFTTAGSVLKEDNATLDVMQRVALSNKENLIRERGRLGHHAYQSCFNCVMVMTVIVVIWSFIAMIIMMRMFPKI

SEQ ID NO: 121215 - protein, 580 aa, Heterodera glycines
  Coding regions on vcDNA: vcDNA=SeqID_47638; Strand=-; Position=1 -208,265-434,462-635,679-951,996-1229,1284-1397,1454-1539,1590-1783
  Homolog annotation: Hit_ID=XP_320668.1; Match level="QueryCoverage =100%, HitCoverage=31%, E-value=1e-117, Identity=42%"; Hit description=ENSANGP00000021183 [Anopheles gambiae]
  Essential gene: C elegans homolog=F55H2.6; Phenotype=Emb
GHNVLLIQIGESDIIQELHMLLERDSSCHRTCFKLYYEGTALDNYTELRNVPDIKDNAVMRVVEEPYNLREARPYNLREARVHVRHLREIIRSVDISDAVSGVDFASLSCLSTITQSTSDELGKKSKGSSDCLPPEWLLPNSSDIILKPLIPLGKKSKGSSDCLPPEWLLPNSSDIILKPLIPMAEHSNGTLQPTQLIALKQISFSAFNPPPGPRKMKGDILYLVVDTGDILYLVVDTVEDRRFHVTCCTRGFFVNSTIGEKFKPERSSTYGGRVFHSLFDLLSDISAHFKKTLVQLLKLRNEKHIFERLPTPFQLYQWIVPSVENTQDQLRADEQVQPHRLGLWIVPSVENTQDQLRADEQVQPHRLGLEDHMPGQIRDWNEELQTTHDMPQSSFAEKLCRDRARFKVHADFLSACTRGASAVIDGSVHTIVIDGSVHTINPMDEPRMHMFIWNNIFFSLGFDVKDHYKELGGDAAAHASYELGGDAAAHASYSADLAAVQAYAQIDDPKLHTSGMLHTSGMAIIDFKGLRVMAQSIIPGILEREQQDSIVYGSYDSGKTVTTNELYEELLKSAKLLKI

SEQ ID NO: 121216 - protein, 124 aa, Heterodera glycines
  Coding regions on vcDNA: vcDNA=SeqID_47639; Strand=-; Position=1 -52,132-222,460-691
  Homolog annotation: Hit_ID=NP_741532.1; Match level="QueryCoverage =87%, HitCoverage=19%, E-value=1e-28, Identity=53%"; Hit description =astacin and metridin-like ShK toxin precursor family member (5F316) [Caenorhabditis elegans] gb|AAL16314.
  Essential gene: C elegans homolog=C37H5.9a; Phenotype=Emb
MHETLHSLGLGHEQSRADRDKYITINKDNINPQQYDVFAISDQTKYSSYGVKYDYGSVMHYDAHMGAKTWGVKTIHAKFDPEHNDSKMGQREKLSDSDIEALRRMYCMPSKANTVFASMPHNLK

SEQ ID NO: 121217 - protein, 192 aa, Heterodera glycines
  misc_feature (23)..(23): Xaa can be any naturally occurring amino acid
  misc_feature (31)..(31): Xaa can be any naturally occurring amino acid
  Coding regions on vcDNA: vcDNA=SeqID_47640; Strand=+; Position=1 -179,235-267,337-447,501-615,1483-1592
  Homolog annotation: Hit_ID=NP_081767.1; Match level="QueryCoverage =83%, HitCoverage=43%, E-value=1e-32, Identity=45%"; Hit description =Ras-related GTP binding D [Mus musculus] dbj|BAB30954.2| unnamed protein product [Mus musculus]
  Essential gene: C elegans homolog=Y24F12A.2; Phenotype=Emb
NFPLWRLFSTFLIRYLFCLLGLXAKDNLFVXGSNVEKSFLFDVSSKIYIATDSSPVDMATYELCCDMIDATYELCCDMIDVTIDISSIYGHRNDFRPIGFDQDSSAVITLRTRQVIFVIFLRQINVYLALVCVIKEDNFEKQGLIDFNFNVFKQAIRKQRKGRKKRKKMRKEKRTEGRRKGPIGRSTSAKVC

SEQ ID NO: 121218 - protein, 218 aa, Heterodera glycines
  Coding regions on vcDNA: vcDNA=SeqID_47641; Strand=+; Position=1 -6,508-643,695-806,1301-1508,1646-1840
  Homolog annotation: Hit_ID=AAM81355.1; Match level="QueryCoverage =99%, HitCoverage=54%, E-value=4e-72, Identity=58%"; Hit description =heat shock protein 40 [Steinernema feltiae]
  Essential gene: C elegans homolog=F39B2.10; Phenotype=Emb,Spd
MGAYEVLSNPEKRKVYDEYGEEGLKGGGEGGGMHNPMDIFEMFFGGGGFRGGGEKPTKVRDTVHQLTVSLDKLYNGCTKHLRITRHILCPKCNGVGGAKEGVKQCENCRGRGLEIHNMQIGPGMIQRIQRACSECGGEGEINRNPCKHCGGKKRIKSEETIEVHIEKGMRDGQRLMFYGKGDQQPGLEPGNVIIVLDEEEHPVFTRRGTNVTLNMKLT

SEQ ID NO: 121219 - protein, 148 aa, Heterodera glycines
  Coding regions on vcDNA: vcDNA=SeqID_47642; Strand=+; Position=1 -162,464-578,725-784,854-927,1032-1064
  Homolog annotation: Hit_ID=CAE56261.1; Match level="QueryCoverage =97%, HitCoverage=44%, E-value=1e-43, Identity=55%"; Hit description =Hypothetical protein CBG23904 [Caenorhabditis briggsae]
  Essential gene: C elegans homolog=F56B3.8; Phenotype=Gro
LCIHIGGGVKFDYFMLNLHPRGPTVADETYDERVIEVRRDPNRTPYIALVAGVKGKRWIYATQNMQAGQIIQTTCHIPERPVIGCEGNSYPLGALVEGTMVNSIELHRNNPNSHVVITEAGGCAEIIRHMDEFTVVRMPNKYEYAVRK

SEQ ID NO: 121220 - protein, 236 aa, Heterodera glycines
  misc_feature (6)..(6): Xaa can be any naturally occurring amino acid
  misc_feature (9)..(9): Xaa can be any naturally occurring amino acid
  Coding regions on vcDNA: vcDNA=SeqID_47643; Strand=+; Position=1 -208,268-391,441-532,653-821,883-953
  Homolog annotation: Hit_ID=NP_593877.1; Match level="QueryCoverage =91%, HitCoverage=80%, E-value=4e-41, Identity=47%"; Hit description =conserved hypothetical UPF0001 family protein [Schizosaccharomyces pombe] emb|CAB90136.1| SPAC644.09 [Sch
  Essential gene: C elegans homolog=F09E5.8; Phenotype=Emb
LSFHVXRSXFMPFVRLPVESVLLCYRQGQRHFGENYLQELETKAQQMAEHGADQIRWHYIGRIQSNMINRICAVPNLINRICAVPNLWCVETVDSVKHANGLQRAMNAMGKPLKIFIQVNTSGELNKNTSGELNKGGVHPEGLLPLATHVTEQCHSLNFKGLMTIGSISQSLGSGDENADFALLRKLRDALQTELRLSTLELSMGMSADYQLAIKYGSTNVRVGSTIFGVRNYAKK

SEQ ID NO: 121221 - protein, 107 aa, Heterodera glycines
  Homolog annotation: Hit_ID=AAG21333.1; Match level="QueryCoverage =100%, HitCoverage=100%, E-value=9e-57, Identity=100%"; Hit description=hypothetical esophageal gland cell secretory protein 3 [Heterodera glycines]
  Gene Ontology: Mol. function=phospholipase C activity; Cellular component=mitochondrion; Biological process=protein-nucleus import
  Essential gene: C elegans homolog=H06O01.1; Phenotype=Sma
  Coding regions on vcDNA: vcDNA=SeqID_47644; Strand=+; Position=35-355
MNSVLSISILFLLSQVLSTVSSSDVLEYTDASFDSGMQQHDIALAEFYAPWCGHCKKLAPEYEKAATKLKNNDPPIPLIKVDCTAEKETCDKFGVSGFPTLKIFRKG

SEQ ID NO: 121222 - protein, 146 aa, Heterodera glycines
  Homolog annotation: Hit_ID=AAT70232.1; Match level="QueryCoverage =100%, HitCoverage=88%, E-value=1e-81, Identity=60%"; Hit description= unc-87 [Heterodera glycines]
  Gene Ontology: Mol. function=troponin C binding; Cellular component =cytoskeleton; Biological process=muscle contraction
  Essential gene: C elegans homolog=F08B6.4a; Phenotype=Unc
  Coding regions on vcDNA: vcDNA=SeqID_47645; Strand=+; Position=2-442
YSHEQSIDQTSIPYQMGSNKYASQKGMTGFGQPRWEVLDPSISYQNRKSQGMVRLQSGTNRFASQAGMTGFGTPRNNTYEAEAGELPYEDMKKSEAIIPSQAGWNKGDSQKLMTNFGTPRDVKGKHLKRIWELEYPEEAEVSLDRL

SEQ ID NO: 121223 - protein, 85 aa, Heterodera glycines
  Homolog annotation: Hit_ID=AAG39301.1; Match level="QueryCoverage =100%, HitCoverage=100%, E-value=1e-44, Identity=100%"; Hit description=HSP90-like protein [Heterodera glycines]
  Gene Ontology: Biological process=reproduction
  Essential gene: C elegans homolog=C47E8.5; Phenotype=Emb,Ste
  Coding regions on vcDNA: vcDNA=SeqID_47646; Strand=+; Position=1-437
NKTKPIWTRNPDDISNEEYAEFYKSLSNDWEDHLAVKHFSVEGQLEFRALLFVPQRAPFDLFENKKSKNAIKLYVRRVFIMDNCE

SEQ ID NO: 121224 - protein, 650 aa, Heterodera glycines
  Homolog annotation: Hit_ID=AAG47839.1; Match level="QueryCoverage =100%, HitCoverage=100%, E-value=0.0, Identity=100%"; Hit description= heat shock protein 70 [Heterodera glycines]
  Gene Ontology: Mol. function=non-chaperonin molecular chaperone ATPase activity; Cellular component=intracellular; Biological process=reproduction
  Essential gene: C elegans homolog=F26D10.3; Phenotype=Lva,Ste
  Coding regions on vcDNA: vcDNA=SeqID_47647; Strand=+; Position=21-1973
MPSKANAIGIDLGMTYSCVGVFQHGKVEIIANDQGNRTTPSYVAFTDTERLIGDAAKNQVAMNPSNTVFDAKRLIGRKFDDPAVQSDMKHWPFKVVQGEGARPKVMVEVKGEDKAFFPEEVSSMVLIKMKETAEAFLGQTVTDAVVTVPAYFNDSQRQATKDAGTIAGLNVLRIINEPTAAAIAYGLDKKGQGERHVLIFDLGGGTFDVSILTIEDGIFEVKSTAGDTHLGGEDFDNRMVNHFVAEFKRKHKKDLSSNPRALRRLRTACERAKRTLSGSTQASIEIDSLFDGIDFYTNITRARFEELCADLFRNTMDPVEKALRDAKMDKSQIHDIVLVGGSTRIPKVQKLLSDFFSGKELNKSINPDEAVAYGAAVQAAILSGDKSETVQDLLLLDVAPLSLGIETAGGVMTSLIKRNTTIPTKTSQTFTTYSDNQPGVLIQVYEGERAMTKDNNLLGKFELSGIPPAPRGVPQIEVTFDIDANGILNVSAQDKSTGKQNKITITNDKGRLSKEEIERMVQEAEKFSKEDEVQRDRVSAKNALESYCFNIKQTMEDSNLKDKISEDDKKKVLEKCGEVLAWLDANQAAEKEEFEHQQKELEGICNPIITKLYQAGGAMPGGPMPGGGMPGGGGAAGAGGAGGPTIEEVD

SEQ ID NO: 121225 - protein, 430 aa, Heterodera glycines
  Homolog annotation: Hit_ID=AAK26376.1; Match level="QueryCoverage =100%, HitCoverage=100%, E-value=0.0, Identity=100%"; Hit description= beta-transducin repeat-containing protein [Heterodera glycines]
  Gene Ontology: Mol. function=ubiquitin conjugating enzyme activity; Cellular component=endoplasmic reticulum; Biological process =locomotor rhythm
  Essential gene: C elegans homolog=K10B2.1; Phenotype=Emb,Lon,Lva,Pvl
  Coding regions on vcDNA: vcDNA=SeqID_47648; Strand=+; Position=1-1293
IERQVRNDALWAGLAIRRGWKKYFFCSKDQATRAISQSWRQPKNGEDALEFQHKFYRELYPKITADIRQIEQNWREGRHRLERINCQSENSKGVYCLQYDDEKIISGLRDNTIKIWSRPSLGCVQTLSGHTGSVLCLQYDNQMIASGSSDATVRIWDVNTGEQLKTLVHHCEAVLHLRFQDGMLVTCSKDRSIAVWDMASPRDIEVRRVLVGHRAAVNVVDFDHKYIVSASGDRTIKVWNASTCEFVRTLNGHKRGIACLQYRDRLIVSGSSDYSIRLWDIECGNCLRVLEGHEELVRCIRFDSKRIVSGAYDGKIMIWDLAAALDPMTPPNSICIKTLSQHTGRVFRLQFDEFQIISSSHDDTILIWDFLNTGPSAAVAAGAAAAAAHNQAVQHHQAAPAAQPAAAAMPGGAGAAPAAAIIPLAPPPSP

SEQ ID NO: 121226 - protein, 333 aa, Heterodera glycines
  Homolog annotation: Hit_ID=AAK26378.1; Match level="QueryCoverage =100%, HitCoverage=100%, E-value=0.0, Identity=100%"; Hit description= putative zinc finger protein [Heterodera glycines]
  Essential gene: C elegans homolog=Y53G8AR.9; Phenotype=Rup
  Coding regions on vcDNA: vcDNA=SeqID_47649; Strand=+; Position=18-1019
MTNERDFSHDDHINNAVGTNGDSKDAAKRKDICRDFLNNICSRGNRCKFYHPEDSVEKNQNSADEPYQFCIDFQNQGCYRENCRYVHAFREDVDRYKRSGDVTLGLARALAALLKGDTINGIPLCKEFQNGHCARGPQCRYWHINRDEERRKRFGGGRNCGGSPSSLAFGAYPAVPPAGAQLSRRRGDEFVSEDFAPPSKRSFAHNQPFATIPGQMAPTSAPTAPSHPSPQLVIELERRNAELTTEVESLKRELNREKERYDDLMSLFRAAQGQPTVQRSVISTPSLVPANLQPNISSLSALQQQHQPQSLQQWSATSTSQQPNWTKFDWGAN

SEQ ID NO: 121227 - protein, 212 aa, Heterodera glycines
  misc_feature (190)..(190): Xaa can be any naturally occurring amino acid
  Homolog annotation: Hit_ID=AAK55116.1; Match level="QueryCoverage =100%, HitCoverage=100%, E-value=1e-131, Identity=99%"; Hit description=venom allergen-like protein [Heterodera glycines]
  Gene Ontology: Mol. function=trypsin inhibitor activity; Cellular component=extracellular space
  Essential gene: C elegans homolog=F49E11.9; Phenotype=Unclassified
  Coding regions on vcDNA: vcDNA=SeqID_47650; Strand=+; Position=1-639
MHLINLIALFFMLFGPSVQQYTKTPTNEDKEAAVNCHNKFRSQLALGNADNKLGGNKMPKAGNMRKFEWDENLAKLADEWANKCTLSHSWNGWAGENLAMNGGTFSNKDGFEYACGRWWDELNRYGFNPDLIMTGENFSGIGHWTQMAWADTDRIGCAMAQNCPNTNWKTYVVCWYYTGGNYFGAPVYLXREPCSKCKANDKCDKATGLCSQ

SEQ ID NO: 121228 - protein, 212 aa, Heterodera glycines
  Homolog annotation: Hit_ID=AAK55116.1; Match level="QueryCoverage =100%, HitCoverage=100%, E-value=1e-132, Identity=100%"; Hit description=venom allergen-like protein [Heterodera glycines]
  Gene Ontology: Mol. function=trypsin inhibitor activity; Cellular component=extracellular space
  Essential gene: C elegans homolog=F49E11.9; Phenotype=Unclassified
  Coding regions on vcDNA: vcDNA=SeqID_47651; Strand=+; Position=1-881
MHLINLIALFFMLFGPSVQQYTKTPTNEDKEAAVNCHNKFRSQLALGNADNKLGGNKMPKAGNMRKFEWDENLAKLADEWANKCTLSHSWNGWAGENLAMNGGTFSNKDGFEYACGRWWDELNRYGFNPDLIMTGENFSGIGHWTQMAWADTDRIGCAMAQNCPNTNWKTYVVCWYYTGGNYFGAPVYLAREPCSKCKANDKCDKATGLCSQ

SEQ ID NO: 121229 - protein, 231 aa, Heterodera glycines
  misc_feature (152)..(152): Xaa can be any naturally occurring amino acid
  misc_feature (163)..(163): Xaa can be any naturally occurring amino acid
  Homolog annotation: Hit_ID=AAK60209.1; Match level="QueryCoverage =100%, HitCoverage=100%, E-value=1e-122, Identity=93%"; Hit description=vap-1 [Heterodera glycines]
  Gene Ontology: Cellular component=extracellular space
  Essential gene: C elegans homolog=F49E11.9; Phenotype=Unclassified
  Coding regions on vcDNA: vcDNA=SeqID_47652; Strand=+; Position=1-1555
MEHFPSKFVLCLLIAFIAVPCSVLALSAGSRVSMLACHNNYRSQLAKGTADNKSGKMPAGSNLIQQKYDSNIESVAQKWANGCSMSHSGSSGMGENLYMTSSSTISEADALKQACDMWWAELKQFGFQSSLVLDMAQFNKGIGHWSQANEYXELIKLILLLSXQAWASTAQIGCAMARCPSSTWKTWVVCNYKEAGNFLNQPVYKKGAACSKCSDYNGATCDSASGLCKLP

SEQ ID NO: 121230 - protein, 671 aa, Heterodera glycines
  Homolog annotation: Hit_ID=AAK66762.1; Match level="QueryCoverage =100%, HitCoverage=100%, E-value=0.0, Identity=100%"; Hit description= proprotein convertase 2 [Heterodera glycines]
  Gene Ontology: Mol. function=peptidase activity; Cellular component =Golgi apparatus; Biological process=proteolysis and peptidolysis
  Essential gene: C elegans homolog=K04F10.4a; Phenotype=Emb,Lvl
  Coding regions on vcDNA: vcDNA=SeqID_47653; Strand=+; Position=8-2023
MPSPLKMAALPPLAVVVLLVAVVLPEALFALEVFTNHFLVHTNTAGTENAHRVAKRNGFVNRGPVLGSDTQWHFVQPALSHARTRRSVGHNAKLSQDKDIAYVEQMTGYKRLKRGYRPLADRLQKQLDFTSVQSPTDPLYPFQWYLKNDGQSNGKPRLDLNVEKAWALGYTGKNITTAIMDDGVDYMHADLRFNFNAEASYDFSSNDPYPYPRYTDDWFNSHGTRCAGEISAARDNGICGVGVAYDSKVAGIRMLDQPYMTDLIEANSMGHEPNKIHIYSASWGPTDDGKTVDGPRNATMRAIVKGVNEGRFGLGSIFVWASGDGGEDDDCNCDGYAASMWTISINSAINNGENAHYDESCSSTLASTFSNGGRNPESGVATTDLYGRCTRSHSGTSAAAPEAAGVFALTLEANPKLTWRDLQHLTVLTSSRNSLFDGRCRELPPLELEDIKRQLVSRQASCSHFEWQTNGVGLEYNHLFGFGVLDAAEMVLMAKVYKTAPPRFHCEAGTIEMPREIPASGEMVLTLRTDACTGSTTEVNFLEHVQAIVSLNSSRRGDTTLYLISPAGTPSMILSRRPKDDDAKDGFTNWPFMTTHTWGENPRGRWRLVVRFQPGKSTPKGHKYRGTLKKFTLMLHGTKEPPYRGIEPLQGHANSKLSVVQSAHKRMANRR

SEQ ID NO: 121231 - protein, 376 aa, Heterodera glycines
  Homolog annotation: Hit_ID=AAN15196.1; Match level="QueryCoverage =100%, HitCoverage=100%, E-value=0.0, Identity=100%"; Hit description= actin [Globodera rostochiensis] gb|AAN78299.1| actin 1 [Heterodera glycines] gb|AAG47837.2| actin 1 [Hete
  Gene Ontology: Biological process=reproduction
  Essential gene: C elegans homolog=M03F4.2a; Phenotype=Ste
  Coding regions on vcDNA: vcDNA=SeqID_47654; Strand=+; Position=83-1213
MCDEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGLVLDSGDGVTHTVPIYEGYALPHAILRLDLAGRDLTDYLMKILTERGYSFVTTAEREIVRDIKEKLCYVALDFEQEMATAASSSSLEKSYELPDGQVITVGNERFRCPEALFQPSFIGMESAGIHESTYNSIMKCDIDIRKDLYANNVLSGGTTMYPGIADRMQKEMTALAPSTMKIKIIAPPERKYSVWIGGSILASLSTFQQMWISKQEYDESGPSIVHRKCF

SEQ ID NO: 121232 - protein, 117 aa, Heterodera glycines
  Homolog annotation: Hit_ID=AAL73347.1; Match level="QueryCoverage =100%, HitCoverage=100%, E-value=7e-67, Identity=100%"; Hit description=putative esophageal gland cell secretory protein 13 [Heterodera glycines]
  Gene Ontology: Mol. function=trypsin inhibitor activity; Cellular component=cell wall (sensu Fungi)
  Essential gene: C elegans homolog=F49E11.9; Phenotype=Unclassified
  Coding regions on vcDNA: vcDNA=SeqID_47655; Strand=+; Position=1-354
MTSSSTISEADALKQACDMWWAELKQFGFQSSLVLDMAQFNKGIGHWSQQAWASTAQIGCAMARCPSSTWKTWVVCNYKEAGNFLNQPVYKKGAACSKCSDYNGATCDSASGLCKLP

SEQ ID NO: 121233 - protein, 249 aa, Heterodera glycines
  Homolog annotation: Hit_ID=AAL78213.1; Match level="QueryCoverage =100%, HitCoverage=100%, E-value=1e-139, Identity=100%"; Hit description=probable protein kinase Hgg-20 [Heterodera glycines]
  Gene Ontology: Mol. function=casein kinase I activity; Biological process=glia cell migration
  Essential gene: C elegans homolog=R90.1; Phenotype=Lva,Unc
  Coding regions on vcDNA: vcDNA=SeqID_47656; Strand=+; Position=1-750
MADELVALAPGTRVSGRWTILKKLGAGAFGAVYLCKDGKGTVAALKTEPIDTRQPLLVMEATVLDTLGKKLKNADGQHFCRLLDLGRSEQRNATSGDTVFNYVVMTVVGTPLDKLIRNAGDRFSPGTAIGMSIQLLSAIKALHNVGFLHRDIKPANTAIGRAETNEHRLLYLIDFGMARQFLRPDGTQRRPRAFANFRGTPIYGTDPLHISRVTTAAKMTSNRGFMSWSNSTKVLSPENLRMTSRRSEG

SEQ ID NO: 121234 - protein, 170 aa, Heterodera glycines
  misc_feature (102)..(102): Xaa can be any naturally occurring amino acid
  misc_feature (104)..(104): Xaa can be any naturally occurring amino acid
  misc_feature (122)..(122): Xaa can be any naturally occurring amino acid
  misc_feature (154)..(154): Xaa can be any naturally occurring amino acid
  misc_feature (159)..(159): Xaa can be any naturally occurring amino acid
  Homolog annotation: Hit_ID=AAL78218.1; Match level="QueryCoverage =100%, HitCoverage=100%, E-value=1e-95, Identity=100%"; Hit description=histone Hgg-28 [Heterodera glycines]
  Essential gene: C elegans homolog=ZK131.1; Phenotype=Unclassified
  Coding regions on vcDNA: vcDNA=SeqID_47657; Strand=+; Position=1-510
MTDTANRQRRGRGERRTRVLLRDSAKKITKASILRLARRAGVARINARVYDEVRAALRSYLETIIRDAAIYCQHERRKTMKSRDVVHALRRQGNLMYGFEQXAXGGGGWIYLEPAPYDIFGXYYYCTYVCICLYCILLCRCYCTPFYPCNCDPXLLLSXCVDICVFWYDK

SEQ ID NO: 121235 - protein, 152 aa, Heterodera glycines
  Homolog annotation: Hit_ID=AAL78220.1; Match level="QueryCoverage =100%, HitCoverage=100%, E-value=2e-84, Identity=100%"; Hit description=putative cysteine proteinase [Heterodera glycines]
  Essential gene: C elegans homolog=T28H10.3; Phenotype=Emb
  Coding regions on vcDNA: vcDNA=SeqID_47658; Strand=+; Position=1-456
MEDSDRQLFLRNETIAEQFNSVKRLTDQSHVKWFGNVRIMTERLSEFQGKTKSKNGQKTDGKNKNSPANFKMYPSRDIGILTEQSQRDKMAMAEKRAYVDTQMERIGKALDEIMPKNGQNESFGGDRITQTECHNEVMHTFNKICFNFSKSP

SEQ ID NO: 121236 - protein, 183 aa, Heterodera glycines
  misc_feature (39)..(39): Xaa can be any naturally occurring amino acid
  misc_feature (76)..(76): Xaa can be any naturally occurring amino acid
  misc_feature (88)..(88): Xaa can be any naturally occurring amino acid
  misc_feature (103)..(103): Xaa can be any naturally occurring amino acid
  misc_feature (132)..(132): Xaa can be any naturally occurring amino acid
  misc_feature (153)..(153): Xaa can be any naturally occurring amino acid
  misc_feature (162)..(162): Xaa can be any naturally occurring amino acid
  misc_feature (172)..(172): Xaa can be any naturally occurring amino acid
  misc_feature (180)..(180): Xaa can be any naturally occurring amino acid
  Homolog annotation: Hit_ID=AAL78221.1; Match level="QueryCoverage =100%, HitCoverage=99%, E-value=2e-94, Identity=100%"; Hit description=putative poly(A)-binding protein [Heterodera glycines]
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_47659; Strand=+; Position=1-549
MFGSILSCKIATDIEGGSKGYGFIHFETEEAANRQLRKXTGCFWMGRKCLLENLCHALLVRSKLVTRPVVSPMFMXKILARQWIRRSXAKCSHSMAKSSVQKXWRMTAANPRGSALSPTRTMKVLRGRWRRXTRFRCQAVRRSSKSLRCAVRXRRASARLSXSVVTSSTKLXAFSVIREXICT

SEQ ID NO: 121237 - protein, 153 aa, Heterodera glycines
  Homolog annotation: Hit_ID=AAL78222.1; Match level="QueryCoverage =100%, HitCoverage=99%, E-value=5e-84, Identity=100%"; Hit description=putative dynein heavy chain fragment [Heterodera glycines]
  Gene Ontology: Mol. function=dynein ATPase activity; Cellular component=fusome; Biological process=mitotic spindle assembly
  Essential gene: C elegans homolog=T21E12.4; Phenotype=Emb
  Coding regions on vcDNA: vcDNA=SeqID_47660; Strand=+; Position=1-459
DDQLLRDTIFQKWMGILDSSQNMFRHELARIEYLSTADERLQWNNNGMPKDELCTENAIMLRRFNRFPLIIDPSGQSIEFICKEFSTASGKEHQKGGSVATTVQLTSFNDNSFRKNLESALRFGTTLLVQDVESYDPILNPVLNKEVKRTGGR

SEQ ID NO: 121238 - protein, 240 aa, Heterodera glycines
  misc_feature (206)..(206): Xaa can be any naturally occurring amino acid
  misc_feature (214)..(214): Xaa can be any naturally occurring amino acid
  misc_feature (220)..(220): Xaa can be any naturally occurring amino acid
  misc_feature (224)..(224): Xaa can be any naturally occurring amino acid
  misc_feature (230)..(230): Xaa can be any naturally occurring amino acid
  misc_feature (235)..(235): Xaa can be any naturally occurring amino acid
  Homolog annotation: Hit_ID=AAL78223.1; Match level="QueryCoverage =100%, HitCoverage=100%, E-value=1e-129, Identity=99%"; Hit description=hypothetical protein Hgg-29 [Heterodera glycines]
  Essential gene: C elegans homolog=ZC373.5; Phenotype=Unc
  Coding regions on vcDNA: vcDNA=SeqID_47661; Strand=+; Position=1-720
MRDLFIEDNSPITPARLAELIRHFYALGWMRDNGGGMAVLCNGAVFGSPTSVQKEKVPENDLFVIDATTGTVLKRPQNAASVPSATCGLLMNTGLNCVIHTHSKYANLVSQLVTGNEFAIQNQEMIQGVENRSSGLRLDNVDRLVVPIVDSELNEQMLSPVLLRTLDKYTEASAILVRGHGFFVFGSSLAGSLPKVMLELFPSTLXLSLALLNXSNTNCXFGAXKFAVNXKIIAXPIFPF

SEQ ID NO: 121239 - protein, 219 aa, Heterodera glycines
  misc_feature (177)..(177): Xaa can be any naturally occurring amino acid
  misc_feature (196)..(196): Xaa can be any naturally occurring amino acid
  Homolog annotation: Hit_ID=AAL78224.1; Match level="QueryCoverage =100%, HitCoverage=100%, E-value=1e-123, Identity=100%"; Hit description=hypothetical protein Hgg-30 [Heterodera glycines]
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_47662; Strand=+; Position=1-657
MNEVSVPGSEKVEQKFTVCRAQKKSERQAELKRRYEQYKAERIQRYQGVNLYVKNLHDTINDETLRSNFESYGNITSAKVMCDEHGRSKGFGFVCFEKADEATKAVVEMNNKIIENKPLYVALAQRKEDRKAQLASQYMQRLAAMRMQNPAGLMGTMYAPASGGFFLPQAIQNQRAXAVHANTESVRGTNAWRCPXLEQYGRLQPSQCKAFMMGSSCWR

SEQ ID NO: 121240 - protein, 132 aa, Heterodera glycines
  misc_feature (106)..(106): Xaa can be any naturally occurring amino acid
  misc_feature (120)..(120): Xaa can be any naturally occurring amino acid
  misc_feature (129)..(129): Xaa can be any naturally occurring amino acid
  Homolog annotation: Hit_ID=AAL78225.1; Match level="QueryCoverage =100%, HitCoverage=100%, E-value=1e-66, Identity=100%"; Hit description=putative pyruvate dehydrogenase [Heterodera glycines]
  Gene Ontology: Mol. function=pyruvate dehydrogenase activity; Cellular component=mitochondrion; Biological process=acetyl-CoA metabolism
  Essential gene: C elegans homolog=T05H10.6a; Phenotype=Emb
  Coding regions on vcDNA: vcDNA=SeqID_47663; Strand=+; Position=1-396
TRDEIQEVRKSRDPITSFKDRIVTAGLVTEEELKDIDKKVRQEVDEAVKVALSDEVLPPETLFSDLYANTPPLAVRGTTADATVTQPFVSTAEVLRKMGREPKNYXENERTDSQRRIDNXEKHGIINCXSII

SEQ ID NO: 121241 - protein, 51 aa, Heterodera glycines
  Homolog annotation: Hit_ID=AAB50811.1; Match level="QueryCoverage =100%, HitCoverage=100%, E-value=4e-25, Identity=100%"; Hit description=cysteine proteinase [Heterodera glycines]
  Gene Ontology: Mol. function=cathepsin S activity; Cellular component= extracellular space; Biological process=proteolysis and peptidolysis
  Essential gene: C elegans homolog=T03E6.7; Phenotype=Emb,Gro,Unc
  Coding regions on vcDNA: vcDNA=SeqID_47664; Strand=+; Position=1-153
QGQCGSCWAFSATGALEGQHVRDKGHLVSLSEQNLIDCSKKYGNMGCNGGY

SEQ ID NO: 121242 - protein, 366 aa, Heterodera glycines
  Homolog annotation: Hit_ID=AAG47838.2; Match level="QueryCoverage =100%, HitCoverage=100%, E-value=0.0, Identity=100%"; Hit description= aldolase [Heterodera glycines]
  Gene Ontology: Mol. function=fructose-bisphosphate aldolase activity; Biological process=fructose metabolism
  Essential gene: C elegans homolog=F01F1.12a; Phenotype=Gro,Unc
  Coding regions on vcDNA: vcDNA=SeqID_47665; Strand=+; Position=31-1131
MAEVGNSYRPPLSEEKQNELRAIAQKILQPGKGILAADESTGSIGKRFDTIGLENTENNRRRYRQLLFTTPSFGQNLSGVILFDETFRQSTDNGVRFVDVIKKAGAVAGIKVDTGVVPLAGTLDEGTTQGLDKLSDRCAEYKKGGCDFAKWRCVLNIGAHKPSHLALMENANVLARYASICQQNGLVPIVEPEVLCDGEHSLERCQKVTELTLAYTYKALADHHIYLEGTLLKPNMVTPGQSHSPKATPDQIGLATVTALRRSVPIAVPGIVFLSGGQSEIEATRNLNAINSVPGPKPWTLSFSYGRALQSSVIKKWNGKDENLGDAQKVLLHRAKANGDAQQGKYTGEEAAASAAESLFVAKHAY

SEQ ID NO: 121243 - protein, 1014 aa, Heterodera glycines
  Homolog annotation: Hit_ID=AAK94490.1; Match level="QueryCoverage =100%, HitCoverage=100%, E-value=0.0, Identity=100%"; Hit description= PAZ/Piwi domain protein [Heterodera glycines]
  Gene Ontology: Mol. function=translation initiation factor activity; Biological process=gametogenesis
  Essential gene: C elegans homolog=F55A12.1; Phenotype=Emb
  Coding regions on vcDNA: vcDNA=SeqID_47666; Strand=+; Position=84-3128
MATTTAPPAAAEIPRKSPQQRKREEMAQLLESRKVDQGATFVEPRKPSGTAGQKGRMKLITNAHILKLLGTQAIYHYEVTINAVSSRSDRKFCVSEPSGPRDRDDFPLLNRRDKCREVFSAFYRTMEQSLKDTGNLLYYDLSKTIFTLKKLQIESEGKFMFNIGTVPTAERPDAARFKHYEFIIRPATGFEVNDLSFITNDVSKMERSLEQFLDIATAQKANMDGKQFIGFTSSRVYLLAPTDYGFGANECPVFDSNHSFLGVGVNKGCRIVEGDQGPGQMTPAIVIQTKKSAFHIPDMCILDKAKTLLFRENQGRFETGDFTQSDYEALCNGLVGIYAEPRYGTSGRFFRISDITKPNTGNGLNSENTYITHQVSGKISVKQYFEDTYQKTLQYPKAPLLVNYRRIGDPAYYPMEVCFVLDGQRVKSSQQNPEQIREMIKETAIPPTVLRVHNERVKESLQLVNNEYLTKASVHFDTTPLHVDYRVLGPPATLYRNNHRVTPAASNCEWRPGDALVNAQIGNWVAYAFGNPAGDSVRRLGLTETMWRNFVDKYAGEMRNKGIVCVPPVRVSFCWFTSVNEVLNVLHKEALNGVEFCLIGHAKGFEGDDVHVTIKAFEQQTEIVTQAITFDVLKEVLDKGSPLTVTNCIHKTNVKMGGLNYALHMDDPSVAQLFDGQTLFLGFAMNFPGGFAPSESAAPINGAVPSGSKAGLTPQNGANGAAATGANTIPLGSNGNVVPSTPVPRVGSSLPPPSCIGWAATIGKRHKDEYIGDFVYQAPRREEKIDIIASVVRRCIESFKKNRNKLPLRVVILRNGCTEGQFEYIMKYEIPLAKKELEELGCTAKLTVIVPNRLQDVRFLRQDARPEDKSNEQNIPPGTVVDTVVVHPKRSEFFLNSHVAIKGTACTPHYTVLRDENDMSMDTLQTMVHYLCFGHQIVTKPTSLPSPVYIADEYAKRGRNIYSHYAKNGIDNSKNLQLFAKNKGVEWPLRTYADMTKVLSFLTTTYLKELRINA

SEQ ID NO: 121244 - protein, 93 aa, Heterodera glycines
  misc_feature (90)..(90): Xaa can be any naturally occurring amino acid
  Homolog annotation: Hit_ID=AAK94492.1; Match level="QueryCoverage =100%, HitCoverage=100%, E-value=2e-45, Identity=98%"; Hit description=hypothetical esophageal gland protein scn1144 [Heterodera glycines]
  Gene Ontology: Biological process=positive regulation of growth rate
  Essential gene: C elegans homolog=Y48A6B.3; Phenotype=Gro
  Coding regions on vcDNA: vcDNA=SeqID_47667; Strand=+; Position=1-279
SMEDSQQNITEQSVSAPTTDRNEYEELSKLVNPISKPLANRKLAKKVYKLVKKAAKEKGFLRHGLADVMKAFRKNEKGIIVWQGTFHRLXVQS

SEQ ID NO: 121245 - protein, 55 aa, Heterodera glycines
  misc_feature (29)..(29): Xaa can be any naturally occurring amino acid
  Homolog annotation: Hit_ID=AAK94493.1; Match level="QueryCoverage =100%, HitCoverage=100%, E-value=1e-24, Identity=100%"; Hit description=putative DNA-J-like protein [Heterodera glycines]
  Gene Ontology: Mol. function=Hsp70/Hsc70 protein regulator activity; Cellular component=cytosol; Biological process=protein folding
  Essential gene: C elegans homolog=F39B2.10; Phenotype=Emb,Spd
  Coding regions on vcDNA: vcDNA=SeqID_47668; Strand=+; Position=3-170
LKKAYRKLALKYHSDKNPNEGERFKLISXAYEVLSNPEKRKVYDEYGEEGLKGGG

SEQ ID NO: 121246 - protein, 659 aa, Heterodera glycines
  Homolog annotation: Hit_ID=AAQ89579.1; Match level="QueryCoverage =100%, HitCoverage=100%, E-value=0.0, Identity=100%"; Hit description= heat shock protein 70-C [Heterodera glycines] gb|AAM93256.1| heat shock protein 70-C [Heterodera glycines
  Gene Ontology: Mol. function=Hsp70/Hsp90 organizing protein activity; Cellular component=endoplasmic reticulum lumen; Biological process =cell organization and biogenesis
  Essential gene: C elegans homolog=C15H9.6; Phenotype=Dpy,Lva
  Coding regions on vcDNA: vcDNA=SeqID_47669; Strand=+; Position=1-1980
MKKSFVSFLFFTALLVIVCSKEEEGGAKEKKYGTIIGIDLGTTYSCVGVYKNGRVEIIANDQGNRITPSYVAFTPDSGERLIGDAAKNQLTLNPENTIFDAKRLIGREFTDKTVQDDMKLWPFKIYNKANKPHVQVKVGNEDKQFAAEEVSAMVLTKMKEIAESYLGHEVKNAVVTVPAYFNDAQRQATKDAGTIAGLNVVRIINEPTAAAIAYGLDKKEGERNILVFDLGGGTFDVSLLTIDNGVFEVLATNGDTHLGGEDFDPRTIEYFIKLIKKKTGKDLRKDNRAVQKLRREVEKAKRALSVQHQVKLEVESLIDGEDFSETLTRAKFEELNMDLFRGTLKPVQKVLEDADLKKEDIHEVVLVGGSTRIPKVQQLLKEFFNGKEPSRGINPDEAVAYGAAVQAGVISGEENSEIVLLDVNPLTMGIETVGGVMTKLITRNTVIPTKKSQIFSTAADNQPTVTIQVFEGERPMTKDNHLLGKFDLTGIPPAPRGVPQIEVTFEIDVNGILHVTAEDKGTGNKNKITITNDHNRLSPEEIERMINDAEKFAEEDKKTKEVVEARNEFESYAYSLKNQLGDSEKLGGKLSAEDKTTIEGAVDEAISWLDSNKDAPPEELKERKKDLEAKVQPIISKLYAGQSPPPGSEPPPTEEKDEL

SEQ ID NO: 121247 - protein, 374 aa, Heterodera glycines
  Homolog annotation: Hit_ID=CAA70693.1; Match level="QueryCoverage =100%, HitCoverage=100%, E-value=0.0, Identity=100%"; Hit description= cathepsin L-like cysteine proteinase [Heterodera glycines]
  Gene Ontology: Mol. function=cathepsin S activity; Cellular component= extracellular space; Biological process=proteolysis and peptidolysis
  Essential gene: C elegans homolog=T03E6.7; Phenotype=Emb,Gro,Unc
  Coding regions on vcDNA: vcDNA=SeqID_47670; Strand=+; Position=40-1164
MFLLFLLSMLLLQTNGWRARERAIELADSDESIELQNIGQRKTDIRTPTERMSALRQMIERGFSDWNAYKQKHGKAYADQEVENERMLTYLSAKQFIDKHNEAYKEGKVSFRVGETHIADLPFSEYQKLNGFRRLMGDSLRRNASTFLAPMNVGDLPESVDWRDKGWVTEVKNQGMCGSCWAFSATGALEGQHVRDKGHLVSLSEQNLIDCSKKYGNMGCNGGIMDNAFQYIKDNKGIDKETAYPYKAKTGKKCLFKRNDVGATDSGYNDIAEGDEEDLKMAVATQGPVSVAIDAGHRSFQLYTNGVYFEKECDPENLDHGVLVVGYGTDPTQGDYWIVKNSWGTRWGEQGYIRMARNRNNNCGIASHASFPLV

SEQ ID NO: 121248 - protein, 353 aa, Heterodera glycines
  Homolog annotation: Hit_ID=CAA70694.1; Match level="QueryCoverage =100%, HitCoverage=100%, E-value=0.0, Identity=100%"; Hit description= cathepsin S-like cysteine proteinase [Heterodera glycines]
  Gene Ontology: Mol. function=cathepsin S activity; Cellular component= extracellular space; Biological process=proteolysis and peptidolysis
  Essential gene: C elegans homolog=T03E6.7; Phenotype=Emb,Gro,Unc
  Coding regions on vcDNA: vcDNA=SeqID_47671; Strand=+; Position=36-1097
MAFLSRLSILPNSPISLLAVSLAVLAFVALASANPPTARETAPNAQQNNANSVATGEIAKNIAEKMERMNEFIKAKKFIDAHNLAFEKGEVSFKVAPNHLMHFTPAQYNRIRGLQMRSNRQRHNMATLAGNSSTLPEKLDWREKGAVTEVKDQGDCGSCWAFSATGAIEGALAQKKASKIISLSEQNLVDCSSKYGNEGCDGGLMDSAFEYVRDNNGLDTEESYPYEAVTGKCQFKNETVGGTVVSFKDLKKGDEEQLKIAVATIGPISVALDASNLSFQFYKTGVYYERWCSNRYLDHGVLLVGYGTDETHGDYWLVKNSWGPHWGENGYIRIARNKQNHCGIATMASYPVV

SEQ ID NO: 121249 - protein, 119 aa, Heterodera glycines
  Homolog annotation: Hit_ID=AAN32889.1; Match level="QueryCoverage =100%, HitCoverage=100%, E-value=4e-62, Identity=100%"; Hit description=ubiquitin extension protein [Heterodera glycines]
  Gene Ontology: Biological process=cell cycle
  Essential gene: C elegans homolog=F25B5.4a; Phenotype=Emb
  Coding regions on vcDNA: vcDNA=SeqID_47672; Strand=+; Position=1-360
MNHFGLTFLFVAVSLLVIAPGCDGMQIFVKTLTGKTITLEVESSDTVDNVKEKIQEKEGIPPDQQRLIFAGKQLEDGRTLADYNIQKESTLHLVLRLRGGNGKRNTGKNKKSNKKLDQN

SEQ ID NO: 121250 - protein, 69 aa, Heterodera glycines
  Homolog annotation: Hit_ID=AAN76045.1; Match level="QueryCoverage =100%, HitCoverage=100%, E-value=6e-34, Identity=100%"; Hit description=heat shock protein hsp-90 [Heterodera glycines]
  Gene Ontology: Biological process=reproduction
  Essential gene: C elegans homolog=C47E8.5; Phenotype=Emb,Ste
  Coding regions on vcDNA: vcDNA=SeqID_47673; Strand=+; Position=2-390
RNPDDISNEKYAEFYKSLSNDWEDHLAVKHFSVEGQLEFRALLFVPQRAPFDLFENKKSKNAIKLYVRR

SEQ ID NO: 121251 - protein, 69 aa, Heterodera glycines
  misc_feature (31)..(31): Xaa can be any naturally occurring amino acid
  Homolog annotation: Hit_ID=AAN76049.1; Match level="QueryCoverage =100%, HitCoverage=100%, E-value=4e-33, Identity=98%"; Hit description=heat shock protein hsp-90 [Heterodera glycines] gb|AAN76047.1| heat shock protein hsp-90 [Heterodera gly
  Gene Ontology: Biological process=reproduction
  Essential gene: C elegans homolog=C47E8.5; Phenotype=Emb,Ste
  Coding regions on vcDNA: vcDNA=SeqID_47674; Strand=+; Position=2-390
RNPDDISNEEYAEFYKSLSNDWEDHLAVKHXSVEGQLEFRALLFVPQRAPFDLFENKKSKNAIKLYVRR

SEQ ID NO: 121252 - protein, 69 aa, Heterodera glycines
  Homolog annotation: Hit_ID=AAN76049.1; Match level="QueryCoverage =100%, HitCoverage=100%, E-value=6e-34, Identity=100%"; Hit description=heat shock protein hsp-90 [Heterodera glycines] gb|AAN76047.1| heat shock protein hsp-90 [Heterodera gl
  Gene Ontology: Biological process=reproduction
  Essential gene: C elegans homolog=C47E8.5; Phenotype=Emb,Ste
  Coding regions on vcDNA: vcDNA=SeqID_47675; Strand=+; Position=2-390
RNPDDISNEEYAEFYKSLSNDWEDHLAVKHFSVEGQLEFRALLFVPQRAPFDLFENKKSKNAIKLYVRR

SEQ ID NO: 121253 - protein, 69 aa, Heterodera glycines
  misc_feature (4)..(4): Xaa can be any naturally occurring amino acid
  Homolog annotation: Hit_ID=AAN76049.1; Match level="QueryCoverage =100%, HitCoverage=100%, E-value=4e-33, Identity=98%"; Hit description=heat shock protein hsp-90 [Heterodera glycines] gb|AAN76047.1| heat shock protein hsp-90 [Heterodera gly
  Gene Ontology: Biological process=reproduction
  Essential gene: C elegans homolog=C47E8.5; Phenotype=Emb,Ste
  Coding regions on vcDNA: vcDNA=SeqID_47676; Strand=+; Position=2-390
RNPXDISNEEYAEFYKSLSNDWEDHLAVKHFSVEGQLEFRALLFVPQRAPFDLFENKKSKNAIKLYVRR

SEQ ID NO: 121254 - protein, 69 aa, Heterodera glycines; identical to SEQ ID NO: 121252
  Homolog annotation: Hit_ID=AAN76049.1; Match level="QueryCoverage =100%, HitCoverage=100%, E-value=6e-34, Identity=100%"; Hit description=heat shock protein hsp-90 [Heterodera glycines] gb|AAN76047.1| heat shock protein hsp-90 [Heterodera gl
  Gene Ontology: Biological process=reproduction
  Essential gene: C elegans homolog=C47E8.5; Phenotype=Emb,Ste
  Coding regions on vcDNA: vcDNA=SeqID_47677; Strand=+; Position=2-390

SEQ ID NO: 121255 - protein, 69 aa, Heterodera glycines
  misc_feature (5)..(5): Xaa can be any naturally occurring amino acid
  Homolog annotation: Hit_ID=AAN76185.1; Match level="QueryCoverage =100%, HitCoverage=100%, E-value=4e-33, Identity=100%"; Hit description=heat shock protein hsp-90 [Heterodera glycines]
  Gene Ontology: Biological process=reproduction
  Essential gene: C elegans homolog=C47E8.5; Phenotype=Emb,Ste
  Coding regions on vcDNA: vcDNA=SeqID_47678; Strand=+; Position=2-390
RNPDXISNEEYAEFYKSLSNDWEDHLAVKHFSVEGQLEFRALLFVPQRAPFDLFENKKSKNAIKLYVRR

SEQ ID NO: 121256 - protein, 69 aa, Heterodera glycines
  misc_feature (6)..(6): Xaa can be any naturally occurring amino acid
  Homolog annotation: Hit_ID=AAN76186.1; Match level="QueryCoverage =100%, HitCoverage=100%, E-value=2e-33, Identity=100%"; Hit description=heat shock protein hsp-90 [Heterodera glycines]
  Gene Ontology: Biological process=reproduction
  Essential gene: C elegans homolog=C47E8.5; Phenotype=Emb,Ste
  Coding regions on vcDNA: vcDNA=SeqID_47679; Strand=+; Position=2-390
RNPDDXSNEEYAEFYKSLSNDWEDHLAVKHFSVEGQLEFRALLFVPQRAPFDLFENKKSKNAIKLYVRR

SEQ ID NO: 121257 - protein, 363 aa, Heterodera glycines
  Homolog annotation: Hit_ID=AAN15196.1; Match level="QueryCoverage =99%, HitCoverage=96%, E-value=0.0, Identity=98%"; Hit description =actin [Globodera rostochiensis] gb|AAN78299.1| actin 1 [Heterodera glycines] gb|AAG47837.2| actin 1 [Heterod
  Gene Ontology: Biological process=reproduction
  Essential gene: C elegans homolog=T04C12.5; Phenotype=Ste
  Coding regions on vcDNA: vcDNA=SeqID_47680; Strand=+; Position=615 -2126
ISALIQAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGLVLDSGDGVTHTVPIYEGYALPHAILRLDLAGRDLTDYLMKILTERGYSFVTTAEREIVRDIKEKLCYVALDFEQEMATAASSSSLEKSYELPDGQVITVGNERFRCPEALFQPSFIGMESAGIHESTYNSIMKCDIDIRKDLYANNVLSGGTTMYPGIADRMQKEMTALAPSTMKIKIIAPPERKYSVWIGGSILASLSTFQQMWISKQEYDESGPSIVHRKCF

SEQ ID NO: 121258 - protein, 658 aa, Heterodera glycines
  misc_feature (67)..(67): Xaa can be any naturally occurring amino acid
  Homolog annotation: Hit_ID=AAN78300.1; Match level="QueryCoverage =100%, HitCoverage=100%, E-value=0.0, Identity=98%"; Hit description =heat shock protein 70 A [Heterodera glycines]
  Gene Ontology: Mol. function=non-chaperonin molecular chaperone ATPase activity; Cellular component=intracellular; Biological process=reproduction
  Essential gene: C elegans homolog=F26D10.3; Phenotype=Lva,Ste
  Coding regions on vcDNA: vcDNA=SeqID_47681; Strand=+; Position=21-2861
MPSKANAIGIDLGTTYSCVGVFQHGKVEIIANDQGNRTTPSYVAFTDTERLIGDAAKNQATFHKINXVAMNPSNTVFDAKRLIGRKFDDPAVQSDMKHWPFKVVQGEGARPKVMVEVKGEDKAFFPEEVSSMVLIKMKETAEAFLGQTVTDAVVTVPAYFNDSQRQATKDAGTIAGLNVLRIINEPTAAAIAYGLDKKGQGERHVLIFDLGGGTFDVSILTIEDGIFEVKSTAGDTHLGGEDFDNRMVNHFVAEFKRKHKKDLSSNPRALRRLRTACERAKRTLSGSTQASIEIDSLFDGIDFYTNITRARFEELCADLFRNTMDPVEKALRDAKMDKSQIHDIVLVGGSTRIPKVQKLLSDFFSGKELNKSINPDEAVAYGAAVQAAILSGDKSETVQDLLLLDVAPLSLGIETAGGVMTSLIKRNTTIPTKTSQTFTTYSDNQPGVLIQVYEGERAMTKDNNLLGKFELSGIPPAPRGVPQIEVTFDIDANGILNVSAQDKSTGKQNKITITNDKGRLSKEEIERMVQEAEKFSKEDEVQRDRVSAKNALESYCFNIKQTMEDSNLKDKISEDDKKKVLEKCGEVLAWLDANQAAEKEEFEHQQKELEGICNPIITKLYQAGGAMPGGPMPGGGMPGGGGAAGAGGAGGPTIEEVD

SEQ ID NO: 121259 - protein, 105 aa, Heterodera glycines
  Homolog annotation: Hit_ID=AAO33478.1; Match level="QueryCoverage =100%, HitCoverage=100%, E-value=4e-53, Identity=100%"; Hit description=ubiquitin extension protein [Heterodera glycines]
  Gene Ontology: Biological process=cell cycle
  Essential gene: C elegans homolog=F25B5.4a; Phenotype=Emb
  Coding regions on vcDNA: vcDNA=SeqID_47682; Strand=+; Position=1-318
MNHFGLTFLFVAVSLLTLTGKTITLEVESSDTVDNVKTKIQEKEGVPPDQQRLIFAGKQLEDGRTLADYNIQKESTLHLVLRLRGGNGKRNTSKNKKSNKKLDQN

SEQ ID NO: 121260 - protein, 580 aa, Heterodera glycines
  Homolog annotation: Hit_ID=AAN46118.1; Match level="QueryCoverage =100%, HitCoverage=100%, E-value=0.0, Identity=100%"; Hit description= intermediate filament protein HG-IF1 [Heterodera glycines]
  Gene Ontology: Mol. function=structural molecule activity; Cellular component=lamin filament; Biological process=muscle development
  Essential gene: C elegans homolog=W10G6.3; Phenotype =Lvl,Unc,Unclassified
  Coding regions on vcDNA: vcDNA=SeqID_47683; Strand=+; Position=63-1805
MSDDYRSSIGPRPAFNRNSTAYSSTGGPVSGGNRVLKIVTETMSSSTSGGGGGMSPFGANAAQIRDSRDREKKELSDLNDRLANYIEKVRFLEAQNRKLKADLDMLQGRRGKDTITIKTMYESEIQTAKKLIEDTGRSKHELEQDVAKLQRDLDEQRRKYEEAVRSRAGDREKLDDLLVQLSNLEAEISLLKRRIALLEEELSKLRKENSRLQADLQRVRAELDQETLNRIDYQNQVQTLLEEIDFIRRSHDQEIKDLQAMAARDTTSENREFFRNELASAIRDIRNEYDVLNNKDRNDIESWYKLKVQEIETQSARQNMEQGYQKDELKRLRVQLTDLRGKLSDLEARNSLLEKQIQELNYQLEDDQRAYEDALNAKDAQIRKMRDECQALMVELQMLLDTKQTLDAEIAIYRKMLEGEGDGPGLKQLVEQVVRTTGINEVADTETMRVVKGETSSRQSYQRSAKGNVSILETSPEGKYVVLENTHRSKEETIGEWKLKRRIDGKREIVYTLPANFVLRPMARLKVWARNQGGLHAPPDQLIFDGEESFGVGSNVQTILYNAQGEERATHIQRSSQTAA

SEQ ID NO: 121261 - protein, 158 aa, Heterodera glycines
  Homolog annotation: Hit_ID=AAP02990.1; Match level="QueryCoverage =100%, HitCoverage=100%, E-value=2e-86, Identity=100%"; Hit description=FMRFamide-related peptide precursor [Heterodera glycines]
  Essential gene: C elegans homolog=F07D3.2; Phenotype=Gro
  Coding regions on vcDNA: vcDNA=SeqID_47684; Strand=+; Position=101-577
MAMNTNSIHCSSASSSPSVPMMLSMFCFIFAIFLHPASSSDLLSSSDDAKLQQMLCARFPGLAECQPNDEASRGIMTKRKSAYMRFGRAAAAADPSEEYEMEKRKSAYMRFGKRSPAEEGETYQIWAANEPDAQMEKRKSAYMRFGKRKSAYMRFGRK

SEQ ID NO: 121262 - protein, 398 aa, Heterodera glycines
  Homolog annotation: Hit_ID=AAP30763.1; Match level="QueryCoverage =100%, HitCoverage=100%, E-value=0.0, Identity=100%"; Hit description= putative gland protein G8H07 [Heterodera glycines]
  Gene Ontology: Mol. function=protein binding; Cellular component =ubiquitin ligase complex; Biological process=mitosis
  Essential gene: C elegans homolog=F46A9.5; Phenotype=Emb
  Coding regions on vcDNA: vcDNA=SeqID_47685; Strand=+; Position=1-1197
MLRIALLISILALFGDCMDMGKRKLGGISINEPSEYGTKEKEAIATKENAQTSKDPPTSAGGQNEAIPSPKKPSPKGKLKSDFGLNLAKAFPRPVPKGRRGKEKVGEKISVMNTAERIEKMDIAQDKAKMEIDNIDTNAKPKQNEDKAPTIFPKCADNVEVEVELDRNIFRFSTTLDTMMEDLGMYTAEGTNQKLPVSNVSSTVMREVIEWCEHHKNDASIEPIYEEIALDVPTGKDAEASAPNAQAGEVAEAAESNAKPNNEKRLVFPSWDENFLDKEWPELVDIILAANYLNIKLLLTFATTMVDNKWINGKTPQEIRKAFGVEEPYPPGHPEWARVEKENEWEESDEEREARHAKEREEEEERERKEEQKRKEEEAERLHQEQLQQQQNQEQQPQ

SEQ ID NO: 121263 - protein, 245 aa, Heterodera glycines
  Homolog annotation: Hit_ID=AAP30833.1; Match level="QueryCoverage =100%, HitCoverage=100%, E-value=1e-142, Identity=100%"; Hit description=putative gland protein G8A07; Hg-G8A07 [Heterodera glycines]
  Gene Ontology: Cellular component=mitochondrion
  Essential gene: C elegans homolog=T26C5.3a; Phenotype=Emb
  Coding regions on vcDNA: vcDNA=SeqID_47686; Strand=+; Position=1-738
MLIMVIVLLTGKIAFAATDGMTDLKLINEGLTTDKIASRSIFLTPLQIILPWVLGKQTAGPKPLNVFLWAYPYRLVMSLALALLVYWTPSFREPNGEYPYFYYAIWIGAYYLQQVSSYCIFLSMMAFNAQISDPKIGGTYRTLLNTLNNLGGNWPVTLFLSITDFFNRKNCVAKGTKIVLGVCTSKHDEELCKAGGDACEFVIDGYYISVAICVVVGLLWYRIFYRRIKYFQKISRQDWRVIKTK

SEQ ID NO: 121264 - protein, 158 aa, Heterodera glycines
  Homolog annotation: Hit_ID=AAC24580.1; Match level="QueryCoverage =100%, HitCoverage=100%, E-value=7e-87, Identity=100%"; Hit description=ADP/ATP translocase [Heterodera glycines]
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_47687; Strand=+; Position=2-478
LAADCGKADARESKGLADCIMRSSSRTVPSGLYRGFFVSVQGIIIYRAAYFGCFDTAKMLFSPEGKQMNFFVNWAIAQVVTVSSGVLSYPWDTVRRRMMMQSGRKDIMYKNTLDCAIKIIKNEGLLKGMFKGALSNVFRGTGGALVLAFYDEIQKYIH

SEQ ID NO: 121265 - protein, 156 aa, Heterodera glycines
  Homolog annotation: Hit_ID=AAC26138.1; Match level="QueryCoverage =100%, HitCoverage=100%, E-value=2e-89, Identity=100%"; Hit description=cleavage stimulation factor [Heterodera glycines]
  Gene Ontology: Mol. function=RNA binding; Cellular component =nucleosome; Biological process=mRNA cleavage
  Essential gene: C elegans homolog=F28C6.3; Phenotype=Emb,Lva
  Coding regions on vcDNA: vcDNA=SeqID_47688; Strand=+; Position=2-469
RWRRRSGSNDFTLKMFDYSKTAVKRAMKTITEVEPITAVSFHPSGEFFLCATRHPTLRLYSAETQQCFVSTIPKDQHSDSITDVCYSENARMFVTGSRDGNVKVWDGVSNRCIETFTRAHDGAPICSAQFTRNGKYVLTVGMAVCPNYGNCPPIAV

SEQ ID NO: 121266 - protein, 659 aa, Heterodera glycines
  Homolog annotation: Hit_ID=AAQ89579.1; Match level="QueryCoverage =100%, HitCoverage=100%, E-value=0.0, Identity=99%"; Hit description =heat shock protein 70-C [Heterodera glycines] gb|AAM93256.1| heat shock protein 70-C [Heterodera glycines]
  Gene Ontology: Mol. function=Hsp70/Hsp90 organizing protein activity; Cellular component=endoplasmic reticulum lumen; Biological process =cell organization and biogenesis
  Essential gene: C elegans homolog=C15H9.6; Phenotype=Dpy,Lva
  Coding regions on vcDNA: vcDNA=SeqID_47689; Strand=+; Position=1-2774
MKKSFVSFLFFTALLVIVCSKEEEGGAKEKKYGTIIGIDLGTTYSCVGVYKNGRVEIIANDQGNRITPSYVAFTPDSGERLIGDAAKNQLTLNPENTIFDAKRLIGREFTDKTVQDDMKLWPFKIYNKANKPHVQVKVGNEDKQFAAEEVSAMVLTKMKEIAESYLGHEVKNAVVTVPAYFNDAQRQATKDAGTIAGLNVVRIINEPTAAAIAYGLDKKEGERNILVFDLGGGTFDVSLLTIDNGVFEVLATNGDTHLGGEDFDPRTIEYFIKLIKKKTGKDLRKDNRAVQKLRREVEKAKRALSVQHQVKLEVESLIDGEDFSETLTRAKFEELNMDLFRGTLKPVQKVLEDADLKKEDIHEVVLVGGSTRIPKVQQLLKEFFNGKEPSRGINPDEAVAYGAAVQAGVISGEENSEIVLLDVNPLTMGIETVGGVMTKLITRNTVIPTKKSQIFSTAADNQPTVTIQVFEGERPMTKDNHLLGKFDLTGIPPAPRGVPQIEVTFEIDVNGILHVTAEDKGTGNKNKITITNDHNRLSPEEIERMINDAEKFAEEDKKTKEVVEARNEFESYAYSLKNQVKRFEKLGGKLSAEDKTTIEGAVDEAISWLDSNKDAPPEELKERKKDLEAKVQPIISKLYAGQSPPPGSEPPPTEEKDEL

SEQ ID NO: 121267 - protein, 374 aa, Heterodera glycines; identical to SEQ ID NO: 121247
  Homolog annotation: Hit_ID=CAA70693.1; Match level="QueryCoverage =100%, HitCoverage=100%, E-value=0.0, Identity=100%"; Hit description= cathepsin L-like cysteine proteinase [Heterodera glycines]
  Gene Ontology: Mol. function=cathepsin S activity; Cellular component= extracellular space; Biological process=proteolysis and peptidolysis
  Essential gene: C elegans homolog=T03E6.7; Phenotype=Emb,Gro,Unc
  Coding regions on vcDNA: vcDNA=SeqID_47690; Strand=+; Position=40-1164

SEQ ID NO: 121268 - protein, 367 aa, Heterodera glycines
  Homolog annotation: Hit_ID=AAR09171.1; Match level="QueryCoverage =100%, HitCoverage=100%, E-value=0.0, Identity=99%"; Hit description =aldolase [Heterodera glycines]
  Gene Ontology: Mol. function=fructose-bisphosphate aldolase activity; Biological process=fructose metabolism
  Essential gene: C elegans homolog=F01F1.12a; Phenotype=Gro,Unc
  Coding regions on vcDNA: vcDNA=SeqID_47691; Strand=+; Position=1-1935
MAEVGNSYRPPLSEEKQNELRAIAQKILQPGKGILAADESTGRSIGKRFDTIGLENTENNRRRYRQLLFTTPSFGQNLSGVILFDETFRQSTDNGVRFVDVIKKAGAVAGIKVDTGVVPLAGTLDEGTTQGLDKLSDRCAEYKKGGCDFAKWRCVLNIGAHKPSHLALMENANVLARYASICQQNGLVPIVEPEVLCDGDHSLERCQKVTELTLAYTYKALANHHIYLEGTLLKPNMVTPGQSHSPKATPDQIGLATVTALRRSVPIAVPGIVFLSGGQSEIEATHNLNAINSVPGPKPWTLSFSYGRALQSSVIKKWNGKDENLGDAQKVLLHRAKANGDAQQGKYTGEEAAASAAESLFVAKHAY

SEQ ID NO: 121269 - protein, 144 aa, Heterodera glycines
  Homolog annotation: Hit_ID=CAE71331.1; Match level="QueryCoverage =98%, HitCoverage=87%, E-value=4e-42, Identity=58%"; Hit description =Hypothetical protein CBG18231 [Caenorhabditis briggsae]
  Gene Ontology: Mol. function=RNA binding; Cellular component=small nuclear ribonucleoprotein complex; Biological process=positive regulation of growth rate
  Essential gene: C elegans homolog=Y48A6B.3; Phenotype=Gro
  Coding regions on vcDNA: vcDNA=SeqID_47692; Strand=+; Position=71-502
SMEDSQQNITEHSVSAPTTDRNEYEELSKLVNPISKPLANRKLAKKVYKLVKKAAKEKGFLRHGLADVMKAFRKNEKGIIVLAGNVSPIDVYSHIPAICEEKGLPYVFTPSREHLGLCAGYKRPAIVLLVKRHDSYADPFDQTH

SEQ ID NO: 121270 - protein, 200 aa, Heterodera glycines
  misc_feature (200)..(200): Xaa can be any naturally occurring amino acid
  Homolog annotation: Hit_ID=CAE69076.1; Match level="QueryCoverage =88%, HitCoverage=58%, E-value=1e-55, Identity=58%"; Hit description =Hypothetical protein CBG15094 [Caenorhabditis briggsae]
  Gene Ontology: Biological process=positive regulation of embryonic development
  Essential gene: C elegans homolog=Y92H12BR.8; Phenotype=Lva
  Coding regions on vcDNA: vcDNA=SeqID_47693; Strand=+; Position=8-607
MAWLSRATFCPHQLHQKAVKTPLQKAVTSAAERALDIVGNASRVRLQDLRDNPGARTVGRQVRAKGHNQAGHTIGELQHASKPPLGWVWDDYYKPWQRSFDGDRRFNGDINLRREYIPISLVELQRLIDLGWLDTSRLVDIAAICATKLLEQKFKPELRQFGIHLTDEGEEIFSTPINLEVQWASCTAIAAIERAGGRIX

SEQ ID NO: 121271 - protein, 209 aa, Heterodera glycines
  misc_feature (154)..(154): Xaa can be any naturally occurring amino acid
  misc_feature (191)..(191): Xaa can be any naturally occurring amino acid
  Homolog annotation: Hit_ID=NP_998614.1; Match level="QueryCoverage =97%, HitCoverage=22%, E-value=2e-79, Identity=64%"; Hit description =zgc:55623 [Danio rerio] gb|AAH48879.1| Zgc:55623 [Danio rerio]
  Gene Ontology: Mol. function=protein tyrosine kinase activity; Cellular component=nucleoplasm; Biological process=signal transduction
  Essential gene: C elegans homolog=F22D6.5; Phenotype=Gro,Stp,Unc
  Coding regions on vcDNA: vcDNA=SeqID_47694; Strand=+; Position=2-683
RKTGVRELEVLKKLNEADRLDKYHILQLYRQFYHRNHLCLVFENLSMNLREVLKKYGNNVGLHMKAVRSYAQQLLLAMKLLKKCNILHADIKPDNIFVNETKMLLKLCDFGSACHVGDAEPAPYLVSRFYRAPEIMLGLPYDFGIDLWSVAVTXFMMDLRGKFPNKVIRKAVFKDQHFDYNCNFLYHETDXVTGQDKSTVLTNIKLLRN

SEQ ID NO: 121272 - protein, 189 aa, Heterodera glycines
  misc_feature (125)..(125): Xaa can be any naturally occurring amino acid
  misc_feature (129)..(129): Xaa can be any naturally occurring amino acid
  Homolog annotation: Hit_ID=NP_508803.2; Match level="QueryCoverage =95%, HitCoverage=42%, E-value=4e-42, Identity=44%"; Hit description =longevity-assurance protein (XF316) [Caenorhabditis elegans] gb|AAK39252.2| Homolog of yeast longevity ge
  Gene Ontology: Cellular component=cytoplasmic vesicle; Biological process=intracellular protein transport
  Essential gene: C elegans homolog=Y6B3B.10; Phenotype=Unclassified
  Coding regions on vcDNA: vcDNA=SeqID_47695; Strand=+; Position=1-565
DVWQYYIIQSGFYLSLLFSLFAFDVRRSNHYEMATHHLATILLLFMSFSINFVRAGTLILLLHDSADVFLELGKLFRYAGWDRAVTIDFCVFMLVWISTRLVYFPLKLVRYMLFDAPKLIMETYXVKIXWTDILQKPIIPRVFLAVLCILLLLHIFWTYLLIKIAIKSVKSGVDDIREDEDDDSEEEAE

SEQ ID NO: 121273 - protein, 165 aa, Heterodera glycines
  Homolog annotation: Hit_ID=AAA81160.2; Match level="QueryCoverage =91%, HitCoverage=35%, E-value=2e-52, Identity=64%"; Hit description =Ectopic membrane ruffles in embryo protein 1 [Caenorhabditis elegans]
  Gene Ontology: Mol. function=NEDD8 activating enzyme activity; Biological process=endomitotic cell cycle
  Essential gene: C elegans homolog=F11H8.1; Phenotype=Emb
  Coding regions on vcDNA: vcDNA=SeqID_47696; Strand=+; Position=18-512
MSSHNTSVIDENRRWSDLRCLTDRASTFANSGFVPGIKNLKEVHKMPVLVVGAGGLGCEILKDLALSGFHDIHIIDMDTIDLSNLNRQFLFRENDIGRSKADVAAAFIEKRVFGCKVTPHNCKIQDKSLEFYRKFFIIICGLDSIEARRWLNATVCSLVEFDDGN

SEQ ID NO: 121274 - protein, 202 aa, Heterodera glycines
  Homolog annotation: Hit_ID=NP_506628.1; Match level="QueryCoverage =100%, HitCoverage=28%, E-value=2e-78, Identity=68%"; Hit description= pleckstrin-like, UNCoordinated locomotion UNC-112 (82.4 kD) (unc-112) [Caenorhabditis elegans] emb|CAA99
  Gene Ontology: Biological process=cell growth
  Essential gene: C elegans homolog=C47E8.7; Phenotype=Emb
  Coding regions on vcDNA: vcDNA=SeqID_47697; Strand=+; Position=2-607
LLRFKFMQFFDMNLRYDPVRINQLYEQAKWSVLLEEVEHTEEESSLFAALQLQAALQRNSPDRESPERDEVDVLLDELEQTLDTTASLSRRDLTYVPELTEYLKYLKPKKLGFNNFKRAYFTFRDLYLSYYNTAQDANGPPLGHYYLKGCEVSQDLSVSQGKFNIKLQVPSSEGMSELILKCDTEQQFAKWMAACRLASRGK

SEQ ID NO: 121275 - protein, 138 aa, Heterodera glycines
  Homolog annotation: Hit_ID=NP_504475.1; Match level="QueryCoverage =98%, HitCoverage=73%, E-value=9e-28, Identity=44%"; Hit description =mitochondrial ribosomal protein L48 (21.3 kD) (5G73) [Caenorhabditis elegans] gb|AAB88341.1| Hypothetical
  Essential gene: C elegans homolog=CD4.3; Phenotype=Emb,Gro
  Coding regions on vcDNA: vcDNA=SeqID_47698; Strand=+; Position=2-418
LLNVLLQAYDFQPVEKFQAYVHWAAKHFGIQIVESYALAHTSELVKEYKAGSTIPVSQSVLKTYSRVVRVGPVPGIQLPLFIALLQAHAPVGMKIVVKKHSPRDERCRYIPDPQLEDFKETLRNLDDPVVRKLLGWEA

SEQ ID NO: 121276 - protein, 166 aa, Heterodera glycines
  Homolog annotation: Hit_ID=NP_492765.1; Match level="QueryCoverage =100%, HitCoverage=66%, E-value=2e-65, Identity=74%"; Hit description= proteasome Alpha Subunit (27.2 kD) (pas-5) [Caenorhabditis elegans] emb|CAB02097.1| Hypothetical protein
  Gene Ontology: Mol. function=endopeptidase activity; Cellular component=proteasome core complex (sensu Eukarya); Biological process=proteolysis and peptidolysis
  Essential gene: C elegans homolog=F25H2.9; Phenotype=Emb,Lva
  Coding regions on vcDNA: vcDNA=SeqID_47699; Strand=+; Position=93-590
MFLTRSEYDRGVNTFSPEGRLFQVEYAIETVKLGSTSIGIHTKEGVLSAAERRSMSKLVVDDSMSKISEVEKHIAVASAGLIADSRTWVEHARVEAQHFWFTYGGKIRVEDITQKVSRLALHFGDDDSTISLGRPFGVSMLFAGIDHTGAHLFHLDPSGTYIKCLA

SEQ ID NO: 121277 - protein, 185 aa, Heterodera glycines
  Homolog annotation: Hit_ID=CAE58762.1; Match level="QueryCoverage =95%, HitCoverage=28%, E-value=6e-18, Identity=30%"; Hit description =Hypothetical protein CBG01954 [Caenorhabditis briggsae]
  Gene Ontology: Cellular component=secretory vesicle; Biological process=body morphogenesis (sensu Nematoda)
  Essential gene: C elegans homolog=C17G1.6; Phenotype=Bmd
  Coding regions on vcDNA: vcDNA=SeqID_47700; Strand=+; Position=24-578
MSDNNLEAKYTGFELSYKSEGTDPTVISPMVTAKPTIAITKRPPKTLTNITPKITVETTPRITTTTDTMPRITTETSPRTTTETSPKTTTTSEPTTETTAEPTTPKEEEGIWSKWGGWSGCSASCGACGHRRRVRTCFKGKCKGESGQMERCAFGICPLAKRRTNRCQGRLVMPCDLMESLEFGT

SEQ ID NO: 121278 - protein, 146 aa, Heterodera glycines
  Homolog annotation: Hit_ID=CAI15102.1; Match level="QueryCoverage =96%, HitCoverage=7%, E-value=2e-17, Identity=39%"; Hit description =programmed cell death 11 [Homo sapiens] emb|CAI16749.1| programmed cell death 11 [Homo sapiens] emb|CAH7148
  Gene Ontology: Mol. function=snoRNA binding; Cellular component =nucleolus organizer complex; Biological process=growth
  Essential gene: C elegans homolog=C16A3.3; Phenotype=Lva
  Coding regions on vcDNA: vcDNA=SeqID_47701; Strand=-; Position=98-538
AYLNLEVALGTEESLQEVFKRACAVSNSIQMHRYLIGLLKKQTNAKGREEEIGELYESMIKRFRPLELEPWFEYGRPLLQQNDADAFQNLLKRFFQCSEKKRHLTILMRFAQLEKGCGDKERAKTIDELIKNVKEGKKRTDASPVE

SEQ ID NO: 121279 - protein, 195 aa, Heterodera glycines
  Homolog annotation: Hit_ID=AAM81355.1; Match level="QueryCoverage =99%, HitCoverage=50%, E-value=1e-67, Identity=61%"; Hit description =heat shock protein 40 [Steinernema feltiae]
  Gene Ontology: Mol. function=Hsp70/Hsc70 protein regulator activity; Cellular component=cytosol; Biological process=protein folding
  Essential gene: C elegans homolog=F39B2.10; Phenotype=Emb,Spd
  Coding regions on vcDNA: vcDNA=SeqID_47702; Strand=+; Position=2-586
HILCPKCNGVGGAKEGVKQCENCRGRGLEIHNMQIGPGMIQRIQRACSECGGEGEINRNPCKHCGGKKRIKSEETIEVHIEKGMRDGQRLMFYGKGDQQPGLEPGNVIIVLDEEEHPVFTRRGTNLTLNMKLTLTEALCGCTKHVVTLDKRILSFTQLPGEVINHRDFYVIQGEGMPTHRHPDQKGDLIIQFFVD

SEQ ID NO: 121280 - protein, 147 aa, Heterodera glycines
  Homolog annotation: Hit_ID=CAE72664.1; Match level="QueryCoverage =91%, HitCoverage=25%, E-value=7e-17, Identity=34%"; Hit description =Hypothetical protein CBG19878 [Caenorhabditis briggsae]
  Gene Ontology: Biological process=embryogenesis and morphogenesis
  Essential gene: C elegans homolog=C55C3.5; Phenotype=Emb
  Coding regions on vcDNA: vcDNA=SeqID_47703; Strand=+; Position=146-586
MLSINETVLNQLLHQFRWDFKIIEEKIPLNSSSLPEETRDFFANLCPQCIFIFNVSADGLPSMTIEDDSILIKIHNRIAAEVENPTIGESGQKKTAIDLTLSLAVQLIPQVRDGIFHTQLNLKERKIDMKNKTAFPKQMKPVVEELL

SEQ ID NO: 121281 - protein, 133 aa, Heterodera glycines
  Homolog annotation: Hit_ID=NP_492601.1; Match level="QueryCoverage =90%, HitCoverage=91%, E-value=4e-40, Identity=57%"; Hit description =cytochrome C Oxidase, subunit Vb, LiPid Depleted LPD-4 (lpd-4) [Caenorhabditis elegans] emb|CAB03002.1| H
  Gene Ontology: Biological process=negative regulation of FGF receptor signaling pathway
  Essential gene: C elegans homolog=F26E4.9; Phenotype=Lpd
  Coding regions on vcDNA: vcDNA=SeqID_47704; Strand=+; Position=41-442
MNMNQLLVGRSLFPKIIRPFSHTKPLAKSEADPDDYGYFPDPIEHSWGLERKMLIARLKGDDRYEPKVYFRAEHTTRDYPNLVPVHLQDKVVGCLCEPDAEYVNYWHIRKGQMKRCECGHWFKGVQADPDSFA

SEQ ID NO: 121282 - protein, 191 aa, Heterodera glycines
  misc_feature (179)..(179): Xaa can be any naturally occurring amino acid
  misc_feature (186)..(186): Xaa can be any naturally occurring amino acid
  Homolog annotation: Hit_ID=NP_523836.2; Match level="QueryCoverage =82%, HitCoverage=65%, E-value=5e-54, Identity=63%"; Hit description =CG3140-PA [Drosophila melanogaster] gb|AAF47139.2| CG3140-PA [Drosophila melanogaster] gb|AAL39993.1| SD0
  Gene Ontology: Mol. function=adenylate kinase activity; Cellular component=mitochondrial intermembrane space; Biological process =purine nucleotide metabolism
  Essential gene: C elegans homolog=C29E4.8; Phenotype=Emb
  Coding regions on vcDNA: vcDNA=SeqID_47705; Strand=+; Position=22-594
MVNWPWSAKQRDEPAQDKQKVVTTHPEPTQGIHGIRTILMGPPGAGKGTQATKLAKKYESCHLSTGDLLRAEIKAGTPLGQKIKGLVEGGDLVSDDIVCEMIDKHLSTAECRNGFILDGFPRNTAQAEKLDALLEKRQRPLQAALELALDDSLLVKRITGRLFHVPSGRSYHEQFNPPXKAMTDDXTGEPL

SEQ ID NO: 121283 - protein, 212 aa, Heterodera glycines
  Homolog annotation: Hit_ID=NP_740776.1; Match level="QueryCoverage =100%, HitCoverage=26%, E-value=1e-104, Identity=81%"; Hit description=ubiquitin-protein ligase with C2 and WW domains; suppressor of deltex; atrophin-1 interacting protein N
  Gene Ontology: Mol. function=protein binding; Cellular component =ubiquitin ligase complex; Biological process=signal transduction
  Essential gene: C elegans homolog=Y65B4BR.4a; Phenotype=Unclassified
  Coding regions on vcDNA: vcDNA=SeqID_47706; Strand=+; Position=2-637
FIDHNNKTTTYNHPRTGRPVGPLGGPGLHMAADKTFKNKVAQFRYLCYSNSVPNHVKISVTRNNLFEDSFQEIMRKNPFDLRRRLYIQFKAEDGLDYGGIAREWFFLLSHEVLNPMYCLFMYANSSNYSLQINPASFVNPDHLKYFEFIGRFIAMALFHGKFIYSGFTLPFYKKMLNRKITLKDLESVDTEFYNSIVWIRDNDIDECDMELY

SEQ ID NO: 121284 - protein, 133 aa, Heterodera glycines
  Homolog annotation: Hit_ID=NP_492765.1; Match level="QueryCoverage =99%, HitCoverage=53%, E-value=3e-50, Identity=75%"; Hit description =proteasome Alpha Subunit (27.2 kD) (pas-5) [Caenorhabditis elegans] emb|CAB02097.1| Hypothetical protein
  Gene Ontology: Mol. function=endopeptidase activity; Cellular component=proteasome core complex (sensu Eukarya); Biological process=sporulation (sensu Saccharomyces)
  Essential gene: C elegans homolog=F25H2.9; Phenotype=Emb,Lva
  Coding regions on vcDNA: vcDNA=SeqID_47707; Strand=+; Position=69-467
MFLTRSEYDRGVNTFSPEGRLFQVEYAIETVKLGSTSIGIHTKEGVLLAAERRSMSKLVVDDSMSKISEVEKHIAVASAGLIADSRTWVEHARVEAQHFWFTYGGKIRVEDITQKVSRLALHFGDDDSTISLG

SEQ ID NO: 121285 - protein, 196 aa, Heterodera glycines
  misc_feature (46)..(46): Xaa can be any naturally occurring amino acid
  Homolog annotation: Hit_ID=CAE62009.1; Match level="QueryCoverage =98%, HitCoverage=73%, E-value=2e-49, Identity=49%"; Hit description =Hypothetical protein CBG06017 [Caenorhabditis briggsae]
  Gene Ontology: Mol. function=7-alpha-hydroxysteroid dehydrogenase activity; Cellular component=mitochondrion; Biological process=lipid metabolism
  Essential gene: C elegans homolog=F01G4.2; Phenotype=Pvl,Stp,Unc
  Coding regions on vcDNA: vcDNA=SeqID_47708; Strand=+; Position=1-588
AQRLVAIVTGGASGLGCATVRRLVAKGFNVSLLDLPMSEGAKVVFXLGTTDNVLFSPVDISSDDQVKKAMDATTEKFGGLNVLVNCAGIAFAQRLYNPSSRAQMDLDKIRRLIDVNIFGTINVIRHALPLLIDNVPDENDQRGVIINTSSIAAFEGQMGQTLYSASKGAVASLTVPLARDYSNNGIRVMAIAPGLM

SEQ ID NO: 121286 - protein, 204 aa, Heterodera glycines
  misc_feature (29)..(29): Xaa can be any naturally occurring amino acid
  Homolog annotation: Hit_ID=NP_501078.1; Match level="QueryCoverage =87%, HitCoverage=63%, E-value=6e-13, Identity=25%"; Hit description =meiotic chromosome core protein, synapsis and chiasma formation factor., High Incidence of Males due to i
  Essential gene: C elegans homolog=ZK381.1; Phenotype=Emb,Him
  Coding regions on vcDNA: vcDNA=SeqID_47709; Strand=+; Position=47-658
MPPLFPEKVESIRHLSTKSWEATFTKDYXSYEGQLRFLSRMCYLAMAHYLLYRGVLPKGVFKRRKLEDLAIYCFDGNTRWGRKLSEMMKGIREAIDQKYIKQAFVMINEDKEDPDVATEVFSVGFCYNEQHTMTVLDDKGNRIVSFGYKGEKVFRMQVKHIIKKLSVVTKNLEPLKKGAVPYLKLTYYENTPDDYEPSMFKHCE

SEQ ID NO: 121287 - protein, 87 aa, Heterodera glycines
  Homolog annotation: Hit_ID=NP_491412.1; Match level="QueryCoverage =97%, HitCoverage=98%, E-value=2e-26, Identity=62%"; Hit description =Acyl-coA-binding protein, ACBP (9.4 kD) (1F204) [Caenorhabditis elegans] gb|AAB54171.1| Hypothetical prot
  Essential gene: C elegans homolog=C44E4.6; Phenotype=Unclassified
  Coding regions on vcDNA: vcDNA=SeqID_47710; Strand=+; Position=52-315
MTLSFNEAASVVKTLRTSPSNDELLEIYALYKQATCGDNNTCKPGTFDFRGKAKWEAWKKKQGISQEKARIDYVKIVEKMVAKYGVN

SEQ ID NO: 121288 - protein, 148 aa, Heterodera glycines
  Homolog annotation: Hit_ID=CAE67195.1; Match level="QueryCoverage =100%, HitCoverage=73%, E-value=6e-75, Identity=91%"; Hit description= Hypothetical protein CBG12631 [Caenorhabditis briggsae]
  Gene Ontology: Mol. function=RAB small monomeric GTPase activity; Biological process=negative regulation of FGF receptor signaling pathway
  Essential gene: C elegans homolog=T23H2.5; Phenotype=Unclassified
  Coding regions on vcDNA: vcDNA=SeqID_47711; Strand=+; Position=85-528
MAKKQYDLLFKLLLIGDSGVGKTCILYRFSDDAFNTSFISTIGIDFKIKTIELRGKKIKLQIWDTAGQERFHTITTSYYRGAMGIMMVYDITNAKSFDNIAKWLRYIDEHASEDVVKMLLGNKCDMSDRRVVPKERGEKIAIDHGIRF

SEQ ID NO: 121289 - protein, 151 aa, Heterodera glycines
  Homolog annotation: Hit_ID=CAE64980.1; Match level="QueryCoverage =79%, HitCoverage=36%, E-value=6e-23, Identity=40%"; Hit description =Hypothetical protein CBG09815 [Caenorhabditis briggsae]
  Gene Ontology: Mol. function=transcription co-activator activity; Cellular component=chromatin remodeling complex; Biological process =chromatin modeling
  Essential gene: C elegans homolog=Y71H2AM.17; Phenotype =Emb,Lva,Lvl,Pvl
  Coding regions on vcDNA: vcDNA=SeqID_47712; Strand=+; Position=124-576
MRTPLELAGKRLAAIRYDRNNRLMAELFSPSYLPDPRAFVPQQRIDHFRRQRMSLEQHQVKSNEELARMAELFSQRKRAIQRDSEAYHEMLKKVCAERPRVDQQRCEELTEQYKEQLLNAWDQFQTKQAAIQAKLEADRRANPVLAELITG

SEQ ID NO: 121290 - protein, 176 aa, Heterodera glycines
  Homolog annotation: Hit_ID=CAE66740.1; Match level="QueryCoverage =84%, HitCoverage=40%, E-value=5e-56, Identity=70%"; Hit description =Hypothetical protein CBG12090 [Caenorhabditis briggsae]
  Gene Ontology: Mol. function=endopeptidase activity; Cellular component=proteasome regulatory particle (sensu Eukarya); Biological process=embryonic cleavage
  Essential gene: C elegans homolog=R12E2.3; Phenotype=Emb
  Coding regions on vcDNA: vcDNA=SeqID_47713; Strand=+; Position=68-595
MAPAPEKEKTEDKKLKDGQKPNVTTDHAHCLSNVQPNLPVNKVVVHPLVLLSVVDHFNRVNKTHKVNRVVGVLLGCMKHDKTLDIANCFAVPYDEDSENSNIFFLDADFLEDMFGMFYKVAARERIVGWYHSGPRLCKNDILINEVIKRFTPNPVLVIIQAAQGRQDLALPTDAYV

SEQ ID NO: 121291 - protein, 196 aa, Heterodera glycines
  Homolog annotation: Hit_ID=CAE57182.1; Match level="QueryCoverage =93%, HitCoverage=16%, E-value=5e-38, Identity=45%"; Hit description =Hypothetical protein CBG00021 [Caenorhabditis briggsae]
  Gene Ontology: Mol. function=translation factor activity, nucleic acid binding; Cellular component=eukaryotic translation initiation factor 3 complex; Biological process=regulation of translational initiation
  Essential gene: C elegans homolog=C27D11.1; Phenotype=Emb,Ste
  Coding regions on vcDNA: vcDNA=SeqID_47714; Strand=+; Position=2-589
QNQKDADSERILARRKRIELYKETNEQVKREKLQKEQAQANKQEEQRRREELKKLQEENKENERRRKLNEQEEIQRKLQSEKLKKYQAHPFFQQLVKEHGEAIFDKVDPDKLIREKRIRFDAERREQQTKLQNLEKKYDHTVRAFHLEEMALWKHLSDERQRIYPGLHEAYETKRIEKAVKERELSFEKYAYLVSA

SEQ ID NO: 121292 - protein, 181 aa, Heterodera glycines
  Homolog annotation: Hit_ID=NP_496178.1; Match level="QueryCoverage =93%, HitCoverage=22%, E-value=2e-12, Identity=28%"; Hit description =XTP5 (87.0 kD) (2K391) [Caenorhabditis elegans] emb|CAA88437.1| Hypothetical protein ZK945.3 [Caenorhabdi
  Essential gene: C elegans homolog=ZK945.3; Phenotype=Egl
  Coding regions on vcDNA: vcDNA=SeqID_47715; Strand=+; Position=2-544
FECIRDNLLTFIKANMRKMLFDKISAVLVLDTLEVPSPSDPFLREIGDSDLDDCFRAIAEIATDEFVPHSPDGPSHIVQGGCARFVFRKLLQADPGRCDGHRLSDFLTDLPADNLSSWTSMDCGCYTLVEVFKSGSDKARKVLRRALSVAMLQNSHLSGAKSLLDLLLGKGKEQPPREHSV

SEQ ID NO: 121293 - protein, 172 aa, Heterodera glycines
  Homolog annotation: Hit_ID=NP_491653.2; Match level="QueryCoverage =99%, HitCoverage=18%, E-value=8e-27, Identity=38%"; Hit description =periodic tryptophan protein 2 homolog (102.1 kD) (1G218) [Caenorhabditis elegans] gb|AAB37807.2| Hypothet
  Gene Ontology: Mol. function=signal transducer activity; Cellular component=cytoplasm; Biological process=signal transduction
  Essential gene: C elegans homolog=F55F8.3; Phenotype=Lva
  Coding regions on vcDNA: vcDNA=SeqID_47716; Strand=+; Position=2-517
ISDSEDERHNPRKAIKLPGTRHTDMAERSIHQPVTVTKMGFCPTGGSFAVVSTEGVALYSLFQMRRFDPFQLEIDVVPNSIVQFSLSGEHAKAISLALRLNDAKLTRRVVESVPILQLSAVVRGIELIYIERLIVWLLFFADKGHQKHVHFYQLLVREILIANASKLKQSVD

SEQ ID NO: 121294 - protein, 185 aa, Heterodera glycines
  Homolog annotation: Hit_ID=NP_495988.1; Match level="QueryCoverage =98%, HitCoverage=59%, E-value=2e-43, Identity=45%"; Hit description =eukaryotic Initiation Factor (32.9 kD) (eif-3.F) [Caenorhabditis elegans] emb|CAA87773.1| Hypothetical pr
  Gene Ontology: Mol. function=translation initiation factor activity; Cellular component=eukaryotic translation initiation factor 3 complex; Biological process=regulation of translational initiation
  Essential gene: C elegans homolog=D2013.7; Phenotype=Emb,Lva
  Coding regions on vcDNA: vcDNA=SeqID_47717; Strand=+; Position=33-587
MASNLTVKVHPIVYMSIVDAYERKSSSNINSRVGTVRSVETTENRALGTLLGFYKKNVVQVTSCYAVPFRETSDDIPEINDALNRQMWHMSKRTSPSEQIVGWFFTVPDLSEMCPHYHGYYTGLVNETPRKEPPPIILITMDFTFSGESADRLPIKAYAAREAGVPGKGATQATIFYPLKVEMDV

SEQ ID NO: 121295 - protein, 151 aa, Heterodera glycines
  misc_feature (45)..(45): Xaa can be any naturally occurring amino acid
  Homolog annotation: Hit_ID=NP_492354.1; Match level="QueryCoverage =92%, HitCoverage=58%, E-value=2e-18, Identity=38%"; Hit description =proteasome Beta Subunit (26.7 kD) (pbs-7) [Caenorhabditis elegans] emb|CAB03081.1| Hypothetical protein F
  Gene Ontology: Cellular component=26S proteasome; Biological process =locomotory behavior
  Essential gene: C elegans homolog=F39H11.5; Phenotype=Emb,Lva,Unc
  Coding regions on vcDNA: vcDNA=SeqID_47718; Strand=+; Position=2-457
MDHMKPKMVHAFLTSLFYQRRSKMNPFLNTMVVCGMQPVEFHAGXIKPFTGVIDMRGNAYEVDHVATEIGKYLLRQMLETRQTQANGAEQMSKEEALRMVAAALEVSVSRNSRTGQMFDVSTVDANGVKFHDQFQIIGKWDEIEVCDGTYK

SEQ ID NO: 121296 - protein, 179 aa, Heterodera glycines
  Homolog annotation: Hit_ID=AAH31828.1; Match level="QueryCoverage =99%, HitCoverage=26%, E-value=1e-64, Identity=64%"; Hit description =Kinesin heavy chain member 2 [Homo sapiens]
  Gene Ontology: Mol. function=microtubule motor activity; Cellular component=spindle microtubule; Biological process=anterograde axon cargo transport
  Essential gene: C elegans homolog=K11D9.1a; Phenotype=Emb
  Coding regions on vcDNA: vcDNA=SeqID_47719; Strand=+; Position=1-537
GICVCVRKRPLGKRELASREVEVITVPNRDHVIVHQPQVKVDLTKYLVNHKFRFDYVFNEAATNEMVYRFSAQPLVRTIFQRGFATCFAYGQTGSGKTYTMGGIIEGRRQDCSNGIYAMTAHDVFAMLHSPEYANQKLTLSCSFFEIYGSKVFDLLNKKSVLRILEDGKHLVQVVGLRE

SEQ ID NO: 121297 - protein, 128 aa, Heterodera glycines
  Homolog annotation: Hit_ID=CAE67231.1; Match level="QueryCoverage =85%, HitCoverage=27%, E-value=3e-52, Identity=80%"; Hit description =Hypothetical protein CBG12670 [Caenorhabditis briggsae]
  Gene Ontology: Mol. function=NADH dehydrogenase (ubiquinone) activity; Cellular component=membrane fraction; Biological process =morphogenesis
  Essential gene: C elegans homolog=T10E9.7a; Phenotype=Lva
  Coding regions on vcDNA: vcDNA=SeqID_47720; Strand=-; Position=101-487
DEVAPIDSITPVFSGAEWYEREIYDMYGVWFNNHPDLRRILTDYGFEGHPQRKDFPLSGYVELRWDHELNRVIYEPTEMTQEFRKFDLNTPWEVFPAFRDESITSGYNVIQKAGKIEAKKLDDASKKP

SEQ ID NO: 121298 - protein, 82 aa, Heterodera glycines
  Homolog annotation: Hit_ID=CAE71898.1; Match level="QueryCoverage =73%, HitCoverage=24%, E-value=1e-22, Identity=70%"; Hit description =Hypothetical protein CBG18956 [Caenorhabditis briggsae]
  Essential gene: C elegans homolog=F46E10.9; Phenotype=Dpy
  Coding regions on vcDNA: vcDNA=SeqID_47721; Strand=+; Position=12-257
MARSPLFLLSIFIRTEFVLCAVKSKNLLNLNDENWRNILSGQWMMEFHAPWCPACKDLQKSWNSFADWSKDLNINVAEIDVT

SEQ ID NO: 121299 - protein, 147 aa, Heterodera glycines
  Homolog annotation: Hit_ID=NP_872244.1; Match level="QueryCoverage =99%, HitCoverage=34%, E-value=2e-73, Identity=88%"; Hit description =translation Elongation FacTor (eft-4) [Caenorhabditis elegans] gb|AAO21384.1| Elongation factor protein 4
  Gene Ontology: Mol. function=translation factor activity, nucleic acid binding
  Essential gene: C elegans homolog=R03G5.1a; Phenotype=Emb,Lva,Unc
  Coding regions on vcDNA: vcDNA=SeqID_47722; Strand=+; Position=1-441
GNPATVPFVPISGFNGDNMLEPSDRMPWFKGWAIERKDGNASGKTLLEALDSILPPQRPTDKPLRLPLQDVYKIGGIGTVPVGRVETGVLKPGMVVTFAPQGISTEVKSVEMHHESLPEALPGDNVGFNVKNISVKDIRRGSVASDS

SEQ ID NO: 121300 - protein, 123 aa, Heterodera glycines
  Homolog annotation: Hit_ID=CAE60314.1; Match level="QueryCoverage =99%, HitCoverage=50%, E-value=2e-49, Identity=68%"; Hit description =Hypothetical protein CBG03905 [Caenorhabditis briggsae]
  Gene Ontology: Mol. function=structural constituent of ribosome; Cellular component=cytosolic large ribosomal subunit (sensu Eukarya); Biological process=protein biosynthesis
  Essential gene: C elegans homolog=F53G12.10; Phenotype=Emb,Lva
  Coding regions on vcDNA: vcDNA=SeqID_47723; Strand=+; Position=2-370
GNKIHPRPRKVLQLLRLRQINNGVFVKLNKATIQMLRIADPYIAWGYPSQKIIRQLVYKRGYAKESGQRIPITDNAIVERNMGKSDVICVEDMIHQIWTVGPHFKQVTNFLWPFKLSNPVGGF

SEQ ID NO: 121301 - protein, 74 aa, Heterodera glycines
  Homolog annotation: Hit_ID=XP_312508.1; Match level="QueryCoverage =95%, HitCoverage=32%, E-value=3e-22, Identity=71%"; Hit description =ENSANGP00000014951 [Anopheles gambiae]
  Gene Ontology: Cellular component=eukaryotic 48S initiation complex; Biological process=protein biosynthesis
  Essential gene: C elegans homolog=F42C5.8; Phenotype=Lva,Ste
  Coding regions on vcDNA: vcDNA=SeqID_47724; Strand=-; Position=108-332
IGGAQKRSKSTLKKYTERQKTAGVEPHLLEQFQAGRLLACISSRPGQSGRCDGYILEGKELEFYNKKLKAKKAK

SEQ ID NO: 121302 - protein, 111 aa, Heterodera glycines
  Homolog annotation: Hit_ID=NP_492222.2; Match level="QueryCoverage =100%, HitCoverage=4%, E-value=4e-34, Identity=61%"; Hit description =j-domain containing protein, required for endocytosis, Receptor Mediated Endocytosis RME-8 (259.2 kD) (rm
  Gene Ontology: Mol. function=co-chaperone activity; Cellular component=vesicle membrane; Biological process=receptor mediated endocytosis
  Essential gene: C elegans homolog=F18C12.2a; Phenotype=Emb,Lva,Unc
  Coding regions on vcDNA: vcDNA=SeqID_47725; Strand=-; Position=3-335
EKIAEMKTLFQSIYQLLRFESLHRLACAATECVCAFSVCTLLQTQLFQAGVIWQLLPHLFRFDYTLDEGGVAHSEKTNHQAVLNRLARNCCEALACLAGFRPDTPDNDGVQ

SEQ ID NO: 121303 - protein, 108 aa, Heterodera glycines
  misc_feature (30)..(30): Xaa can be any naturally occurring amino acid
  Homolog annotation: Hit_ID=XP_317472.1; Match level="QueryCoverage =89%, HitCoverage=19%, E-value=4e-32, Identity=62%"; Hit description =ENSANGP00000011826 [Anopheles gambiae]
  Gene Ontology: Mol. function=SH3/SH2 adaptor protein activity; Cellular component=nucleus; Biological process=signal transduction
  Essential gene: C elegans homolog=H37N21.1; Phenotype=Unclassified
  Coding regions on vcDNA: vcDNA=SeqID_47726; Strand=-; Position=1-324
EYMSSGSMSRFLQRARSSGSLLNIKAWKSXTRQILTALSYLHSCDPPIVHANLTCNSVFIQQNGLVKIGCVAPKTIHHHVKTFRENIKNVHYLAPEYDHQKKNKKKKK

SEQ ID NO: 121304 - protein, 123 aa, Heterodera glycines
  Homolog annotation: Hit_ID=AAP49515.1; Match level="QueryCoverage =98%, HitCoverage=27%, E-value=1e-23, Identity=42%"; Hit description =At2g42120 [Arabidopsis thaliana] gb|AAM97084.1| putative DNA polymerase delta small subunit [Arabidopsis t
  Gene Ontology: Mol. function=delta DNA polymerase activity; Cellular component=delta DNA polymerase complex; Biological process=DNA replication
  Essential gene: C elegans homolog=F12F6.7; Phenotype =Emb,Gro,Pvl,Stp,Unc
  Coding regions on vcDNA: vcDNA=SeqID_47727; Strand=-; Position=132-503
FLGTSGQNINDLRRLTRGKDTLALMERTLEMGYIFPTVPDTLPGFPFSGRDPLVLDQIPHIYFVGNQPTFEKRIVEFGGKPTKRCCLLAVPKFCKTKSVILLNLRTLESNEYCFGANFNESGQ

SEQ ID NO: 121305 - protein, 142 aa, Heterodera glycines
  Homolog annotation: Hit_ID=AAK94490.1; Match level="QueryCoverage =99%, HitCoverage=13%, E-value=1e-76, Identity=97%"; Hit description =PAZ/Piwi domain protein [Heterodera glycines]
  Gene Ontology: Mol. function=translation initiation factor activity; Biological process=gametogenesis
  Essential gene: C elegans homolog=F55A12.1; Phenotype=Emb
  Coding regions on vcDNA: vcDNA=SeqID_47728; Strand=+; Position=1-426
GRLQDVRFLRQDAKPEDKSNEQNIPPGTVVDTVVVFFKRSEFFLNSHVAIKGTACTPHYTVLRDENDMSMDTLQTMVHYLCFGHQIVTKPTSLPSPVYIADEYAKRGRNIYSHYAKNGIDNSKNLQLFAKNKGVEWPLRTYA

SEQ ID NO: 121306 - protein, 165 aa, Heterodera glycines
  Homolog annotation: Hit_ID=NP_503425.2; Match level="QueryCoverage =100%, HitCoverage=100%, E-value=2e-58, Identity=68%"; Hit description=UNCoordinated locomotion UNC-60 (unc-60) [Caenorhabditis elegans] gb|AAL02461.1| Uncoordinated protein
  Gene Ontology: Mol. function=actin binding; Cellular component=actin filament; Biological process=cell organization and biogenesis
  Essential gene: C elegans homolog=C38C3.5a; Phenotype=Let
  Coding regions on vcDNA: vcDNA=SeqID_47729; Strand=+; Position=5-502
MSSGVMVNSECQNAFQQLSEGKRYRYIIYKIVDKEVIVEVAVSSEDIGSTGTESYDDNSKAAYETFVKDLKERTEGFVDCRYAVFDFKFQTQRPGAGTSKMDKIVFIQLCPDGASIKKKMLYASSASAIKASLGTAKILQFQVSDESEIAHKELLSKLNEQYRDN

SEQ ID NO: 121307 - protein, 84 aa, Heterodera glycines
  misc_feature (60)..(60): Xaa can be any naturally occurring amino acid
  Homolog annotation: Hit_ID=CAE73097.1; Match level="QueryCoverage =92%, HitCoverage=13%, E-value=5e-21, Identity=50%"; Hit description =Hypothetical protein CBG20476 [Caenorhabditis briggsae]
  Gene Ontology: Mol. function=protein tyrosine kinase activity; Cellular component=chromosome
  Essential gene: C elegans homolog=F22D6.5; Phenotype=Gro,Stp,Unc
  Coding regions on vcDNA: vcDNA=SeqID_47730; Strand=-; Position=112-367
MMDLRGKFPNKVIRKAVFKDQHFDYNCNFLYHETDKVTGKDKVTVLTNIKLLRNLPAELXMTALDPSKRISCSDALKHPFIVEK

SEQ ID NO: 121308 - protein, 110 aa, Heterodera glycines
  Homolog annotation: Hit_ID=XP_340748.1; Match level="QueryCoverage =100%, HitCoverage=9%, E-value=1e-26, Identity=51%"; Hit description =similar to Ubiquitin carboxyl-terminal hydrolase 7 (Ubiquitin thiolesterase 7) (Ubiquitin-specific proces
  Gene Ontology: Mol. function=ubiquitin-specific protease activity; Cellular component=nucleus; Biological process=pathogenesis
  Essential gene: C elegans homolog=H19N07.2a; Phenotype=Gro
  Coding regions on vcDNA: vcDNA=SeqID_47731; Strand=-; Position=1-330
YLLYAVLVHSGDFHGGHYVAFINTNLKGSPRWCKFDDDVVSRVTSRDAVTANFGGENPEGVGRSFTNAYMLVYIKKSATGEVLGSVSEEDVPDHLKVRFESEKKKKKKKK

SEQ ID NO: 121309 - protein, 155 aa, Heterodera glycines
  Homolog annotation: Hit_ID=CAE66544.1; Match level="QueryCoverage =99%, HitCoverage=6%, E-value=2e-47, Identity=60%"; Hit description =Hypothetical protein CBG11852 [Caenorhabditis briggsae]
  Gene Ontology: Mol. function=co-chaperone activity; Cellular component=vesicle membrane; Biological process=receptor mediated endocytosis
  Essential gene: C elegans homolog=F18C12.2a; Phenotype=Emb,Lva,Unc
  Coding regions on vcDNA: vcDNA=SeqID_47732; Strand=+; Position=2-466
GYKRNLQVLSPYKYAGYTQLIKTIDLESSDDTLFARTKEDGGQLLVAAVELCHWTLRSSSLNAEQLRRDGGLDALYKTFERCVPMITACSLESEMPVQVCTHVCNCFATAARFDACREKIAEMKTLFQSICQLLRFESLHRLACAAAECVCAFSV

SEQ ID NO: 121310 - protein, 128 aa, Heterodera glycines
  Homolog annotation: Hit_ID=NP_494781.1; Match level="QueryCoverage =100%, HitCoverage=28%, E-value=2e-39, Identity=60%"; Hit description= . protein (50.8 kD) (2E714) [Caenorhabditis elegans] gb|AAA83580.1| Hypothetical protein ZK430.7 [Caenor
  Gene Ontology: Mol. function=snoRNA binding; Cellular component=small nuclear ribonucleoprotein complex; Biological process=35S primary transcript processing
  Essential gene: C elegans homolog=ZK430.7; Phenotype=Lva
  Coding regions on vcDNA: vcDNA=SeqID_47733; Strand=+; Position=27-410
MKVKVISRHPDEYQRETKHDIFKVPRNYAAPPDPFQQQVEYTRALNAAKLERMFAKPFLAAFDGHNEAVNLLVKHPTRLSTVLSGARDGQVRVWHLATRRCLHVLQAHSGPINGLSVDASDGLHFVTV

SEQ ID NO: 121311 - protein, 154 aa, Heterodera glycines
  Homolog annotation: Hit_ID=NP_496226.1; Match level="QueryCoverage =92%, HitCoverage=17%, E-value=1e-20, Identity=34%"; Hit description =interacting protein (2K638) [Caenorhabditis elegans] emb|CAA90093.1| Hypothetical protein C07E3.1a [Caeno
  Gene Ontology: Mol. function=protein binding; Cellular component =intracellular; Biological process=cell differentiation
  Essential gene: C elegans homolog=C07E3.1a; Phenotype=Emb
  Coding regions on vcDNA: vcDNA=SeqID_47734; Strand=+; Position=1-462
GQDYSSFSRRAKMPIIDGDRPNFNIPELPHNLNTLLDLSEEEILKTDKEVRHLKNQNEALISEEKRILEESAESQFEFVRLQELEQLVSKFCVSAEESSLDECKKLFQKLHKQFEAEFKMYGLDALAMPIVLPKIKRYFMEWDPLNPEQTFFGF

SEQ ID NO: 121312 - protein, 124 aa, Heterodera glycines
  Homolog annotation: Hit_ID=XP_311177.1; Match level="QueryCoverage =90%, HitCoverage=27%, E-value=3e-60, Identity=99%"; Hit description =ENSANGP00000019055 [Anopheles gambiae]
  Gene Ontology: Biological process=reproduction
  Essential gene: C elegans homolog=T04C12.6; Phenotype=Ste
  Coding regions on vcDNA: vcDNA=SeqID_47735; Strand=+; Position=3-374
DSTFFLVLNSWTKMCDEEVAALVVDNGSGMCKAGFAGDDAPRAVFPSIVGRPRHQGVMVGMGQKDSYVGDEAQSKRGILTLKYPIEHGIVTNRDDMEKIWHHTFYNELRVAPEEHPVLLTEAPL

SEQ ID NO: 121313 - protein, 170 aa, Heterodera glycines
  Homolog annotation: Hit_ID=CAE72032.1; Match level="QueryCoverage =98%, HitCoverage=45%, E-value=3e-55, Identity=58%"; Hit description =Hypothetical protein CBG19114 [Caenorhabditis briggsae] emb|CAE72028.1| Hypothetical protein CBG19110 [Cae
  Gene Ontology: Cellular component=nucleolus; Biological process=rRNA processing
  Essential gene: C elegans homolog=C05C8.2; Phenotype=Lva
  Coding regions on vcDNA: vcDNA=SeqID_47736; Strand=+; Position=1-510
GCDIIKISSMVPNRERFVKRRARLVGQNGATLKAIELLTECFVHIQGGTVSSIGTHFGLKQVRKIVEDCMKNIHPIYNIKTLMIKKELMKDDKLRNENWERFLPKFKKKVQNAKDIRKTKQKSKTKWKTKADYTPFPPPQKARKVDEQLETGEYFLNEKVNHKQKKMKRE

SEQ ID NO: 121314 - protein, 123 aa, Heterodera glycines
  Homolog annotation: Hit_ID=P30757; Match level="QueryCoverage=100%, HitCoverage=100%, E-value=5e-57, Identity=89%"; Hit description =Histone H2B pir||S16084 histone H2B - sipunculid (Sipunculus nudus)
  Gene Ontology: Mol. function=DNA binding; Cellular component =nucleosome; Biological process=nucleosome assembly
  Essential gene: C elegans homolog=H02I12.6; Phenotype=Gro,Pvl,Ste
  Coding regions on vcDNA: vcDNA=SeqID_47737; Strand=+; Position=93-464
MPPKPSGKGAKKAVKSTKAVRTGDKKRRKARKESYSVYIYRVLKQVHPDTGISSKAMSIMNSFVNDVFERIAAEASRLAHYNKRSTISSREIQTAVRLILPGELAKHAVSEGTKAVTKYTSSK

SEQ ID NO: 121315 - protein, 164 aa, Heterodera glycines
  Homolog annotation: Hit_ID=NP_491672.1; Match level="QueryCoverage =99%, HitCoverage=37%, E-value=9e-80, Identity=90%"; Hit description =proteasome Regulatory Particle, ATPase-like, S6a (48.1 kD) (rpt-5) [Caenorhabditis elegans] gb|AAC19196.1
  Gene Ontology: Mol. function=transcription co-repressor activity; Cellular component=26S proteasome; Biological process=embryonic cleavage
  Essential gene: C elegans homolog=F56H1.4; Phenotype=Emb
  Coding regions on vcDNA: vcDNA=SeqID_47738; Strand=+; Position=3-494
GVNKDSYLILEKLPPEYDSRVKAMEVDERPKETYSDIGGCDSQIRELVEAIVLPMTKKDLFINIGIQPPKGVLMYGPPGTGKTMLARAVAAQTKSTFLKLAGPQLVQMFIGDGAKLVRDAFALAKEKAPSIIFIDELDAIGTKRFSSEKAGDREVQRTMLELLT

SEQ ID NO: 121316 - protein, 209 aa, Heterodera glycines
  Homolog annotation: Hit_ID=CAE59883.1; Match level="QueryCoverage =99%, HitCoverage=5%, E-value=4e-87, Identity=72%"; Hit description =Hypothetical protein CBG03363 [Caenorhabditis briggsae]
  Gene Ontology: Mol. function=ubiquitin-protein ligase activity; Cellular component=ubiquitin ligase complex; Biological process =protein modification
  Essential gene: C elegans homolog=Y67D8C.5; Phenotype=Emb
  Coding regions on vcDNA: vcDNA=SeqID_47739; Strand=+; Position=2-628
ITAPGDRVTYMINKTSYVNPEHLDYFRFVGRVIAKAIYDNKQLDCYFTRAFYKHVLNKHVRYQDIESEDPDLFKSLEFLLNNAVEDLGAELTFTVEVEEFGVRSTRQLLENGNKTTVTDANKHEYVHLMCQMKMTGSIRQQLNAFLEGFYEVIPKKLISIFNEQELELLISGLPDIDIDDLCANTEYKTYTRTSPQIQWFWRALKAFDA

SEQ ID NO: 121317 - protein, 93 aa, Heterodera glycines
  Homolog annotation: Hit_ID=AAO33478.1; Match level="QueryCoverage =100%, HitCoverage=88%, E-value=5e-46, Identity=100%"; Hit description=ubiquitin extension protein [Heterodera glycines]
  Gene Ontology: Biological process=cell cycle
  Essential gene: C elegans homolog=F25B5.4a; Phenotype=Emb
  Coding regions on vcDNA: vcDNA=SeqID_47740; Strand=+; Position=114-392
MNHFGLTFLFVAVSLLTLTGKTITLEVESSDTVDNVKTKIQEKEGVPPDQQRLIFAGKQLEDGRTLADYNIQKESTLHLVLRLRGGNGKRNTS

SEQ ID NO: 121318 - protein, 155 aa, Heterodera glycines
  Homolog annotation: Hit_ID=AAK26104.1; Match level="QueryCoverage =97%, HitCoverage=87%, E-value=5e-56, Identity=71%"; Hit description =SKP1-like protein ASK10 [Arabidopsis thaliana]
  Gene Ontology: Mol. function=protein binding; Cellular component =ubiquitin ligase complex; Biological process=reproduction
  Essential gene: C elegans homolog=F46A9.5; Phenotype=Emb
  Coding regions on vcDNA: vcDNA=SeqID_47741; Strand=+; Position=1-465
GSASKFFLKSNDDEVFEVDRNVIRLSTTLNTMFQDLGMDQAEAGEKMYTDPIPLANVNGAILRKVIAWCNHHKDDVPTGEDAESKERRTDDIPSWDVEFLKVDQGTLFELILAANYLDVRGLLDVACKTVANMIKGKSPDEIRRTFNIKNDFTPE

SEQ ID NO: 121319 - protein, 131 aa, Heterodera glycines
  misc_feature (54)..(54): Xaa can be any naturally occurring amino acid
  misc_feature (83)..(83): Xaa can be any naturally occurring amino acid
  Homolog annotation: Hit_ID=AAK94492.1; Match level="QueryCoverage =69%, HitCoverage=95%, E-value=2e-41, Identity=97%"; Hit description =hypothetical esophageal gland protein scn1144 [Heterodera glycines]
  Gene Ontology: Biological process=positive regulation of growth rate
  Essential gene: C elegans homolog=Y48A6B.3; Phenotype=Gro
  Coding regions on vcDNA: vcDNA=SeqID_47742; Strand=+; Position=12-403
SMEDSQQNITEQSVSAPTTDRNEYEELSKLVNPISKPLANRKLAKKVYKLVKKXAAKEKGFLRHGLADVMKAFRKNEKGIIVXWQGTFHRLTCTVIFLPFVKKRVFLMFSLRLVNTLVFVLAINVLQLSFW

SEQ ID NO: 121320 - protein, 167 aa, Heterodera glycines
  Homolog annotation: Hit_ID=NP_501065.1; Match level="QueryCoverage =99%, HitCoverage=27%, E-value=2e-56, Identity=60%"; Hit description =ribophorin I (4H677) [Caenorhabditis elegans] pir||T32708 hypothetical protein T22D1.4 - Caenorhabditis e
  Gene Ontology: Mol. function=oligosaccharyl transferase activity; Cellular component=oligosaccharyl transferase complex; Biological process=protein modification
  Essential gene: C elegans homolog=T22D1.4; Phenotype=Unclassified
  Coding regions on vcDNA: vcDNA=SeqID_47743; Strand=+; Position=2-502
GERIIEVSHWGGNIAVEENVEILHKGAKLKGSFSRLDFQMDRRGSRQPVIKNFKTILPAASNDIYYRDEIGNISTSNVYPRADRVEVELRPRFPLYGGWRTNYILGYNVPSTSFLRHSGSNFAIKMKLMDRLYDNAVVEKLCVKIILPETSKNIKLVTPYSVKRLPD

SEQ ID NO: 121321 - protein, 50 aa, Heterodera glycines
  Homolog annotation: Hit_ID=NP_492601.1; Match level="QueryCoverage =96%, HitCoverage=36%, E-value=2e-10, Identity=54%"; Hit description =cytochrome C Oxidase, subunit Vb, LiPid Depleted LPD-4 (lpd-4) [Caenorhabditis elegans] emb|CAB03002.1| H
  Gene Ontology: Biological process=negative regulation of FGF receptor signaling pathway
  Essential gene: C elegans homolog=F26E4.9; Phenotype=Lpd
  Coding regions on vcDNA: vcDNA=SeqID_47744; Strand=-; Position=128-280
PVHLQDKVVGSLCDPDPEYVNYWHIRKGQMKRCECGHWFKGVQAAPDSFA

SEQ ID NO: 121322 - protein, 140 aa, Heterodera glycines
  Homolog annotation: Hit_ID=AAL78213.1; Match level="QueryCoverage =100%, HitCoverage=55%, E-value=6e-47, Identity=69%"; Hit description= probable protein kinase Hgg-20 [Heterodera glycines]
  Essential gene: C elegans homolog=R90.1; Phenotype=Lva,Unc
  Coding regions on vcDNA: vcDNA=SeqID_47745; Strand=+; Position=67-486
MPEELVALSPGTRVSGRWTIIKKLGAGAFGAVYLCQDRDGRTMAALKTEPIDAQRPLLYMEAHVLLSLNELRSNSGRHFCRCLDLGRDEQPDADSGQTMEFNYVVMSLVGRPMDKLLHESGDRFSPGTAIGTSIQLLKAL

SEQ ID NO: 121323 - protein, 138 aa, Heterodera glycines
  Homolog annotation: Hit_ID=CAE61909.1; Match level="QueryCoverage =97%, HitCoverage=15%, E-value=7e-33, Identity=52%"; Hit description =Hypothetical protein CBG05905 [Caenorhabditis briggsae]
  Gene Ontology: Mol. function=aminopeptidase activity; Cellular component=cytosol
  Essential gene: C elegans homolog=F49E8.3; Phenotype=Emb
  Coding regions on vcDNA: vcDNA=SeqID_47746; Strand=+; Position=1-414
RNLHSITYAKSNSIIRMLFNHLGEATFQKAIRDYLKKHQYANAETNDLWKSLSDASGIDVKALMSSWTQQMGFPLVTVEEKILDGDRIELHLKQSRFLADGGHDEANPVWQVPFGVTTAADPTHPNAKFLLMKAEDKF

SEQ ID NO: 121324 - protein, 179 aa, Heterodera glycines
  Homolog annotation: Hit_ID=CAE74484.1; Match level="QueryCoverage =100%, HitCoverage=51%, E-value=2e-78, Identity=77%"; Hit description= Hypothetical protein CBG22235 [Caenorhabditis briggsae]
  Gene Ontology: Mol. function=structural constituent of ribosome; Cellular component=cytosolic large ribosomal subunit (sensu Eukarya); Biological process=protein biosynthesis
  Essential gene: C elegans homolog=B0041.4; Phenotype=Emb,Ste
  Coding regions on vcDNA: vcDNA=SeqID_47747; Strand=+; Position=6-542
MASRPLVSIYNEKNEPTGKQIKLPAVFRAPIRPDIVSFIHDQIRKNKRQAYAVSTAAGHQTSAESWGTGRAVARIPRVRGGGTHRSGQGAFGNMCRGGRMFAPTKVYRRWHRRVNVAQRRYAIVSAIAASAVPALVQARGHVIDQLNEIPLVISDKIESFTKTKEAVGFLQRAHLWDDV

SEQ ID NO: 121325 - protein, 118 aa, Heterodera glycines
  Homolog annotation: Hit_ID=AAN32889.1; Match level="QueryCoverage =100%, HitCoverage=99%, E-value=2e-61, Identity=100%"; Hit description=ubiquitin extension protein [Heterodera glycines]
  Gene Ontology: Biological process=cell cycle
  Essential gene: C elegans homolog=F25B5.4a; Phenotype=Emb
  Coding regions on vcDNA: vcDNA=SeqID_47748; Strand=+; Position=110-463
MNHFGLTFLFVAVSLLVIAPGCDGMQIFVKTLTGKTITLEVESSDTVDNVKEKIQEKEGIPPDQQRLIFAGKQLEDGRTLADYNIQKESTLHLVLRLRGGNGKRNTGKNKKSNKKLDQ

SEQ ID NO: 121326 - protein, 128 aa, Heterodera glycines
  Homolog annotation: Hit_ID=EAL33347.1; Match level="QueryCoverage =98%, HitCoverage=13%, E-value=5e-42, Identity=67%"; Hit description =GA10519-PA [Drosophila pseudoobscura]
  Gene Ontology: Biological process=oogenesis
  Essential gene: C elegans homolog=C12C8.3a; Phenotype =Adl,Rup,Sma,Ste,Stp
  Coding regions on vcDNA: vcDNA=SeqID_47749; Strand=+; Position=3-386
LNDTELTDLSILMGGDSTAKLSGGGNANTMGGSDGLAASIPMLYPPRSQIKRQKMTYHCKFGEFGVIEGQFTEPSGVAVNAQCDIIVADTNNHRIQVFDREGRFKFQFGECGKRDGQLLYPNRVSVNR

SEQ ID NO: 121327 - protein, 215 aa, Heterodera glycines
  Homolog annotation: Hit_ID=NP_495079.1; Match level="QueryCoverage =91%, HitCoverage=55%, E-value=2e-23, Identity=36%"; Hit description =acyl-CoA thioesterase family member (39.7 kD) (2F863C) [Caenorhabditis elegans] gb|AAK31429.1| Hypothetic
  Gene Ontology: Mol. function=acyl-CoA thioesterase activity; Biological process=acyl-CoA metabolism
  Essential gene: C elegans homolog=C17C3.1a; Phenotype=Unclassified
  Coding regions on vcDNA: vcDNA=SeqID_47750; Strand=+; Position=2-646
GSNGWHASNGPALSLLGYRKAVNRDVFGGQMFAQAIAAAEATVDGDEFAPNAAHSMFIRKAFIDHPIEYIVTRTRDGRSFCTRTVEARQNGETVFCAQISLCVKERSSIEHQTEMPAEVPEPEELVPFFETVRRVVTEHDEGRTERNGRTIANLRAVLEDEQQPSVFEFRPIHSDIFLGIRPHSPTPIRYWLKCAVPLGSERTNKALNRFLLAFI

SEQ ID NO: 121328 - protein, 203 aa, Heterodera glycines
  Homolog annotation: Hit_ID=NP_495912.1; Match level="QueryCoverage =99%, HitCoverage=66%, E-value=2e-58, Identity=56%"; Hit description =haymaker protein (32.4 kD) (2J262) [Caenorhabditis elegans] emb|CAA93850.1| Hypothetical protein C18E9.6
  Essential gene: C elegans homolog=C18E9.6; Phenotype=Gro,Sma
  Coding regions on vcDNA: vcDNA=SeqID_47751; Strand=+; Position=3-611
GKCRDLFPVCFEGAKAMVQKGLSSHFQVSHNISISPALNGYRFGATYVGYMQATPAEVFPVFFGEMDLQGNTQATVLHQIGNFRGKFQGQIQQNMLAAAQFSLEHRGRLSTYGLTFANPSVSANNCQGTLVAQMLRRVTKNLDLGAEYIYHRDERFPGKQSNTLSYALRYIQPTWIFSGTLAPTELHLCYYHKQSEHLQFGVE

SEQ ID NO: 121329 - protein, 183 aa, Heterodera glycines
  Homolog annotation: Hit_ID=CAB59358.1; Match level="QueryCoverage =100%, HitCoverage=39%, E-value=3e-98, Identity=95%"; Hit description= translation elongation factor eEF-1 alpha chain [Anisakis simplex]
  Gene Ontology: Mol. function=translation factor activity, nucleic acid binding; Biological process=protein biosynthesis
  Essential gene: C elegans homolog=R03G5.1a; Phenotype=Emb,Lva,Unc
  Coding regions on vcDNA: vcDNA=SeqID_47752; Strand=+; Position=58-606
MGKEKIHINIVVIGHVDSGKSTTTGHLIYKCGGIDKRTIEKFEKEAQEMGKGSFKYAWVLDKLKAERERGITIDIALWKFETSKYYVTIIDAPGHRDFIKNMITGTSQADCAVLVVACGTGEFEAGISKNGQTREHALLAQTLGVKQLIVACNKMDTTEPPFAEARYTEVMTEVSNFIKKIGY

SEQ ID NO: 121330 - protein, 188 aa, Heterodera glycines
  misc_feature (63)..(63): Xaa can be any naturally occurring amino acid
  Homolog annotation: Hit_ID=NP_492476.1; Match level="QueryCoverage =98%, HitCoverage=16%, E-value=2e-78, Identity=74%"; Hit description =RNA polymerase (1J858) [Caenorhabditis elegans] emb|CAA99827.1| Hypothetical protein F14B4.3 [Caenorhabdi
  Gene Ontology: Mol. function=protein binding; Cellular component =nucleolus; Biological process=growth
  Essential gene: C elegans homolog=F14B4.3; Phenotype=Lva,Lvl
  Coding regions on vcDNA: vcDNA=SeqID_47753; Strand=+; Position=1-565
GKPNERNYGIGADGLPIEGRLYQQGDCYYGTFNLVSGQFNEHKFTNSEPAYCGLVRIVQEAEXKKNVHVLIQWRIQRNPIIGDKFASRHGQKGINSFLWPPESMPFSESGMVPDIIFNPHGFPSRMTIGMMIESMAGKAAAMHGTSYDASPFVFNEQNTAIEHFGKLLAKSGYNYYGNETMYSGIDGR

SEQ ID NO: 121331 - protein, 143 aa, Heterodera glycines
  Homolog annotation: Hit_ID=NP_999498.1; Match level="QueryCoverage =93%, HitCoverage=22%, E-value=3e-33, Identity=50%"; Hit description =ribophorin I [Sus scrofa] emb|CAC04096.1| ribophorin I [Sus scrofa]
  Gene Ontology: Mol. function=oligosaccharyl transferase activity; Cellular component=oligosaccharyl transferase complex; Biological process=protein modification
  Essential gene: C elegans homolog=T22D1.4; Phenotype=Unclassified
  Coding regions on vcDNA: vcDNA=SeqID_47754; Strand=+; Position=1-432
GSTSFLRHSGSNFAIKMKLMDRLYDNAVVEKLCVKIILPETSKNIKLVTPYSVKRLPDEVHKTYLDTFGRPVIVLEKENLINNHIQPFTLYYEFDRFSMLYEPLLIVVAFGALFLAAVILFRLDFSIAGKDEKEAASGHQKKE

SEQ ID NO: 121332 - protein, 228 aa, Heterodera glycines
  Homolog annotation: Hit_ID=NP_506193.1; Match level="QueryCoverage =100%, HitCoverage=19%, E-value=2e-45, Identity=43%"; Hit description= yeast mitotic condensin subunit SCC homolog (124.8 kD) (scc-3) [Caenorhabditis elegans] emb|CAA99836.1|
  Gene Ontology: Cellular component=synaptonemal complex; Biological process=embryogenesis and morphogenesis
  Essential gene: C elegans homolog=F18E2.3; Phenotype=Emb
  Coding regions on vcDNA: vcDNA=SeqID_47755; Strand=-; Position=1-684
FKDRLVSMVLDTDVEVATKTCQLMTHIYRAFPALLDPGACVPLYELVYCNNRQLATAAGEFVNAKLFSTAADNSLLTSSTSLLTPPAENRQLIKDLVTFFIDGAVHRHPAYLVDSLIDICPMLKDWSTMVDILLSDEFDQFDTQLISIMCAAVKHAATGEHPPNRIVVSIRRGPGAGTEKKDLRMLHDGRVHLSEVFIPKLPRLLQKFIADQEKVRDLIGLFLYFELE

SEQ ID NO: 121333 - protein, 128 aa, Heterodera glycines
  Homolog annotation: Hit_ID=NP_501167.1; Match level="QueryCoverage =100%, HitCoverage=60%, E-value=6e-43, Identity=68%"; Hit description= ribosomal Protein, Small subunit (23.8 kD) (rps-8) [Caenorhabditis elegans] gb|AAA81485.1| Ribosomal pro
  Gene Ontology: Cellular component=eukaryotic 48S initiation complex; Biological process=protein biosynthesis
  Essential gene: C elegans homolog=F42C5.8; Phenotype=Lva,Ste
  Coding regions on vcDNA: vcDNA=SeqID_47756; Strand=-; Position=108-494
YNASNNELVRTKTLVKGMIVSIDAIPFRQWYEAHYALPLARKKGQKLTENEKARIGGAQKRSKSTLKKYTERQKTAGVEPHLLEQFQAGRLFACISSRPLQSGRCDGYILEGKELEFYNKKLKAKKAK

SEQ ID NO: 121334 - protein, 168 aa, Heterodera glycines
  Homolog annotation: Hit_ID=AAN05602.1; Match level="QueryCoverage =100%, HitCoverage=86%, E-value=6e-54, Identity=62%"; Hit description= ribosomal protein S7 [Argopecten irradians]
  Gene Ontology: Mol. function=structural constituent of ribosome; Cellular component=cytosolic small ribosomal subunit (sensu Eukarya); Biological process=morphogenesis
  Essential gene: C elegans homolog=ZC434.2; Phenotype=Lva
  Coding regions on vcDNA: vcDNA=SeqID_47757; Strand=+; Position=42-545
MVATFEKLVKTDGKAPDDLEKQVATALSELAHNSEIKAQLSELYFVGAQEYEFGNKKCILVWIPVPQLRDYQKIHPKLVRELEKKMSGCHVIFIAKRRILPKPQRGKNRKPLGQKRPRSRTLTAVHDSILADVVFPAEVVGKRTRVKLDGKQIIKVHLDKAQQTTVEH

SEQ ID NO: 121335 - protein, 191 aa, Heterodera glycines
  Homolog annotation: Hit_ID=CAE58533.1; Match level="QueryCoverage =86%, HitCoverage=44%, E-value=3e-41, Identity=52%"; Hit description =Hypothetical protein CBG01690 [Caenorhabditis briggsae]
  Gene Ontology: Mol. function=transcription regulator activity; Cellular component=integral to membrane; Biological process=cell cycle
  Essential gene: C elegans homolog=R08C7.2a; Phenotype=Gro
  Coding regions on vcDNA: vcDNA=SeqID_47758; Strand=+; Position=39-611
MARNRPNANIITSDLGEAQIKKHRPKDTRLLQQRLVAWQPILTAKTVIPLVFSISILFIPIGIVLLRISQSVQEYVVQYVNDANECKDYHANGQCAVNFTLNEDFKGDVYFYYALENFFQNHRRYMKSRNDQQLSGIDFLNTKDCTPFEKAPDGRPIAPCGAIANSLFNDSFQLNYLGRNGNGYANISWSH

SEQ ID NO: 121336 - protein, 145 aa, Heterodera glycines
  misc_feature (77)..(77): Xaa can be any naturally occurring amino acid
  misc_feature (120)..(120): Xaa can be any naturally occurring amino acid
  Homolog annotation: Hit_ID=CAE17287.1; Match level="QueryCoverage =99%, HitCoverage=31%, E-value=2e-67, Identity=88%"; Hit description =beta-tubulin [Cyathostomum pateratum]
  Gene Ontology: Mol. function=MHC class I protein binding; Cellular component=tubulin; Biological process=embryogenesis and morphogenesis
  Essential gene: C elegans homolog=K01G5.7; Phenotype=Emb
  Coding regions on vcDNA: vcDNA=SeqID_47759; Strand=+; Position=2-434
GISKIREEYPDRIMCSFSEVPSPKVSDTGDEPYNATLSVHQLVENTDETLCIDNEALYDICFRTLKLQNPTYGDLNXHLVSVTMSGVTTCLRFPGQLNADLRKLAVNMVPFPRLHFFMPXCAPLSAKGAAAYQALSVSQLTKQMY

SEQ ID NO: 121337 - protein, 107 aa, Heterodera glycines
  Homolog annotation: Hit_ID=CAE60390.1; Match level="QueryCoverage =98%, HitCoverage=32%, E-value=6e-34, Identity=60%"; Hit description =Hypothetical protein CBG03991 [Caenorhabditis briggsae]
  Gene Ontology: Mol. function=translation factor activity, nucleic acid binding; Cellular component=eukaryotic translation initiation factor 3 complex; Biological process=regulation of translational initiation
  Essential gene: C elegans homolog=Y74C10AR.1; Phenotype=Ste
  Coding regions on vcDNA: vcDNA=SeqID_47760; Strand=-; Position=128-451
LQHLKTYKSNRPVNTASVSPSRDHIVLGGGEEHMEVTQTATTAEQFVARLYHLIFEEEFARFRGHLGPINSIIFDPTGDIVVFGGEDGYVRVQELDQSYKEFHFDIS

SEQ ID NO: 121338 - protein, 174 aa, Heterodera glycines
  Homolog annotation: Hit_ID=AAQ89579.1; Match level="QueryCoverage =99%, HitCoverage=26%, E-value=3e-95, Identity=100%"; Hit description= heat shock protein 70-C [Heterodera glycines] gb|AAM93256.1| heat shock protein 70-C [Heterodera glycines
  Gene Ontology: Mol. function=Hsp70/Hsp90 organizing protein activity; Cellular component=endoplasmic reticulum lumen; Biological process =reproduction
  Essential gene: C elegans homolog=C15H9.6; Phenotype=Dpy,Lva
  Coding regions on vcDNA: vcDNA=SeqID_47761; Strand=+; Position=1-525
GDLTGIPPAPRGVPQIEVTFEIDVNGILHVTAEDKGTGNKNKITITNDHNRLSPEEIERMINDAEKFAEEDKKTKEVVEARNEFESYAYSLKNQLGDSEKLGGKLSAEDKTTIEGAVDEAISWLDSNKDAPPEELKERKKDLEAKVQPIISKLYAGQSPPPGSEPPPTEEKDEL

SEQ ID NO: 121339 - protein, 201 aa, Heterodera glycines
  misc_feature (174)..(174): Xaa can be any naturally occurring amino acid
  misc_feature (194)..(194): Xaa can be any naturally occurring amino acid
  Homolog annotation: Hit_ID=AAS64750.1; Match level="QueryCoverage =99%, HitCoverage=38%, E-value=4e-47, Identity=50%"; Hit description =cyclin L; C52E4.6a [Caenorhabditis elegans] ref|NP_506007.1| cyclin (56.0 kD) (5M472) [Caenorhabditis eleg
  Gene Ontology: Biological process=cell cycle
  Essential gene: C elegans homolog=C52E4.6a; Phenotype=Emb,Lva
  Coding regions on vcDNA: vcDNA=SeqID_47762; Strand=+; Position=2-604
GEHMVQACLLLASKIEEEPRKPRDVLNVYNRLKQIHHRRNAVASQHPEDLQKLSKKFEHLELCSKRYQELKNIVIKAERRLLNVLGFVVHVHHPHKLIYIYLHILDQLKNDQKKYSASEIRKSRQLLQKAWSFMNDGLRTDMFLRYTPETIACACIQLAVRTVDQPIVLPTEPXAWFELFDASDRDVRAISQTXWELYTRK

SEQ ID NO: 121340 - protein, 219 aa, Heterodera glycines
  Homolog annotation: Hit_ID=NP_497617.1; Match level="QueryCoverage =99%, HitCoverage=57%, E-value=8e-75, Identity=58%"; Hit description =phosphotyrosyl phosphatase activator (42.9 kD) (3D872) [Caenorhabditis elegans] gb|AAK29984.1| Hypothetic
  Gene Ontology: Mol. function=protein phosphatase type 2A, intrinsic regulator activity; Cellular component=soluble fraction; Biological process=protein amino acid dephosphorylation
  Essential gene: C elegans homolog=Y71H2AM.20a; Phenotype=Emb,Lva
  Coding regions on vcDNA: vcDNA=SeqID_47763; Strand=+; Position=1-657
GQRFGNKSFKKWFERLMSDGQSLLSDLFPENLKSAVLEIWPYLMDSFGNSTRIDYGSGHETSFLIFLFCLYEIGVLHSPDDDRASILRVFHRYLKLARRLQCEYRMEPAGSRGVHAIDDFQFLPFLFGSAQLIDNKQRLIPDYYLRPDMVTQHQDDNLFFEAIHYINQTKIGPFHEHSNQLYNISAVNTWDRINEGMFKMYEGEVLKEVPVVQHFLFGS

SEQ ID NO: 121341 - protein, 178 aa, Heterodera glycines
  Homolog annotation: Hit_ID=CAE66157.1; Match level="QueryCoverage =99%, HitCoverage=30%, E-value=2e-60, Identity=63%"; Hit description =Hypothetical protein CBG11388 [Caenorhabditis briggsae]
  Gene Ontology: Mol. function=serine C-palmitoyltransferase activity; Cellular component=mitochondrion; Biological process=sphingolipid biosynthesis
  Essential gene: C elegans homolog=F43H9.2a; Phenotype=Unclassified
  Coding regions on vcDNA: vcDNA=SeqID_47764; Strand=+; Position=1-537
GFTKSFGAAGGYLAGKSSLIAHLRRHSPTSFYSLAMSAPVAQQVFTSMSIIMGRDNTDQGWRRIERSARNTRYFRLRLKQMGFIVYGSNDSPVIPIMIYHPTKCGLWGRLLLERKISAVVVSFPATAMTESRCRICISAAHDKEMLDRVLDAIDEVGDISATKHSHRTHRYRQLDVKW

SEQ ID NO: 121342 - protein, 180 aa, Heterodera glycines
  Homolog annotation: Hit_ID=NP_492354.1; Match level="QueryCoverage =98%, HitCoverage=73%, E-value=4e-32, Identity=43%"; Hit description =proteasome Beta Subunit (26.7 kD) (pbs-7) [Caenorhabditis elegans] emb|CAB03081.1| Hypothetical protein F
  Gene Ontology: Mol. function=endopeptidase activity; Cellular component=proteasome core complex (sensu Eukarya); Biological process=locomotory behavior
  Essential gene: C elegans homolog=F39H11.5; Phenotype=Emb,Lva,Unc
  Coding regions on vcDNA: vcDNA=SeqID_47765; Strand=+; Position=27-566
MSLTGGTVIALAYKGGVAMATDRTVFASGVHRFQNNTRQYRLNNYCLISFSGDFAEFQWLQNLLERRQMELQIDAGMDHMKPKMVHAFLTSLFYQRRSKMNPFLNTMVVCGMQPVEFHAGEIKPFIGVIDMRGNAYEVDHVATEIGKYLLRQMLETRQTQANGAEQMSKEEALRMVAAAL

SEQ ID NO: 121343 - protein, 178 aa, Heterodera glycines
  Homolog annotation: Hit_ID=CAE66157.1; Match level="QueryCoverage =99%, HitCoverage=30%, E-value=5e-60, Identity=62%"; Hit description =Hypothetical protein CBG11388 [Caenorhabditis briggsae]
  Gene Ontology: Mol. function=serine C-palmitoyltransferase activity; Cellular component=serine C-palmitoyltransferase complex; Biological process=sphingolipid biosynthesis
  Essential gene: C elegans homolog=F43H9.2a; Phenotype=Unclassified
  Coding regions on vcDNA: vcDNA=SeqID_47766; Strand=+; Position=1-537
GFTKSFGAAGGYLAGKSSLIAHLRRHSPTSFYSLAMSAPVAHQVFTSMSIIMGRDNTDQGWRRIERTARNTRYFRLRLKQMGFIVYGSNDSPVIPIMIYHPTKCGLWGRLLLERKISAVVVSFPATAMTESRCRICISAAHDKEMLDRVLDAIDEVGDISATKHSHRTHRYRQLDVKW

SEQ ID NO: 121344 - protein, 161 aa, Heterodera glycines
  Homolog annotation: Hit_ID=NP_500841.1; Match level="QueryCoverage =99%, HitCoverage=43%, E-value=2e-75, Identity=78%"; Hit description =constitutive photomorphogenic COP9 SigNalosome subunit, Jun activation domain binding protein (41.0 kD) (
  Gene Ontology: Mol. function=metalloendopeptidase activity; Cellular component=signalosome complex; Biological process=glia cell migration
  Essential gene: C elegans homolog=B0547.1; Phenotype=Emb
  Coding regions on vcDNA: vcDNA=SeqID_47767; Strand=+; Position=3-485
VIRNVKPWEQDPHYFKEVKISALALVKMVMHARSGGNIEIMGLMQGRVDANTIIVLDAFALPVEGTETRVNAQAQAYEFMTNFSESCEAVGRLEKVVGWYHSHPGYGCWLSGIDVNTQSINQQFQEPFVAIVIDPIRTVSAGKVDIGAFRTYPKGYKPPDE

SEQ ID NO: 121345 - protein, 77 aa, Heterodera glycines
  Homolog annotation: Hit_ID=NP_492761.1; Match level="QueryCoverage =100%, HitCoverage=50%, E-value=2e-27, Identity=74%"; Hit description= nucleoside diphosphate kinase (1L130) [Caenorhabditis elegans] emb|CAB02101.1| Hypothetical protein F25H
  Gene Ontology: Mol. function=ATP binding; Cellular component=nucleus; Biological process=DNA metabolism
  Essential gene: C elegans homolog=F25H2.5; Phenotype=Pvl,Stp
  Coding regions on vcDNA: vcDNA=SeqID_47768; Strand=-; Position=219-452
MVWKGLNVVKQGRVLLGATNPLASAPGTIRGNFCIEMGRNICHGSDSVPSAAREIAHWFNPEELVDWESAQNAWVYE

SEQ ID NO: 121346 - protein, 103 aa, Heterodera glycines
  Homolog annotation: Hit_ID=CAE60131.1; Match level="QueryCoverage =77%, HitCoverage=19%, E-value=1e-18, Identity=54%"; Hit description =Hypothetical protein CBG03676 [Caenorhabditis briggsae]
  Essential gene: C elegans homolog=B0286.4a; Phenotype=Unclassified
  Coding regions on vcDNA: vcDNA=SeqID_47769; Strand=-; Position=131-442
EVYQVAAATELYSRDWRFHKVERVWLMRAPFSAPPREIGGTYDRCSYLVFAPIQWRRIPREMVLEYKDLEGNPSVPGTGQSSASAGSMPPLKPDSGADQSMFS

SEQ ID NO: 121347 - protein, 86 aa, Heterodera glycines
  Homolog annotation: Hit_ID=AAC24580.1; Match level="QueryCoverage =98%, HitCoverage=53%, E-value=5e-40, Identity=95%"; Hit description =ADP/ATP translocase [Heterodera glycines]
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_47770; Strand=-; Position=108-368
NWAIAQVVPVSSGVLSYPWDPVRRRMIMQSGRKDIMYKNPLDCAIKIIKNEGLLKGMFKGALSNVFRGTGGALVLAFYDEIQKYIP

SEQ ID NO: 121348 - protein, 122 aa, Heterodera glycines
  Homolog annotation: Hit_ID=CAE57827.1; Match level="QueryCoverage =99%, HitCoverage=100%, E-value=2e-49, Identity=78%"; Hit description= Hypothetical protein CBG00852 [Caenorhabditis briggsae]
  Gene Ontology: Mol. function=hydrogen-transporting ATPase activity, rotational mechanism; Cellular component=vacuolar membrane (sensu Fungi); Biological process=hydrogen transport
  Essential gene: C elegans homolog=ZK970.4; Phenotype=Emb
  Coding regions on vcDNA: vcDNA=SeqID_47771; Strand=+; Position=33-401
MAFGQKGKLLAVIGDEDTVVGFLLGGVGQLNKARKPNFVIVDKNTSVAEIEDAFRTFCTRDDIAIILINQHVAEMIRYQVDQHVASIPAVLEIPSKEMPYDASKDSILNRARGLVNTDDLKS

SEQ ID NO: 121349 - protein, 200 aa, Heterodera glycines
  Homolog annotation: Hit_ID=NP_493672.1; Match level="QueryCoverage =96%, HitCoverage=61%, E-value=9e-54, Identity=53%"; Hit description =mitochondrial ribosomal protein L28 (36.4 kD) (2A446) [Caenorhabditis elegans] gb|AAC26291.1| Hypothetica
  Gene Ontology: Biological process=positive regulation of growth rate
  Essential gene: C elegans homolog=T25D3.2; Phenotype=Lva
  Coding regions on vcDNA: vcDNA=SeqID_47772; Strand=+; Position=26-625
MSFAKSCSLAKHCKPLTAAPPRPVITWDKHERIRRNKEIWDNPKSVVHRLPRHYQERYWKNFVLADQTAVNYKVPPFRFYWDEHRKIELETEYFPILPIYCPEMDQGLWAGEGIIKGYSESDAKIKKKILPREWLPRLWIPHLNLVPLYSEVLDKYFKVTVTERLLRAVDKHFGFDLYLLETPDIDINSRLGLDLKRLIL

SEQ ID NO: 121350 - protein, 172 aa, Heterodera glycines
  Homolog annotation: Hit_ID=CAE62725.1; Match level="QueryCoverage =90%, HitCoverage=34%, E-value=2e-47, Identity=60%"; Hit description =Hypothetical protein CBG06885 [Caenorhabditis briggsae]
  Gene Ontology: Mol. function=acetyl-CoA C-acetyltransferase activity; Cellular component=mitochondrion; Biological process=fatty acid beta -oxidation
  Essential gene: C elegans homolog=B0303.3; Phenotype=Emb
  Coding regions on vcDNA: vcDNA=SeqID_47773; Strand=+; Position=3-518
ALASVLLQQQKFSAVASSPNKNLNAVLIDAVRTPFLQSNTTFRELLAVDLQRHALKALVERTKIPFDEIGHIICGQVVQECKTSNIAREAAITAGFPDSIPCNTVTLACISSGVSIQNISLMISTGYLKAGIAGGVELLSDFPIRYNRKVRLSLIDLQKAKSFGERFKHLKT

SEQ ID NO: 121351 - protein, 149 aa, Heterodera glycines
  Homolog annotation: Hit_ID=NP_498048.2; Match level="QueryCoverage =95%, HitCoverage=42%, E-value=8e-40, Identity=57%"; Hit description =cell differentiation proteins, Rcd1-like (3G35) [Caenorhabditis elegans] gb|AAA21157.2| Hypothetical prot
  Gene Ontology: Cellular component=CCR4-NOT complex; Biological process=sex differentiation
  Essential gene: C elegans homolog=C26E6.3; Phenotype=Emb
  Coding regions on vcDNA: vcDNA=SeqID_47774; Strand=+; Position=43-489
MEKLLSPNIANAQSTSTTTTSATASSNNKEENSKEKDAEQICHWIRELREHEKRENALLQISKRREGVEDLAVWLWFSYGTVSVLLQEIISIYPFILPPTLTAAQSNRVCNALALMQCIASHRNTRKQFLDANVPLYLYPFLHTTSDSR

SEQ ID NO: 121352 - protein, 81 aa, Heterodera glycines
  Homolog annotation: Hit_ID=AAL40720.1; Match level="QueryCoverage =98%, HitCoverage=20%, E-value=5e-25, Identity=68%"; Hit description =calreticulin [Meloidogyne incognita]
  Gene Ontology: Mol. function=calcium ion binding; Cellular component =extracellular space; Biological process=regulation of transcription, DNA-dependent
  Essential gene: C elegans homolog=Y38A10A.5; Phenotype=Unc
  Coding regions on vcDNA: vcDNA=SeqID_47775; Strand=+; Position=2-247
GFDNFLVADSVEDAKKHAADTFDQLKEAEKKQKEAHDEEERKKFEEEEKKRKEEEEKKPKKDEEEVEEDEEEKKEEEHDEL

SEQ ID NO: 121353 - protein, 165 aa, Heterodera glycines
  Homolog annotation: Hit_ID=CAE74666.1; Match level="QueryCoverage =93%, HitCoverage=18%, E-value=8e-23, Identity=38%"; Hit description =Hypothetical protein CBG22467 [Caenorhabditis briggsae]
  Essential gene: C elegans homolog=H06I04.3a; Phenotype=Lva
  Coding regions on vcDNA: vcDNA=SeqID_47776; Strand=-; Position=3-497
PNEIKECLKDIKVCGPAELRSILKWRKKLVDEQKKEEKASKESVKSAEEMVEGDTGEELEENTEFKELEEIDDLIRPAKAEEKATLKKRKRKLLKAKRNLEERKKLKMVHEGDDPTIGEDLELFSLKTVKRLAERAAKAVKGIKEEEEEKESNDEDAKKKKKKKK

SEQ ID NO: 121354 - protein, 151 aa, Heterodera glycines
  Homolog annotation: Hit_ID=NP_491653.2; Match level="QueryCoverage =96%, HitCoverage=16%, E-value=1e-20, Identity=36%"; Hit description =periodic tryptophan protein 2 homolog (102.1 kD) (1G218) [Caenorhabditis elegans] gb|AAB37807.2| Hypothet
  Gene Ontology: Mol. function=snoRNA binding; Cellular component =cytoplasm; Biological process=rRNA processing
  Essential gene: C elegans homolog=F55F8.3; Phenotype=Lva
  Coding regions on vcDNA: vcDNA=SeqID_47777; Strand=-; Position=18-473
IKLPGTRHTYMAERSIHQPVTVPKMGFCPTGGSFAVVSTEGVALYSLFQMRRFDPFQLEIDVVPNSIVQFSLSGVHAKAILLALRLSDAKLKRRVVESVPILQLSAVVRGIELIYIGRVIVWLLFFADKGHQKHVHFYQLLVRGILIANAS

SEQ ID NO: 121355 - protein, 101 aa, Heterodera glycines
  Homolog annotation: Hit_ID=CAE64199.1; Match level="QueryCoverage =94%, HitCoverage=21%, E-value=7e-25, Identity=53%"; Hit description =Hypothetical protein CBG08829 [Caenorhabditis briggsae]
  Gene Ontology: Mol. function=protein binding; Biological process =purine nucleotide metabolism
  Essential gene: C elegans homolog=C37H5.6a; Phenotype =Emb,Gro,Pvl,Stp,Unc
  Coding regions on vcDNA: vcDNA=SeqID_47778; Strand=+; Position=2-307
GTKVDILDQFHEIKIAIGYELNGRQIEYPPATVDDWANLCVHYKTFEGWQSPTTSARQWEQLPDKCRAYLEFIQNQLGVPVEYIGVGKGREQLIVRTNNGG

SEQ ID NO: 121356 - protein, 173 aa, Heterodera glycines
  Homolog annotation: Hit_ID=AAP30833.1; Match level="QueryCoverage =100%, HitCoverage=70%, E-value=3e-97, Identity=100%"; Hit description=putative gland protein G8A07; Hg-G8A07 [Heterodera glycines]
  Gene Ontology: Cellular component=mitochondrion; Biological process =lipid metabolism
  Essential gene: C elegans homolog=T26C5.3a; Phenotype=Emb
  Coding regions on vcDNA: vcDNA=SeqID_47779; Strand=+; Position=78-596
MLIMVIVLLTGKIAFAATDGMTDLKLINEGLTTDKIASRSIFLTPLQIILPWVLGKQTAGPKPLNVFLWAYPYRLVMSLALALLVYWTPSFREPNGEYPYFYYAIWIGAYYLQQVSSYCIFLSMMAFNAQISDPKIGGTYRTLLNTLNNLGGNWPVTLFLSITDFFNRKNCVA

SEQ ID NO: 121357 - protein, 164 aa, Heterodera glycines
  Homolog annotation: Hit_ID=NP_502053.1; Match level="QueryCoverage =98%, HitCoverage=20%, E-value=6e-32, Identity=40%"; Hit description =glucosidase 1 (4L782) [Caenorhabditis elegans] emb|CAA92954.1| Hypothetical protein F13H10.4 [Caenorhabdi
  Gene Ontology: Mol. function=mannosyl-oligosaccharide glucosidase (processing A-glucosidase I) activity; Cellular component =endoplasmic reticulum membrane; Biological process=N-linked glycosylation
  Essential gene: C elegans homolog=F13H10.4; Phenotype=Gro,Unc
  Coding regions on vcDNA: vcDNA=SeqID_47780; Strand=+; Position=41-532
IPDEEANFAAIQFDFSKNIHIELEMLAEGDAKIANFDHIFTRKLETFSNKFDEIFPIDHQEGSDSFNRLGKIALSNLLGGIGVWHGYSLVKIDESDQNNSYGPLSLISAVPSRPFFPRGFLWDEGFHNLIIRHFDPQLTLQILASWLDSMNFDGWMPREMILGS

SEQ ID NO: 121358 - protein, 172 aa, Heterodera glycines
  Homolog annotation: Hit_ID=CAE66979.1; Match level="QueryCoverage =90%, HitCoverage=91%, E-value=7e-31, Identity=44%"; Hit description =Hypothetical protein CBG12375 [Caenorhabditis briggsae]
  Gene Ontology: Biological process=positive regulation of embryonic development
  Essential gene: C elegans homolog=F36A2.7; Phenotype=Emb,Lva
  Coding regions on vcDNA: vcDNA=SeqID_47781; Strand=+; Position=2-520
GFSNDYLLCRFQAFRNYAIKKERPPPAKIQVPPPANETGHWKYERDYSYDLRYSNPINKYSSFTRFITLTATGHKELWALFALLMLSSSLAIGIVFYSLGKIEVWVDRSTSTPPWDWARVRDKYWKFPTVLYDPTGITHVRLSPMEKLQDEMLEAAKERGTRDAKGYWVGKQ

SEQ ID NO: 121359 - protein, 61 aa, Heterodera glycines
  Homolog annotation: Hit_ID=NP_725894.1; Match level="QueryCoverage =98%, HitCoverage=51%, E-value=1e-23, Identity=85%"; Hit description =CG9291-PA, isoform A [Drosophila melanogaster] ref|NP_523794.1| CG9291-PB, isoform B [Drosophila melanoga
  Essential gene: C elegans homolog=Y82E9BR.15; Phenotype=Emb,Lva
  Coding regions on vcDNA: vcDNA=SeqID_47782; Strand=+; Position=2-187
DAESETNEVHFREIPSHVLQKVCHYFAYKARYTNSATEIPEFFVAPEVALELLMAANFLDC

SEQ ID NO: 121360 - protein, 90 aa, Heterodera glycines
  Homolog annotation: Hit_ID=AAC24580.1; Match level="QueryCoverage =98%, HitCoverage=56%, E-value=3e-43, Identity=95%"; Hit description =ADP/ATP translocase [Heterodera glycines]
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_47783; Strand=-; Position=111-383
NFFVNWAIAQVVPVSSGVLSYPWDTVRRRMIMQSARKDIMYKNTLDCAIKIIKNEGLLKGMFKGALSNVFRGTGGALVLAFYDEVQKYIP

SEQ ID NO: 121361 - protein, 153 aa, Heterodera glycines
  Homolog annotation: Hit_ID=AAC24580.1; Match level="QueryCoverage =100%, HitCoverage=96%, E-value=5e-78, Identity=94%"; Hit description= ADP/ATP translocase [Heterodera glycines]
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_47784; Strand=+; Position=3-464
GKADAREFKGLADCIMKILKSDGPIGLYRGFFVSVQGIIIYRAAYFGCFDTAKMLFSPEGKQMNFFVNWAIAQVVTVSSGVLSYPWDTVRRRMMMQSGRKDIMYKNTLDCAIKIIKNEGLLKGMFKGALSNVFRGTGGALVLAFYDEIQKYIH

SEQ ID NO: 121362 - protein, 165 aa, Heterodera glycines
  Homolog annotation: Hit_ID=XP_392715.1; Match level="QueryCoverage =95%, HitCoverage=24%, E-value=1e-36, Identity=47%"; Hit description =similar to ENSANGP00000013083 [Apis mellifera]
  Gene Ontology: Mol. function=SUMO activating enzyme activity; Cellular component=nucleus; Biological process=protein modification
  Essential gene: C elegans homolog=W02A11.4; Phenotype =Emb,Lva,Pvl,Stp,Unc
  Coding regions on vcDNA: vcDNA=SeqID_47785; Strand=+; Position=1-495
GDAITKNGKMSTRQFAEATDYGPKQIFEKLFFDDINYLLSMADLWKERKKPTPIHFMQVIDEGLGGSRPNEDENEHWGVSKWAELFEDSLFALAERYRGAVKEKRMLIWDKDDEPAMQFVAACANLRAYIFGIGTKPLFDLKAMAGNIIPAIATTNACVAGMIVV

SEQ ID NO: 121363 - protein, 153 aa, Heterodera glycines
  Homolog annotation: Hit_ID=CAE58391.1; Match level="QueryCoverage =76%, HitCoverage=14%, E-value=3e-11, Identity=31%"; Hit description =Hypothetical protein CBG01520 [Caenorhabditis briggsae]
  Essential gene: C elegans homolog=T23B12.4; Phenotype=Emb
  Coding regions on vcDNA: vcDNA=SeqID_47786; Strand=+; Position=3-461
FICGSTPLEGVVLNSISSANWINGTVDQPLKLLFASDESLRDIFNDFLVVVVRAYVNLFQTFGHNLSRQMDKFLRVIFDEFGALIIEASKIEAVLETARINLDVDNSDCQIPNMQHLFSNFFLQTILALMHHYFSMAFQMRLVQPYEFHYIYW

SEQ ID NO: 121364 - protein, 73 aa, Heterodera glycines
  Homolog annotation: Hit_ID=CAE60115.1; Match level="QueryCoverage =100%, HitCoverage=23%, E-value=2e-25, Identity=72%"; Hit description= Hypothetical protein CBG03655 [Caenorhabditis briggsae]
  Gene Ontology: Cellular component=mitochondrion; Biological process =energy pathways
  Essential gene: C elegans homolog=C01F1.2; Phenotype=Emb,Lva
  Coding regions on vcDNA: vcDNA=SeqID_47787; Strand=-; Position=214-435
TGSKEQIAKVAKAFRVYHSEGPRTKRTDDYIVDHTVIMYLIDPEGNFHDYYGQNRRAREITNVIKLKAAEWDA

SEQ ID NO: 121365 - protein, 102 aa, Heterodera glycines
  Homolog annotation: Hit_ID=CAE71878.1; Match level="QueryCoverage =97%, HitCoverage=15%, E-value=2e-24, Identity=51%"; Hit description =Hypothetical protein CBG18933 [Caenorhabditis briggsae]
  Gene Ontology: Biological process=embryogenesis and morphogenesis
  Essential gene: C elegans homolog=T05H4.14; Phenotype=Emb
  Coding regions on vcDNA: vcDNA=SeqID_47788; Strand=+; Position=2-307
GANGLDTVFPQTDCGYSPHAEFIYTTTNAKDKGGGERGALLFFDAESLELLYKIEYPKQGCIRAFWHPKINQILVGLSDGTSKIYYDPSISLRGALQCVSKP

SEQ ID NO: 121366 - protein, 142 aa, Heterodera glycines
  Homolog annotation: Hit_ID=NP_493466.1; Match level="QueryCoverage =99%, HitCoverage=38%, E-value=8e-37, Identity=58%"; Hit description =putative protein family member, with at least 4 transmembrane domains, of eukaryotic origin (1O709) [Caen
  Gene Ontology: Biological process=gametogenesis
  Essential gene: C elegans homolog=Y63D3A.8; Phenotype=Sck,Sma,Stp
  Coding regions on vcDNA: vcDNA=SeqID_47789; Strand=+; Position=87-512
MDSKSLEIVPPNKKWRISNEFVSLFHSILSGIWALAILTRFDFHQIDDLVNKDSLDARYLTYMSFGYLVHDFIDLVINERSARIIELLFHHVVVLVALMVTHLSCKFLYIITLGLLMEVNSILLHSRSLCNLYRQPKQSNLF

SEQ ID NO: 121367 - protein, 183 aa, Heterodera glycines
  Homolog annotation: Hit_ID=NP_501459.1; Match level="QueryCoverage =91%, HitCoverage=45%, E-value=2e-37, Identity=45%"; Hit description =homolog of Yeast Longevity gene, vertebrate TRH (43.9 kD) (hyl-1) [Caenorhabditis elegans] gb|AAF99867.2|
  Gene Ontology: Cellular component=integral to membrane; Biological process=intracellular protein transport
  Essential gene: C elegans homolog=Y6B3B.10; Phenotype=Unclassified
  Coding regions on vcDNA: vcDNA=SeqID_47790; Strand=+; Position=10-558
MDEKKGSIYYRIWDHLFFGFAGRSKFKRVAETGWRFTYYSIIWFVGVSVLYKEPQFSSVIECFREWPKHHLPNDVWQYYIIQSGFYLSLLFSLFAFDVRRSDHYEMATHHLATILLLFMSFSINFVRAGTLILLLHDSADVFLELGKLFRYAGWDRAVTIDFCVFMLVWISTRLVYFPLKTCP

SEQ ID NO: 121368 - protein, 152 aa, Heterodera glycines
  misc_feature (59)..(59): Xaa can be any naturally occurring amino acid
  Homolog annotation: Hit_ID=CAE60581.1; Match level="QueryCoverage =89%, HitCoverage=23%, E-value=4e-29, Identity=51%"; Hit description =Hypothetical protein CBG04215 [Caenorhabditis briggsae]
  Gene Ontology: Biological process=negative regulation of FGF receptor signaling pathway
  Essential gene: C elegans homolog=Y71F9AM.4a; Phenotype=Lva,Unc
  Coding regions on vcDNA: vcDNA=SeqID_47791; Strand=+; Position=1-455
GNHFEAFIEGLCRVLYDTLRPLVVHNPHLETLAQLCTLLKVEMIDERCARFRRPIRTLXPPPFSATSPTEAIAENVNNMATELSNSRAGFARVMSELVADIVERIVYRTSLFAQSDILEYNAAPDDLVYPERLMMMRDINQGRSVTSAVSTD

SEQ ID NO: 121369 - protein, 112 aa, Heterodera glycines
  Homolog annotation: Hit_ID=NP_741234.1; Match level="QueryCoverage =85%, HitCoverage=90%, E-value=1e-11, Identity=38%"; Hit description =putative protein, with a coiled coil-4 domain, of bilaterial origin (12.1 kD) (3J31) [Caenorhabditis eleg
  Essential gene: C elegans homolog=C29E4.12; Phenotype=Emb
  Coding regions on vcDNA: vcDNA=SeqID_47792; Strand=-; Position=146-484
TQTFIFMASFNSTAITTFKQIFRELKRADKSFTTKSALHKYLRNQLSLHRNTKQCEATKAHHSAQTYAIYLGSKRNLDEIRAKYFKGGERTVKETARMVGLEVPEEQQWVSC

SEQ ID NO: 121370 - protein, 50 aa, Heterodera glycines
  misc_feature (11)..(11): Xaa can be any naturally occurring amino acid
  Homolog annotation: Hit_ID=NP_502365.1; Match level="QueryCoverage =100%, HitCoverage=34%, E-value=6e-19, Identity=84%"; Hit description= ribosomal Protein, Small subunit (15.9 kD) (rps-23) [Caenorhabditis elegans] emb|CAA94601.1| Hypothetica
  Gene Ontology: Cellular component=eukaryotic 48S initiation complex; Biological process=protein biosynthesis
  Essential gene: C elegans homolog=F28D1.7; Phenotype=Ste
  Coding regions on vcDNA: vcDNA=SeqID_47793; Strand=+; Position=3-153
ERWNDKRYKKXNLGTRWKADPFGGACMAKGIVLEKIGVEAKQPNSAIRKC

SEQ ID NO: 121371 - protein, 190 aa, Heterodera glycines
  Homolog annotation: Hit_ID=CAE69180.1; Match level="QueryCoverage =98%, HitCoverage=55%, E-value=8e-72, Identity=70%"; Hit description =Hypothetical protein CBG15213 [Caenorhabditis briggsae]
  Gene Ontology: Mol. function=L-malate dehydrogenase activity; Cellular component=mitochondrial matrix; Biological process=malate metabolism
  Essential gene: C elegans homolog=F20H11.3; Phenotype=Emb,Gro
  Coding regions on vcDNA: vcDNA=SeqID_47794; Strand=+; Position=2-571
GIKVTLIGASGGIGQPLGLLLKKNPSIAHLALYDLVGTPGVAADLSHINTPAKVTGHLGPDQLVAALEGADVVIIPAGVPRKPGMTRDDLFTTNAGIVRDMAEAAAKTCPKAFMGIITNPVNSTLPIACEVYKNNDCFDPRRIFGVTLLDIVRAQALVSELKGLDVSQTKVSVVGGHSGVTIVPLLSRCT

SEQ ID NO: 121372 - protein, 212 aa, Heterodera glycines
  Homolog annotation: Hit_ID=NP_504292.2; Match level="QueryCoverage =97%, HitCoverage=27%, E-value=1e-32, Identity=38%"; Hit description =putative protein, with 2 coiled coil domains, of eukaryotic origin (88.9 kD) (5F313) [Caenorhabditis eleg
  Essential gene: C elegans homolog=C37H5.5; Phenotype=Lva
  Coding regions on vcDNA: vcDNA=SeqID_47795; Strand=+; Position=1-636
GALLVNKKAASVPAALLATFLALNITENEANITEKKNQRQIGGKWKSKRSKKYDKQIGKIDAELKEAIETEANFTKTQLATQTIKNVFLTYCRVLKRMPATALLRPVLAGLSKFVHLINAELHEDLARHLANLVHQKQFGFSDVLHCVHTAAVVLEGDGRLLGVDLLSFYRAIFGALPNVCFQPEQTLFTDLSLLSKSLHLLFVRRRKSAVS

SEQ ID NO: 121373 - protein, 123 aa, Heterodera glycines
  Homolog annotation: Hit_ID=NP_740880.1; Match level="QueryCoverage =86%, HitCoverage=36%, E-value=9e-15, Identity=43%"; Hit description =quaking related 5 (33.2 kD) (1H379C) [Caenorhabditis elegans] gb|AAM81088.1| Hypothetical protein E02D9.1
  Essential gene: C elegans homolog=E02D9.1b; Phenotype=Gro,Pvl,Unc
  Coding regions on vcDNA: vcDNA=SeqID_47796; Strand=+; Position=179-547
MSKFEGGFSSHDSYGYGQMPSAFPSIGGAAPSAPPFGFSGAPFGSHAFGGDIPSPLDAEIQIVLREIQSEVHQLENSGEYGEQLKNARRLLATEATKLENNIDPEWLEVDISLLLMAYEQRIE

SEQ ID NO: 121374 - protein, 140 aa, Heterodera glycines
  Homolog annotation: Hit_ID=NP_493396.1; Match level="QueryCoverage =72%, HitCoverage=9%, E-value=4e-14, Identity=42%"; Hit description =putative protein of eukaryotic origin (120.8 kD) (1O265) [Caenorhabditis elegans] emb|CAB04900.2| Hypothet
  Gene Ontology: Biological process=locomotory behavior
  Essential gene: C elegans homolog=W04A4.5; Phenotype=Unclassified
  Coding regions on vcDNA: vcDNA=SeqID_47797; Strand=+; Position=129-548
MCEDASMKMLEKECLSLEYYPHLANLCKNSEQNVRVVALRILTKFALVYPEEKVMASFCFKIRLHDDAFSIVCDAMNDLEVKVRAQAANLLGFFENVSESFLDQTLDKKLMRNMTMLNTNVRNTKNALSAGVGYIGGWST

SEQ ID NO: 121375 - protein, 187 aa, Heterodera glycines
  Homolog annotation: Hit_ID=CAE68942.1; Match level="QueryCoverage =99%, HitCoverage=42%, E-value=7e-34, Identity=39%"; Hit description =Hypothetical protein CBG14922 [Caenorhabditis briggsae]
  Gene Ontology: Cellular component=nucleus; Biological process=N signaling pathway
  Essential gene: C elegans homolog=F55F8.5; Phenotype=Lva
  Coding regions on vcDNA: vcDNA=SeqID_47798; Strand=+; Position=2-562
ISGSFDKCLKVWDIENTGDQNGMPMAGKNTTRMNSTKRMRMDVPKITPMVTLESHREPVVGCAWHPSNLSQAITASWDHQLMLRDLQLAGPISTLTSNKAFSALSVCPANGLVLTSSVDSLVRLWDFRSRDGSMVKASFHGHVGVVSDVCWHSTDQHLFVSASFDNTVKMWDVRSPRAALYDLMGHS

SEQ ID NO: 121376 - protein, 152 aa, Heterodera glycines
  misc_feature (9)..(9): Xaa can be any naturally occurring amino acid
  misc_feature (25)..(25): Xaa can be any naturally occurring amino acid
  Homolog annotation: Hit_ID=CAF98543.1; Match level="QueryCoverage =96%, HitCoverage=31%, E-value=2e-40, Identity=55%"; Hit description =unnamed protein product [Tetraodon nigroviridis]
  Gene Ontology: Mol. function=ATP dependent DNA helicase activity; Cellular component=chromatin; Biological process=DNA recombination
  Essential gene: C elegans homolog=T22D1.10; Phenotype=Emb,Lva
  Coding regions on vcDNA: vcDNA=SeqID_47799; Strand=+; Position=2-458
FDLECFSLXNRYIESDLSPILVMAXNRGIVNIRGTSVESPHGVPLDLLDRSLIIRTSSYKENEIGEILKIRASDELVEMEDASIAVLVQIALETSMRYCMQLISTADILRQRRKGEKVTEEDVRKARSLFIDVKRCRKEMEKHGDSFINDFN

SEQ ID NO: 121377 - protein, 220 aa, Heterodera glycines
  Homolog annotation: Hit_ID=AAC46611.1; Match level="QueryCoverage =98%, HitCoverage=85%, E-value=7e-71, Identity=47%"; Hit description =a2 (IV) basement membrane collagen
  Gene Ontology: Mol. function=structural constituent of bone; Cellular component=collagen type I; Biological process=epidermal differentiation
  Essential gene: C elegans homolog=F01G12.5a; Phenotype=Lva,Unc
  Coding regions on vcDNA: vcDNA=SeqID_47800; Strand=+; Position=1-660
ISWLDGERHAGIRDAGPYGPQGLPGPKGNAGLPGIPGLSGQSLGGVKGEPGLPGLPGRDGVPGPSGEKGDSGVPGVPGFDGEKGSVGAPGFPGQKGESGLPGIPGQRGQDGMPGSPGFPGPVGEPGPLGEPCLAGGPGMPGQPGFPGTKGELGMPGFPGEKGEPGFAGQPGVPGLPGAKGDAGLPGHPGPQGLPGQDGPQGPAGMAGPEPLTQHGQKGLP

SEQ ID NO: 121378 - protein, 205 aa, Heterodera glycines
  misc_feature (16)..(16): Xaa can be any naturally occurring amino acid
  misc_feature (194)..(194): Xaa can be any naturally occurring amino acid
  Homolog annotation: Hit_ID=CAE66491.1; Match level="QueryCoverage =100%, HitCoverage=49%, E-value=1e-101, Identity=90%"; Hit description=Hypothetical protein CBG11771 [Caenorhabditis briggsae]
  Gene Ontology: Mol. function=proteasome endopeptidase activity; Cellular component=proteasome regulatory particle (sensu Eukarya); Biological process=embryogenesis and morphogenesis
  Essential gene: C elegans homolog=Y49E10.1; Phenotype=Emb
  Coding regions on vcDNA: vcDNA=SeqID_47801; Strand=+; Position=1-614
YVVDIDMSLDVAKLTXGCRVALRADSYALHMILPNKVDPLVSLMMVEKVPDSTYEMIGGLDTQIKEIKEVIELPVKHPELFEALGIAQPKGVLLYGPPGTGKTLLARAVAHHTECTFIRVSGSELVQKFIGEGARMVRELFVMAREHSPSIIFMDEIDSIGSSRVEGSHGGDSEVQRTMLELLNQLDGFEPTKXIKVIMATNRID

SEQ ID NO: 121379 - protein, 235 aa, Heterodera glycines
  Homolog annotation: Hit_ID=AAC79129.1; Match level="QueryCoverage =93%, HitCoverage=67%, E-value=1e-116, Identity=95%"; Hit description= glyceraldehyde-3-phosphate-dehydrogenase [Globodera rostochiensis] sp|O16027|G3P1_GLORO Glyceraldehyde-3-
  Gene Ontology: Mol. function=glyceraldehyde 3-phosphate dehydrogenase (phosphorylating) activity; Cellular component=cytoplasm; Biological process=glycolysis
  Essential gene: C elegans homolog=K10B3.7; Phenotype=Unclassified
  Coding regions on vcDNA: vcDNA=SeqID_47802; Strand=+; Position=8-712
IPGVFTPIEKASAHLKGGAKKVVISAPSADAPMYVMGVNEDKYDPAKDDVISNASCTTNCLAPLAKVINDEFGIIEGLMTTVHAVTATQKTVDGPSGKQWRDGRGAAQNIIPASTGAAKAVGKVIPELNGKLTGMAFRVPTPNVSVVDLTARLEKPAPLDAIKEAVKKAANGKLKGILAYTEDQVVSTDFLGDSHSSIFDAGACISLNPHFVKLASWYDNEFGYSCRLVDLITHC

SEQ ID NO: 121380 - protein, 214 aa, Heterodera glycines
  misc_feature (182)..(182): Xaa can be any naturally occurring amino acid
  Homolog annotation: Hit_ID=CAE72581.1; Match level="QueryCoverage =93%, HitCoverage=22%, E-value=3e-39, Identity=43%"; Hit description =Hypothetical protein CBG19769 [Caenorhabditis briggsae]
  Gene Ontology: Biological process=locomotory behavior
  Essential gene: C elegans homolog=W04A4.5; Phenotype=Unclassified
  Coding regions on vcDNA: vcDNA=SeqID_47803; Strand=+; Position=7-648
MCEDASMKMLEKECLSLEYYPHLANLCKNSEQNVRVVALRILTKFALVYPEEKVMASKGFKIRLHDDAFSIVCDAMNDLEVKVRAQAANLLGFFENVSESFLDQTLDKKLMRNMTMLNTNVRNTKNALSAGVGYIGGWSTGKKMGDDMPIEKLEDESQSLIPTGSCGAFVTALEDEFMAVRXAAVYSLGKLARNRPVFASACIDHLADMFNDEI

SEQ ID NO: 121381 - protein, 219 aa, Heterodera glycines
  Homolog annotation: Hit_ID=NP_502354.2; Match level="QueryCoverage =98%, HitCoverage=22%, E-value=1e-57, Identity=51%"; Hit description =yeast SEC homolog (109.3 kD) (sec-24.2) [Caenorhabditis elegans] emb|CAA92988.3| Hypothetical protein ZC5
  Gene Ontology: Mol. function=transporter activity; Cellular component= membrane; Biological process=embryogenesis and morphogenesis
  Essential gene: C elegans homolog=ZC518.2; Phenotype=Bmd,Emb,Gro,Unc
  Coding regions on vcDNA: vcDNA=SeqID_47804; Strand=+; Position=1-657
IHENEREPRHIIEFDVEESFAPVFSGLFVELNVFKEIIKKFIYNIPSIFERSMSSSNCLGSALTVAKNLINEIGGRITVFTASMPNLGIGALKCLEFNTAKKIAFTPQIDFYKSLALECTGKQIAIDLFVVGCQNVDLRTLSDMSRFSSGTVYHFPEYHFLRDQVEVKRFQMILRRYFIRKLGLEAVLRIRCSRGLSLHTFYGNFFVRSTDLLALPNVS

SEQ ID NO: 121382 - protein, 209 aa, Heterodera glycines
  Homolog annotation: Hit_ID=AAH62499.1; Match level="QueryCoverage =98%, HitCoverage=61%, E-value=1e-82, Identity=69%"; Hit description =COP9 signalosome subunit 5 [Xenopus tropicalis] ref|NP_989109.1| COP9 signalosome subunit 5 [Xenopus tropi
  Gene Ontology: Mol. function=metalloendopeptidase activity; Cellular component=signalosome complex; Biological process=glia cell migration
  Essential gene: C elegans homolog=B0547.1; Phenotype=Emb
  Coding regions on vcDNA: vcDNA=SeqID_47805; Strand=+; Position=1-630
IVLDAFALPVEGTETRVNAQAQAYEFMTNFSESCEAVGRLEKVVGWYHSHPGYGCWLSGIDVNTQSINQQFQEPFVAIVIDPIRTVSAGKVDIGAFRTYPKGYKPPDEPPSEYQTIPLNKIEDFGVHCKQYYSLDVTYFKSSLDSKMFDAFWNTYWVSTLCANPLRTNADYITAQLADLGAKLQQVNTRHGASFRERFRKAERRGEVGL

SEQ ID NO: 121383 - protein, 207 aa, Heterodera glycines
  Homolog annotation: Hit_ID=AAF81283.1; Match level="QueryCoverage =100%, HitCoverage=99%, E-value=4e-40, Identity=42%"; Hit description= glutathione S-transferase [Haemonchus contortus]
  Gene Ontology: Mol. function=glutathione transferase activity; Biological process=glutathione conjugation reaction
  Essential gene: C elegans homolog=R05F9.5a; Phenotype=Unclassified
  Coding regions on vcDNA: vcDNA=SeqID_47806; Strand=+; Position=41-664
MVQYKLYYFDGRGLGESIRLLLHYVGQPFEDIRIKDMEEWEKTYKPKFFYGKVPVLEVDGKPLGQSATILRYLAEKFGLAGKDEWEKAKANEIIDFQKDANTDLAPYLYVKMGFRQGDLDKLRAEVFEPGVKHILPLFEKLLKESGSGYMLKSGLSMVDFQVANFLYTFTKLEPETINAFPELIKYVDRVHALPQLQQYLKQRPQDR

SEQ ID NO: 121384 - protein, 140 aa, Heterodera glycines
  Homolog annotation: Hit_ID=CAE71615.1; Match level="QueryCoverage =99%, HitCoverage=81%, E-value=3e-68, Identity=86%"; Hit description =Hypothetical protein CBG18577 [Caenorhabditis briggsae]
  Gene Ontology: Mol. function=peptidyl-prolyl cis-trans isomerase activity; Cellular component=membrane fraction; Biological process =protein folding
  Essential gene: C elegans homolog=Y75B12B.2; Phenotype=Emb
  Coding regions on vcDNA: vcDNA=SeqID_47807; Strand=+; Position=2-424
AENFRALCTGEKGMGKSGKPLHYKGSKFHRVIPSFMLQGGDFTRGNGTGGESIYGEKFPDENFKEKHTVPGLLSMANAGPNTNGSQFFITTVKTEWLDGKHVVFGRVVEGMDVVKQVEAQGNQSGKTANEITIADCGQLS

SEQ ID NO: 121385 - protein, 235 aa, Heterodera glycines
  misc_feature (7)..(7): Xaa can be any naturally occurring amino acid
  Homolog annotation: Hit_ID=AAH85906.1; Match level="QueryCoverage =100%, HitCoverage=28%, E-value=4e-97, Identity=72%"; Hit description= Unknown (protein for MGC:94742) [Rattus norvegicus]
  Gene Ontology: Mol. function=ribonucleoside-diphosphate reductase activity; Cellular component=cytoplasm; Biological process=DNA replication
  Essential gene: C elegans homolog=T23G5.1; Phenotype=Emb
  Coding regions on vcDNA: vcDNA=SeqID_47808; Strand=+; Position=3-706
EETAVCXLASVALNRFVLGEGNGPNQRKFDFEKLKGVTKTVTQNLNKVIDVNDYPTECSKRSNKRHRPIGIGVQGLADTFMLMRYPFNSEQARLLNKQIFETIYYGALEASCELAEKFGPYETYEGSPVSKGILQYDMWDVVPTDLWDWPLLKGRISKFGVRNSLLVAPMPTASTAQILGNNESIEPYTSNVYSRRVLSGDFQIVNPHLMKDLIELNLWDDQMKNRLIAENGSVQ

SEQ ID NO: 121386 - protein, 199 aa, Heterodera glycines
  misc_feature (6)..(6): Xaa can be any naturally occurring amino acid
  Homolog annotation: Hit_ID=NP_506137.1; Match level="QueryCoverage =97%, HitCoverage=43%, E-value=5e-25, Identity=34%"; Hit description =hemoglobinase-type cysteine proteinase family C13, legumain (53.2 kD) (5M993) [Caenorhabditis elegans] em
  Gene Ontology: Cellular component=extracellular space; Biological process=embryogenesis and morphogenesis
  Essential gene: C elegans homolog=T28H10.3; Phenotype=Emb
  Coding regions on vcDNA: vcDNA=SeqID_47809; Strand=+; Position=3-601
LVNWMXDSDQENLRTETLRKQFGIVREETNKSHVMHYGDLQIQDEHVSEFMGKEQAQKRNERPPSPHKFPMFPSRDIPMFMMARRQNESKQIQHNLRVAWKKRSFLEQTIKQIVHQLVHDMNNRRQILTTYPQQIRDLDCHHEVVHTFSNFCFKFSENPYALKYAYVLANLCERPELDAERIKMALIEQCAEVELSGVI

SEQ ID NO: 121387 - protein, 101 aa, Heterodera glycines
  Homolog annotation: Hit_ID=XP_416300.1; Match level="QueryCoverage =100%, HitCoverage=10%, E-value=6e-42, Identity=82%"; Hit description= PREDICTED: similar to hypothetical protein HSPC117 [Gallus gallus]
  Essential gene: C elegans homolog=F16A11.2; Phenotype=Gro
  Coding regions on vcDNA: vcDNA=SeqID_47810; Strand=+; Position=15-320
MGTCSYVLTGTEKGLNDTFGTTCHGAGRAMSRAKSRRALGFEQVLNRLKQQGIAIRVASPKLVMEEAPESYKNVCDVVDTCHIAGISKKAVKLRPIAVIKG

SEQ ID NO: 121388 - protein, 106 aa, Heterodera glycines
  misc_feature (38)..(38): Xaa can be any naturally occurring amino acid
  Homolog annotation: Hit_ID=NP_492761.1; Match level="QueryCoverage =98%, HitCoverage=69%, E-value=6e-38, Identity=71%"; Hit description =nucleoside diphosphate kinase (1L130) [Caenorhabditis elegans] emb|CAB02101.1| Hypothetical protein F25H2
  Gene Ontology: Mol. function=ATP binding; Cellular component=nucleus; Biological process=negative regulation of cell proliferation
  Essential gene: C elegans homolog=F25H2.5; Phenotype=Pvl,Stp
  Coding regions on vcDNA: vcDNA=SeqID_47811; Strand=+; Position=1-320
PPLEVHSRPKDKPFFAGLVKYMASGPIVAMVWEGLDVXKQGRVLLGATNPLASAPWTIRGNFCIEMGRNICHGSDSVPSADREIAHWFKPEELVDWESAQNAWVYE

SEQ ID NO: 121389 - protein, 159 aa, Heterodera glycines
  Homolog annotation: Hit_ID=CAE59352.1; Match level="QueryCoverage =98%, HitCoverage=27%, E-value=2e-21, Identity=38%"; Hit description =Hypothetical protein CBG02701 [Caenorhabditis briggsae]
  Gene Ontology: Biological process=embryogenesis and morphogenesis
  Essential gene: C elegans homolog=Y73B6BL.38; Phenotype=Emb
  Coding regions on vcDNA: vcDNA=SeqID_47812; Strand=+; Position=131-607
YGCRVIQFVLENVVQPVHGTANANNSLEKEISIQILHVLIEPILKNAYSLAQNEFANYLVQFIIKSPYLRRRRCYIIKTHIIRNVYHLSLLKYSSHVVEQAFKHAEDRCNCLAMLFREVLEGYKPSTDGKQRTALYEMLFNQYGNYVVQRMIPIARDVY

SEQ ID NO: 121390 - protein, 224 aa, Heterodera glycines
  Homolog annotation: Hit_ID=NP_492222.2; Match level="QueryCoverage =95%, HitCoverage=9%, E-value=5e-72, Identity=62%"; Hit description=j- domain containing protein, required for endocytosis, Receptor Mediated Endocytosis RME-8 (259.2 kD) (rme
  Gene Ontology: Mol. function=co-chaperone activity; Cellular component=vesicle membrane; Biological process=receptor mediated endocytosis
  Essential gene: C elegans homolog=F18C12.2a; Phenotype=Emb,Lva,Unc
  Coding regions on vcDNA: vcDNA=SeqID_47813; Strand=+; Position=2-673
KRNLQCFRLQIAGYTQLIKTIDLESSDDTLFARTKEDGGQLLVAAVELCHWTLRSSSLNAEQLRRDGGLDALYKTFERCVPMITAGSLESEMPVQVCTHVCNCFATAARFDACREKIAEMKTLFQSICQLLRFESLHRLACAAAECVCAFSVCTLLQTQPFQAGVIWQLLPHLFRFDYTLDEGGVAHSEKTNHQAVLNRLARNCCEALACLAGFRPDTPDNDGV

SEQ ID NO: 121391 - protein, 154 aa, Heterodera glycines
  misc_feature (65)..(65): Xaa can be any naturally occurring amino acid
  misc_feature (112)..(112): Xaa can be any naturally occurring amino acid
  misc_feature (129)..(129): Xaa can be any naturally occurring amino acid
  Homolog annotation: Hit_ID=CAA66387.1; Match level="QueryCoverage =94%, HitCoverage=43%, E-value=2e-59, Identity=71%"; Hit description =put.activated protein kinase C receptor [Hydra vulgaris] sp|Q25189|GBLP_HYDAT Guanine nucleotide-binding p
  Gene Ontology: Cellular component=cytoplasm; Biological process =signal transduction
  Essential gene: C elegans homolog=K04D7.1; Phenotype=Gro,Slu
  Coding regions on vcDNA: vcDNA=SeqID_47814; Strand=+; Position=1-467
FPPAGTNCKVWNLATCRLKTNRFGHTGYINSVTVSPDGSLCASGGKDGSAMLWDLNDGKHLYTVXGNDVINALAFSPNRYWLCAAVGPVVKIWDLENKTVVDELKLDIASTXPQIRCVYPKNRVAQCIXLAWTTDGQTLFAGYTDNIIRVWRIA

SEQ ID NO: 121392 - protein, 208 aa, Heterodera glycines
  Homolog annotation: Hit_ID=CAE60081.1; Match level="QueryCoverage =99%, HitCoverage=35%, E-value=8e-79, Identity=49%"; Hit description =Hypothetical protein CBG03601 [Caenorhabditis briggsae]
  Gene Ontology: Mol. function=ATP binding; Cellular component=integral to membrane; Biological process=muscle development
  Essential gene: C elegans homolog=ZK1058.2; Phenotype=Mig
  Coding regions on vcDNA: vcDNA=SeqID_47815; Strand=+; Position=1-624
KIQKNIMVDNANASMGLRLSYRSTCVDGRTLQDTNTCDGVKVGDTVAFEVTLEALHCVPQRDFALHIGPSGLEEVLTLYVHVICDCDCEDEIVYNAPECNGHGNLVCGICQCAEGYVGTHCECESGGESAVALEAKCKKDNDSLVCSGRGICKCGVCECFPRANADELVSGQFCECGNFNCPRHDRLLCGGHGDCVCGTCQCEPGYTG

SEQ ID NO: 121393 - protein, 176 aa, Heterodera glycines
  misc_feature (99)..(99): Xaa can be any naturally occurring amino acid
  Homolog annotation: Hit_ID=NP_493580.1; Match level="QueryCoverage =100%, HitCoverage=40%, E-value=6e-17, Identity=33%"; Hit description= putative mitochondrial protein, with 3 coiled coil domains, of bilaterial origin (48.2 kD) (1P387) [Caen
  Essential gene: C elegans homolog=K11B4.1; Phenotype=Emb,Lva
  Coding regions on vcDNA: vcDNA=SeqID_47816; Strand=+; Position=1-655
EDRLLNEENVRLFRYPFLKNPFWDGHFDENDSDRMAGKALEWLSYHLKLAKNDETNYDETLTRVIRLLGLSIQRKWTEAKSLAEEIRPKFGGIGENGTXKNYLSKKSAEFEINKAKATEKLSEMLAVRFEPILQKEEERMMEVQRKHFWEWAERRKRLIHSQAQRAEHLARLNEIQ

SEQ ID NO: 121394 - protein, 191 aa, Heterodera glycines
  Homolog annotation: Hit_ID=AAQ89579.1; Match level="QueryCoverage =100%, HitCoverage=28%, E-value=1e-106, Identity=100%"; Hit description=heat shock protein 70-C [Heterodera glycines] gb|AAM93256.1| heat shock protein 70-C [Heterodera glycin
  Gene Ontology: Mol. function=Hsp70/Hsp90 organizing protein activity; Cellular component=endoplasmic reticulum lumen; Biological process =reproduction
  Essential gene: C elegans homolog=C15H9.6; Phenotype=Dpy,Lva
  Coding regions on vcDNA: vcDNA=SeqID_47817; Strand=+; Position=2-577
VFEGERPMTKDNHLLGKFDLTGIPPAPRGVPQIEVTFEIDVNGILHVTAEDKGTGNKNKITITNDHNRLSPEEIERMINDAEKFAEEDKKTKEVVEARNEFESYAYSLKNQLGDSEKLGGKLSAEDKTTIEGAVDEAISWLDSNKDAPPEELKERKKDLEAKVQPIISKLYAGQSPPPGSEPPPTEEKDEL

SEQ ID NO: 121395 - protein, 228 aa, Heterodera glycines
  Homolog annotation: Hit_ID=AAO51573.1; Match level="QueryCoverage =53%, HitCoverage=12%, E-value=1e-12, Identity=37%"; Hit description =similar to Dictyostelium discoideum (Slime mold). Adenylyl cyclase
  Gene Ontology: Mol. function=general RNA polymerase II transcription factor activity; Cellular component=SWI/SNF complex; Biological process=chromatin modeling
  Essential gene: C elegans homolog=F39B2.4a; Phenotype=Adl,Egl
  Coding regions on vcDNA: vcDNA=SeqID_47818; Strand=+; Position=51-737
MPEVSHGHNVRLGQLQISATPYIISVYKVLGDLVKKVGQLHYEDTICDLLYQFKYMFVGYALKEQTEIFILNFPDSMREKLKFLFTHSSTAAAAVENQQQMLQQQQQQLVGIGFALGQQLSFPMESATHQQQQQVLPFHHSQQQQQQQPAALIGMLQRQSREDEGQQQQHQSRQNQAVQMQQQTNTNQQQVEQMGTAGSSTTASQQQQQSTPAPLSVSSVSSAALSPI

SEQ ID NO: 121396 - protein, 204 aa, Heterodera glycines
  Homolog annotation: Hit_ID=NP_495280.1; Match level="QueryCoverage =98%, HitCoverage=49%, E-value=3e-24, Identity=34%"; Hit description =hydroyxsteroid dehydrogenase like (40.9 kD) (2G648) [Caenorhabditis elegans] gb|AAC46799.1| Hypothetical
  Essential gene: C elegans homolog=C32D5.12; Phenotype=Dpy,Lvl,Unc
  Coding regions on vcDNA: vcDNA=SeqID_47819; Strand=+; Position=83-694
MGVKVAITGGSGFLAAHLIKRLRADANVDEIRTIDRKPFRQLGTIVCSSSDDCPPSSVGFPSLIHFQCDLLDVAKLEKALDGVDVLFHLARKAFEYIFFADQKALNDRYSRDNLEATHSLLNTIFKCSVPRLVHVGDAFANIPPGDNFGSAEHIHRGLPSKFLLGHYGETRIKAELAGREKCGKILPNGQPFHALFLRPTFVYG

SEQ ID NO: 121397 - protein, 182 aa, Heterodera glycines
  Homolog annotation: Hit_ID=AAK12348.1; Match level="QueryCoverage =96%, HitCoverage=24%, E-value=2e-83, Identity=80%"; Hit description =elongation factor-2 [Mastigoproctus giganteus]
  Gene Ontology: Mol. function=translation elongation factor activity; Biological process=protein biosynthesis
  Essential gene: C elegans homolog=F25H5.4; Phenotype=Emb,Lva
  Coding regions on vcDNA: vcDNA=SeqID_47820; Strand=+; Position=3-548
GSPVRTLIAGAGELHLEICLKDLEEDHACIPLKKSDPVVSYRETVTEESEIVCLSKSPNKHNRLFCKARPLPDGLPEAIERGDVNPTDDPKNRAKILTEKFEMDATDSRKIWCFGPEGTGANLLIDVTKGVQYLNEIKDSVVAGFQWATKEGVLCDENMRGVRFDIHDVTLHADAIHRGGGQ

SEQ ID NO: 121398 - protein, 225 aa, Heterodera glycines
  Homolog annotation: Hit_ID=NP_498868.1; Match level="QueryCoverage =96%, HitCoverage=28%, E-value=8e-57, Identity=49%"; Hit description =heat shock 105kD (86.9 kD) (3J534) [Caenorhabditis elegans] gb|AAA27967.1| Hypothetical protein C30C11.4
  Gene Ontology: Mol. function=heat shock protein activity; Cellular component=cytoplasm; Biological process=protein folding
  Essential gene: C elegans homolog=C30C11.4; Phenotype=Bmd,Gro
  Coding regions on vcDNA: vcDNA=SeqID_47821; Strand=+; Position=2-676
PCSLGTDVTECVINVPFFYEENQRRALLNAGRIAGLSLRLITDPAALAYCYGMYNGANLPPPEQPARLVAFVDVGHSSVQASLIAFSAGKAEVLAASFDLTVGGVHFDALLRDYFNEDFGKRFKIDARKTPRAWLRLLDECEKIKKQISANSQPIPFAIECFVKDTDVNGVMQRDQFEQLAEKLFQKVQELLQQLISDANVKVGDIFDVELVGGSSRIPRIKQIV

SEQ ID NO: 121399 - protein, 157 aa, Heterodera glycines
  Homolog annotation: Hit_ID=NP_492222.2; Match level="QueryCoverage =100%, HitCoverage=6%, E-value=1e-44, Identity=53%"; Hit description =j-domain containing protein, required for endocytosis, Receptor Mediated Endocytosis RME-8 (259.2 kD) (rm
  Gene Ontology: Mol. function=co-chaperone activity; Cellular component=vesicle membrane; Biological process=receptor mediated endocytosis
  Essential gene: C elegans homolog=F18C12.2a; Phenotype=Emb,Lva,Unc
  Coding regions on vcDNA: vcDNA=SeqID_47822; Strand=+; Position=2-472
ICLRAMALVYERHCISIGPFADTRHIVEMLAKCTNVAERDHFLFLINKLSLDKQNVRELISANLISLFIDIAVLAHLHTNRAKLHGQTNVIEATKDAAHCEETEPKEWYYNDRQGQRQGPISFKKMKRLYRDGVLFEKSEIWAEGLDKWCHLSLVSQ

SEQ ID NO: 121400 - protein, 90 aa, Heterodera glycines
  misc_feature (9)..(9): Xaa can be any naturally occurring amino acid
  misc_feature (40)..(40): Xaa can be any naturally occurring amino acid
  Homolog annotation: Hit_ID=AAM44068.1; Match level="QueryCoverage =85%, HitCoverage=26%, E-value=1e-33, Identity=92%"; Hit description =glyceraldehyde-3-phosphate dehydrogenase [Sigmodon hispidus]
  Gene Ontology: Mol. function=glyceraldehyde 3-phosphate dehydrogenase (phosphorylating) activity; Cellular component=cytoplasm; Biological process=glycolysis
  Essential gene: C elegans homolog=T09F3.3; Phenotype=Emb,Gon,Sma
  Coding regions on vcDNA: vcDNA=SeqID_47823; Strand=+; Position=2-276
NCLAPLAKXQHEFGIIEGLMTTVHAVTATQKTVDGPSGKXWRDGRGAAQNIIPASTGAAKAVGKVIPELNGKLTGMASPCCPLRTCPSST

SEQ ID NO: 121401 - protein, 112 aa, Heterodera glycines
  Homolog annotation: Hit_ID=NP_495286.1; Match level="QueryCoverage =91%, HitCoverage=63%, E-value=6e-23, Identity=50%"; Hit description =ATP synthase H+ transporting mitochondrial F1 complex (16.9 kD) (2G673) [Caenorhabditis elegans] gb|AAC46
  Gene Ontology: Mol. function=hydrogen-transporting ATP synthase activity, rotational mechanism; Cellular component=proton -transporting ATP synthase, central stalk (sensu Eukarya); Biological process=ATP synthesis coupled proton transport
  Essential gene: C elegans homolog=F58F12.1; Phenotype=Emb,Lva
  Coding regions on vcDNA: vcDNA=SeqID_47824; Strand=+; Position=2-337
TLASPLKAFYANVAVKQIDVTGMSSSVGILPTHVPTIAVLKPGVVKVHELDGNVSKFFASSGTLSMNIDGSCQALAEELCSLSELNEQAIKNLIDVSQKKASDLNATDVQKA

SEQ ID NO: 121402 - protein, 215 aa, Heterodera glycines
  Homolog annotation: Hit_ID=CAE72581.1; Match level="QueryCoverage =86%, HitCoverage=20%, E-value=6e-38, Identity=43%"; Hit description =Hypothetical protein CBG19769 [Caenorhabditis briggsae]
  Gene Ontology: Biological process=locomotory behavior
  Essential gene: C elegans homolog=W04A4.5; Phenotype=Unclassified
  Coding regions on vcDNA: vcDNA=SeqID_47825; Strand=+; Position=47-691
MCEDASMKMLEKECLGLEYYPHLANLCKNSEQNVRVVALRILTKFALVYPEEKVMASKGFKIRLHDDAFSIVCDAVNDLEVKVRAQAANLLGFFENVSESFLDQTLDKKLMRNMTMLNTNVRNTKNALSAGVGYIGGWSTGKKMGEDMPIEKLEDESQSLIPTGSCGAFVTALEDEFMAVRQAAVYSLGKLARNRPVFASACIDHLADMFNDGIQ

SEQ ID NO: 121403 - protein, 173 aa, Heterodera glycines
  misc_feature (13)..(13): Xaa can be any naturally occurring amino acid
  Homolog annotation: Hit_ID=AAQ89579.1; Match level="QueryCoverage =99%, HitCoverage=26%, E-value=2e-90, Identity=97%"; Hit description =heat shock protein 70-C [Heterodera glycines] gb|AAM93256.1| heat shock protein 70-C [Heterodera glycines]
  Gene Ontology: Mol. function=Hsp70/Hsp90 organizing protein activity; Cellular component=endoplasmic reticulum lumen; Biological process =cell organization and biogenesis
  Essential gene: C elegans homolog=C15H9.6; Phenotype=Dpy,Lva
  Coding regions on vcDNA: vcDNA=SeqID_47826; Strand=+; Position=2-521
WGIEPVGGVMTNXTRNTVIPTKKSQIFSTAADNQPTVTIQVFEGERPMTKDNHLLGKFDLTGIPPAPRGVPQIEVTFEIDVNGILHVTAEDKGTGNKNKITITNDHNRLSPEEIERMINDAEKFAEEDKKTKEVVEARNEFESYAYSLKNQLGDSEKLGGKLSAEDKTTIEGA

SEQ ID NO: 121404 - protein, 221 aa, Heterodera glycines
  Homolog annotation: Hit_ID=CAE72248.1; Match level="QueryCoverage =95%, HitCoverage=43%, E-value=9e-19, Identity=29%"; Hit description =Hypothetical protein CBG19366 [Caenorhabditis briggsae]
  Gene Ontology: Mol. function=histone binding; Cellular component =nucleus
  Essential gene: C elegans homolog=C50B6.2; Phenotype=Emb,Unc
  Coding regions on vcDNA: vcDNA=SeqID_47827; Strand=+; Position=2-664
VLDSCWPKTKLMLAQSFYDASVVLCKAAELSSKFFGDFAPQSFLPHFNYGKALIEVARLESLPIKPPMDDIDESDEEDEGEEEQGEELQSKNGTEKEVVEDQQKTEEKGGEKGTDECAEERDGEQQDEAEKADNEMAEVTLKTDNEEEEADEDGGDEDDGQIAWESLEVARKICENHMKSDEAKLWTERKSDVLVALGDCMTVTENFPLALEEFTSALAIR

SEQ ID NO: 121405 - protein, 214 aa, Heterodera glycines
  misc_feature (67)..(67): Xaa can be any naturally occurring amino acid
  Homolog annotation: Hit_ID=AAM81355.1; Match level="QueryCoverage =100%, HitCoverage=54%, E-value=4e-73, Identity=59%"; Hit description= heat shock protein 40 [Steinernema feltiae]
  Gene Ontology: Mol. function=heat shock protein activity; Cellular component=cytosol; Biological process=protein folding
  Essential gene: C elegans homolog=F39B2.10; Phenotype=Emb,Spd
  Coding regions on vcDNA: vcDNA=SeqID_47828; Strand=+; Position=3-645
GEEGLKGGGEGGGMHNPMDIFEMFFGGGGFRGGGEKPTKVRDTVHQLTVSLDKLYNGCTKHLRITRXILCPKCNGVGGAKEGVKQCENCRGRGLEIHNMQIGPGMIQRIQRACSECGGEGEINRNPCKHCGGKKRIKSEETIEVHIEKGMRDGQRLMFYGKGDQQPGLEPGNVIIVLDEEEHPVFTRRGTNLTLNMKLTLTEALCGCTKHVVTL

SEQ ID NO: 121406 - protein, 218 aa, Heterodera glycines
  Homolog annotation: Hit_ID=CAE64798.1; Match level="QueryCoverage =97%, HitCoverage=34%, E-value=8e-78, Identity=62%"; Hit description =Hypothetical protein CBG09591 [Caenorhabditis briggsae]
  Gene Ontology: Mol. function=pre-mRNA splicing factor activity; Cellular component=nucleus; Biological process=mRNA splice site selection
  Essential gene: C elegans homolog=K07C5.6; Phenotype=Emb
  Coding regions on vcDNA: vcDNA=SeqID_47829; Strand=+; Position=2-655
SSESRTAPAMVDVETGRDINPHIPEFIEKTPWYVPSSGPTLKHQRPHPERQKQMSSVAEWYPKGTTERVAFKYRDGACQNCGALGHNRKNCFEKPRLVGAKFTNSNIAPDDHVLPSLEMGYDAKRDRWNGYNAEDYSLVAAEFEKMEETRKLIRAEQLKEAGEEDKKAEEDEDIYAEDASAPGQSVDMDSRTRITVRNLRIREDTAKYLYSLDPNGAY

SEQ ID NO: 121407 - protein, 186 aa, Heterodera glycines
  misc_feature (127)..(127): Xaa can be any naturally occurring amino acid
  Homolog annotation: Hit_ID=NP_683689.1; Match level="QueryCoverage =100%, HitCoverage=34%, E-value=1e-48, Identity=52%"; Hit description= N-myristoyltransferase 1 [Rattus norvegicus] emb|CAD37349.1| peptide N-myristoyltransferase 1 [Rattus no
  Gene Ontology: Mol. function=glycyl-peptide N -tetradecanoyltransferase activity; Cellular component=cytoplasm; Biological process=N-terminal peptidyl-glycine N-myristoylation
  Essential gene: C elegans homolog=T17E9.2a; Phenotype=Emb
  Coding regions on vcDNA: vcDNA=SeqID_47830; Strand=+; Position=2-563
KLPETPSLIDATQQRFCQSAFELLSGYLTKFDLVPIFTIEEFEHFFLPRDDVIYTYVIQNNGEVTDLVSFYSLPSTVMHHSHHKSIKAAYSFYNVAGSVPLSHLLNDALILARNVRFFLFVSVRLGXPNLFHNQLGFDVFNALDLMENKGILEDLKFGIGDGNLQYYLYNWKCPDIPSDRIGLVLQ

SEQ ID NO: 121408 - protein, 128 aa, Heterodera glycines
  Homolog annotation: Hit_ID=CAE69561.1; Match level="QueryCoverage =100%, HitCoverage=100%, E-value=2e-66, Identity=96%"; Hit description=Hypothetical protein CBG15773 [Caenorhabditis briggsae]
  Essential gene: C elegans homolog=ZK1010.1; Phenotype=Emb
  Coding regions on vcDNA: vcDNA=SeqID_47831; Strand=+; Position=49-435
MQIFIKTLTGKTITLEVEASDTIENVKAKIQDKEGIPPDQQRLIFAGKQLEDGRTLADYNIQKESTLHLVLRLRGGIIEPSLRMLAQKYNCDKQICRKCYARLPPRATNCRKKKCGHSNDLRIKKKLK

SEQ ID NO: 121409 - protein, 221 aa, Heterodera glycines
  Homolog annotation: Hit_ID=NP_496095.1; Match level="QueryCoverage =96%, HitCoverage=31%, E-value=5e-64, Identity=56%"; Hit description =WEE homolog, defective SPErmatogenesis SPE-37 (77.0 kD) (wee-1.3) [Caenorhabditis elegans] emb|CAB16484.1
  Gene Ontology: Mol. function=protein tyrosine kinase activity; Cellular component=nucleus; Biological process=DNA replication
  Essential gene: C elegans homolog=Y53C12A.1; Phenotype=Unclassified
  Coding regions on vcDNA: vcDNA=SeqID_47832; Strand=+; Position=36-698
MLCTSGQIGPGDFGEVVSVRSKDDGKLYAVKSSLDIYRNSADRREKLQEVQKHEMLPPHPNLIHFVKAWEERGRLYIQTELCSQSLDDMARERHEIPEPEIWYYLIDSLMALEHMHSHDIIHVDIKPSNIFVTSDGICKLGDFGLVFDLNKDDPRKASEGDSKYLAAEVLNDKPTKAADIFSLGMTILELATDLDLPNNGLFWHEIRDRMIDEKYIGFLSP

SEQ ID NO: 121410 - protein, 196 aa, Heterodera glycines
  Homolog annotation: Hit_ID=NP_496500.1; Match level="QueryCoverage =98%, HitCoverage=48%, E-value=1e-56, Identity=58%"; Hit description =Malate/L-lactate dehydrogenase (42.8 kD) (2M3) [Caenorhabditis elegans] emb|CAA88951.1| Hypothetical prot
  Essential gene: C elegans homolog=F36A2.3; Phenotype=Egl,Unc
  Coding regions on vcDNA: vcDNA=SeqID_47833; Strand=+; Position=93-680
MLSSSPKEFVAPVGEVHAFVVKCMQSVGTSAAHAAQLADLLLDADIVGHYSHGLNRLCIYIEDVASGVKGDGEPKVLKQKGATAWVDGCDLLGAVVGNFCTELAIKLAKEHGIGWVVCKRSNHYGICQHYAKKIANAGLLGLSFTNTSPIIFPTRSSQIGLGTNPISCCANSREKGDGFILDMAASTVALGKVEIA

SEQ ID NO: 121411 - protein, 238 aa, Heterodera glycines
  misc_feature (13)..(13): Xaa can be any naturally occurring amino acid
  misc_feature (67)..(67): Xaa can be any naturally occurring amino acid
  Homolog annotation: Hit_ID=AAN15196.1; Match level="QueryCoverage =100%, HitCoverage=63%, E-value=1e-130, Identity=98%"; Hit description=actin [Globodera rostochiensis] gb|AAN78299.1| actin 1 [Heterodera glycines] gb|AAG47837.2| actin 1 [Het
  Gene Ontology: Mol. function=structural constituent of cytoskeleton; Cellular component=cytoskeleton; Biological process=reproduction
  Essential gene: C elegans homolog=T04C12.5; Phenotype=Ste
  Coding regions on vcDNA: vcDNA=SeqID_47834; Strand=+; Position=1-712
QAVLSLYASGRTXGLVLDSGDGVTHTVPIYEGYALPHAILRLDLAGRDLTDYLMKILTERGYSFVTXAEREIVRDIKEKLCYVALDFEQEMATAASSSSLEKSYELPDGQGITVGNERFRCPEALFQPSFIGMESAGTHESTYNSIMKCDIDIRKDLYANNVLSGGTTMYPGIADRMQKEMTALAPSTMKIKIIAPPERKYSVWIGGSILASLSTFQQMWISKQEYDESGPSIVHRKC

SEQ ID NO: 121412 - protein, 93 aa, Heterodera glycines
  misc_feature (12)..(12): Xaa can be any naturally occurring amino acid
  Homolog annotation: Hit_ID=CAA34603.1; Match level="QueryCoverage =100%, HitCoverage=61%, E-value=2e-38, Identity=83%"; Hit description= unnamed protein product [Brugia pahangi] sp|P62300|RS13_WUCBA 40S ribosomal protein S13 (40S ribosomal pr
  Gene Ontology: Mol. function=structural constituent of ribosome; Cellular component=cytosolic small ribosomal subunit (sensu Eukarya); Biological process=protein biosynthesis
  Essential gene: C elegans homolog=C16A3.9; Phenotype=Emb
  Coding regions on vcDNA: vcDNA=SeqID_47835; Strand=+; Position=1-278
RCSVPTWQKLTXQEVEEQIVKLARKGLRPSQIGVILRDSHGVAQVRRITGNKIVRILRSKGMAPEIPEDLYHLIKKAVSIRKHLERFRKDIDS

SEQ ID NO: 121413 - protein, 217 aa, Heterodera glycines
  Homolog annotation: Hit_ID=NP_506486.1; Match level="QueryCoverage =95%, HitCoverage=24%, E-value=6e-28, Identity=33%"; Hit description =citron-like (105.0 kD) (5O516) [Caenorhabditis elegans] emb|CAB04720.1| Hypothetical protein T08G5.5 [Cae
  Essential gene: C elegans homolog=T08G5.5; Phenotype=Emb,Rup
  Coding regions on vcDNA: vcDNA=SeqID_47836; Strand=+; Position=3-653
EYLTPGDGGLHFLKKECITAAIPYLEHVIYEWSDESPHFHGELLEQYVLRCNTLLGQFLHSLSSPSIGVPSFVAEDDELSILRRKLQYFLATDQHYSIESARDLIGEDQNLMEERAIIMGKLGQHLNALKIYTEILMDFNGAERHCQTYYDERNASTRNIFFDLFHYYIKGEMPQKEVIQVESDYEIRRKPNISEALKLFKRHPTKIDTVGAFALIP

SEQ ID NO: 121414 - protein, 172 aa, Heterodera glycines
  misc_feature (46)..(46): Xaa can be any naturally occurring amino acid
  Homolog annotation: Hit_ID=CAE64981.1; Match level="QueryCoverage =94%, HitCoverage=25%, E-value=5e-66, Identity=76%"; Hit description =Hypothetical protein CBG09816 [Caenorhabditis briggsae]
  Gene Ontology: Mol. function=RNA helicase activity; Cellular component=cytoplasm; Biological process=translational initiation
  Essential gene: C elegans homolog=Y54E10A.9a; Phenotype=Emb
  Coding regions on vcDNA: vcDNA=SeqID_47837; Strand=+; Position=3-517
PSRTNYLRRPGNSVSNVNESRKFAYRTPIVSALLYGGRENYRDQIXKLRLGVHMLIATPGRLIDVIQNGLIGMEACRFLVLDEADRMLDMGFEPQIRRIVQMSGMPQKGERITAMFSATFPRDIQILAQDFLMPEYVFLAVGRVGSTSENIGQKGVWVEEHNKRHFLMDLLD

SEQ ID NO: 121415 - protein, 205 aa, Heterodera glycines
  Homolog annotation: Hit_ID=NP_494839.1; Match level="QueryCoverage =100%, HitCoverage=22%, E-value=1e-68, Identity=61%"; Hit description= domain protein (100.8 kD) (2E999) [Caenorhabditis elegans] gb|AAA81130.1| Tudor staphylococcal nuclease
  Gene Ontology: Cellular component=transcription factor complex; Biological process=regulation of transcription, DNA-dependent
  Essential gene: C elegans homolog=F10G7.2; Phenotype=Gro
  Coding regions on vcDNA: vcDNA=SeqID_47838; Strand=+; Position=18-632
EGLAKCVDWSMAVVTGGAEKLREAERIAKEKRLRLWKSFTGSSSTVKNAFTAKVVEIGLVDSLSVLKDNGEEMKVYFSSLRAPRREGTDGTSGGVQRQFRPLYDIPFMFEAREFLRRRLIGKSVQVIFDYVQPKQDQFPEKTCCTVMFNNQNVAVMLIERGFARAVRHGRDDDNRSPQYDALFAAEAQAEKDKKGIWAEKCTEKK

SEQ ID NO: 121416 - protein, 216 aa, Heterodera glycines
  Homolog annotation: Hit_ID=AAL78213.1; Match level="QueryCoverage =98%, HitCoverage=85%, E-value=5e-77, Identity=69%"; Hit description =probable protein kinase Hgg-20 [Heterodera glycines]
  Gene Ontology: Mol. function=casein kinase I activity; Biological process=signal transduction
  Essential gene: C elegans homolog=B0218.5; Phenotype=Unclassified
  Coding regions on vcDNA: vcDNA=SeqID_47839; Strand=+; Position=46-693
MPEELVALSPGTRVSGRWTIIKKLGAGAFGAVYLCQDRDGRTMAALKTEPFDAQRPLLYMEAHVLLSLNELRSNSGRHFCRCLDLGRDEQPDADSGQTMEFNYVVMSLVGRPMDKLLHESGDRFSPGTAIGTSIQLLKALKALHSVGYLHRDIKPANSAIGTPETNEQRLLYLLDFGMARKYVREDGTHRRQRDTARFRGTPIYAPISAHIKRDYS

SEQ ID NO: 121417 - protein, 223 aa, Heterodera glycines
  Homolog annotation: Hit_ID=NP_494712.1; Match level="QueryCoverage =100%, HitCoverage=71%, E-value=1e-113, Identity=91%"; Hit description=proteasome Regulatory Particle, Non-ATPase-like, S13 (34.6 kD) (rpn-11) [Caenorhabditis elegans] gb|AAC
  Gene Ontology: Mol. function=proteasome endopeptidase activity; Cellular component=proteasome regulatory particle (sensu Eukarya); Biological process=proteolysis and peptidolysis
  Essential gene: C elegans homolog=K07D4.3; Phenotype=Emb
  Coding regions on vcDNA: vcDNA=SeqID_47840; Strand=+; Position=4-672
LRLAGLSGLGAGSLNATPHDSNQVDTSETVYISSLALLKMLKHGRAGVPMEVMGLMLGEFVDDYTVNVIDVFAMPQSGTGVSVEAVDPVFQAKMLDMLKQTGRPEMVVGWYHSHPGFGCWLSGVDINTQQSFEALSDRAVAVVVDPIQSVKGKVVIDAFRTINPQAIALNQEPRQTTSNIGHLQKPSIQALIHGLNRHYYSIPIAYRTNENEQQMLLNLNKQS

SEQ ID NO: 121418 - protein, 133 aa, Heterodera glycines
  Homolog annotation: Hit_ID=CAE72024.1; Match level="QueryCoverage =76%, HitCoverage=47%, E-value=1e-15, Identity=46%"; Hit description =Hypothetical protein CBG19106 [Caenorhabditis briggsae]
  Essential gene: C elegans homolog=C13F10.7; Phenotype=Emb
  Coding regions on vcDNA: vcDNA=SeqID_47841; Strand=+; Position=280-678
MNEFVKKRAATFLRLAVTLYVMFDQKWEEQQADQTTSTQYQRNDMIGREIGEVLARAPLVTGACRKCGFVGHLPFQCRNFIQLKPNQKLDIDVSSTSSEEYTTPLTDREGKKAAKKIKKREKKELKKLEKLKK

SEQ ID NO: 121419 - protein, 134 aa, Heterodera glycines
  Homolog annotation: Hit_ID=NP_503425.2; Match level="QueryCoverage =97%, HitCoverage=78%, E-value=5e-47, Identity=69%"; Hit description =UNCoordinated locomotion UNC-60 (unc-60) [Caenorhabditis elegans] gb|AAL02461.1| Uncoordinated protein 60
  Gene Ontology: Mol. function=actin binding; Cellular component=actin filament; Biological process=cell organization and biogenesis
  Essential gene: C elegans homolog=C38C3.5a; Phenotype=Let
  Coding regions on vcDNA: vcDNA=SeqID_47842; Strand=+; Position=2-406
SGQEVIVEVAVSSEDIGSTGTESYDDNSKAAYETFVKDLKERTEGFVDCRYAVFDFKFQTQRPGAGTSKMDKIVFIQLCPDGASIKKKMLYASSASAIKASLGTAKILQFQVSDESEIAHKELLSKLNDKYRDN

SEQ ID NO: 121420 - protein, 238 aa, Heterodera glycines
  Homolog annotation: Hit_ID=NP_506134.2; Match level="QueryCoverage =100%, HitCoverage=52%, E-value=6e-40, Identity=34%"; Hit description= splicing factor PWI family member (5M983) [Caenorhabditis elegans] emb|CAA99936.2| Hypothetical protein
  Essential gene: C elegans homolog=W04D2.6a; Phenotype=Gro
  Coding regions on vcDNA: vcDNA=SeqID_47843; Strand=+; Position=3-716
RKLKKEVKEKEESYQARLKKWEEREKRMAKLYDKEREEEKQRQKTLQKEAKKLRQFLEDYVDERDDPKYYRGSALFQRKRNYEREREADAKDRHEERAELEEIRRSILEEEVVSKKEGDGEEADESGDTSGRMDIADEQKAEWETVGETAAMVSGPVPPPPLPSEEPTPAQVESPTPVKKTIVTTLQQKQVVPLSKLNGVFQEEEEDEVDTLHQIEKKIKPFEITREDRLQSMTPEER

SEQ ID NO: 121421 - protein, 199 aa, Heterodera glycines
  Homolog annotation: Hit_ID=CAE59767.1; Match level="QueryCoverage =91%, HitCoverage=75%, E-value=5e-44, Identity=51%"; Hit description =Hypothetical protein CBG03219 [Caenorhabditis briggsae]
  Gene Ontology: Cellular component=Golgi membrane; Biological process =Golgi to endosome transport
  Essential gene: C elegans homolog=C18E9.10; Phenotype=Lva
  Coding regions on vcDNA: vcDNA=SeqID_47844; Strand=+; Position=2-601
RNSNGIDDVQRLTEDADAAQNGQLPSNKNRKYSWMSFSSVSASVSPDSNPCGLTRFQRIAAFFLCIFAAGFCFTTAMMLIPVLVLQTRKFAALNTLGSVFFIVSFGFLWGPLAYCQFLFSEPRRVVTAVYLLSVLATLYTSLWLQSSLLTVITAALQTFGLIWFLLSYVPGGENGLKWMGRMAKMAFCARQSSTLVLPI

SEQ ID NO: 121422 - protein, 207 aa, Heterodera glycines
  Homolog annotation: Hit_ID=NP_493558.1; Match level="QueryCoverage =98%, HitCoverage=70%, E-value=3e-56, Identity=55%"; Hit description =proteasome Beta Subunit (31.2 kD) (pbs-5) [Caenorhabditis elegans] emb|CAB04567.1| Hypothetical protein K
  Gene Ontology: Mol. function=endopeptidase activity; Cellular component=proteasome core complex (sensu Eukarya); Biological process=embryonic cleavage
  Essential gene: C elegans homolog=K05C4.1; Phenotype=Emb
  Coding regions on vcDNA: vcDNA=SeqID_47845; Strand=+; Position=92-712
MFYHDLHDNENSHDKELKQLVQMDDLAIPKFVMPPLGIKPKKFVRKHFGPNSRLPMAQFLKGTTTLSFVYKPKTPQDKGGVIVAVDSRATGGTYISSKTVEKIIPINDQLVATMAGGAADCQYWTRVVSKYCNLFELREGTQISVAAASKYFANVMYDYRGQELGVHSMVCGVDKFGPSIYMVEAEGTRVKIDTICSLGSGMLHAMS

SEQ ID NO: 121423 - protein, 245 aa, Heterodera glycines
  Homolog annotation: Hit_ID=NP_491824.1; Match level="QueryCoverage =99%, HitCoverage=45%, E-value=1e-47, Identity=44%"; Hit description =IMportin Alpha, nuclear localization sequence receptor (59.2 kD) (ima-2) [Caenorhabditis elegans] gb|AAB3
  Gene Ontology: Mol. function=nuclear localization sequence binding; Cellular component=nucleoplasm; Biological process=protein-nucleus import
  Essential gene: C elegans homolog=F26B1.3; Phenotype=Emb
  Coding regions on vcDNA: vcDNA=SeqID_47846; Strand=+; Position=1-735
WEDSRRRRTETRVELRKKKCNEEMMKRRNINLECADDSATSAEELVTDGEIGEPTGRLSPEMLSLEDAVEVLQKEQNAERFRLAFESVRRVLSRSKCPPIDKVITLGFPCALVQALHYDDDKVKFEAAWCITNIVSGTSEQTMTMVNAGAVGPLLKLCSSPSLKLSEQAVWCIANMAGDGVQLRDLLISEGILPLLVGLADCADTLGISFVRILTWAFSNLCRHKKPQVPLQMLAVMAPSISKLI

SEQ ID NO: 121424 - protein, 166 aa, Heterodera glycines
  Homolog annotation: Hit_ID=NP_898988.1; Match level="QueryCoverage =95%, HitCoverage=32%, E-value=4e-42, Identity=51%"; Hit description =cDNA sequence BC027061 [Mus musculus] gb|AAH27061.1| CDNA sequence BC027061 [Mus musculus]
  Essential gene: C elegans homolog=C26D10.3; Phenotype=Lvl
  Coding regions on vcDNA: vcDNA=SeqID_47847; Strand=+; Position=8-508
AFSCRRYGILVNEQMRTNIEDVFAAGDVCTANWTAKSPHWKQIRLWTQARQMGLFCARCMLIDNVLLDIAFELFTHVTSFFGFKVILLGDFSGERLEKPFEKNYRITEGCEYVKVLTKDHRVHGAVLVGETDLEGAVENLILNQTDIGQIEQVFLDPDFDLEDFFD

SEQ ID NO: 121425 - protein, 211 aa, Heterodera glycines
  Homolog annotation: Hit_ID=AAK60209.1; Match level="QueryCoverage =100%, HitCoverage=98%, E-value=1e-122, Identity=100%"; Hit description=vap-1 [Heterodera glycines]
  Gene Ontology: Cellular component=extracellular space
  Essential gene: C elegans homolog=F49E11.9; Phenotype=Unclassified
  Coding regions on vcDNA: vcDNA=SeqID_47848; Strand=+; Position=70-702
MEHFPSKFVLCLLIAFIAVPCSVLALSAGSRVSMLACHNNYRSQLAKGTADNKSGKMPAGSNLIQQKYDSNIESVAQKWANGCSMSHSGSSGMGENLYMTSSSTISEADALKQACDMWWAELKQFGFQSSLVLDMAQFNKGIGHWSQQAWASTAQIGCAMARCPSSTWKTWVVCNYKEAGNFLNQPVYKKGAACSKCSDYNGATCDSASGL

SEQ ID NO: 121426 - protein, 166 aa, Heterodera glycines
  Homolog annotation: Hit_ID=NP_491237.1; Match level="QueryCoverage =92%, HitCoverage=49%, E-value=5e-50, Identity=56%"; Hit description =protein phosphatase 1A (34.6 kD) (1E406) [Caenorhabditis elegans] gb|AAB42233.1| Yeast glc seven-like pho
  Gene Ontology: Mol. function=protein serine/threonine phosphatase activity; Cellular component=cytoplasm; Biological process=sodium ion homeostasis
  Essential gene: C elegans homolog=W09C3.6; Phenotype=Ste
  Coding regions on vcDNA: vcDNA=SeqID_47849; Strand=+; Position=167-664
AIIRKVRQSPVHRFTDEITDEELQQLCMAATDVFRMQPTLVRIQPPVVVVGDIHGQFTDLQRIFDTHGYPPEQQYVFLGDYVDRGPQSLETIVLLFCYKVKYPANFMLLRGNHECANINRVYGFFDEFINRYKRPDPCRLYDLFNQTFAWMPYVGLIGDKILCMHG

SEQ ID NO: 121427 - protein, 220 aa, Heterodera glycines
  Homolog annotation: Hit_ID=NP_493252.2; Match level="QueryCoverage =96%, HitCoverage=8%, E-value=1e-72, Identity=63%"; Hit description =PAtterning Defective PAD-1, dopey, N-terminal (266.8 kD) (pad-1) [Caenorhabditis elegans]
  Gene Ontology: Biological process=development
  Essential gene: C elegans homolog=Y18D10A.13; Phenotype=Emb
  Coding regions on vcDNA: vcDNA=SeqID_47850; Strand=+; Position=3-662
SKTARRCGHKKDPSDPTQALFLLAENLAELIDSVCKSEDKEKLLPALQAVWNNTLPYLKAKSAKNVRFFLASSQFLASMSSYNYMRSVWKKNAMDLLWDNSFFKMDIHALRQWLIVIDNLMTNDKTSFKELLTRITTSTSTTLSTLITSKEQEYEMRAQYLKRLAFVILSSELDQYAGQLNEIQERLTENLRLCQVPVIHTQVFTCYRVLLVRMSPSSFV

SEQ ID NO: 121428 - protein, 133 aa, Heterodera glycines; identical to SEQ ID NO: 121281
  Homolog annotation: Hit_ID=NP_492601.1; Match level="QueryCoverage =90%, HitCoverage=91%, E-value=4e-40, Identity=57%"; Hit description =cytochrome C Oxidase, subunit Vb, LiPid Depleted LPD-4 (lpd-4) [Caenorhabditis elegans] emb|CAB03002.1| H
  Gene Ontology: Biological process=negative regulation of FGF receptor signaling pathway
  Essential gene: C elegans homolog=F26E4.9; Phenotype=Lpd
  Coding regions on vcDNA: vcDNA=SeqID_47851; Strand=+; Position=28-429

SEQ ID NO: 121429 - protein, 175 aa, Heterodera glycines
  misc_feature (47)..(47): Xaa can be any naturally occurring amino acid
  Homolog annotation: Hit_ID=NP_495707.1; Match level="QueryCoverage =97%, HitCoverage=80%, E-value=2e-70, Identity=74%"; Hit description =ribosomal Protein, Large subunit (24.7 kD) (rpl-10) [Caenorhabditis elegans] emb|CAA88308.1| Hypothetical
  Gene Ontology: Mol. function=structural constituent of ribosome; Cellular component=cytosolic large ribosomal subunit (sensu Eukarya); Biological process=protein biosynthesis
  Essential gene: C elegans homolog=F10B5.1; Phenotype=Lva,Ste
  Coding regions on vcDNA: vcDNA=SeqID_47852; Strand=+; Position=8-534
ETRTVDSFLLCAMISNEREHLSSEALEAARICANKYMVKNCGKDGFXMRVRIHPFHVIRINKMLSCAGADRLQTGMRGAFGKPQGLVARVGIGDMLMSVRVRDQHQAHALEAFRRAKFKFPGRQYIVISRKWGFTPFDREVYEKHRKEGRVIPDGVNCRFLKQHGPLTEWLKNPI

SEQ ID NO: 121430 - protein, 232 aa, Heterodera glycines
  misc_feature (35)..(35): Xaa can be any naturally occurring amino acid
  misc_feature (63)..(63): Xaa can be any naturally occurring amino acid
  Homolog annotation: Hit_ID=NP_492457.1; Match level="QueryCoverage =100%, HitCoverage=27%, E-value=1e-117, Identity=89%"; Hit description=translation Elongation FacTor (94.8 kD) (eft-2) [Caenorhabditis elegans] emb|CAB02985.1| Hypothetical p
  Gene Ontology: Mol. function=translation elongation factor activity; Cellular component=nucleolus; Biological process=protein biosynthesis
  Essential gene: C elegans homolog=F25H5.4; Phenotype=Emb,Lva
  Coding regions on vcDNA: vcDNA=SeqID_47853; Strand=+; Position=3-696
KSTAISMFFELERKDLEFVKGESQADIEQVDGKSXKYNGFLINLIDSPGHVDFSSEVTAALRXTDGALVVVDCVSGVCVQTETVLRQAIAERIKPVLFMNKMDRALLELQLGQEELFQTFQRIVENINVIIATYGDDDGPMGPIQVDPSIGNVGFGSGLHGWAFTLKQFAEMYADKFGVQIDKLMKNLWGDRFFNMKTKKWTNNQEPETKRGFCQFVLDPIFKVFDAVMNIK

SEQ ID NO: 121431 - protein, 190 aa, Heterodera glycines
  Homolog annotation: Hit_ID=NP_492528.1; Match level="QueryCoverage =81%, HitCoverage=27%, E-value=1e-20, Identity=36%"; Hit description =benzodiazepine receptor (1K94) [Caenorhabditis elegans] emb|CAB02840.1| Hypothetical protein C41G7.3 [Cae
  Gene Ontology: Biological process=chromosome segregation
  Essential gene: C elegans homolog=C41G7.3; Phenotype=Him
  Coding regions on vcDNA: vcDNA=SeqID_47854; Strand=+; Position=20-592
MPLHWTSVDTRNALLCAAVPSIGAFVGSTMAIKDQELVQFLKNQNFPSFARCCKYNYLLANTSVTIPFGYASYLVYKIGGGVSCTDSKIALGLYGATLLSGCFLVPTLKKHDTKALTANAVVLAGPSVATSVAFYNIDKISAYWTMPFTLLAILYAGLTVKANCWNSKLTTYEASSGGKNENKKADSCSD

SEQ ID NO: 121432 - protein, 209 aa, Heterodera glycines
  misc_feature (12)..(12): Xaa can be any naturally occurring amino acid
  misc_feature (16)..(16): Xaa can be any naturally occurring amino acid
  Homolog annotation: Hit_ID=XP_392715.1; Match level="QueryCoverage =100%, HitCoverage=28%, E-value=1e-37, Identity=40%"; Hit description= similar to ENSANGP00000013083 [Apis mellifera]
  Gene Ontology: Mol. function=SUMO activating enzyme activity; Cellular component=nucleus; Biological process=protein modification
  Essential gene: C elegans homolog=W02A11.4; Phenotype =Emb,Lva,Pvl,Stp,Unc
  Coding regions on vcDNA: vcDNA=SeqID_47855; Strand=+; Position=3-627
TEMIHCVVWARXLFNXLFGESDPDDDVSPETVTSDGMGDQKNSQTMDNDGTTTNGSVIFADNGNSSANDAITKNGKMSTRQFAEATDYGPKQIFEKLFFDDINYLLSMADLWKERKKPTPIHFMQVIDEGLGGSRPNEDENEHWGVSKWAELFEDSLFALAERYRGAVKEKRMLIWDKDDEPAMQFVAACANLRAYIFGIGTKPLFDLK

SEQ ID NO: 121433 - protein, 233 aa, Heterodera glycines
  misc_feature (66)..(66): Xaa can be any naturally occurring amino acid
  Homolog annotation: Hit_ID=CAE72952.1; Match level="QueryCoverage =92%, HitCoverage=27%, E-value=4e-43, Identity=45%"; Hit description =Hypothetical protein CBG20283 [Caenorhabditis briggsae]
  Gene Ontology: Mol. function=ubiquitin-specific protease activity; Biological process=protein modification
  Essential gene: C elegans homolog=T27A3.2; Phenotype=Gro,Pvl,Slu,Stp
  Coding regions on vcDNA: vcDNA=SeqID_47856; Strand=+; Position=3-700
MRTRRSATLAWSHLARFGLDIKKFRKTEKTTLEIELDANLKHEFSAIQEEGLELVNVSGPGYTGLXNLGSSCYINSALQVLLIVPDFVRAFTEELLLRKQPPEINEDFAAQLAKIFVAMKSGDYSREDNKHGAEKEKGIRPTTFRRIVGRNHPEFSTAKQQDVEEYVRFLFEKVDACSDLSSENPVAAFRFRLVTRFLDELSDCVRYSFRTDNILSVAIPMDLCKESDTVVNG

SEQ ID NO: 121434 - protein, 118 aa, Heterodera glycines
  misc_feature (12)..(12): Xaa can be any naturally occurring amino acid
  misc_feature (33)..(33): Xaa can be any naturally occurring amino acid
  misc_feature (54)..(54): Xaa can be any naturally occurring amino acid
  Homolog annotation: Hit_ID=NP_498774.1; Match level="QueryCoverage =99%, HitCoverage=72%, E-value=2e-33, Identity=58%"; Hit description =ribosomal Protein, Large subunit (18.3 kD) (rpl-21) [Caenorhabditis elegans] gb|AAA27951.1| Ribosomal pro
  Gene Ontology: Mol. function=structural constituent of ribosome; Cellular component=cytosolic large ribosomal subunit (sensu Eukarya); Biological process=protein biosynthesis
  Essential gene: C elegans homolog=C14B9.7; Phenotype=Emb
  Coding regions on vcDNA: vcDNA=SeqID_47857; Strand=+; Position=3-358
GNGAFQKGMPFXAYHGKTGRVFNVTKHALGVVXNKRVFYRIIPKRINVRVEHVXPSGSRLFFLQRCKANDLQKKQHKEGNAPFVALKRKPKEPRGAHLVKVKSTKVERLAPVKFEIVA

SEQ ID NO: 121435 - protein, 164 aa, Heterodera glycines
  Homolog annotation: Hit_ID=NP_491560.1; Match level="QueryCoverage =100%, HitCoverage=28%, E-value=5e-34, Identity=46%"; Hit description= ezrin, Radixin and Moesin family, Ezrin/Radixin/Moesin (66.0 kD) (erm- 1) [Caenorhabditis elegans] gb|AAB
  Gene Ontology: Mol. function=structural constituent of cytoskeleton; Cellular component=cytoskeleton; Biological process=establishment and/or maintenance of epithelial cell polarity
  Essential gene: C elegans homolog=C01G8.5a; Phenotype=Emb,Gro,Stp,Unc
  Coding regions on vcDNA: vcDNA=SeqID_47858; Strand=+; Position=3-497
SLSEEERSRLLTEIAMQESRVSEMRFEVKNKTDEMNKLKAEVESGKTTAHIYNPGNGHLPTEFNDPDDLTNAHIELSTFHEGDVNNVMPQRELDRTNFTDQDMSLKNKLELLTKELDNARDERAITDFDVLHMENKKQGRDRYKTLRQIRSGNTKRRIDQYENM

SEQ ID NO: 121436 - protein, 241 aa, Heterodera glycines
  Homolog annotation: Hit_ID=CAE67815.1; Match level="QueryCoverage =85%, HitCoverage=40%, E-value=3e-32, Identity=35%"; Hit description =Hypothetical protein CBG13395 [Caenorhabditis briggsae]
  Gene Ontology: Mol. function=glutathione synthase activity; Biological process=neurogenesis
  Essential gene: C elegans homolog=M176.2; Phenotype=Emb,Lva
  Coding regions on vcDNA: vcDNA=SeqID_47859; Strand=+; Position=1-723
IALAAVRNDAELKLLAEYAVDYAHSIGLVGRSGDDKYKHSNDVSVAPPIALLPSPFPRELYEQATDAQQSLNELYFRIACDHDFLMEAYKDVIKGDPFHAKLIELAKVIQKEGIRQPLMVGLQRADYLSHWNEAAQKMELKQVEVNPGQIGGPGAATAVSKCHRKMLDKVEIMHGKKLPIMAKAVVPENRPGPGIARTLYQAWKMFGDPNAIILYVNQPDLFPVCHFEQLQFVMFQVEKLA

SEQ ID NO: 121437 - protein, 209 aa, Heterodera glycines
  misc_feature (186)..(186): Xaa can be any naturally occurring amino acid
  misc_feature (193)..(193): Xaa can be any naturally occurring amino acid
  Homolog annotation: Hit_ID=NP_496011.1; Match level="QueryCoverage =58%, HitCoverage=21%, E-value=5e-12, Identity=34%"; Hit description =glutathione synthetase (55.4 kD) (2J706) [Caenorhabditis elegans] emb|CAB01655.1| Hypothetical protein M1
  Essential gene: C elegans homolog=M176.2; Phenotype=Emb,Lva
  Coding regions on vcDNA: vcDNA=SeqID_47860; Strand=+; Position=31-658
MNGLRPSKTFLILLSISICWQLSVVSSSPTTHDIAQSAEVQSESEEQLPLLSPATPSEQQQQSADTLATTYCVENVEKDEVLLKQYVRDAKDWALAHGLVLPALPFRCKNEECKEANKALNIVPADVVKIAPFTLFPSPFPRELFVQAQKVHKAIQLMYFRAASNFEFLKGVHKGLLKTDQNFIEXLKALKAXHLEGIKQPLTLFCTEQ

SEQ ID NO: 121438 - protein, 225 aa, Heterodera glycines
  Homolog annotation: Hit_ID=CAE72581.1; Match level="QueryCoverage =65%, HitCoverage=14%, E-value=1e-31, Identity=46%"; Hit description =Hypothetical protein CBG19769 [Caenorhabditis briggsae]
  Gene Ontology: Biological process=locomotory behavior
  Essential gene: C elegans homolog=W04A4.5; Phenotype=Unclassified
  Coding regions on vcDNA: vcDNA=SeqID_47861; Strand=+; Position=2-676
LRSFPWPSPRDQLDTILTVLDDATADNRLALHTLLAKSNLADSNCVSQCLKKLLHSLRRFPMDKFSIFGCLSGIGQNHSSLVQPLVNDWLDVHPIFDTPEQSIDDDFYLARLILVLNAASHRSVLCSLIPSYALKHYRYLRRSWPEIVPKILEFDHEKLHQCDSSPFLCPFLAVGPEDKTIEKENDAKTARVLEPSREFRNNETIRFVAGLPTGIFIRILLCNVT

SEQ ID NO: 121439 - protein, 239 aa, Heterodera glycines
  misc_feature (14)..(14): Xaa can be any naturally occurring amino acid
  misc_feature (62)..(62): Xaa can be any naturally occurring amino acid
  misc_feature (64)..(64): Xaa can be any naturally occurring amino acid
  Homolog annotation: Hit_ID=NP_493569.1; Match level="QueryCoverage =98%, HitCoverage=73%, E-value=7e-55, Identity=47%"; Hit description =metaxin 1 (1P348) [Caenorhabditis elegans] emb|CAB07391.1| Hypothetical protein F39B2.11 [Caenorhabditis
  Gene Ontology: Cellular component=integral to membrane
  Essential gene: C elegans homolog=F39B2.11; Phenotype=Ste
  Coding regions on vcDNA: vcDNA=SeqID_47862; Strand=+; Position=1-714
WNFCAQSTDVVLDXDLVPSQLCEFEAYNCLLKQKLLPALNHLFWVDKCNYGTIVHPLYAQQXHXFPYNIYYMERRRRRMDTTVRAIRKNQQQLTSDAIQALNLLSAKLSDNKYFCGDKPCSIDALVFGCLAPLLRTPLPNDRLQLHLSATPNLVRFVDSILSIYLPLPEKVIKEQAMARKKWQKLKMDAQQTMEEGRIERELRKAEKKERNSMHHILFFAISSITISLLFALHTGIIVV

SEQ ID NO: 121440 - protein, 225 aa, Heterodera glycines
  misc_feature (34)..(34): Xaa can be any naturally occurring amino acid
  Homolog annotation: Hit_ID=CAE62725.1; Match level="QueryCoverage =94%, HitCoverage=47%, E-value=5e-68, Identity=62%"; Hit description =Hypothetical protein CBG06885 [Caenorhabditis briggsae]
  Gene Ontology: Mol. function=acetyl-CoA C-acetyltransferase activity; Cellular component=mitochondrion; Biological process=fatty acid beta -oxidation
  Essential gene: C elegans homolog=B0303.3; Phenotype=Emb
  Coding regions on vcDNA: vcDNA=SeqID_47863; Strand=+; Position=2-677
AFCFTYAAKFSAVASSPNKNLNAVLIDAVRTPFXIESTFRELLAVDLQRHALKALVERTKIPFDEIGHIICGQVVQECKTSNIAREAAITAGFPDSIPCNTVTLACISSGVSIQNISLMISTGYLKAGIAGGVELLSDFPIRYNRKVRLSLIDLQKAKSFGERFKHLKTVASNWFSPELPAVSEFTTGEVMGNYGDRLAAAFCVSRREHDEFAIRSHTLADKAFR

SEQ ID NO: 121441 - protein, 228 aa, Heterodera glycines
  Homolog annotation: Hit_ID=NP_492051.1; Match level="QueryCoverage =89%, HitCoverage=20%, E-value=6e-34, Identity=41%"; Hit description =yeast BUB homolog (112.0 kD) (bub-1) [Caenorhabditis elegans] emb|CAA95845.1| Hypothetical protein R06C7.
  Gene Ontology: Mol. function=protein kinase activity; Cellular component=spindle pole body; Biological process=embryonic cleavage
  Essential gene: C elegans homolog=R06C7.8; Phenotype=Emb
  Coding regions on vcDNA: vcDNA=SeqID_47864; Strand=+; Position=3-686
AYLMEVRDAYHFKNASAIVYEYFPKGTLLDLTNVYKKNGTVVGGLLATFFGIHLARALRQVHETANIIHADVKPDNVMLLTAALNAHDSLDNLLKTPVLKLIDWGRSIDMNHFQGVEFHGKAGTENFDCVEMKTGMPWTFQTDFYGFCATMYVMMNGEYLVTFKYSQTDKVVPVKQLKRRMALYDVWTQLFDQFLNIPNCKQLPKWLNTLDQMESRLAEAVKTEPLEW

SEQ ID NO: 121442 - protein, 57 aa, Heterodera glycines
  Homolog annotation: Hit_ID=NP_510360.1; Match level="QueryCoverage =89%, HitCoverage=15%, E-value=1e-10, Identity=56%"; Hit description =putative endoplasmic reticulum protein, with a coiled coil domain, of bilaterial origin (34.2 kD) (XO782)
  Essential gene: C elegans homolog=R03E1.2; Phenotype=Emb,Lva,Lvl,Unc
  Coding regions on vcDNA: vcDNA=SeqID_47865; Strand=+; Position=39-212
TFTWFSSPNFAPMFGIIAGLSVVLIIAIVFIVVGLLSMEPAKDSIIYRMTTTRLKKD

SEQ ID NO: 121443 - protein, 216 aa, Heterodera glycines
  Homolog annotation: Hit_ID=XP_520752.1; Match level="QueryCoverage =93%, HitCoverage=46%, E-value=1e-77, Identity=70%"; Hit description =PREDICTED: similar to DEAD (Asp-Glu-Ala-Asp) box polypeptide 47 isoform 1; E4-DEAD box protein [Pan trogl
  Gene Ontology: Mol. function=ATP dependent RNA helicase activity; Cellular component=nucleolus; Biological process=rRNA processing
  Essential gene: C elegans homolog=T26G10.1; Phenotype=Lva
  Coding regions on vcDNA: vcDNA=SeqID_47866; Strand=+; Position=1-648
EDNDTESICGEIVAQESGENTANQQNQTQQNTTFEELGVNDELCNACESLGWTKPMPIQQKVIPLALKGRDIIGLAETGSGKTGAFALPILQALMDSPQHLFALILAPTRELAFQISEQFEALGATIGLNVCIIVGGIDMTSQTLSLAKRPHIIVATPGRLVDHLENTKGFDLRTVKFLVLDEADRILNMDFEVELDKILKVLPKARKTYLFSATM

SEQ ID NO: 121444 - protein, 159 aa, Heterodera glycines
  Homolog annotation: Hit_ID=CAE72582.1; Match level="QueryCoverage =98%, HitCoverage=87%, E-value=2e-43, Identity=57%"; Hit description =Hypothetical protein CBG19770 [Caenorhabditis briggsae]
  Gene Ontology: Biological process=positive regulation of growth rate
  Essential gene: C elegans homolog=W09C5.8; Phenotype=Age,Gro,Ste
  Coding regions on vcDNA: vcDNA=SeqID_47867; Strand=+; Position=83-562
MTWWWGPEKNNGREVVGPTFHGDEFYQDRLDRWYPSIRFRKNDEVITPIRHKELGDWKKLSIEEKKLIYRYSFRQTLAEFEALTPYGYLTVTLFFSMLGLTILYASFVRTYVTKFNDRLPDTFDDEYKESQAERRVVLERGNPYGPAYYYDYEKNRWKD

SEQ ID NO: 121445 - protein, 237 aa, Heterodera glycines
  Homolog annotation: Hit_ID=NP_499734.1; Match level="QueryCoverage =95%, HitCoverage=59%, E-value=3e-34, Identity=39%"; Hit description =cleavage and Polyadenylation Factor (cpf-2) [Caenorhabditis elegans] emb|CAB05746.1| Hypothetical protein
  Gene Ontology: Mol. function=RNA binding; Cellular component=nucleus; Biological process=embryogenesis and morphogenesis
  Essential gene: C elegans homolog=F56A8.6; Phenotype=Emb
  Coding regions on vcDNA: vcDNA=SeqID_47868; Strand=+; Position=4-714
MTLTRPQNPTDELSPYGPELEPGKAPEVIARTVASMPPEKMFELMRSMKETVNNNPQMARQLLMENPQLSYALLQAQVVMRVVDPKIAYQMLHREHAQPLVPPTSIPTHIPQQFAGKPPQLPPQFNIPPPSVPSHQFQMQPPPLVPGQFHHGFPSMGMAPPSLLQQQQQQTPFTQQKPTPIAPLAVPPAATAPQQQQAVTPPPLSQQAQQSNSDNLDDEQHAQMLIRVLQLTDEQIR

SEQ ID NO: 121446 - protein, 142 aa, Heterodera glycines; identical to SEQ ID NO: 119609
  Homolog annotation: Hit_ID=AAH46078.1; Match level="QueryCoverage =92%, HitCoverage=91%, E-value=1e-22, Identity=42%"; Hit description =Similar to H2A histone family, member X [Danio rerio] ref|NP _957367.1| similar to H2A histone family, memb
  Gene Ontology: Mol. function=DNA binding; Cellular component =nucleosome; Biological process=nucleosome assembly
  Essential gene: C elegans homolog=T23D8.6; Phenotype=Emb
  Coding regions on vcDNA: vcDNA=SeqID_47869; Strand=+; Position=51-479

SEQ ID NO: 121447 - protein, 197 aa, Heterodera glycines
  Homolog annotation: Hit_ID=CAA70694.1; Match level="QueryCoverage =100%, HitCoverage=55%, E-value=1e-106, Identity=99%"; Hit description=cathepsin S-like cysteine proteinase [Heterodera glycines]
  Gene Ontology: Mol. function=cathepsin S activity; Cellular component= lysosome; Biological process=proteolysis and peptidolysis
  Essential gene: C elegans homolog=T03E6.7; Phenotype=Emb,Gro,Unc
  Coding regions on vcDNA: vcDNA=SeqID_47870; Strand=+; Position=22-612
MAFLSRLSILPNSPISLLAVSLAVLAFVALASANPPTARETAPNAQQNNANSVATGEIAKNIAEKMERMNEFIKAKKFIDAHNLAFEKGEVSFKVAPNHLMHFTPAQYNRIRGLQMRSNRQRHNMATLAGNSSTLPEKLDWREKGAVTGVKDQGDCGSCWAFSATGAIEGALAQKKASKIISLSEQNLVDCSSKYGN

SEQ ID NO: 121448 - protein, 128 aa, Heterodera glycines
  Homolog annotation: Hit_ID=NP_505463.1; Match level="QueryCoverage =98%, HitCoverage=99%, E-value=1e-58, Identity=90%"; Hit description =histone (13.4 kD) (his-35) [Caenorhabditis elegans] emb|CAA94747.1| Hypothetical protein C50F4.13 [Caenor
  Gene Ontology: Mol. function=DNA binding; Cellular component =nucleosome; Biological process=nucleosome assembly
  Essential gene: C elegans homolog=T23D8.6; Phenotype=Emb
  Coding regions on vcDNA: vcDNA=SeqID_47871; Strand=+; Position=46-432
MSGRGKGGKAKTGGKQKTRSSRAGLQFPVGRLHRLLRKGHYAERVGAGAPVYLAAVLEYLAAEVLELAGNASRDNKKTRINPRHLQLAVRNDEELNKLLSGVTISQGGVLPNIQAVLLPKKTQHDESQ

SEQ ID NO: 121449 - protein, 149 aa, Heterodera glycines
  Homolog annotation: Hit_ID=CAE71105.1; Match level="QueryCoverage =63%, HitCoverage=38%, E-value=1e-14, Identity=36%"; Hit description =Hypothetical protein CBG17958 [Caenorhabditis briggsae]
  Essential gene: C elegans homolog=C35D10.5; Phenotype=Gro
  Coding regions on vcDNA: vcDNA=SeqID_47872; Strand=+; Position=3-452
GWRCSHGLVHSLGQAAKEMGMSVNKRKEGMALHAIYISTLHDYDEGFFGDDRVLAAAVWRSFFLQQPDVSPAQINRVVRYMRATMTSLARMDDTRLLTDGIERWDVAEELARLVSAEQFGTIPAAPPSSSMDDDGRNSAQPAPKVAASN

SEQ ID NO: 121450 - protein, 155 aa, Heterodera glycines
  misc_feature (15)..(15): Xaa can be any naturally occurring amino acid
  misc_feature (42)..(42): Xaa can be any naturally occurring amino acid
  misc_feature (62)..(62): Xaa can be any naturally occurring amino acid
  misc_feature (107)..(107): Xaa can be any naturally occurring amino acid
  misc_feature (129)..(129): Xaa can be any naturally occurring amino acid
  Homolog annotation: Hit_ID=CAA25004.1; Match level="QueryCoverage =99%, HitCoverage=40%, E-value=2e-45, Identity=57%"; Hit description =beta-actin [Gallus gallus]
  Gene Ontology: Biological process=reproduction
  Essential gene: C elegans homolog=T04C12.5; Phenotype=Ste
  Coding regions on vcDNA: vcDNA=SeqID_47873; Strand=+; Position=73-538
MGSDCSRTSFSGDDXAPRSVFTSIAGLPRHQSLMVSMGQMTXFVGDYVYCNHRILTTQLPIXHGMGSNWDDLYNILNHTFYNELRVAPNEHPVLVTNVPLNSLCQHXKMTLMMFQTFNTSSIYVVLHTXLFLYSFGRTINLVMDSGDGVTHTVPI

SEQ ID NO: 121451 - protein, 214 aa, Heterodera glycines
  misc_feature (7)..(7): Xaa can be any naturally occurring amino acid
  misc_feature (15)..(15): Xaa can be any naturally occurring amino acid
  Homolog annotation: Hit_ID=CAE64863.1; Match level="QueryCoverage =69%, HitCoverage=27%, E-value=3e-38, Identity=53%"; Hit description =Hypothetical protein CBG09661 [Caenorhabditis briggsae]
  Gene Ontology: Mol. function=voltage-gated potassium channel activity; Cellular component=voltage-gated potassium channel complex; Biological process=potassium ion transport
  Essential gene: C elegans homolog=C32C4.1; Phenotype=Unclassified
  Coding regions on vcDNA: vcDNA=SeqID_47874; Strand=+; Position=3-642
KLARYAXGLRAFGEXMRKSAAELSMLGMFLLTGIMLFSTAIYFFERDEPNSKFYSIPSAWWWCVATMTTVGYGDLVPVTTGGKVVAAIASVCGIIVLAFPISMIIDKFAESTGHGQRVFDETVAQGEVPLEANKSNVLLGSPTGRGMSRRRKSETESQRKAKGKAKGKRNEKPKESERKAKGKRNEKPKEKPKENPKESETKSQRKAKGKKKKK

SEQ ID NO: 121452 - protein, 216 aa, Heterodera glycines
  misc_feature (15)..(15): Xaa can be any naturally occurring amino acid
  misc_feature (131)..(131): Xaa can be any naturally occurring amino acid
  misc_feature (204)..(204): Xaa can be any naturally occurring amino acid
  Homolog annotation: Hit_ID=XP_392715.1; Match level="QueryCoverage =99%, HitCoverage=29%, E-value=6e-40, Identity=40%"; Hit description =similar to ENSANGP00000013083 [Apis mellifera]
  Gene Ontology: Mol. function=SUMO activating enzyme activity; Cellular component=nucleus; Biological process=protein modification
  Essential gene: C elegans homolog=W02A11.4; Phenotype =Emb,Lva,Pvl,Stp,Unc
  Coding regions on vcDNA: vcDNA=SeqID_47875; Strand=+; Position=1-647
TTEMIHCVVWAKSLXNQLFGESDPDDDVSPETVTSDGMGDQKNSQTMDNDGTTTNGSVIFADNGNSSANDAITKNGKMSTRQFAEATDYGPKQIFEKLFFDDINYLLSMADLWKERKKPTPIHFMQVIDEXLGGSRPNEDENEHWGVSKWAELFEDSLFALAERYRGAVKEKRMLIWDNDDEHAMQFVAACANLRAYIFGIGTXPLFDLKAMAGNI

SEQ ID NO: 121453 - protein, 246 aa, Heterodera glycines
  misc_feature (16)..(16): Xaa can be any naturally occurring amino acid
  Homolog annotation: Hit_ID=NP_506137.1; Match level="QueryCoverage =99%, HitCoverage=54%, E-value=3e-47, Identity=43%"; Hit description =hemoglobinase-type cysteine proteinase family C13, legumain (53.2 kD) (5M993) [Caenorhabditis elegans] em
  Gene Ontology: Cellular component=extracellular space; Biological process=embryogenesis and morphogenesis
  Essential gene: C elegans homolog=T28H10.3; Phenotype=Emb
  Coding regions on vcDNA: vcDNA=SeqID_47876; Strand=+; Position=1-737
FLGPGSVGVIGFQQPXLTVKQLTQTLKEMHAKKMYGELTFYLEACESGSMFDHTLAQSLKIYAVTAANGDESSWGCFCDTKFLPGNCLGDLFSVNWMQDSDQENLRTETLRKQFGIVREETNKSHVMHYGDLQIQDEHVSEFMGKEQAQKRNERPPSPHKFPMFPSRDIPMFMMARRQNESKQIQHNLRVAWKKRSFLEQTIKQIVHQLVHDMNNRRQILTTYPQQIRDLDCHHDVVHTFSNFCFK

SEQ ID NO: 121454 - protein, 156 aa, Heterodera glycines
  Homolog annotation: Hit_ID=CAE59770.1; Match level="QueryCoverage =99%, HitCoverage=42%, E-value=7e-33, Identity=43%"; Hit description =Hypothetical protein CBG03222 [Caenorhabditis briggsae]
  Essential gene: C elegans homolog=C18E9.2; Phenotype=Lon
  Coding regions on vcDNA: vcDNA=SeqID_47877; Strand=+; Position=4-471
RDVSKSPPNAAKAEKRQRKEAEEVSKTEEDEAREEEEDEEGQQQEKPEANTKDEEKRRKKKVKLLFHDIQTLDVSTSDVYVWVFDPTPLWKKCVGILIVLGTIGGCLFPLWPDWLRLGIYYLSVIGIALFGLLLGVAFARTILFGLVWLFTLGRHR

SEQ ID NO: 121455 - protein, 187 aa, Heterodera glycines
  misc_feature (164)..(164): Xaa can be any naturally occurring amino acid
  Homolog annotation: Hit_ID=NP_510191.1; Match level="QueryCoverage =98%, HitCoverage=40%, E-value=2e-51, Identity=58%"; Hit description =aspartic protease (49.3 kD) (asp-4) [Caenorhabditis elegans] emb|CAA90633.1| Hypothetical protein R12H7.2
  Gene Ontology: Mol. function=saccharopepsin activity; Cellular component=vacuole (sensu Fungi); Biological process=induction of non- apoptotic programmed cell death
  Essential gene: C elegans homolog=R12H7.2; Phenotype=Ced
  Coding regions on vcDNA: vcDNA=SeqID_47878; Strand=+; Position=1-561
EGLARVTLRRMDTVRSRLAAAGSLVQFRKHLRQALRQRLDRLYSDKMARADVAFDTDAAAREGIDEVLRNYMDAQYYGDISIGSPPQNFTVIFDTGSSNLWVPSKKCSFFDLACRYHSKYDHKKSSTYQPDGREVAIEYGTGSMKGFVSKDTVCIMDGMCVEGXEFAEATSEPGDTFVNTKADGILG

SEQ ID NO: 121456 - protein, 153 aa, Heterodera glycines
  misc_feature (7)..(7): Xaa can be any naturally occurring amino acid
  misc_feature (102)..(102): Xaa can be any naturally occurring amino acid
  Homolog annotation: Hit_ID=AAQ89579.1; Match level="QueryCoverage =100%, HitCoverage=23%, E-value=1e-76, Identity=95%"; Hit description= heat shock protein 70-C [Heterodera glycines] gb|AAM93256.1| heat shock protein 70-C [Heterodera glycines
  Gene Ontology: Mol. function=Hsp70/Hsp90 organizing protein activity; Cellular component=endoplasmic reticulum lumen; Biological process =protein folding
  Essential gene: C elegans homolog=F43E2.8; Phenotype=Emb,Lva
  Coding regions on vcDNA: vcDNA=SeqID_47879; Strand=+; Position=2-459
LKLWPFXLHKANKPHVQVKVGNEDKQFAAEEVSAMVLTKMKEIAESYLGHEVKNAVVTVPAYFNDAQRQATKDAGTIAGLNVVRIINEPTAAAIAYGLDKKXEGERNILVFDLGGGTFDVSLLTIDNGVFEVLATNGDTHLGGEDFDQRTIEY

SEQ ID NO: 121457 - protein, 128 aa, Heterodera glycines
  Homolog annotation: Hit_ID=AAC79129.1; Match level="QueryCoverage =96%, HitCoverage=38%, E-value=2e-62, Identity=94%"; Hit description =glyceraldehyde-3-phosphate-dehydrogenase [Globodera rostochiensis] sp|O16027|G3P1_GLORO Glyceraldehyde-3-p
  Gene Ontology: Mol. function=glyceraldehyde 3-phosphate dehydrogenase (phosphorylating) activity; Cellular component=cytoplasm; Biological process=glycolysis
  Essential gene: C elegans homolog=K10B3.7; Phenotype=Unclassified
  Coding regions on vcDNA: vcDNA=SeqID_47880; Strand=+; Position=2-385
RSVYTLENASAHLKGGAKKVVISAPSADAPMYVMGVNEDKYDPAKDDVISNASCTTNCLAPLAKVINDEFGIIEGLMTTVHAVTATQKTVDGPSGKQWRDGRGAAHNIIPASTGASKAVGKVIPDLNG

SEQ ID NO: 121458 - protein, 80 aa, Heterodera glycines
  Homolog annotation: Hit_ID=AAN32889.1; Match level="QueryCoverage =100%, HitCoverage=67%, E-value=1e-38, Identity=100%"; Hit description=ubiquitin extension protein [Heterodera glycines]
  Gene Ontology: Biological process=cell cycle
  Essential gene: C elegans homolog=F25B5.4a; Phenotype=Emb
  Coding regions on vcDNA: vcDNA=SeqID_47881; Strand=+; Position=87-326
MNHFGLTFLFVAVSLLVIAPGCDGMQIFVKTLTGKTITLEVESSDTVDNVKEKIQEKEGIPPDQQRLIFAGKQLEDGRTL

SEQ ID NO: 121459 - protein, 174 aa, Heterodera glycines
  Homolog annotation: Hit_ID=CAE72699.1; Match level="QueryCoverage =99%, HitCoverage=24%, E-value=4e-69, Identity=75%"; Hit description =Hypothetical protein CBG19923 [Caenorhabditis briggsae]
  Gene Ontology: Mol. function=dynamine GTPase activity; Cellular component=Golgi cis-face; Biological process=cell communication
  Essential gene: C elegans homolog=T12E12.4a; Phenotype=Emb
  Coding regions on vcDNA: vcDNA=SeqID_47882; Strand=+; Position=1-522
QLKLRASAMTVQCQTILRSYGEPVMDKHRTLLQIITYFASAYNSTIEGTSRNIETTELCGGARIGYIFHETFKRALEKLNPIENLSTYDILTAIKNATGTRPALFVPEVSFELLVKRQIQRLEEPSLECVNLVYEEMLRIVQHCGFEIQQEMQRFPRLYEKISEVISLLLSNRL

SEQ ID NO: 121460 - protein, 211 aa, Heterodera glycines
  misc_feature (83)..(83): Xaa can be any naturally occurring amino acid
  Homolog annotation: Hit_ID=CAE73363.1; Match level="QueryCoverage =96%, HitCoverage=57%, E-value=6e-70, Identity=54%"; Hit description =Hypothetical protein CBG20797 [Caenorhabditis briggsae]
  Gene Ontology: Mol. function=helicase activity; Biological process =growth
  Essential gene: C elegans homolog=Y48C3A.7; Phenotype=Lpd
  Coding regions on vcDNA: vcDNA=SeqID_47883; Strand=+; Position=2-633
VENFPPKNIDDIRGELTRTLNWLNTPFAEHQKRLNMDEFRVRMSDFEWALRVVKPSAKREGFATVPDVRWEDIGALNAVREEXEMYPIQKPELFQHFGTSAQPQGILLSGPPGCGKTLLAKAVANETGMSFISVKGPELLSMYVGESERAVRTVFQRARDSAPCVVFFDEIDALCPKRSQRENSGSSRLVNQLLTEMDGLDGRRNVFLIGA

SEQ ID NO: 121461 - protein, 134 aa, Heterodera glycines
  misc_feature (134)..(134): Xaa can be any naturally occurring amino acid
  Homolog annotation: Hit_ID=CAE59951.1; Match level="QueryCoverage =82%, HitCoverage=34%, E-value=1e-32, Identity=55%"; Hit description =Hypothetical protein CBG03439 [Caenorhabditis briggsae]
  Gene Ontology: Mol. function=inorganic diphosphatase activity; Cellular component=mitochondrion; Biological process=energy pathways
  Essential gene: C elegans homolog=C47E12.4a; Phenotype=Emb,Lva
  Coding regions on vcDNA: vcDNA=SeqID_47884; Strand=+; Position=81-482
MLLSTRHIYPAFSRLIFLSSYCKTIGTSPICIFNKNLSSTMSAYQTIEKGSLHTLNYRVFFKNSDGKLISPWHDIPLYASESNKLFNMVVEIPRWTNAKMEIATKEVMSPIRQDEKKGLPRFVNNIFPHRGYIX

SEQ ID NO: 121462 - protein, 193 aa, Heterodera glycines
  Homolog annotation: Hit_ID=AAL78223.1; Match level="QueryCoverage =96%, HitCoverage=77%, E-value=1e-101, Identity=98%"; Hit description= hypothetical protein Hgg-29 [Heterodera glycines]
  Essential gene: C elegans homolog=ZC373.5; Phenotype=Unc
  Coding regions on vcDNA: vcDNA=SeqID_47885; Strand=+; Position=16-594
MRDLFIEDNSPITPARLAELIRHFYALGWMRDNGGGMAVLCNGAVFGSPTSVQKEKVSENDLFVIDATTGTVLKRPQNAASVPSATCGLLMNTGLNCVIHTHSKYANLVSQLVTGNEFAIQNQEMIQGVENRSSGLRLDNVDRLVVPIVDSELNEQMLSPVLLRTLDKYTEASAILVRGHRFFVFGSHCWQST

SEQ ID NO: 121463 - protein, 210 aa, Heterodera glycines
  Homolog annotation: Hit_ID=CAB62552.1; Match level="QueryCoverage =100%, HitCoverage=92%, E-value=1e-111, Identity=98%"; Hit description=vacuolar ATPase subunit E [Heterodera schachtii] sp|Q9U1G5|VATE_HETSC Vacuolar ATP synthase subunit E (V
  Gene Ontology: Mol. function=hydrogen-transporting ATPase activity, rotational mechanism; Cellular component=vacuolar membrane (sensu Fungi); Biological process=proton transport
  Essential gene: C elegans homolog=C17H12.14; Phenotype=Emb,Lva
  Coding regions on vcDNA: vcDNA=SeqID_47886; Strand=+; Position=57-686
MGISDNDVQKQLRHMMAFIEQEANEKAEEIDAKAEEEFNIEKGKLVQQQRQKIMEYYEKKEKQVELQRKIQRSNMQNQSRLKCLKARDDHLKNVLEEARANLSKISADRERYPAILKGLLLQGLFQLLESKVVLRCRKKDEEMVARILPECLEEFQRTWGNRSEVKIDNEYFLSPESAGGVELLAKDGKIRVSSTLEARLDLIADKITPQ

SEQ ID NO: 121464 - protein, 140 aa, Heterodera glycines
  misc_feature (61)..(61): Xaa can be any naturally occurring amino acid
  Homolog annotation: Hit_ID=NP_499705.1; Match level="QueryCoverage =92%, HitCoverage=25%, E-value=5e-16, Identity=36%"; Hit description =cytochrome P450 precursor family member (3O113) [Caenorhabditis elegans] emb|CAB04113.1| Hypothetical pro
  Gene Ontology: Mol. function=oxidoreductase activity; Biological process=epoxygenase P450 pathway
  Essential gene: C elegans homolog=T10B9.4; Phenotype=Clr,Emb,Slu
  Coding regions on vcDNA: vcDNA=SeqID_47887; Strand=+; Position=1-420
SSKNGPAFSPLALIFLCSLFAFIVMMRKHRKYWSNRGISSSSPQLISGNFGSLNGNHLSMXQLMDWTRQYGKQYGVQYGWRNALVTPDPAMVHELLVTKFEYSHARNLSPIFGNWDTNKWISMFLATGGRRKRLRTIANP

SEQ ID NO: 121465 - protein, 179 aa, Heterodera glycines
  misc_feature (12)..(12): Xaa can be any naturally occurring amino acid
  Homolog annotation: Hit_ID=AAQ89579.1; Match level="QueryCoverage =98%, HitCoverage=26%, E-value=3e-93, Identity=97%"; Hit description =heat shock protein 70-C [Heterodera glycines] gb|AAM93256.1| heat shock protein 70-C [Heterodera glycines]
  Gene Ontology: Mol. function=Hsp70/Hsp90 organizing protein activity; Cellular component=endoplasmic reticulum lumen; Biological process =protein folding
  Essential gene: C elegans homolog=F43E2.8; Phenotype=Emb,Lva
  Coding regions on vcDNA: vcDNA=SeqID_47888; Strand=+; Position=9-544
MTGEPKTPSYVXFTPDSGERLIGDAAKNQLTLNPENTIFDAKRLIGREFTDKTVQDDMKLWPFKIYNKANKPHVQVKVGNEDKQFAAEEVSAMVLTKMKEIAESYLGHEVKNAVVTVPAYFNDAQRQTTKDAGTIAGLNVVRIINEPTAAAIAYGLDKKEGERNILVFDLGGGTFDVSL

SEQ ID NO: 121466 - protein, 228 aa, Heterodera glycines
  misc_feature (26)..(26): Xaa can be any naturally occurring amino acid
  misc_feature (28)..(28): Xaa can be any naturally occurring amino acid
  Homolog annotation: Hit_ID=NP_506486.1; Match level="QueryCoverage =96%, HitCoverage=25%, E-value=8e-28, Identity=33%"; Hit description =citron-like (105.0 kD) (5O516) [Caenorhabditis elegans] emb|CAB04720.1| Hypothetical protein T08G5.5 [Cae
  Essential gene: C elegans homolog=T08G5.5; Phenotype=Emb,Rup
  Coding regions on vcDNA: vcDNA=SeqID_47889; Strand=+; Position=8-691
MDDKETRPKTKGANESKRNLDREYGXCXFLKKECITAAIPYLEHVIYEWSDESPHFHGELLEQYVLRCNTLLGQFLHSLSSPSIGVPSFVAEDDELSILRRKLQYFLATDQHYSIESARDLIGEDQNLMEERAIIMGKLGQHLNALKIYTEILMDFNGAERHCQTYYDERNASTRNIFFDLFHYYIKGEMPQKEVIQVESDYEIRRKPNISEALKLFKRHPTKIDTVG

SEQ ID NO: 121467 - protein, 151 aa, Heterodera glycines
  Homolog annotation: Hit_ID=CAE75506.1; Match level="QueryCoverage =100%, HitCoverage=32%, E-value=4e-45, Identity=59%"; Hit description= Hypothetical protein CBG23516 [Caenorhabditis briggsae]
  Gene Ontology: Mol. function=GPI-anchor transamidase activity; Cellular component=integral to endoplasmic reticulum membrane; Biological process=embryogenesis and morphogenesis
  Essential gene: C elegans homolog=T28H10.3; Phenotype=Emb
  Coding regions on vcDNA: vcDNA=SeqID_47890; Strand=+; Position=3-455
PGGKDVYEGVKIDYSGTEVNPENFEAVLLGDEQRSEGKPVLKSTEKDKVFVYFSDHGAVGVIGFPAADLTVKQLTQTLKEMHAKKMYGELTFYLEACESGSMFDHTLAQSLKIYAVTAANGDESSWGCFCDTKFLPGNCLGDLFSVNWMQD

SEQ ID NO: 121468 - protein, 207 aa, Heterodera glycines
  Homolog annotation: Hit_ID=NP_493558.1; Match level="QueryCoverage =98%, HitCoverage=70%, E-value=1e-56, Identity=55%"; Hit description =proteasome Beta Subunit (31.2 kD) (pbs-5) [Caenorhabditis elegans] emb|CAB04567.1| Hypothetical protein K
  Gene Ontology: Mol. function=endopeptidase activity; Cellular component=proteasome core complex (sensu Eukarya); Biological process=embryonic cleavage
  Essential gene: C elegans homolog=K05C4.1; Phenotype=Emb
  Coding regions on vcDNA: vcDNA=SeqID_47891; Strand=+; Position=57-677
MFYHDLHDNENSHDKELKQLVQMDDLAIPKFVMPPLGIKPIFFVRKHFGPNSRLPMAQFLKGTTTLSFVYKPKTPQDKGGVIVAVDSRATGGTYISSKTVEKIIPINDQLVATMAGGAADCQYWTRVVSKYCNLFELREGTQISVAAASKYFANVMYDYRGQELGVHSMVCGVDKFGPSIYMVEAEGTRVKIDTICSLGSGMLHAMS

SEQ ID NO: 121469 - protein, 158 aa, Heterodera glycines
  Homolog annotation: Hit_ID=NP_492727.1; Match level="QueryCoverage =92%, HitCoverage=19%, E-value=4e-16, Identity=37%"; Hit description =polyadenylate-binding protein, PolyA Binding protein (71.6 kD) (pab -1) [Caenorhabditis elegans] emb|CAA21
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_47892; Strand=+; Position=14-490
MPGMGGGHQQQGMRYQGQPRGMQQQQQAQQPQIAYSSYPQQQSRGGIAPQMGGGASGGGATLATVITSSTHQEPLNTQLLTEANITAQKQMLGERLYAMVARCFRDGDVEKIGKITGMLLEMENAEIVLLLGDEEMLRLRVDEAATVLYQATGQKEAQ

SEQ ID NO: 121470 - protein, 122 aa, Heterodera glycines
  Homolog annotation: Hit_ID=NP_493394.1; Match level="QueryCoverage =97%, HitCoverage=67%, E-value=2e-31, Identity=59%"; Hit description =cytochrome c oxidase subunit IV (1O250) [Caenorhabditis elegans] emb|CAB63334.1| Hypothetical protein W09
  Gene Ontology: Biological process=positive regulation of growth rate
  Essential gene: C elegans homolog=W09C5.8; Phenotype=Age,Gro,Ste
  Coding regions on vcDNA: vcDNA=SeqID_47893; Strand=+; Position=38-403
LLRKLHFARLSSARSMTWWWGPEKNNGREVVGPTFHGDEFYQDRLDRWYPSIRFRKNDEVITPIRHKELGDWKKLSIEEKKLIYRYSFRQTLAEFEALTPYGYLTVTLFFSMLGLTILYASF

SEQ ID NO: 121471 - protein, 114 aa, Heterodera glycines
  misc_feature (43)..(43): Xaa can be any naturally occurring amino acid
  Homolog annotation: Hit_ID=NP_493252.2; Match level="QueryCoverage =99%, HitCoverage=4%, E-value=5e-29, Identity=58%"; Hit description =PAtterning Defective PAD-1, dopey, N-terminal (266.8 kD) (pad-1) [Caenorhabditis elegans]
  Gene Ontology: Biological process=development
  Essential gene: C elegans homolog=Y18D10A.13; Phenotype=Emb
  Coding regions on vcDNA: vcDNA=SeqID_47894; Strand=+; Position=2-341
TLPYLKVKSAKNVRLFLGHLQFLSSMSSYSYMRSEWKKNAMDXLLWDNSFFKMDFRALRQWLIVIDNLMTNDKTWFKELLTRITTSTSTTLSTLITSKEHEYDMRAHYLKRLAF

SEQ ID NO: 121472 - protein, 186 aa, Heterodera glycines
  misc_feature (19)..(19): Xaa can be any naturally occurring amino acid
  Homolog annotation: Hit_ID=CAE57680.1; Match level="QueryCoverage =98%, HitCoverage=34%, E-value=8e-72, Identity=72%"; Hit description =Hypothetical protein CBG00674 [Caenorhabditis briggsae]
  Gene Ontology: Mol. function=chaperone activity; Cellular component =actin filament; Biological process=cell organization and biogenesis
  Essential gene: C elegans homolog=K01C8.10; Phenotype=Emb,Lva,Ste
  Coding regions on vcDNA: vcDNA=SeqID_47895; Strand=+; Position=3-559
PVVVLAGSLLDAAEKLLAXGIHPTTISDSFQRAATFSEKVLEEMATPIDINDDDELVKLAMTSLNSKVVSQYSHLLAPMAVQAVKKLMSSPEDSSVNLKLIKVVKKLGETVEESQLIEGALIDQKSMGHGGPARVEKAKIGLIQFQISPPKPNMENQVVISDYAQMDRALKEERNYILELCKQIKK

SEQ ID NO: 121473 - protein, 198 aa, Heterodera glycines
  Homolog annotation: Hit_ID=CAE66968.1; Match level="QueryCoverage =93%, HitCoverage=30%, E-value=1e-31, Identity=39%"; Hit description =Hypothetical protein CBG12363 [Caenorhabditis briggsae]
  Gene Ontology: Mol. function=protein binding; Cellular component =lamin filament; Biological process=pronuclear envelope synthesis
  Essential gene: C elegans homolog=DY3.2; Phenotype=Emb
  Coding regions on vcDNA: vcDNA=SeqID_47896; Strand=+; Position=2-595
TIEEILRKRQVEMTSFSDEVEHRYQAKLQEQLQAMRDDFDNRIAQNRAEVDELYRNKLGEAAENANRNRDLAAKAREEAAMWRVRVQDLENSSKDHQGIVESLNRRVKDLEAALRRAHEDADIRIQQRDEQIEQLQKEIALMISDYQDLLDVKVQLDTELQAYQKMLEQEETRLHITPSTSPNTSVVGQNISTPNMVI

SEQ ID NO: 121474 - protein, 184 aa, Heterodera glycines
  Homolog annotation: Hit_ID=CAA79619.2; Match level="QueryCoverage =98%, HitCoverage=45%, E-value=4e-24, Identity=35%"; Hit description =Hypothetical protein F02A9.4b [Caenorhabditis elegans] sp|P34384|YLPD_CAEEL Hypothetical protein F02A9.4b
  Essential gene: C elegans homolog=F02A9.4b; Phenotype=Lva
  Coding regions on vcDNA: vcDNA=SeqID_47897; Strand=+; Position=1-555
WEDVLPFRHPFAVLGDYLRKWQGATDIEPRTIGSGAVMTATPFYEVAIYVDKQQIVGQSGGEFPWVALDLAAHNGLLRLWRVADHPRVFPFKFEEVYATRFEHAQQRNHRLSDVCGENTDLSLYTPEELARDPIDMVDMCNQYYTKIRPDVGIPLRRRQRHKFSRGTISRLSRRFLVKPTIFNI

SEQ ID NO: 121475 - protein, 198 aa, Heterodera glycines
  Homolog annotation: Hit_ID=AAL78223.1; Match level="QueryCoverage =100%, HitCoverage=82%, E-value=1e-103, Identity=96%"; Hit description=hypothetical protein Hgg-29 [Heterodera glycines]
  Essential gene: C elegans homolog=ZC373.5; Phenotype=Unc
  Coding regions on vcDNA: vcDNA=SeqID_47898; Strand=+; Position=12-605
MRDLFIEDNSPITPARLAELIRHFYALGWMRDNGGGMAVLCNGAVFGSPTSVQKEKVPENDLFVIDATTGTVLKRPQNAASVPSATCGLLMNTGLNCVIHTHSKYANLVSQLVTGNEFAIQNQEMIQGVENRSSGLRLDNVDRLVVPIVDSELNEQMLSPVLLRTLDKYTEASAILVRGHGFFVFGSHCWQSTKVMLE

SEQ ID NO: 121476 - protein, 199 aa, Heterodera glycines
  Homolog annotation: Hit_ID=CAE68954.1; Match level="QueryCoverage =94%, HitCoverage=74%, E-value=4e-50, Identity=51%"; Hit description =Hypothetical protein CBG14934 [Caenorhabditis briggsae]
  Gene Ontology: Mol. function=electron transporter activity; Cellular component=nucleus; Biological process=carbohydrate metabolism
  Essential gene: C elegans homolog=C01G12.5; Phenotype=Gro
  Coding regions on vcDNA: vcDNA=SeqID_47899; Strand=+; Position=34-630
MDFENGGRDTGASSGLGKATAVLFARNGYHLSLCGRNERALEGVASNCLAEGGLTREQVLTIIGDVCEEKTLQNIVKRTDESFGRIDVLVNCAGVIASGGAENTPTSVLDGLMNVNVKSMIRLSQLVVPYLEKTKGSIVNVSSIAGICAFPAVTYYCISKAAVDKFTECLSMELAPKGIRVNAVNPALIVTELHLRSGM

SEQ ID NO: 121477 - protein, 190 aa, Heterodera glycines
  Homolog annotation: Hit_ID=AAK28335.1; Match level="QueryCoverage =95%, HitCoverage=25%, E-value=2e-73, Identity=69%"; Hit description =glycogen synthase [Steinernema feltiae]
  Gene Ontology: Mol. function=glycogen (starch) synthase activity; Biological process=glycogen metabolism
  Essential gene: C elegans homolog=Y46G5A.31; Phenotype=Bmd,Emb,Lvl,Unc
  Coding regions on vcDNA: vcDNA=SeqID_47900; Strand=+; Position=66-635
MSDSGRSSIIRKSSSSKLIRQFAEMNIPTNGDEYLDRGESAKREKRFVFECAWEVVNKVGGIYTVLRTKAPISTDELGDQYYMMGPYVEERVRLEVEVLEPETANLKYTLDQMYDWGFRVVYGRWLIDGYPKVLLFDVGSAAWKLDTWKHELWEKCSIGVPFLDREANDCIIFGFLVAIFLKSFLDSSEN

SEQ ID NO: 121478 - protein, 186 aa, Heterodera glycines
  Homolog annotation: Hit_ID=CAE66017.1; Match level="QueryCoverage =95%, HitCoverage=25%, E-value=4e-29, Identity=37%"; Hit description =Hypothetical protein CBG11210 [Caenorhabditis briggsae]
  Gene Ontology: Mol. function=transcription co-activator activity; Cellular component=nucleus; Biological process=transcription from Pol II promoter
  Essential gene: C elegans homolog=ZK1127.9a; Phenotype=Ste
  Coding regions on vcDNA: vcDNA=SeqID_47901; Strand=+; Position=3-560
GFLKLMEEAKLHGKSTFASFSTKWVKDARFKAVEKMRDREAYFKDYVEELYKKEKEEKRKEREKAKDEFKALLSEQNDLRRNSIWAIVKKRLDKEARYKNKHLDSETRQRLFEEHVKDCPEPTEEEEEEAKRLAAESLEASNGKRRSDHDGVENGEKRKRKEPLTAEEKALEERKREVAEELGEHL

SEQ ID NO: 121479 - protein, 174 aa, Heterodera glycines
  misc_feature (102)..(102): Xaa can be any naturally occurring amino acid
  misc_feature (122)..(122): Xaa can be any naturally occurring amino acid
  misc_feature (146)..(146): Xaa can be any naturally occurring amino acid
  misc_feature (164)..(164): Xaa can be any naturally occurring amino acid
  Homolog annotation: Hit_ID=AAL78218.1; Match level="QueryCoverage =97%, HitCoverage=100%, E-value=3e-91, Identity=94%"; Hit description= histone Hgg-28 [Heterodera glycines]
  Essential gene: C elegans homolog=ZK131.1; Phenotype=Unclassified
  Coding regions on vcDNA: vcDNA=SeqID_47902; Strand=+; Position=68-589
MTDTANRQRRGRGERRTRVLLRDSAKKITKASILRLARRAGVARINARVYDEVRAALRSYLETIIRDAAIYCQHERRKTMKSRDVVHALKRQGNLMYGFEQXAQGGGGWIYLEPAPYDIFGXYYYCTYVCICLYCILLCRCYCTPXYPCSCDPLLLLSLCIDIXCIWYDKDWRF

SEQ ID NO: 121480 - protein, 198 aa, Heterodera glycines
  Homolog annotation: Hit_ID=NP_491519.1; Match level="QueryCoverage =91%, HitCoverage=93%, E-value=5e-39, Identity=39%"; Hit description =CHORD protein, with cysteine and histidine-rich domain, zinc-binding (36.0 kD) (chp-1) [Caenorhabditis el
  Gene Ontology: Biological process=mitotic spindle positioning and orientation
  Essential gene: C elegans homolog=Y110A7A.13; Phenotype=Pvl,Stp
  Coding regions on vcDNA: vcDNA=SeqID_47903; Strand=+; Position=45-638
MIPLNLQIAESALKVLQTKTPGGEIEQSATAGALCTNNTCKKVFTGPDIYSEECVFHPGNAVFHEGLKYWSCCGRKTTDFTTFLDQLGCTRGKHCWKKKEIVTNAREDWFQRGGQVHITIYCKGALPSETSAKSDGLTLEVTINGSTKRYELFGEIAPSESVVIISERKVEIVLKQVAKIGWTKLLKEQTTGLAQSSD

SEQ ID NO: 121481 - protein, 126 aa, Heterodera glycines
  Homolog annotation: Hit_ID=CAE56013.1; Match level="QueryCoverage =97%, HitCoverage=94%, E-value=3e-27, Identity=45%"; Hit description =Hypothetical protein CBG23568 [Caenorhabditis briggsae]
  Essential gene: C elegans homolog=T02H6.11; Phenotype=Age,Gro,Lva,Ste
  Coding regions on vcDNA: vcDNA=SeqID_47904; Strand=+; Position=129-509
MAKGVKFDHDNAFVRFCRYYLWHYCWSGRQYGLQFYDQAFEPHPVVQEALRRLRLKDPYQYDLRLQRILLASQLGSKNERLPKNMWTKWDDETFYLNPYFNEIEEEKLEREASTGMKPGYQLKEQI

SEQ ID NO: 121482 - protein, 120 aa, Heterodera glycines
  misc_feature (88)..(88): Xaa can be any naturally occurring amino acid
  misc_feature (98)..(98): Xaa can be any naturally occurring amino acid
  misc_feature (108)..(108): Xaa can be any naturally occurring amino acid
  Homolog annotation: Hit_ID=AAL78218.1; Match level="QueryCoverage =100%, HitCoverage=70%, E-value=4e-60, Identity=95%"; Hit description= histone Hgg-28 [Heterodera glycines]
  Essential gene: C elegans homolog=ZK131.1; Phenotype=Unclassified
  Coding regions on vcDNA: vcDNA=SeqID_47905; Strand=+; Position=3-362
RRTRVLLRDSAKKITKASILRLARRAGVARINARVYDEVRAALRSYLETIIRDAAIYCQHHRRKTMNSRDVVHALKRQGNLMYGFQQXAQGGGGWIYXEPAPYDIFGXYYYCTYVCICLY

SEQ ID NO: 121483 - protein, 105 aa, Heterodera glycines
  misc_feature (61)..(61): Xaa can be any naturally occurring amino acid
  Homolog annotation: Hit_ID=CAE58995.1; Match level="QueryCoverage =93%, HitCoverage=48%, E-value=2e-11, Identity=33%"; Hit description =Hypothetical protein CBG02268 [Caenorhabditis briggsae]
  Gene Ontology: Mol. function=glutathione transferase activity; Biological process=glutathione conjugation reaction
  Essential gene: C elegans homolog=R05F9.5a; Phenotype=Unclassified
  Coding regions on vcDNA: vcDNA=SeqID_47906; Strand=+; Position=2-320
PDLAPYLYVKMGFRQGYLDKLRAEVFEPGVKHILPLFEKLLKDLWSGYMLKSGLSMVDFLXQPSVFFTKLEPETINAFPELIKYVDRVHALPQLQQYLKQRPQDR

SEQ ID NO: 121484 - protein, 168 aa, Heterodera glycines
  Homolog annotation: Hit_ID=XP_416229.1; Match level="QueryCoverage =86%, HitCoverage=28%, E-value=8e-34, Identity=48%"; Hit description =PREDICTED: similar to Polymerase (RNA) III (DNA directed) polypeptide H [Gallus gallus]
  Gene Ontology: Mol. function=DNA-directed RNA polymerase activity; Cellular component=DNA-directed RNA polymerase III complex; Biological process=transcription from Pol III promoter
  Essential gene: C elegans homolog=ZK856.10; Phenotype=Lva
  Coding regions on vcDNA: vcDNA=SeqID_47907; Strand=+; Position=9-515
ALSFSKHTVKIEPTALGRDFTEALVERLNRQFANYVIPNVGLCITFYDFKKYGASYILPGDASTHTPVLFRYVVFQPMINEILEGNILRSNQEGITISMQFFSDITVAPDKLPAVSKFDESVQVWRWEYQNENGDITPFYMDPGKRVRFVIVFWYSNDLNFSIFSRVC

SEQ ID NO: 121485 - protein, 176 aa, Heterodera glycines
  misc_feature (8)..(8): Xaa can be any naturally occurring amino acid
  Homolog annotation: Hit_ID=AAK71499.1; Match level="QueryCoverage =98%, HitCoverage=97%, E-value=5e-68, Identity=73%"; Hit description =translationally controlled tumor protein-like protein [Wuchereria bancrofti] sp|Q962A2|TCTP_WUCBA Translat
  Essential gene: C elegans homolog=F25H2.11; Phenotype=Gro,Stp,Unc
  Coding regions on vcDNA: vcDNA=SeqID_47908; Strand=+; Position=1-530
LQDAFTDXELASDSFPMKLVDDLIYEFKGRHVVRKEGEITMSGANPSAEEIDEGTEEAVERGIDFVLNHRLQEMNCYENQATFKGYVKDFMKKIIEYMEKEQKSADEIAAFKKKIQAWVVSLLAKDRFKNLAFFIGENMAEGKGEGQVAIVEYRQENGEEVPTLMLIKEALIVEKC

SEQ ID NO: 121486 - protein, 212 aa, Heterodera glycines
  Homolog annotation: Hit_ID=XP_394536.1; Match level="QueryCoverage =93%, HitCoverage=48%, E-value=9e-50, Identity=47%"; Hit description =similar to ENSANGP00000012356 [Apis mellifera]
  Gene Ontology: Mol. function=cyclin-dependent protein kinase, intrinsic regulator activity; Cellular component=transcription factor complex; Biological process=cell cycle
  Essential gene: C elegans homolog=F43D2.1; Phenotype=Gro,Pvl,Rup,Unc
  Coding regions on vcDNA: vcDNA=SeqID_47909; Strand=+; Position=14-652
MNLKACPTLATATVFFHRFYMFHTFDEHHLHMTALACFFLAGKVEETPKKCKDFLTVARELYPHHFTAKVTPDDLMLMERVLLQTIRFDLHVEHPYTFLVQYAKGFRMDKEYMSKIVTNAWTFVNDSLGTTLCLLWEPEVIAIALLYMSFKMERMEEQQIGRTFHFDASTEWWNLYVQNLTVPMMDDICHKVLDSIAPANGEDAPMANGTKN

SEQ ID NO: 121487 - protein, 154 aa, Heterodera glycines
  Homolog annotation: Hit_ID=CAE73166.1; Match level="QueryCoverage =100%, HitCoverage=35%, E-value=3e-35, Identity=48%"; Hit description= Hypothetical protein CBG20562 [Caenorhabditis briggsae]
  Gene Ontology: Mol. function=GTPase activity; Cellular component =eukaryotic translation initiation factor 2B complex; Biological process=translational initiation
  Essential gene: C elegans homolog=C37C3.2a; Phenotype=Emb,Lva,Ste
  Coding regions on vcDNA: vcDNA=SeqID_47910; Strand=+; Position=2-466
YRNLLLRFCLKDEKAQRILLGGIEQLVQNNKDILMSKTAHIIKALYDNDICEEDVILAWGSKPSKKFADKEVVKEMIKVAQPVLKWLKEAEEGSDESEDDDLDVAFDDRSRDIGMTVEVEKGAKDGVTRVQNGQIATNGKMDDGNADDIDIDNI

SEQ ID NO: 121488 - protein, 186 aa, Heterodera glycines
  Homolog annotation: Hit_ID=AAR85527.1; Match level="QueryCoverage =100%, HitCoverage=73%, E-value=2e-46, Identity=50%"; Hit description= 14-3-3b protein [Meloidogyne incognita]
  Gene Ontology: Mol. function=protein kinase C inhibitor activity; Cellular component=cytoplasm; Biological process=regulation of mitosis
  Essential gene: C elegans homolog=M117.2; Phenotype=Emb
  Coding regions on vcDNA: vcDNA=SeqID_47911; Strand=+; Position=1-558
EKARRYDDMVEAMKKLIKLDPNLTLEERISLSTAYKGAMASRRTSWRALVSIEERTGASLSDAQQQVLENYREKVQNELVNTCQELLTCINEVLFPKASDVEQKVFYLKMKADYYRYISEVATDEDRSGVVELAKVAYQEAIDMAGDKIPATNPTRFGLALNLAVFNYEILNSVTEARKVIQTALD

SEQ ID NO: 121489 - protein, 179 aa, Heterodera glycines
  misc_feature (29)..(29): Xaa can be any naturally occurring amino acid
  Homolog annotation: Hit_ID=AAP30833.1; Match level="QueryCoverage =100%, HitCoverage=73%, E-value=1e-101, Identity=97%"; Hit description=putative gland protein G8A07; Hg-G8A07 [Heterodera glycines]
  Gene Ontology: Cellular component=mitochondrion
  Essential gene: C elegans homolog=T26C5.3a; Phenotype=Emb
  Coding regions on vcDNA: vcDNA=SeqID_47912; Strand=+; Position=3-541
FLWAYPYRLVMSLALALLVYWTPSFREPXGEYPYFYYAIWIGAYYLQQVSSYCIFLSMMAFNAQISDPKIGGTYMTLLNTLNNLGGNWPVTLSLSITDFFNRKNCVAKGTKIVLGVCTSKHDEELCKAGGDACEFVIDGYYISVAICVVVGLLWYRIFYRRIKYFQKIPRQDWRVIKTK

SEQ ID NO: 121490 - protein, 166 aa, Heterodera glycines
  misc_feature (27)..(27): Xaa can be any naturally occurring amino acid
  Homolog annotation: Hit_ID=XP_317466.1; Match level="QueryCoverage =92%, HitCoverage=96%, E-value=2e-43, Identity=59%"; Hit description =ENSANGP00000012302 [Anopheles gambiae] gb|EAA12435.2| ENSANGP00000012302 [Anopheles gambiae str. PEST]
  Gene Ontology: Biological process=cell cycle
  Essential gene: C elegans homolog=H06I04.4a; Phenotype=Ste
  Coding regions on vcDNA: vcDNA=SeqID_47913; Strand=+; Position=4-543
ALHLTKTFNQTEKMFVKTFSNKTVVLXVDPTELSVEQLKALIAEEEEIAVPDQRLVFAGCQLVDGTLLRTYGVDADSTIHLDLRLLGGGKKRKKKQYTGPKKQKHVRKKVKLAVLKLYKVIDDNGKIHRQRLECNSASCGAGIFMAKHKDGRFYCGKCHQTLKEKK

SEQ ID NO: 121491 - protein, 160 aa, Heterodera glycines
  Homolog annotation: Hit_ID=XP_516761.1; Match level="QueryCoverage =78%, HitCoverage=6%, E-value=2e-15, Identity=35%"; Hit description =PREDICTED: similar to topoisomerase (DNA) II binding protein 1 [Pan troglodytes]
  Gene Ontology: Mol. function=protein C-terminus binding; Cellular component=nucleus; Biological process=DNA replication and chromosome cycle
  Essential gene: C elegans homolog=F37D6.1; Phenotype=Unc
  Coding regions on vcDNA: vcDNA=SeqID_47914; Strand=+; Position=13-495
MRPRIREIKEARRRKLPVLLPSWVFAANSMDRRLKDTLNVITSEKHLDTHKTPLFAGCEITVSGFPGADRVDIGRLVELHGGVFTGQMNRSSCTHLIAATNSGEKFRKAREWGTVWVVTSRWLRKCIETGYRLSESRFAHSHDEDTQQRVSPSFSLITKK

SEQ ID NO: 121492 - protein, 219 aa, Heterodera glycines
  misc_feature (21)..(21): Xaa can be any naturally occurring amino acid
  Homolog annotation: Hit_ID=CAF90706.1; Match level="QueryCoverage =96%, HitCoverage=86%, E-value=3e-84, Identity=68%"; Hit description =unnamed protein product [Tetraodon nigroviridis]
  Gene Ontology: Mol. function=structural constituent of ribosome; Cellular component=eukaryotic 48S initiation complex; Biological process=protein biosynthesis
  Essential gene: C elegans homolog=F56F3.5; Phenotype=Emb,Ste
  Coding regions on vcDNA: vcDNA=SeqID_47915; Strand=+; Position=2-656
YGCRTEQKMGKKGAKKKAVDXPFTRKEWYDIKAPAMFTHRNVGKTLVNRTQGTRISSDFRKFRLICEEVQGKICLTNFRGMTFTRDKLCSIVKKWHTLIEANVAVKTTDGFLLRLFCIGFTKRNANQIKKTSYAKTSQVRMIRAKMVEIMQKEVSSGDLKEVVNKLIPDSIGKDIEKACSFYYPLQDVYIRKVNVLKKPKFELGKLLEMHGEGAGTVAT

SEQ ID NO: 121493 - protein, 199 aa, Heterodera glycines
  Homolog annotation: Hit_ID=CAE72716.1; Match level="QueryCoverage =96%, HitCoverage=70%, E-value=2e-57, Identity=54%"; Hit description =Hypothetical protein CBG19953 [Caenorhabditis briggsae]
  Gene Ontology: Mol. function=transferase activity, transferring groups other than amino-acyl groups; Cellular component=integral to membrane; Biological process=fatty acid elongation
  Essential gene: C elegans homolog=F41H10.8; Phenotype=Gro
  Coding regions on vcDNA: vcDNA=SeqID_47916; Strand=+; Position=1-597
PSAAELSPPNTFLGVSLASPFDYAAAREYTAYTQGPDIWITTAYVVTIFGIQWYMKDRKPMQLTLSLRLWNLWLAMFSTAGCLVTSYALLREIGTYGLVSSYTNCRDFFEGFTGLWTWWFCMSKFAELGDTYFIVLRKKPLMFLHWYHHVATLNYGLMSYVDNTAFNTWIVWLNFSVHAVMYTYYFLAACRIRLPAWFA

SEQ ID NO: 121494 - protein, 162 aa, Heterodera glycines
  Homolog annotation: Hit_ID=CAE70953.1; Match level="QueryCoverage =88%, HitCoverage=46%, E-value=2e-24, Identity=44%"; Hit description =Hypothetical protein CBG17764 [Caenorhabditis briggsae]
  Gene Ontology: Mol. function=cyclin-dependent protein kinase activity; Cellular component=nucleus; Biological process=regulation of CDK activity
  Essential gene: C elegans homolog=Y49F6B.1; Phenotype =Dpy,Emb,Gro,Pvl,Rup,Stp
  Coding regions on vcDNA: vcDNA=SeqID_47917; Strand=+; Position=2-487
ETILTLEPDVMLKLNYNLTVHTPYRPFEGHLIEMKTKIGRQLSEIEFDLESIRPMSSEFLKNSLLSDAMFLYSPSQIALAAVKFGMDKALGEVRSSTLMVDFLAALLDVDIGDAGGRRTADILQLEKLQVRLDQICKLVLQQFAQGVSAEESASLQIKKKQK

SEQ ID NO: 121495 - protein, 160 aa, Heterodera glycines
  misc_feature (24)..(24): Xaa can be any naturally occurring amino acid
  Homolog annotation: Hit_ID=EAA05425.2; Match level="QueryCoverage =93%, HitCoverage=98%, E-value=3e-78, Identity=98%"; Hit description =ENSANGP00000012700 [Anopheles gambiae str. PEST]
  Gene Ontology: Mol. function=calcium ion binding
  Essential gene: C elegans homolog=T21H3.3; Phenotype=Emb,Ste
  Coding regions on vcDNA: vcDNA=SeqID_47918; Strand=+; Position=2-483
PLSYSYTELHKMADQLTEEQIAEXKEAFSLFDKDGDGTITTKELGTVMRSLGQNPTEAELQDMINEVDADGNGTIDFPGFLTMMARKMKDTDSEEEIREAFRVFDKDGNGFISAAELRHVMTNLGEKLTDEEVDEMIREADIDGDGQVNYEEFVTMMTTK

SEQ ID NO: 121496 - protein, 173 aa, Heterodera glycines
  Homolog annotation: Hit_ID=NP_494883.1; Match level="QueryCoverage =94%, HitCoverage=78%, E-value=3e-33, Identity=49%"; Hit description =glutathione S-Transferase (23.0 kD) (gst-7) [Caenorhabditis elegans] gb|AAB37846.1| Glutathione s-transfe
  Gene Ontology: Mol. function=glutathione transferase activity; Biological process=glutathione conjugation reaction
  Essential gene: C elegans homolog=R05F9.5a; Phenotype=Unclassified
  Coding regions on vcDNA: vcDNA=SeqID_47919; Strand=+; Position=81-599
MVQYKLYYFDGRGLGESIRLLLHYVGQPFEDIRIKDVEEWEKTYKPKFFYGKVPVLEVDGKPLGQSATILRYLAEKFGLAGKDECEKAKANEIIDFQKDANTDLAPYLYVKMGFRQGDLDKLRGEVFEPGVKHILPLFEKLLKESGSGYMLKSGLSMVDFQVANFLYTFTKLE

SEQ ID NO: 121497 - protein, 216 aa, Heterodera glycines
  Homolog annotation: Hit_ID=AAK67238.1; Match level="QueryCoverage =77%, HitCoverage=72%, E-value=9e-71, Identity=73%"; Hit description =Hmg protein 1.2, isoform c [Caenorhabditis elegans]
  Gene Ontology: Mol. function=DNA bending activity; Cellular component= nucleus; Biological process=development
  Essential gene: C elegans homolog=F47D12.4a; Phenotype =Emb,Gro,Pvl,Sma,Stp
  Coding regions on vcDNA: vcDNA=SeqID_47920; Strand=+; Position=33-680
MHGIQQHHSERPLVRGKTSPYGFFVKMCYEEHKKKYPNECVQVTEISKKCSQKWKTMTDDEKKRFFELAQKDAERYQAEVAAYGGEDVLKRKKRAKKDPNAPKRALSAFFFFSNEKRQEVSGEHPEWKVGQIAQELGVRWKALSDEERAIYEKKAQEDKERYAEEMRAYRNDSALSSGTCQKPSYLEGGPSMTTAEHVLQSQGGAHVVSTSAGGQP

SEQ ID NO: 121498 - protein, 192 aa, Heterodera glycines
  Homolog annotation: Hit_ID=AAB88449.1; Match level="QueryCoverage =88%, HitCoverage=57%, E-value=1e-65, Identity=41%"; Hit description =polyadenylate binding protein [Petromyzon marinus]
  Gene Ontology: Mol. function=poly(A) binding; Cellular component =cytoplasm; Biological process=mRNA metabolism
  Essential gene: C elegans homolog=Y106G6H.2a; Phenotype=Gro,Stp
  Coding regions on vcDNA: vcDNA=SeqID_47921; Strand=+; Position=50-625
MAQLAVAAPLPPTTNATAATATPAAPSYPMASLYVGDLHPEVTESLLFEKFSVVGPVLSIHVCRDAISRRSLGYAYVNFQQTSDAEKALNSMNFDCVLGKQIRIMWSQRDPSIRRSGSGNIFIKNLDKDIDTKNFFSTFSAFGRILSCKVATDSDGKSKGYGFIHYASEDDANKAIEKINGIHVDGKTVFAG

SEQ ID NO: 121499 - protein, 192 aa, Heterodera glycines
  Homolog annotation: Hit_ID=NP_497728.1; Match level="QueryCoverage =100%, HitCoverage=42%, E-value=1e-108, Identity=98%"; Hit description=BENzimidazole resistant BEN-1, beta-tubulin, Tubulin, Beta (ben-1) [Caenorhabditis elegans] pir||T20194
  Gene Ontology: Mol. function=MHC class I protein binding; Cellular component=tubulin; Biological process=embryogenesis and morphogenesis
  Essential gene: C elegans homolog=C36E8.5; Phenotype=Emb
  Coding regions on vcDNA: vcDNA=SeqID_47922; Strand=+; Position=3-578
LFRPDNFAFGQSGAGNNWAKGHYTEGAELVDNVLDVVRKKAEGCDCLQGFQLTHSLGGGTGSGMGTLLISKIREEYPDRIMSSFSVVPSPKVSDTVVEPYNATLSVHQLVENTDETFCIDNEALYDICFRTLKLQNPTYGDLNHLVSVTMSGVTTCLRFPGQLNADLRKLAVNMVPFPRLHFFMPGFAPLSA

SEQ ID NO: 121500 - protein, 211 aa, Heterodera glycines
  Homolog annotation: Hit_ID=NP_651209.1; Match level="QueryCoverage =91%, HitCoverage=45%, E-value=1e-31, Identity=39%"; Hit description =CG5429-PA [Drosophila melanogaster] gb|AAF56227.1| CG5429-PA [Drosophila melanogaster] gb|AAL28972.1| LD3
  Gene Ontology: Cellular component=cytoplasmic vesicle; Biological process=anti-apoptosis
  Essential gene: C elegans homolog=T19E7.3; Phenotype=Gro,Unc
  Coding regions on vcDNA: vcDNA=SeqID_47923; Strand=+; Position=3-635
EKECIQYKKSLDHLLRRRADCPFDVEASRIKLDALKSEERDLLEQLTLLEDEERTLLHELDTKQEERKKIGERDEQLYRQLRDNHSILIEQSDEQRSFKLQINQANEQIRRLSRMNVLDLVFHIWVDGEYGTISGFRLGRLRHDQVEWSEINAALGQTAFLLKVIAERLGLDFVGYELVPCGSTSLIRILPKNGGTTTASSTTAPAAHAVE

SEQ ID NO: 121501 - protein, 185 aa, Heterodera glycines
  Homolog annotation: Hit_ID=XP_319798.1; Match level="QueryCoverage =84%, HitCoverage=33%, E-value=2e-19, Identity=33%"; Hit description =ENSANGP00000005197 [Anopheles gambiae]
  Essential gene: C elegans homolog=B0280.9; Phenotype=Lva
  Coding regions on vcDNA: vcDNA=SeqID_47924; Strand=+; Position=2-559
TFRGGENVVDFCFAPFNRQILYSLAVGGAVNTFDLARCTGQDTFFDQGCVRATCLSCSPSGQFIACGSNTGIVNVYDLTKLSPSLAKSNAPRPVRMFDQLTTLVSFVRFNNDSQMLAFGSAVKRMSGRVANCSSGSVFQNFPAKQEHFASDKFTTCDFSPNSAFFSFGTKQGKMRLYQLHHSDVY

SEQ ID NO: 121502 - protein, 203 aa, Heterodera glycines
  misc_feature (21)..(21): Xaa can be any naturally occurring amino acid
  misc_feature (203)..(203): Xaa can be any naturally occurring amino acid
  Homolog annotation: Hit_ID=CAE56141.1; Match level="QueryCoverage =99%, HitCoverage=17%, E-value=1e-93, Identity=76%"; Hit description =Hypothetical protein CBG23754 [Caenorhabditis briggsae]
  Gene Ontology: Mol. function=isoleucine-tRNA ligase activity; Cellular component=cytosol; Biological process=protein biosynthesis
  Essential gene: C elegans homolog=R11A8.6; Phenotype=Emb,Gro,Stp
  Coding regions on vcDNA: vcDNA=SeqID_47925; Strand=+; Position=3-612
LVDRHMTHNEETYWVPSFVEXRFANWLRDARDWCVSRNRFWGTPINLWVSDDFQEMECPGSIDELERLTGTKVTDLHRENIDHLQIPSKTGHGMLKRVTEVFDCWFESGSMPYAQQHYPFENSEVFEHNFPADFIAEGIDQTRGWFYTLLVISTALFGRPPFKNLVCNGLVLASDGSKMSKSKKNFPNPLDVVRKYGADALRX

SEQ ID NO: 121503 - protein, 233 aa, Heterodera glycines
  misc_feature (38)..(38): Xaa can be any naturally occurring amino acid
  misc_feature (129)..(129): Xaa can be any naturally occurring amino acid
  Homolog annotation: Hit_ID=AAR09171.1; Match level="QueryCoverage =100%, HitCoverage=63%, E-value=1e-125, Identity=95%"; Hit description=aldolase [Heterodera glycines]
  Gene Ontology: Mol. function=fructose-bisphosphate aldolase activity; Biological process=fructose metabolism
  Essential gene: C elegans homolog=F01F1.12a; Phenotype=Gro,Unc
  Coding regions on vcDNA: vcDNA=SeqID_47926; Strand=+; Position=11-707
PGKGFSLLTEPGSIGKRFDTIGLENTENNRRRYRQLLXTTPSFGQNLSGVILFDETFRQSTDNGVRFVDVIKKAGAVAGIKVDTGVVPLAGTLDEGTTQGLDKLSDRCAEYKKGGCDFAKWRCVLNIGXHKPSHLALMENANVLARYASICQQNGLVPIVEPEVLCDGDHSLERCQKVTELTLAYTYKALANHHIYLEGTLLKPNMVTPGQSHSPNATPDQIGLATVTALRRS

SEQ ID NO: 121504 - protein, 171 aa, Heterodera glycines
  Homolog annotation: Hit_ID=NP_741371.2; Match level="QueryCoverage =95%, HitCoverage=61%, E-value=7e-50, Identity=57%"; Hit description =ribosomal protein L7Ae/L30e/S12e/Gadd45 (30.2 kD) (4F154) [Caenorhabditis elegans] gb|AAK84600.1| Ribosom
  Gene Ontology: Mol. function=structural constituent of ribosome; Cellular component=cytosolic large ribosomal subunit (sensu Eukarya); Biological process=protein biosynthesis
  Essential gene: C elegans homolog=Y24D9A.4a; Phenotype=Ste
  Coding regions on vcDNA: vcDNA=SeqID_47927; Strand=+; Position=1-516
TLLNCLQYRPETRQAKKERLRQRAQDRADGKQEKLTKRPPVVHFGIKDVVKAVENKKASLVVIAHDVDPIEIVICLPAICRKFGVPYAIVKGKAFLGQVVYRKTTSAVCLCDVNPEDRNALKNLAGVAVTNFNERGDELRKNWGGAIMSQRSQARQAKIEKARQKDVGQKV

SEQ ID NO: 121505 - protein, 189 aa, Heterodera glycines
  misc_feature (18)..(18): Xaa can be any naturally occurring amino acid
  Homolog annotation: Hit_ID=NP_001004234.1; Match level="QueryCoverage= 100%, HitCoverage=38%, E-value=1e-47, Identity=49%"; Hit description =similar to Recql protein [Rattus norvegicus] gb|AAH79377.1| Similar to Recql protein [Rattus norvegic
  Essential gene: C elegans homolog=C26D10.3; Phenotype=Lvl
  Coding regions on vcDNA: vcDNA=SeqID_47928; Strand=+; Position=3-573
GCDLIVDARGVVPTLTMXSDCPELSLAEDYGILVNEQMRTNIEDVFAAGDVCTANWTAKSPHWKQIRLWTQARQMGLFCARCMLIDNVLLDIAFELFTHVTSFFGFKVILLGDFSGERLEKPFEKNYRITEGCEYVKVLTKDHRVHGAVLVGETDLEGAVENLILNQTDIGQIEQVFLDPDFDLEDFFD

SEQ ID NO: 121506 - protein, 201 aa, Heterodera glycines
  Homolog annotation: Hit_ID=NP_497663.1; Match level="QueryCoverage =100%, HitCoverage=45%, E-value=1e-105, Identity=90%"; Hit description=MEChanosensory abnormality MEC-12, TuBulin, Alpha, specific of 15 protofilament microtubules found in m
  Gene Ontology: Mol. function=GTP binding; Cellular component =microtubule; Biological process=spindle assembly
  Essential gene: C elegans homolog=F26E4.8; Phenotype=Emb
  Coding regions on vcDNA: vcDNA=SeqID_47929; Strand=+; Position=57-659
MREVISIHVGQAGVQIGNACWELYCLEHGIQPDGKMPSDQNNQDDSFSTFFSETGNGRHVPRAVMVDLEPTVIDEIRTGTYKHLFHPEQLITGKGDAANNYARGHYTVGKEIIDPVLDRIRRIADNCTGLQGFLIFHSFGGGTGSGFTSLLMERLSVDYGKKSKLEFSIYPAPQVSTAVVEPYNSVLTTHTTLEHSDCAFM

SEQ ID NO: 121507 - protein, 179 aa, Heterodera glycines
  misc_feature (62)..(62): Xaa can be any naturally occurring amino acid
  Homolog annotation: Hit_ID=AAM81355.1; Match level="QueryCoverage =97%, HitCoverage=45%, E-value=2e-61, Identity=60%"; Hit description =heat shock protein 40 [Steinernema feltiae]
  Gene Ontology: Mol. function=heat shock protein activity; Cellular component=cytosol; Biological process=protein folding
  Essential gene: C elegans homolog=F39B2.10; Phenotype=Emb,Spd
  Coding regions on vcDNA: vcDNA=SeqID_47930; Strand=+; Position=22-557
KTDQVRDTVHQLTVSLGKLYNGCTKHLRITRHILCPKCNGVGGAKEGVKQCENCRGRGLEIXNMQIGPGMIQRIQRACSECGGEGEINRNPCKHCGGKKRIKSEETIEVHIEKGMRDGQRLMFYGKGDQQPGLEPGNVIIVLDEEEHPVFTRRGTNLTLSMKLTLTEALCGCTKHVVTL

SEQ ID NO: 121508 - protein, 165 aa, Heterodera glycines
  Homolog annotation: Hit_ID=NP_501167.1; Match level="QueryCoverage =99%, HitCoverage=77%, E-value=2e-61, Identity=71%"; Hit description =ribosomal Protein, Small subunit (23.8 kD) (rps-8) [Caenorhabditis elegans] gb|AAA81485.1| Ribosomal prot
  Gene Ontology: Cellular component=eukaryotic 48S initiation complex; Biological process=protein biosynthesis
  Essential gene: C elegans homolog=F42C5.8; Phenotype=Lva,Ste
  Coding regions on vcDNA: vcDNA=SeqID_47931; Strand=+; Position=1-498
ARCRGGNIKHRGLRLDTGNFAWASEGCTRKTRIIDTMYNASNNELVRTKTLVKGMIVSIDAIPFRQWYEAHYALPLARKKGQKLTEDEEARIGGAQKRSKSTLKKYTERQKTAGVEPHLLEQFQAGRLLACISSRPGQSGRCDGYILEGKELEFYNKKLKAKKAK

SEQ ID NO: 121509 - protein, 221 aa, Heterodera glycines
  misc_feature (9)..(9): Xaa can be any naturally occurring amino acid
  Homolog annotation: Hit_ID=NP_509400.2; Match level="QueryCoverage =54%, HitCoverage=7%, E-value=5e-14, Identity=38%"; Hit description =regucalcin gene promotor region related protein (XI911) [Caenorhabditis elegans]
  Gene Ontology: Biological process=regulation of protein activity, epigenetic
  Essential gene: C elegans homolog=ZK512.5; Phenotype=Emb
  Coding regions on vcDNA: vcDNA=SeqID_47932; Strand=+; Position=3-664
LGLALAQRXFNSAADFCFLAVNLLYGFDCFQEQQSDENHRRTIRLISATLPDDGANSFLTRFGWSILDYQATELFDFALQLANPNSPTLLSKSHYYAKVRLQYAQLLDELGGFKHAVELYRLENSNHSKTPSPPPLVPSVHKTKLAHLKRQDHEPTPAVAPAPPTFLPVQLQSASKEDHAPTPFAVAPASHTFQPVQSASTQGQEPTAFAVAPASQTFLPV

SEQ ID NO: 121510 - protein, 152 aa, Heterodera glycines
  Homolog annotation: Hit_ID=NP_493761.1; Match level="QueryCoverage =99%, HitCoverage=40%, E-value=6e-40, Identity=54%"; Hit description =cdc37 (42.7 kD) (2A868) [Caenorhabditis elegans] gb|AAC71172.1| Hypothetical protein W08F4.8 [Caenorhabdi
  Gene Ontology: Mol. function=protein binding; Cellular component =cytoplasm; Biological process=protein targeting
  Essential gene: C elegans homolog=W08F4.8; Phenotype =Emb,Gro,Pvl,Rup,Stp,Unc
  Coding regions on vcDNA: vcDNA=SeqID_47933; Strand=+; Position=8-466
YELELAKSLHAMATNTNVIKNFFKKIRIAEQNYMKMFTDEVEAFKDRLRKRARDKREAMLSETEVEEKKKRVAQSPGGLDPQEVFDSLPAEMQEAFETQSMAKIFEVAKSMDSEVFKYHLDRCTASGLWIPNAKEAEGHGQEEEEKKETEEK

SEQ ID NO: 121511 - protein, 174 aa, Heterodera glycines
  Homolog annotation: Hit_ID=CAE72664.1; Match level="QueryCoverage =86%, HitCoverage=28%, E-value=6e-15, Identity=32%"; Hit description =Hypothetical protein CBG19878 [Caenorhabditis briggsae]
  Gene Ontology: Biological process=embryogenesis and morphogenesis
  Essential gene: C elegans homolog=C55C3.5; Phenotype=Emb
  Coding regions on vcDNA: vcDNA=SeqID_47934; Strand=+; Position=104-628
RTSQYDHRRRLHPDKIHNRIAAEVENPTIGESGQKKTAIDLTLSLAVQLIPQVRDGIFHTQLNLKERKIDMKNKTAFPKQMKPVVEELLQDMIKDDVWPAVKRGIEPLIYVKGVELPANCGVDPKSAQLHFGHRKIGASAKLNIKEISLSHCVEQFKSKLPDPATLFKINGTSF

SEQ ID NO: 121512 - protein, 173 aa, Heterodera glycines
  Homolog annotation: Hit_ID=CAE69213.1; Match level="QueryCoverage =78%, HitCoverage=24%, E-value=3e-12, Identity=29%"; Hit description =Hypothetical protein CBG15253 [Caenorhabditis briggsae]
  Essential gene: C elegans homolog=W06E11.1; Phenotype=Lva
  Coding regions on vcDNA: vcDNA=SeqID_47935; Strand=+; Position=39-557
QEYTPSSSALFSPPPSASAPSSAIKGGSDLTSDEMFTGEGFSQQGLLNYAVGFFKKGRLFLLPVDKTFEMRKPLRGTIERESTARTTALKPSSSVSSTSTRSVAADSAPSGTASASSSSVAVAAPLRIRFARAENDLQRRRREQSSFYKQKLVEQDQWIPLKVEHRDLLEMYE

SEQ ID NO: 121513 - protein, 174 aa, Heterodera glycines
  misc_feature (25)..(25): Xaa can be any naturally occurring amino acid
  Homolog annotation: Hit_ID=NP_510260.1; Match level="QueryCoverage =98%, HitCoverage=43%, E-value=3e-53, Identity=46%"; Hit description =PolyA Binding protein (76.0 kD) (pab-2) [Caenorhabditis elegans] emb|CAA90444.1| Hypothetical protein F18
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_47936; Strand=+; Position=2-522
CKVNGMLLDGKKVFVGKFLPRSARXQQIGDPSSRFTNVYVKNFGDAMNSEKLSELFSQFGEIISAKVMEDDSGKSKGFGFVAYKDHESAARAVEKMNEVSVPGSEKVEQKFTVCRAQKKSERQAELKRRYEQYKAERIQRYQGVNLYVKNLHDTINDETLRSNFESYGNITSAN

SEQ ID NO: 121514 - protein, 126 aa, Heterodera glycines; identical to SEQ ID NO: 121481
  Homolog annotation: Hit_ID=CAE56013.1; Match level="QueryCoverage =97%, HitCoverage=94%, E-value=3e-27, Identity=45%"; Hit description =Hypothetical protein CBG23568 [Caenorhabditis briggsae]
  Essential gene: C elegans homolog=T02H6.11; Phenotype=Age,Gro,Lva,Ste
  Coding regions on vcDNA: vcDNA=SeqID_47937; Strand=+; Position=95-475

SEQ ID NO: 121515 - protein, 186 aa, Heterodera glycines
  Homolog annotation: Hit_ID=CAE61909.1; Match level="QueryCoverage =87%, HitCoverage=18%, E-value=5e-58, Identity=64%"; Hit description =Hypothetical protein CBG05905 [Caenorhabditis briggsae]
  Gene Ontology: Mol. function=aminopeptidase activity; Cellular component=cytosol
  Essential gene: C elegans homolog=F49E8.3; Phenotype=Emb
  Coding regions on vcDNA: vcDNA=SeqID_47938; Strand=+; Position=2-559
KKPFDHKQLLTLFCRRSLHFWFGNLVTMKWWSDLWLKEGFASFTQYLFTDKNYPEFKIWSDFVDAEVVRAMALDSLRSTHPIEVPIDNPNELEEIYDSITYAKSNSIIRMLFNHLGEATFQKAIRDYLKKHQYANAETNDLWKSLSDASGIDVKALMSSWTQQMGFPLVTVEEKILDGDRIELHLK

SEQ ID NO: 121516 - protein, 154 aa, Heterodera glycines
  misc_feature (66)..(66): Xaa can be any naturally occurring amino acid
  Homolog annotation: Hit_ID=CAE63933.1; Match level="QueryCoverage =94%, HitCoverage=78%, E-value=5e-60, Identity=76%"; Hit description =Hypothetical protein CBG08510 [Caenorhabditis briggsae]
  Gene Ontology: Mol. function=structural constituent of ribosome; Cellular component=cytosolic large ribosomal subunit (sensu Eukarya); Biological process=protein biosynthesis
  Essential gene: C elegans homolog=Y48G8AL.8a; Phenotype=Emb,Lva
  Coding regions on vcDNA: vcDNA=SeqID_47939; Strand=+; Position=3-466
MRRRVPSTMPLKRAIRFLENVREKKEIVPFRHFNGGVGRKAQAQAWGTTQGRWPKKSAEFLLQLLXNAESNAEVKGLDVDHLVIDHIVVQAAAKMRRRTYRAHGRINPYMSSPCHIEVILTEKKDVVAKPAGALVKVKKESKKKQRRQLARGEF

SEQ ID NO: 121517 - protein, 248 aa, Heterodera glycines
  misc_feature (63)..(63): Xaa can be any naturally occurring amino acid
  misc_feature (231)..(231): Xaa can be any naturally occurring amino acid
  Homolog annotation: Hit_ID=AAA93233.1; Match level="QueryCoverage =100%, HitCoverage=46%, E-value=1e-100, Identity=73%"; Hit description=CCT-2
  Gene Ontology: Mol. function=chaperone activity; Cellular component =cytoplasm; Biological process=regulation of cell cycle
  Essential gene: C elegans homolog=T21B10.7; Phenotype=Emb,Lva,Ste
  Coding regions on vcDNA: vcDNA=SeqID_47940; Strand=+; Position=2-744
KILIANSPMDQDKIKVFGSRIRVDSVAKIAELEQAEKDKMKQKVENICNHGINVFINRQLIYXYPEQLFADRKVMAIEHADFEGIERLALVLGGEIASTFDSPSEVKLGSCKLIEEVTVGEDTLLRFSGVPLGNACSVVLRGSTQQIIDEAERSLHDALCVLSTHVKDQRVVPGAGASEMLMAMAVMGESQKVAGKESIAMEAFARALAKLPTIICDNAGLDSAEIISHVXAEHSKWNRQFGIDVENG

SEQ ID NO: 121518 - protein, 172 aa, Heterodera glycines
  misc_feature (156)..(156): Xaa can be any naturally occurring amino acid
  Homolog annotation: Hit_ID=CAE61909.1; Match level="QueryCoverage =98%, HitCoverage=19%, E-value=1e-57, Identity=62%"; Hit description =Hypothetical protein CBG05905 [Caenorhabditis briggsae]
  Gene Ontology: Mol. function=aminopeptidase activity; Cellular component=cytosol
  Essential gene: C elegans homolog=F49E8.3; Phenotype=Emb
  Coding regions on vcDNA: vcDNA=SeqID_47941; Strand=+; Position=33-548
LCIVARSLHFWFGNLVTMKWWSDLWLKEGFASFTQYLFTDKNYPEFKIWSDFVDAEVVRAMALDSLRSTHPIEVPIDNPNELEEIYDSITYAKSNSIIRMLFNHLGEATFQKAIRDYLKKHQYANAETNDLWKSLSDASGIDVKALMSSWTQQMGXPLVTVEEKILDGDRIE

SEQ ID NO: 121519 - protein, 209 aa, Heterodera glycines
  Homolog annotation: Hit_ID=CAE70892.1; Match level="QueryCoverage =96%, HitCoverage=48%, E-value=1e-31, Identity=40%"; Hit description =Hypothetical protein CBG17683 [Caenorhabditis briggsae]
  Gene Ontology: Biological process=growth
  Essential gene: C elegans homolog=T14A8.1; Phenotype=Unclassified
  Coding regions on vcDNA: vcDNA=SeqID_47942; Strand=+; Position=2-628
TRRGVAQWKLCLVGAAIFLCFALLYPSVFSPMLSNLFGGGTQRQQPAAADRPMHPSMMGPNQQQQQQRERAHRPPPHHPGASMRMPDMHNQQQQQQQGGFWSGKSGGSMAWMLPFYTVGVVCFLLYTLFKSKTKRQKRRRDRPLDLLYGDDDDDEGTEDGLEYGVRGAKLRSVQHRLRKTEQAMADILSQLEQISAHSKDINDDDTKAA

SEQ ID NO: 121520 - protein, 215 aa, Heterodera glycines
  Homolog annotation: Hit_ID=S65469; Match level="QueryCoverage=100%, HitCoverage=28%, E-value=6e-83, Identity=71%"; Hit description=DNA topoisomerase (EC 5.99.1.2) - Caenorhabditis elegans
  Gene Ontology: Mol. function=DNA topoisomerase type I activity; Cellular component=nucleus; Biological process=chromatin assembly/disassembly
  Essential gene: C elegans homolog=M01E5.5a; Phenotype=Lva,Unc
  Coding regions on vcDNA: vcDNA=SeqID_47943; Strand=+; Position=1-645
DDMDDLKYVVEFDFLGKDSIRYYNRVPVEKQVFKNLKLFMEEKDPGDDLFDRLDTSSLNQYLNELMDGLTAKVFRTYNASITLQEQLDKLTNPSDSVHEKMLSYNRANRQVAILCNHQRAVPKTHEKSMENLENKIKEKKQEYKELKDQLKKIKSVDEKMAKKYERLKEQIAKLNTQRTDKDENKQIALGTSKLNYLDPRISVAWCKKNDVPVEK

SEQ ID NO: 121521 - protein, 211 aa, Heterodera glycines
  Homolog annotation: Hit_ID=CAE66826.1; Match level="QueryCoverage =100%, HitCoverage=4%, E-value=8e-88, Identity=77%"; Hit description =Hypothetical protein CBG12193 [Caenorhabditis briggsae]
  Gene Ontology: Mol. function=dynein ATPase activity; Cellular component=cytoplasmic dynein complex; Biological process=mitotic spindle assembly
  Essential gene: C elegans homolog=T21E12.4; Phenotype=Emb
  Coding regions on vcDNA: vcDNA=SeqID_47944; Strand=+; Position=8-666
MPKDELCTENAIMLRRFNRFPLIIDPSGQSIEFICKEFSQHLARNIKREDRFNDNSFRKNLESALRFGTTLLVQDVESYDPILNPVLNREVKRTDGRVLITIGDQDIDLSPAFKIFLFTRDSSVEFPADVCSRVTFVNFTITRASLEAQCLHQVLRSERPDIDKKRNDLLKLQGEFAVRLRHLEKALLNALNECKGKILDDDSVIATLEKL

SEQ ID NO: 121522 - protein, 132 aa, Heterodera glycines
  misc_feature (69)..(69): Xaa can be any naturally occurring amino acid
  Homolog annotation: Hit_ID=CAE69864.1; Match level="QueryCoverage =87%, HitCoverage=27%, E-value=9e-22, Identity=44%"; Hit description =Hypothetical protein CBG16195 [Caenorhabditis briggsae]
  Gene Ontology: Cellular component=mitochondrion
  Essential gene: C elegans homolog=T24C4.1; Phenotype=Stp
  Coding regions on vcDNA: vcDNA=SeqID_47945; Strand=+; Position=4-399
MILSSLDCSSRHFATASAAAKWGPAVEPIQEKTTLLPNGLSVASVELQGPISQLMFAFRSGARFEQHDXAGLTHQLRNAIGTDSINYLGVRLLWVTGQSGATLQAKLSKDLMLVHMSVPRTMSPVAISVLGD

SEQ ID NO: 121523 - protein, 179 aa, Heterodera glycines
  Homolog annotation: Hit_ID=AAH77170.1; Match level="QueryCoverage =98%, HitCoverage=19%, E-value=2e-44, Identity=49%"; Hit description =ESG protein [Xenopus laevis]
  Gene Ontology: Mol. function=ATP binding; Cellular component=nucleus; Biological process=signal transduction
  Essential gene: C elegans homolog=W02D3.9; Phenotype=Emb
  Coding regions on vcDNA: vcDNA=SeqID_47946; Strand=+; Position=57-593
FAHGDVVCAVTMARNGRHVFTGGKGAVKMWDIGERIGLASSVGGSISPSSSTIADGTNGRVGSAEPWTPVNTFPCLKDSYVRSCKLFPDASTLIVGGETRTICVWDLNSEKVKAMLDCDAEACYALAISADCRLCFACCSSGSIVIWDLQSEQKVAQLDGHTDGASCVDLNGDGLRLWT

SEQ ID NO: 121524 - protein, 216 aa, Heterodera glycines
  Homolog annotation: Hit_ID=AAO14563.2; Match level="QueryCoverage =100%, HitCoverage=29%, E-value=1e-117, Identity=98%"; Hit description=Hsp90 [Heterodera glycines]
  Gene Ontology: Biological process=reproduction
  Essential gene: C elegans homolog=C47E8.5; Phenotype=Emb,Ste
  Coding regions on vcDNA: vcDNA=SeqID_47947; Strand=+; Position=2-652
YMVDPIDEYCVQQLKEYDGKKLVSVTKEGLELPESEEEKKKFEEDKVKFEKLCKVIKDILDKKVQKVSVSNRLVSSPCCIVTGEYGWSANMERIMKAQALRDSSTMGYMASKKNLEINPDHSIIKSLRDRVEKEQDDKTAKDLVVLLYETSLLTSGFSLEDPQQHASRIYRMVKLGLDIPDEEEPAEQQPSTSGEPTIAEKIAGAEDDASRMDEVD

SEQ ID NO: 121525 - protein, 122 aa, Heterodera glycines
  misc_feature (61)..(61): Xaa can be any naturally occurring amino acid
  Homolog annotation: Hit_ID=NP_506579.1; Match level="QueryCoverage =84%, HitCoverage=18%, E-value=2e-34, Identity=69%"; Hit description =dihydrolipoamide S-acetyltransferase (53.5 kD) (5O926) [Caenorhabditis elegans] emb|CAB01163.1| Hypotheti
  Gene Ontology: Mol. function=dihydrolipoamide S-acetyltransferase activity; Cellular component=pyruvate dehydrogenase complex (sensu Eukarya); Biological process=acetyl-CoA biosynthesis from pyruvate
  Essential gene: C elegans homolog=F23B12.5; Phenotype=Emb,Gro
  Coding regions on vcDNA: vcDNA=SeqID_47948; Strand=+; Position=2-369
KLQPHEFQGGTFTVSNLGMFGSVDHFTAIINPPQSCILAIGSARRMLVPMEEEDKSDFSNXFRAFSSLKVTLSCDHRVVDGAVGAVWLQNFKQFMEEPFTMILWGTPGNVFLIVSPHSRPNY

SEQ ID NO: 121526 - protein, 216 aa, Heterodera glycines
  Homolog annotation: Hit_ID=CAE64961.1; Match level="QueryCoverage =72%, HitCoverage=65%, E-value=2e-40, Identity=50%"; Hit description =Hypothetical protein CBG09795 [Caenorhabditis briggsae]
  Gene Ontology: Mol. function=chaperone activity; Cellular component =mitochondrion; Biological process=mitochondrial translocation
  Essential gene: C elegans homolog=C34C12.8; Phenotype=Lva
  Coding regions on vcDNA: vcDNA=SeqID_47949; Strand=+; Position=43-693
MTSRILSCNLRRYFSKMNQHIEFGTTKSASSDKQSPPSPTNNQTQHEGMSQECREQIEQMERLKSDNEMLTDKYKRTLADMENLRKRTQRQIEEAKLFAIQPFCKDLLEVADVLDLALNSLEKMKTEDGAASLDSGVNKGIKMTKEVLLKTFKKHGLVPVQPEGQKFDPNLHEAVYEIPKDQSDRPAGHIAHVLNIGYSLHDRPIRPAKVGVVKME

SEQ ID NO: 121527 - protein, 119 aa, Heterodera glycines; identical to SEQ ID NO: 121249
  Homolog annotation: Hit_ID=AAN32889.1; Match level="QueryCoverage =100%, HitCoverage=100%, E-value=4e-62, Identity=100%"; Hit description=ubiquitin extension protein [Heterodera glycines]
  Gene Ontology: Biological process=cell cycle
  Essential gene: C elegans homolog=F25B5.4a; Phenotype=Emb
  Coding regions on vcDNA: vcDNA=SeqID_47950; Strand=+; Position=85-444

SEQ ID NO: 121528 - protein, 221 aa, Heterodera glycines
  Homolog annotation: Hit_ID=AAQ89579.1; Match level="QueryCoverage =100%, HitCoverage=33%, E-value=1e-122, Identity=99%"; Hit description=heat shock protein 70-C [Heterodera glycines] gb|AAM93256.1| heat shock protein 70-C [Heterodera glycine
  Gene Ontology: Mol. function=Hsp70/Hsp90 organizing protein activity; Cellular component=endoplasmic reticulum lumen; Biological process =SRP-dependent cotranslational membrane targeting, translocation
  Essential gene: C elegans homolog=C15H9.6; Phenotype=Dpy,Lva
  Coding regions on vcDNA: vcDNA=SeqID_47951; Strand=+; Position=2-664
VGGVMTKLIPRNTVIPTKKSQIFSTAADNQPTVTIQVFEGERPMTKDNHLLGKFDLTGIPPAPRGVPQIEVTFEIDVNGILHVTAEDKGTGNKNKITITNDHNRLSPEEIERMINDAEKFAEEDKKTKEVVEARNEFESYAYSLKNQLGDSEKLGGKLSAEDKTTIEGAVDEAISWLDSNKDAPPEELKERKKDLEAKVQPIISKLYAGQSPPPGSEPPPT

SEQ ID NO: 121529 - protein, 208 aa, Heterodera glycines
  Homolog annotation: Hit_ID=CAE56899.1; Match level="QueryCoverage =94%, HitCoverage=50%, E-value=4e-59, Identity=55%"; Hit description =Hypothetical protein CBG24740 [Caenorhabditis briggsae]
  Gene Ontology: Mol. function=acetyl-CoA C-acetyltransferase activity; Cellular component=mitochondrion; Biological process=lipid metabolism
  Essential gene: C elegans homolog=T02G5.7; Phenotype=Bmd,Unc
  Coding regions on vcDNA: vcDNA=SeqID_47952; Strand=+; Position=49-672
MSSPPSSVLPQDVFILSAVRTPIASFRSSFASLNAVDLGTFVATEAIQRAGLRPDQVEETVTGCVLSAGSGQNVSRQIAIKSGIPEARQAYTVNKVCSSSLKALILGTQSVQLGQRSMVLVVGVESMSQAPFYLARGDNNYGDIKLLDSIQRDGISDAMLGQPMGVCAEKTVAEFGFTREQHDAYALASYARATRAWAGGAFGAEIVP

SEQ ID NO: 121530 - protein, 119 aa, Heterodera glycines
  Homolog annotation: Hit_ID=AAN32889.1; Match level="QueryCoverage =100%, HitCoverage=100%, E-value=1e-60, Identity=97%"; Hit description=ubiquitin extension protein [Heterodera glycines]
  Gene Ontology: Biological process=cell cycle
  Essential gene: C elegans homolog=F25B5.4a; Phenotype=Emb
  Coding regions on vcDNA: vcDNA=SeqID_47953; Strand=+; Position=98-457
MNHFGLTFLFVAVSLLVIAPGCDGMQIFVKTLTGKTITLEVESSDTVDNVKTKIQEKEGVPPDQQRLIFAGKQLEDGRTLADYNIQKESTLHLVLRLRGGNGKRNTSKNKKSNKKLDQN

SEQ ID NO: 121531 - protein, 189 aa, Heterodera glycines
  Homolog annotation: Hit_ID=AAH54266.1; Match level="QueryCoverage =100%, HitCoverage=89%, E-value=1e-75, Identity=72%"; Hit description= Rps8-prov protein [Xenopus laevis] sp|Q7SYU0|RS8_XENLA 40S ribosomal protein S8
  Gene Ontology: Cellular component=eukaryotic 48S initiation complex; Biological process=protein biosynthesis
  Essential gene: C elegans homolog=F42C5.8; Phenotype=Lva,Ste
  Coding regions on vcDNA: vcDNA=SeqID_47954; Strand=+; Position=3-569
SQDRWHKRRKTGGKRNPIHKKRKFEMGRPAANTKIGPKRIHLVRCRGGNIKHRGLRLDTGNFAWASEGCTRKTRIIDTMYNASNNELVRTKTLVKGMIVSIDAIPFRQWYEAHYALPLARKKGQKLTEDEEARIGGAQKRSKSTLKKYTERQKTAGVEPHLLEQFQAGRLLACISSRPGQSGRCDGYIL

SEQ ID NO: 121532 - protein, 181 aa, Heterodera glycines
  Homolog annotation: Hit_ID=CAA70694.1; Match level="QueryCoverage =90%, HitCoverage=46%, E-value=3e-88, Identity=100%"; Hit description= cathepsin S-like cysteine proteinase [Heterodera glycines]
  Gene Ontology: Mol. function=cathepsin K activity; Cellular component= lysosome; Biological process=proteolysis and peptidolysis
  Essential gene: C elegans homolog=T03E6.7; Phenotype=Emb,Gro,Unc
  Coding regions on vcDNA: vcDNA=SeqID_47955; Strand=+; Position=2-544
IPKTDKKNRRSSPVSPPSNSPISLLAVSLAVLAFVALASANPPTARETAPNAQQNNANSVATGEIAKNIAEKMERMNEFIKAKKFIDAHNLAFEKGEVSFKVAPNHLMHFTPAQYNRIRGLQMRSNRQRHNMATLAGNSSTLPEKLDWREKGAVTEVKDQGDCGSCWAFSATGAIEGALAQ

SEQ ID NO: 121533 - protein, 189 aa, Heterodera glycines
  Homolog annotation: Hit_ID=NP_957146.1; Match level="QueryCoverage =98%, HitCoverage=95%, E-value=2e-84, Identity=83%"; Hit description =40S ribosomal protein S9 [Danio rerio] gb|AAH62833.1| 40S ribosomal protein S9 [Danio rerio] gb|AAH59492.
  Gene Ontology: Mol. function=structural constituent of ribosome; Cellular component=cytosolic small ribosomal subunit (sensu Eukarya); Biological process=protein biosynthesis
  Essential gene: C elegans homolog=F40F8.10; Phenotype=Emb,Lva,Ste
  Coding regions on vcDNA: vcDNA=SeqID_47956; Strand=+; Position=3-572
IKNVYSKVYDVPRRPFEKERLDQELKLIGEFGLRNKREVWRVKLSLAKIRKRARELLTLEDKDPKRLFEGNALLRRLVRIGVLEEDKMKLDYVLGLRVEDFMERRLQTQVFKLGLAKSIHQARVFIRQRHIRVRRQVVNIPSFAVRLDSQKHIDLSAKSPYAGGRPGRVKRKNAKKGAGGGGSGGEEED

SEQ ID NO: 121534 - protein, 193 aa, Heterodera glycines
  Homolog annotation: Hit_ID=CAE67904.1; Match level="QueryCoverage =95%, HitCoverage=60%, E-value=8e-59, Identity=57%"; Hit description =Hypothetical protein CBG13501 [Caenorhabditis briggsae]
  Gene Ontology: Mol. function=purine-nucleoside phosphorylase activity; Biological process=DNA modification
  Essential gene: C elegans homolog=K02D7.1; Phenotype=Unc
  Coding regions on vcDNA: vcDNA=SeqID_47957; Strand=+; Position=128-706
MPTAANDCNNNSIEDIQSDRRRGPIDPTNFDHLVRLSELIRSMADLGTLQPEFGIICGSGLGAIADQMEGARILPFSEVPGFPQPSVIGHKGNLAFGRIGGHFCMCLQGRFHPYEHKMDMALCTMPVRLMAFLGVRTMIVSNAAGALNGDFQTGDLMVIKDHIFLPGLSGYSPLLGISDPRFGSRFVSLHNAY

SEQ ID NO: 121535 - protein, 193 aa, Heterodera glycines
  Homolog annotation: Hit_ID=NP_498349.1; Match level="QueryCoverage =97%, HitCoverage=76%, E-value=4e-86, Identity=83%"; Hit description =ribosomal Protein, Small subunit (27.3 kD) (rps-3) [Caenorhabditis elegans] gb|AAF99870.1| Ribosomal prot
  Gene Ontology: Mol. function=structural constituent of ribosome; Cellular component=eukaryotic 48S initiation complex; Biological process=protein biosynthesis
  Essential gene: C elegans homolog=C23G10.3; Phenotype=Emb
  Coding regions on vcDNA: vcDNA=SeqID_47958; Strand=+; Position=2-580
NGQQQAITKKRKAVQAGIFKAELNNFLMKELAEDGYSGVEVRRAPSRTEVIIMATRTQSVLGERGKRIRELTALVQKRFGYSAGQIELYAEKVSSRGLCAVAQCESLRYKLVGGLAVRRACYGVLRFIMESNARGCEIVVSGKLRGQRAKAMKFVDGVMIHSGNPVTEYIQEAVRHVQMRQGVLGIKVKIMLP

SEQ ID NO: 121536 - protein, 203 aa, Heterodera glycines
  Homolog annotation: Hit_ID=NP_496011.1; Match level="QueryCoverage =76%, HitCoverage=27%, E-value=4e-15, Identity=32%"; Hit description =glutathione synthetase (55.4 kD) (2J706) [Caenorhabditis elegans] emb|CAB01655.1| Hypothetical protein M1
  Essential gene: C elegans homolog=M176.2; Phenotype=Emb,Lva
  Coding regions on vcDNA: vcDNA=SeqID_47959; Strand=+; Position=1-609
PFLILFFLGIDLQKFVNSAFTQDTEEKYCVENIESDEKVLMERIRDAKDWALTNGLTFPVPRRKLKCDACDKINENVVLDDMAQFVPFTLYPSPFPRELFDQAMDVNKTLLLMYFRASLPSNFEFLKELHKSVLAVSPSLRSTADLIERKHKEGIRQPLMLICIRADYMASEEIDEKSNEKKYALKQIELNGGSIGGYGTPQP

SEQ ID NO: 121537 - protein, 182 aa, Heterodera glycines
  Homolog annotation: Hit_ID=XP_522178.1; Match level="QueryCoverage =100%, HitCoverage=16%, E-value=1e-63, Identity=67%"; Hit description= PREDICTED: similar to beta isoform of regulatory subunit A, protein phosphatase 2 isoform b; protein pho
  Gene Ontology: Mol. function=protein phosphatase type 2A activity; Cellular component=shmoo tip; Biological process=cell organization and biogenesis
  Essential gene: C elegans homolog=F48E8.5; Phenotype=Emb
  Coding regions on vcDNA: vcDNA=SeqID_47960; Strand=+; Position=3-548
DTIYDEDEVLCGMWPNNSGNFTPLVGGPEYVHCLLPPLENLANIEETVVRDKAVESLQKIAEKHSAAQLEEYFIPMVLRLSAGDWFTSRTSACGLFSVAYARANPAQKTELRAAFRCLCRDDTPMVRRAAASKLGDFAKVQEEDYLKNEITQMFEDLAKDEQDSVRLLSVEAGIVIVGLLSE

SEQ ID NO: 121538 - protein, 198 aa, Heterodera glycines
  Homolog annotation: Hit_ID=CAB59358.1; Match level="QueryCoverage =100%, HitCoverage=42%, E-value=1e-97, Identity=88%"; Hit description= translation elongation factor eEF-1 alpha chain [Anisakis simplex]
  Gene Ontology: Mol. function=translation factor activity, nucleic acid binding; Biological process=protein biosynthesis
  Essential gene: C elegans homolog=R03G5.1a; Phenotype=Emb,Lva,Unc
  Coding regions on vcDNA: vcDNA=SeqID_47961; Strand=+; Position=1-597
ETGVLKPGMVVTFAPQGISTEVKSVEMHHESLPEALPGDNVGFNVKNISVKDIRRGSVASDSKNDPAKETKSFTAQVIIMNHPGQIAAGYTPVLDCHTAHIACKFAELKEKVDRRSGKKVEDNPKALKTGDAGIVDLIPTKPMCVEAFTDYAPLGRFAVRDMRQTVAVGVIKAVEKTEGGGKVTKSAQKAAAPGGKKK

SEQ ID NO: 121539 - protein, 198 aa, Heterodera glycines
  Homolog annotation: Hit_ID=AAK94490.1; Match level="QueryCoverage =75%, HitCoverage=14%, E-value=3e-15, Identity=32%"; Hit description =PAZ/Piwi domain protein [Heterodera glycines]
  Gene Ontology: Biological process=gametogenesis
  Essential gene: C elegans homolog=F55A12.1; Phenotype=Emb
  Coding regions on vcDNA: vcDNA=SeqID_47962; Strand=+; Position=12-605
DEPEVDGNASTIEQYFNNKYGRRLDYPNLPLIAMNSRFANEKRVNYYPIEVLDIIDNQRVTTQQQTPTMIQQSIKKCAIPPLVFKRQVHNTAKSIHLWDSEYLDEAGIKLTTEPIALRAHQLNHPEVKAGDGNMQRPMVEGSAAWRINSALVPQSVFADGTYSWMLACFVQLGGRGLSEPDLHKFIQLLEDQAKRRSL

SEQ ID NO: 121540 - protein, 225 aa, Heterodera glycines
  Homolog annotation: Hit_ID=NP_491237.1; Match level="QueryCoverage =76%, HitCoverage=55%, E-value=5e-52, Identity=54%"; Hit description =protein phosphatase 1A (34.6 kD) (1E406) [Caenorhabditis elegans] gb|AAB42233.1| Yeast glc seven-like pho
  Gene Ontology: Mol. function=protein serine/threonine phosphatase activity; Cellular component=cytoplasm; Biological process=protein amino acid dephosphorylation
  Essential gene: C elegans homolog=W09C3.6; Phenotype=Ste
  Coding regions on vcDNA: vcDNA=SeqID_47963; Strand=+; Position=55-729
MAKEEYCFDAKAAAAAGQSRRPSTTASVLVQGDGQSSRFVDAIIRKVTQPPLQRFTDEITDEELKQLCKAATDVFRMQPTLVRIRPPVVVVGDIHGQFSDLQRIFTTHGPPPEQQYMFLGDYVDRGAHSMETIILLFCYKIKYPSNFMLLRGNHECSNINKAYGFYEEIDRRYPRPGARRLFDLFNQVFAWMPFVGLIGEKILCMHGGISDKMRSLDQLSTLRRH

SEQ ID NO: 121541 - protein, 242 aa, Heterodera glycines
  misc_feature (217)..(217): Xaa can be any naturally occurring amino acid
  Homolog annotation: Hit_ID=CAE59830.1; Match level="QueryCoverage =96%, HitCoverage=52%, E-value=5e-73, Identity=58%"; Hit description =Hypothetical protein CBG03302 [Caenorhabditis briggsae]
  Gene Ontology: Mol. function=dolichyl-diphospho-oligosaccharide -protein glycosyltransferase activity; Cellular component=endoplasmic reticulum; Biological process=protein modification
  Essential gene: C elegans homolog=T09A5.11; Phenotype=Emb,Lva
  Coding regions on vcDNA: vcDNA=SeqID_47964; Strand=+; Position=1-725
TCFGHRSHTTIAVPNAQLIKAPLITGESALLAPVLYRGIALVADELGPLQMILMTASSTAYSHNPNKTVEEHPSAVGKSTILLGALQARNNARVILSGSLDFFSNKFFTATVNQAGGHTANAVKSGNQQLAASVLKWLLKESGVLRIKSVKHHTVGQKSPPAEYTIMDDVRYEIGIEELQNGKWVPFQGKDVQLEFVRIDPFVRVTLKNNNGKFSAXIKIPDVYGVYKFLVDYHRIGYTHLT

SEQ ID NO: 121542 - protein, 202 aa, Heterodera glycines
  misc_feature (13)..(13): Xaa can be any naturally occurring amino acid
  Homolog annotation: Hit_ID=NP_493639.1; Match level="QueryCoverage =99%, HitCoverage=46%, E-value=2e-24, Identity=35%"; Hit description =RNA U transporter 1 (2A320) [Caenorhabditis elegans] gb|AAB70323.1| Hypothetical protein F23F1.5 [Caenorh
  Gene Ontology: Mol. function=RNA cap binding; Cellular component =nuclear pore
  Essential gene: C elegans homolog=F23F1.5; Phenotype=Emb,Lva,Unc
  Coding regions on vcDNA: vcDNA=SeqID_47965; Strand=+; Position=3-607
MLMFSDWLVDIPXTLSTEWTMLPSPVGRRTLVVANRGETRVYFKNGHLATNFHSLLPGGNAKTKGSLTILDAIFDAKKRKLYLLDLLWWNKLLYTDMEFTARRFFLQSRIDEMNEDIERKNSRASISKNQERNGCKIAEQDKMSSSEISPYEMSPPSDTSPEQNAVEPKSRRDIKFVPVPSCACSPDEIGQFMRTLFPFRLD

SEQ ID NO: 121543 - protein, 232 aa, Heterodera glycines
  Homolog annotation: Hit_ID=BAA22203.1; Match level="QueryCoverage =100%, HitCoverage=51%, E-value=1e-125, Identity=93%"; Hit description=alpha-3 tubulin [Caenorhabditis elegans]
  Gene Ontology: Mol. function=GTP binding; Cellular component =microtubule; Biological process=microtubule-based process
  Essential gene: C elegans homolog=C47B2.3; Phenotype=Emb
  Coding regions on vcDNA: vcDNA=SeqID_47966; Strand=+; Position=1-696
AFSTFFSETGNGRHVPRAVMVDLEPTVIDEIRTGTYKHLFHPEQLITGKEDAANNYARGHYTVGKEIIDPVLDRIRRIADNCTGLQGFLIFHSFGGGTGSGFTSLLMERLSVDYGKKSKLEFSIYPAPQVSTAVVEPYNSVLTTHTTLEHSDCAFMVDNEAIYDICRRNLDVERPSYTNLNRLISQVVSSITASLRFDGALNVDLTEFQTNLVPYPRIHFPLATYSPVISAE

SEQ ID NO: 121544 - protein, 197 aa, Heterodera glycines
  Homolog annotation: Hit_ID=CAB65088.1; Match level="QueryCoverage =89%, HitCoverage=29%, E-value=2e-28, Identity=41%"; Hit description =poly-(ADP-ribose) polymerase II [Homo sapiens]
  Gene Ontology: Mol. function=ATP binding; Cellular component=nucleus; Biological process=base-excision repair
  Essential gene: C elegans homolog=E02H1.4; Phenotype=Stp
  Coding regions on vcDNA: vcDNA=SeqID_47967; Strand=+; Position=9-599
MDKKMKEMEQKTTKTKRRKKEKDTENGGTNREKPKDSEKENLDGRISKRNKMQSEEATVDAECAELRGNAKVFVDGKGRCYDVMLSQTNIQQNNNKFYLIQLLCNQTAANKFWVWFRWGRVGFKGQTNLVPFGTDFDGALELFHRKFTDKTQNDFLTDIKKFKKVAGKYDLIKIDHSREVTTETERDAKVRRKVAKT

SEQ ID NO: 121545 - protein, 168 aa, Heterodera glycines
  Homolog annotation: Hit_ID=AAH54266.1; Match level="QueryCoverage =100%, HitCoverage=79%, E-value=8e-66, Identity=72%"; Hit description= Rps8-prov protein [Xenopus laevis] sp|Q7SYU0|RS8_XENLA 40S ribosomal protein S8
  Gene Ontology: Cellular component=eukaryotic 48S initiation complex; Biological process=protein biosynthesis
  Essential gene: C elegans homolog=F42C5.8; Phenotype=Lva,Ste
  Coding regions on vcDNA: vcDNA=SeqID_47968; Strand=+; Position=47-550
MGISQDRWHKRRKTGGKRNPIHKKRKFEMGRPAANTKIGPKRIHLVRCRGGNIKHRGLRLDTGNFAWASEGCTRKTRIIDTMYNASNNELVRTKTLVKGMIVSIDAIPFRQWYEAHYALPLARKKGQKLTEDEEARIGGAQKRSKSTLKKYTERQKTAGVEPHLLEQF

SEQ ID NO: 121546 - protein, 152 aa, Heterodera glycines
  misc_feature (140)..(140): Xaa can be any naturally occurring amino acid
  Homolog annotation: Hit_ID=CAH04322.1; Match level="QueryCoverage =98%, HitCoverage=77%, E-value=3e-65, Identity=82%"; Hit description =S9e ribosomal protein [Meladema coriacea]
  Gene Ontology: Mol. function=structural constituent of ribosome; Cellular component=cytosolic small ribosomal subunit (sensu Eukarya); Biological process=protein biosynthesis
  Essential gene: C elegans homolog=F40F8.10; Phenotype=Emb,Lva,Ste
  Coding regions on vcDNA: vcDNA=SeqID_47969; Strand=+; Position=3-458
MVGRIKNVYSKVYDVPRRPFEKERLDQELKLIGEFGLRNKREVWRVKLSLAKIRKRARELLTLEDNDPKRLFEGNALLRRLVRIGVLEEDKMKLDYVLGLRVEDFMERRLQTQVFKLGLAKSIHQARVFIRQRHIRVRRXVVNIPSFAVRLD

SEQ ID NO: 121547 - protein, 81 aa, Heterodera glycines
  misc_feature (19)..(19): Xaa can be any naturally occurring amino acid
  Homolog annotation: Hit_ID=CAE70384.1; Match level="QueryCoverage =100%, HitCoverage=9%, E-value=5e-33, Identity=85%"; Hit description =Hypothetical protein CBG16945 [Caenorhabditis briggsae]
  Gene Ontology: Mol. function=translation elongation factor activity; Biological process=protein biosynthesis
  Essential gene: C elegans homolog=F25H5.4; Phenotype=Emb,Lva
  Coding regions on vcDNA: vcDNA=SeqID_47970; Strand=+; Position=2-245
QPVLLLSTMDRALLELSLXEELFQTFQRIVENINVIIATYGDDDGPMGPIQVDPSIGNVGFGSGLHGRAFTLKQFAEMYAD

SEQ ID NO: 121548 - protein, 159 aa, Heterodera glycines
  misc_feature (132)..(132): Xaa can be any naturally occurring amino acid
  Homolog annotation: Hit_ID=CAE67904.1; Match level="QueryCoverage =94%, HitCoverage=49%, E-value=2e-41, Identity=52%"; Hit description =Hypothetical protein CBG13501 [Caenorhabditis briggsae]
  Gene Ontology: Mol. function=purine-nucleoside phosphorylase activity; Biological process=DNA modification
  Essential gene: C elegans homolog=K02D7.1; Phenotype=Unc
  Coding regions on vcDNA: vcDNA=SeqID_47971; Strand=+; Position=153-629
MPTAANDCNNNSIEYIQSDRRRGPIDPTNFDHLVRLSELIRSMADLGTLQPEFGIICGSGLGAIADQMEGARILPFSEVPGFPQPSVIGHKGNLAFGRIGGHFCLCLQGRFHPYEHKMDMALCTMPVRLMAXLGVRTMIVSNAAGALNGDFQTGDLMVI

SEQ ID NO: 121549 - protein, 122 aa, Heterodera glycines
  misc_feature (21)..(21): Xaa can be any naturally occurring amino acid
  Homolog annotation: Hit_ID=NP_498349.1; Match level="QueryCoverage =100%, HitCoverage=48%, E-value=9e-47, Identity=78%"; Hit description= ribosomal Protein, Small subunit (27.3 kD) (rps-3) [Caenorhabditis elegans] gb|AAF99870.1| Ribosomal pro
  Gene Ontology: Mol. function=structural constituent of ribosome; Cellular component=cytosolic small ribosomal subunit (sensu Eukarya); Biological process=protein biosynthesis
  Essential gene: C elegans homolog=C23G10.3; Phenotype=Emb
  Coding regions on vcDNA: vcDNA=SeqID_47972; Strand=+; Position=14-377
MAQQQAITKKRKAVQAGIFKXAELNNFLMKELAEDGYSGVEVRRAPSRTEVIIMATRTQSVLGERGKRIRELTALVQKRFGYSAGQIELYAEKVFSRGLCAVAQCELLRYKLVGGLAVRCAC

SEQ ID NO: 121550 - protein, 87 aa, Heterodera glycines
  misc_feature (73)..(73): Xaa can be any naturally occurring amino acid
  Homolog annotation: Hit_ID=CAE61350.1; Match level="QueryCoverage =93%, HitCoverage=13%, E-value=3e-32, Identity=82%"; Hit description =Hypothetical protein CBG05190 [Caenorhabditis briggsae]
  Gene Ontology: Mol. function=protein phosphatase type 2A activity; Cellular component=shmoo tip; Biological process=cell organization and biogenesis
  Essential gene: C elegans homolog=F48E8.5; Phenotype=Emb
  Coding regions on vcDNA: vcDNA=SeqID_47973; Strand=+; Position=14-274
THAQRILINLLTDTIYDEDEVLLALAEQLGNFTPLVGGPEYVHCLLPPLENLANIEETVVRDKAVESLQKIAXKHSAAQLEEYFIPM

SEQ ID NO: 121551 - protein, 170 aa, Heterodera glycines
  Homolog annotation: Hit_ID=A45618; Match level="QueryCoverage=100%, HitCoverage=36%, E-value=4e-87, Identity=89%"; Hit description =translation elongation factor eEF-1 alpha chain - nematode (Onchocerca volvulus) sp|P27592|EF1A_ONCVO ELONGAT
  Gene Ontology: Mol. function=translation factor activity, nucleic acid binding; Biological process=protein biosynthesis
  Essential gene: C elegans homolog=R03G5.1a; Phenotype=Emb,Lva,Unc
  Coding regions on vcDNA: vcDNA=SeqID_47974; Strand=+; Position=1-510
FKIGGIGTVPVGRVETGVLKPGMVVTFAPQGISTEVKSVEMHHESLPEALPGDNVGFNVKNISVKDIRRGSVASDSKNDPAKETKSFTAQVIIMNHPGQIAAGYTPVLDCHTAHIACKFAELKEKVDRRSGKKVEDNPKALKTGDAGIVDLIPTKPMCVEAFTDYAPLGR

SEQ ID NO: 121552 - protein, 180 aa, Heterodera glycines
  Homolog annotation: Hit_ID=AAK94490.1; Match level="QueryCoverage =82%, HitCoverage=14%, E-value=2e-15, Identity=32%"; Hit description =PAZ/Piwi domain protein [Heterodera glycines]
  Gene Ontology: Biological process=gametogenesis
  Essential gene: C elegans homolog=F55A12.1; Phenotype=Emb
  Coding regions on vcDNA: vcDNA=SeqID_47975; Strand=+; Position=32-571
MQIEVDGNASTIEQYFNNKYGRRLDYPNLPLIAMNSRFANEKRVNYYPIEVLDIIDNQRVTTQQQTPTMIQQSIKKCAIPPLVFKRQVHNTAKSIHLWDSEYLDEAGIKLTTEPIALRAHQLNHPEVKAGDGNMQRPMVEGSAAWRINSALVPQSVFADGTYSWMLACFVQLGGRGLSEP

SEQ ID NO: 121553 - protein, 171 aa, Heterodera glycines
  Homolog annotation: Hit_ID=AAH73434.1; Match level="QueryCoverage =95%, HitCoverage=37%, E-value=2e-38, Identity=47%"; Hit description =MGC80921 protein [Xenopus laevis]
  Gene Ontology: Mol. function=dolichyl-diphospho-oligosaccharide -protein glycosyltransferase activity; Cellular component=endoplasmic reticulum
  Essential gene: C elegans homolog=T09A5.11; Phenotype=Emb,Lva
  Coding regions on vcDNA: vcDNA=SeqID_47976; Strand=+; Position=3-515
FWTWADTTIAVPNAQLIKAPLITGESALLAPVLYRGIALVADELGPLQMILMTASSTAYSHNPIITVEEHPSAVGKSTILLGALQARNNARVILSGSLDFFSNKFFTATVNQAGGHTANAVKSGNQQLAASVLKWLLKESGVLRIKSVKHHTVGQKSPPAEYTIMDDVRYE

SEQ ID NO: 121554 - protein, 155 aa, Heterodera glycines
  Homolog annotation: Hit_ID=CAE62832.1; Match level="QueryCoverage =72%, HitCoverage=34%, E-value=1e-23, Identity=51%"; Hit description =Hypothetical protein CBG07011 [Caenorhabditis briggsae]
  Gene Ontology: Mol. function=RNA cap binding; Cellular component =nuclear pore
  Essential gene: C elegans homolog=F23F1.5; Phenotype=Emb,Lva,Unc
  Coding regions on vcDNA: vcDNA=SeqID_47977; Strand=+; Position=3-467
PVQDMLMFSDWLVDIPGTLSTEWTMLPSPVGRRTLVVANRGETRVYFKNGHLATNFHSLLPGGNAKTKGSLTILDAIFDAKKRKLYLLDLLWWNKLLYTDMEFTARRFFLQSRIDEMNDDIERKNSRASISKNQERNGCKIAEQDKMSSSEISPY

SEQ ID NO: 121555 - protein, 208 aa, Heterodera glycines
  misc_feature (17)..(17): Xaa can be any naturally occurring amino acid
  misc_feature (43)..(43): Xaa can be any naturally occurring amino acid
  Homolog annotation: Hit_ID=BAA22203.1; Match level="QueryCoverage =97%, HitCoverage=44%, E-value=1e-106, Identity=92%"; Hit description= alpha-3 tubulin [Caenorhabditis elegans]
  Gene Ontology: Mol. function=structural constituent of cytoskeleton; Cellular component=microtubule; Biological process=spindle assembly
  Essential gene: C elegans homolog=F26E4.8; Phenotype=Emb
  Coding regions on vcDNA: vcDNA=SeqID_47978; Strand=+; Position=2-623
PPTKQPDDSFSTFFSEXGNGRHVPRAVMVDLEPTVIDEIRTGXYKHLFHPEQLITGKEDAANNYARGHYTVGKEIIDPVLDRIRRIADNCTGLQGFLIFHSFGGGTGSGFTSLLMERLSVDYGKKSKLEFSIYPAPQVSTAVVEPYNSVLTTHTTLEHSDCAFMVDNEAIYDICRRNLDVERPSYTNLNRLISQVVSSITASLRFDGA

SEQ ID NO: 121556 - protein, 162 aa, Heterodera glycines
  Homolog annotation: Hit_ID=NP_496500.1; Match level="QueryCoverage =98%, HitCoverage=40%, E-value=1e-46, Identity=58%"; Hit description =Malate/L-lactate dehydrogenase (42.8 kD) (2M3) [Caenorhabditis elegans] emb|CAA88951.1| Hypothetical prot
  Essential gene: C elegans homolog=F36A2.3; Phenotype=Egl,Unc
  Coding regions on vcDNA: vcDNA=SeqID_47979; Strand=+; Position=58-543
MLSSSPKEFVAPVGEVHAFVVKCMQSVGTSAAHAAQLADLLLDADIVGHYSHGLNRLCIYIEDVASGVKGDGEPKVLKQKGATAWVDGCDLLGAVVGNFCTELAIKLAKEHGIGWVVCKRSNHYGICQHYAKKIANAGLLGLSFTNTSPIIFPTRSSQIGLG

SEQ ID NO: 121557 - protein, 183 aa, Heterodera glycines
  Homolog annotation: Hit_ID=NP_495912.1; Match level="QueryCoverage =97%, HitCoverage=58%, E-value=1e-43, Identity=51%"; Hit description =haymaker protein (32.4 kD) (2J262) [Caenorhabditis elegans] emb|CAA93850.1| Hypothetical protein C18E9.6
  Essential gene: C elegans homolog=C18E9.6; Phenotype=Gro,Sma
  Coding regions on vcDNA: vcDNA=SeqID_47980; Strand=+; Position=1-549
IVGYMQAPPAEVFPVFFGEMDLQGNTQATVLHQIGNFRGKFQGQIQQNMLAAAQFSLEHRGRLSTYGLTFANPSVSANNCQGTLVAQMLRRVTKNLDLGAEYIYHRDERFPGKQSNTLSYALRYIQPTWIFSGTLAPTELHLCYYHKQSEHLQFGVEFEANFKLQEVNTTFAYQIEVPDSLTL

SEQ ID NO: 121558 - protein, 158 aa, Heterodera glycines
  Homolog annotation: Hit_ID=CAE60299.1; Match level="QueryCoverage =99%, HitCoverage=33%, E-value=1e-75, Identity=84%"; Hit description =Hypothetical protein CBG03884 [Caenorhabditis briggsae]
  Gene Ontology: Mol. function=translation factor activity, nucleic acid binding; Cellular component=eukaryotic translation initiation factor 2 complex; Biological process=locomotory behavior
  Essential gene: C elegans homolog=Y39G10AR.8; Phenotype=Emb,Lva
  Coding regions on vcDNA: vcDNA=SeqID_47981; Strand=+; Position=19-492
SSGVHRVKFKNELERNITIKLGYANAKIFRCSNIKCPRPHCYRSAGSSTPDRFPCERPNCGGDFVCVRHVSFVDCPGHDILMATMLNGAAVMDAALLLVAGNEPCPQPQTSEHLAAVEIMKLKHLLILQNKIDLINESQAKDQHDQIKSFVEGTVADS

SEQ ID NO: 121559 - protein, 123 aa, Heterodera glycines
  Homolog annotation: Hit_ID=AAL78224.1; Match level="QueryCoverage =78%, HitCoverage=44%, E-value=9e-49, Identity=95%"; Hit description =hypothetical protein Hgg-30 [Heterodera glycines]
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_47982; Strand=+; Position=9-377
GGGGGGGGKGRADARPRITARAGAIPNEGSVPGSDKVEQKFTVCRAQKKSERQAELKRRYEQYKAERIQRYRGVNLYVENLHDTINDETLRSNFESYGNITSAKVMCDEHGRSKGFGFVCFEK

SEQ ID NO: 121560 - protein, 102 aa, Heterodera glycines
  misc_feature (70)..(70): Xaa can be any naturally occurring amino acid
  misc_feature (72)..(72): Xaa can be any naturally occurring amino acid
  Homolog annotation: Hit_ID=NP_507909.1; Match level="QueryCoverage =94%, HitCoverage=27%, E-value=8e-34, Identity=75%"; Hit description =heterogeneous nuclear ribonucleoproteins methyltransferase-like 2 (39.8 kD) (5U738) [Caenorhabditis elega
  Gene Ontology: Mol. function=protein methyltransferase activity; Cellular component=nucleus; Biological process=organogenesis
  Essential gene: C elegans homolog=Y113G7B.17; Phenotype=Gro,Rup
  Coding regions on vcDNA: vcDNA=SeqID_47983; Strand=+; Position=3-309
ILNGDCGVSTSTAVKSQQINEMTSKDYYFDSYAHFGIHEEMLKDEVRTVTYRNAIYHNRHLFKNKVVMDXGXSGTGILSMFAARAGAKKVFAVEYSKMATQS

SEQ ID NO: 121561 - protein, 208 aa, Heterodera glycines
  misc_feature (106)..(106): Xaa can be any naturally occurring amino acid
  misc_feature (195)..(195): Xaa can be any naturally occurring amino acid
  Homolog annotation: Hit_ID=AAL78213.1; Match level="QueryCoverage =83%, HitCoverage=69%, E-value=4e-46, Identity=54%"; Hit description =probable protein kinase Hgg-20 [Heterodera glycines]
  Gene Ontology: Mol. function=casein kinase I activity; Biological process=signal transduction
  Essential gene: C elegans homolog=B0218.5; Phenotype=Unclassified
  Coding regions on vcDNA: vcDNA=SeqID_47984; Strand=+; Position=3-626
ILRHQLQQQQQHIDNDLVSQSPGTLSEERFASDYELVSLSPGTRVCGRWTIIKELGQGAFGTVFLCKDTTTGRQAAMKTESADAEPFLWQEAAIMRSVHSRGAQAXEHFCRCFDEGKDIQRDAKRGTLVSFNYIVMSLIGRGLFGLLSKANDKFSPGTAIGVSIQLLQALKTLHNIGYLHLDVKPENAVIGRREXNERQLIFLIDFGL

SEQ ID NO: 121562 - protein, 155 aa, Heterodera glycines
  Homolog annotation: Hit_ID=AAH65442.1; Match level="QueryCoverage =84%, HitCoverage=26%, E-value=4e-26, Identity=49%"; Hit description =Zgc:77730 protein [Danio rerio]
  Gene Ontology: Mol. function=RNA binding; Cellular component=nucleus; Biological process=mRNA cleavage
  Essential gene: C elegans homolog=F56A8.6; Phenotype=Emb
  Coding regions on vcDNA: vcDNA=SeqID_47985; Strand=+; Position=65-529
VVLKRHRRIESFWARIRSRGKAPEVIARTVASMPPEKMFELMRSMKETVNNNPQMARQLLMENPQLSYALLQAQVVMRVVDPKIAYQMLHREHAQPLVPPTSIPTHIPQQFAGKPPQLPPEFNVPPPSVPSHQFQMQPPPLVPGQFHHGFPSMGM

SEQ ID NO: 121563 - protein, 202 aa, Heterodera glycines
  Homolog annotation: Hit_ID=NP_501440.1; Match level="QueryCoverage =99%, HitCoverage=97%, E-value=1e-93, Identity=56%"; Hit description =ADP ATP carrier protein family member (4J224) [Caenorhabditis elegans] gb|AAB38001.1| Hypothetical protei
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_47986; Strand=+; Position=5-613
RVFTQGVDKEKQFLKFFAMNLASGGAAGATSLCFVYPLDFARTRLAADVGKADAREFKGLADCIMKILKSDGPIGLYRGFFVSVQGIIIYRAAYFGCFDTAKMLFSPEGKQMNFFVNWAIAQVVTVSSGVLSYPWDTVRRRMMMQSGRKDIMYKNTLDCAIKIIKNEGLLKGMFKGALSNVFRGTGGALVLAFYDEIQKYIH

SEQ ID NO: 121564 - protein, 183 aa, Heterodera glycines
  Homolog annotation: Hit_ID=NP_871868.1; Match level="QueryCoverage =92%, HitCoverage=29%, E-value=1e-55, Identity=62%"; Hit description =lipolytic enzyme, G-D-S-L family (1J397) [Caenorhabditis elegans] emb|CAD56582.1| Hypothetical protein F3
  Essential gene: C elegans homolog=T19D7.7; Phenotype=Dpy,Unc
  Coding regions on vcDNA: vcDNA=SeqID_47987; Strand=+; Position=15-563
STLQEAVKLPDSEQHRPDDAVSIINSAFSNRKSFSCPKTKSDLLTGTSTANLSPEDIGIIASMGDSLATGAGLWPRTDIEFRGAAFPIVGDATIDGLVTVPNILREFIDSNLLFGVSHGMGQRDQLPENQLNVAVSGASSSSMPGQAVELVRRMKRLRELDVFNTWALIIVTIGTEEVCKNCT

SEQ ID NO: 121565 - protein, 210 aa, Heterodera glycines
  misc_feature (15)..(15): Xaa can be any naturally occurring amino acid
  misc_feature (59)..(59): Xaa can be any naturally occurring amino acid
  Homolog annotation: Hit_ID=CAE60550.1; Match level="QueryCoverage =99%, HitCoverage=36%, E-value=5e-56, Identity=54%"; Hit description =Hypothetical protein CBG04177 [Caenorhabditis briggsae]
  Gene Ontology: Biological process=positive regulation of growth rate
  Essential gene: C elegans homolog=K09H9.6; Phenotype=Lpd
  Coding regions on vcDNA: vcDNA=SeqID_47988; Strand=+; Position=3-634
PHLSIIRNPQGPTFXFRVEKYSLARDVLSVQKRPVIYEELFQHAPLVVMNGFSSEDGSXKKHLQLVQTVVQNMFPSIDVDRVKLASIRRTLLLNYDTEDGLMEFRQYSIKSVPAGVSRSAKKLMQSKVPDLSKYKDISDFMLKPEQLSDSEFEGEQTELELTQDIGGRGKKRGQQTKLRLMEIGPRMTLRLMKIEEGVNAGTALWTHSST

SEQ ID NO: 121566 - protein, 112 aa, Heterodera glycines
  misc_feature (31)..(31): Xaa can be any naturally occurring amino acid
  Homolog annotation: Hit_ID=CAE67341.1; Match level="QueryCoverage =99%, HitCoverage=97%, E-value=4e-21, Identity=42%"; Hit description =Hypothetical protein CBG12804 [Caenorhabditis briggsae]
  Gene Ontology: Cellular component=integral to endoplasmic reticulum membrane; Biological process=proteolysis and peptidolysis
  Essential gene: C elegans homolog=C34B2.10; Phenotype=Lva,Lvl,Unc
  Coding regions on vcDNA: vcDNA=SeqID_47989; Strand=+; Position=12-351
MLEVVLEYLPSWIRTLNSFIDYEGQRKSERXFQVILIVHGVLGFFAGYLTQQLSVTMYSVGVGFLTSCLIVLPPWPFYRQNPLNWQPNSPVEEDKAANPSSSSGNKNSKKTR

SEQ ID NO: 121567 - protein, 192 aa, Heterodera glycines
  Homolog annotation: Hit_ID=NP_499089.1; Match level="QueryCoverage =99%, HitCoverage=37%, E-value=2e-72, Identity=67%"; Hit description =aspartyl(D) tRNA Synthetase (59.9 kD) (drs-1) [Caenorhabditis elegans] emb|CAA79536.1| Hypothetical prote
  Gene Ontology: Mol. function=ATP binding; Cellular component =intracellular; Biological process=aspartyl-tRNA aminoacylation
  Essential gene: C elegans homolog=B0464.1; Phenotype=Emb,Ste
  Coding regions on vcDNA: vcDNA=SeqID_47990; Strand=+; Position=1-576
CYGLVARTPQPVTACTQSDVEIKVHKFFIVSQAEPRLPLQLEDAVRPDNDQEELAVVKLDTRLDNRVLDLRTPTSQAIFRLQGGVCDAFRKILSSRGFMEIHTPKIISAASEGGANVFEVSYFKGHAFLAQSPQLYKQMAIAGDFGRVFTIGSVFRAEDSNTHRHLTEFIGLDLEMAFNFHYHEVLQTIAEM

SEQ ID NO: 121568 - protein, 133 aa, Heterodera glycines
  misc_feature (14)..(14): Xaa can be any naturally occurring amino acid
  Homolog annotation: Hit_ID=NP_498516.1; Match level="QueryCoverage =39%, HitCoverage=2%, E-value=9e-12, Identity=63%"; Hit description =NOT-like, component of CCR4/NOT complex (ntl-1) [Caenorhabditis elegans] gb|AAA21168.1| Not-like (yeast cc
  Gene Ontology: Biological process=reproduction
  Essential gene: C elegans homolog=F57B9.2; Phenotype=Emb
  Coding regions on vcDNA: vcDNA=SeqID_47991; Strand=+; Position=1-398
LWLGDSILKVLAEXHYEPDLKLNLRFEIEVLCRELNVNLRSIEVGGYLKEQRRLPRLVPPSKLGTAAASSTLAQCQLPPIQPPHIGAGISSHSTADYTPTDIANILAEMSISRKYSPASYTPGGSQQQVSSIT

SEQ ID NO: 121569 - protein, 142 aa, Heterodera glycines
  Homolog annotation: Hit_ID=CAE67904.1; Match level="QueryCoverage =87%, HitCoverage=41%, E-value=3e-38, Identity=58%"; Hit description =Hypothetical protein CBG13501 [Caenorhabditis briggsae]
  Gene Ontology: Mol. function=purine-nucleoside phosphorylase activity; Biological process=DNA modification
  Essential gene: C elegans homolog=K02D7.1; Phenotype=Unc
  Coding regions on vcDNA: vcDNA=SeqID_47992; Strand=+; Position=2-427
LEDIQSDRRRGPIDPTNFDHLVRLSELIRSMADLGTLQPEFGTICGSGLGAIADQMEGARILPFSEVPGFPQPSVIGHKGNLVFGRIGGHFCMCLQGRFHPYEHKMDMALCTMPVRLMAFLGVRTMIVSNAAGALNGDFQTG

SEQ ID NO: 121570 - protein, 176 aa, Heterodera glycines
  Homolog annotation: Hit_ID=AAR06361.1; Match level="QueryCoverage =89%, HitCoverage=98%, E-value=2e-33, Identity=54%"; Hit description =histone H3.2 protein [Oryza sativa (japonica cultivar-group)] ref|XP_ 493701.1| histone H3 [Oryza sativa (j
  Gene Ontology: Mol. function=DNA binding; Cellular component =nucleosome; Biological process=embryogenesis and morphogenesis
  Essential gene: C elegans homolog=ZK131.7; Phenotype=Emb,Gro
  Coding regions on vcDNA: vcDNA=SeqID_47993; Strand=+; Position=3-533
MLSIFLQNMARTKQTARKTQSQKGFSSSSGSQHMQSQLHNLRKQLATKRPNPKRGIGYKELPPVKIAQKRHHKKGALALKEIRKYQKSVNLLIPRRPFMRLVREVTQDMSQSTDLRWQGLALLAIQEAAELYLVSLFDDTNLCAIHASRVTIMPKDMQLVRKIRGETFLKPLSSQY

SEQ ID NO: 121571 - protein, 232 aa, Heterodera glycines
  Homolog annotation: Hit_ID=CAE72892.1; Match level="QueryCoverage =99%, HitCoverage=63%, E-value=1e-103, Identity=78%"; Hit description= Hypothetical protein CBG20205 [Caenorhabditis briggsae]
  Gene Ontology: Mol. function=ribonucleoside-diphosphate reductase activity; Cellular component=nucleus; Biological process=DNA replication
  Essential gene: C elegans homolog=C03C10.3; Phenotype=Emb
  Coding regions on vcDNA: vcDNA=SeqID_47994; Strand=+; Position=32-727
MDEPLLQENPNRFVIFPIKYHDIWQFYKKAVASFWTVEEVDLSKDISDWKSLTDNERFFISRVLAFFAASDGIVNENLVERFAQEVQVPEARCFYGFQIAIENIHSEMYSLLINSYVKDLEERAKLFNAIFEFEFIKKKADWALRWIASSEASFAERLVAFAAVGGIFFSGSFAAIFWLKKRGLLPGLTHSNELISRDEGLHRDFACLLYTHLKNTPPKERIYEIISDAVKI

SEQ ID NO: 121572 - protein, 244 aa, Heterodera glycines
  Homolog annotation: Hit_ID=NP_499734.1; Match level="QueryCoverage =99%, HitCoverage=65%, E-value=5e-36, Identity=39%"; Hit description =cleavage and Polyadenylation Factor (cpf-2) [Caenorhabditis elegans] emb|CAB05746.1| Hypothetical protein
  Gene Ontology: Mol. function=RNA binding; Cellular component=nucleus; Biological process=embryogenesis and morphogenesis
  Essential gene: C elegans homolog=F56A8.6; Phenotype=Emb
  Coding regions on vcDNA: vcDNA=SeqID_47995; Strand=+; Position=2-733
DFDSFQNPADELSPYRPELEPGKAPEVIARTVASMPPEKMFELMRSMKETVNNNPQMARQLLMENPQLSYALLQAQVVMRVVDPKIAYQMLHREHAQPLVPPTSIPTHIPQQFAGKPPQLPPQFNIPPPSVPSHQFQMQPPPLVPGQFHHGFPSMGMAPPSLLQQQQQQTPFTQQKPTPIAPLAVPPAATAPQQQQAVTPPPLSQQAQQSNSDNLDEEQQAQMLIRVLQLTDEQIRMLPPTERA

SEQ ID NO: 121573 - protein, 228 aa, Heterodera glycines
  Homolog annotation: Hit_ID=NP_501001.1; Match level="QueryCoverage =97%, HitCoverage=23%, E-value=3e-43, Identity=44%"; Hit description =bicaudal D like (4H330) [Caenorhabditis elegans] gb|AAB09108.1| Hypothetical protein C43G2.2 [Caenorhabdi
  Gene Ontology: Mol. function=protein binding; Cellular component =Golgi apparatus; Biological process=oocyte cell fate determination (sensu Insecta)
  Essential gene: C elegans homolog=C43G2.2; Phenotype=Pvl,Unc
  Coding regions on vcDNA: vcDNA=SeqID_47996; Strand=+; Position=5-688
MLSPIPKRIGGINIGADAQKENFALNELVSEGDLRECLLLAGGDGTDTDDSQMAYGLAGELLKAVRNEAEQRISARMALEDKDKADLYQNITKLKSQLAIKREQVSSLRSVLRSNKSSTESVLQCLREKFESEFRLKDEANEVLRNQLKQFKEDAATFASHRATFTARSEELQQQVESLQDSLKMAEEEKKTINQLLRMSIQQKLALTQRLEELEMDRERQMQQANSR

SEQ ID NO: 121574 - protein, 214 aa, Heterodera glycines
  Homolog annotation: Hit_ID=NP_496500.1; Match level="QueryCoverage =85%, HitCoverage=45%, E-value=2e-51, Identity=56%"; Hit description =Malate/L-lactate dehydrogenase (42.8 kD) (2M3) [Caenorhabditis elegans] emb|CAA88951.1| Hypothetical prot
  Essential gene: C elegans homolog=F36A2.3; Phenotype=Egl,Unc
  Coding regions on vcDNA: vcDNA=SeqID_47997; Strand=+; Position=3-644
LSFRPFLFLPPSFWPLPPHFFCLLPTFFRHALSSPKEFVAPVGEVHAFVVKCMQSVGTSAAHAAQLADLLLDADIVGHYSHGLNRLCIYIEDVASGVKGDGEPKVLKQKGATAWVDGCDLLGAVVGNFCTELAIKLAKEHGIGWVVCKRSNHYGICQHYAKKIANAGLLGLSFTNTSPIIFPTRSSQIGLGTNPISCCANSREKGDGFIFDMAA

SEQ ID NO: 121575 - protein, 187 aa, Heterodera glycines
  Homolog annotation: Hit_ID=NP_495912.1; Match level="QueryCoverage =97%, HitCoverage=60%, E-value=2e-43, Identity=50%"; Hit description =haymaker protein (32.4 kD) (2J262) [Caenorhabditis elegans] emb|CAA93850.1| Hypothetical protein C18E9.6
  Essential gene: C elegans homolog=C18E9.6; Phenotype=Gro,Sma
  Coding regions on vcDNA: vcDNA=SeqID_47998; Strand=+; Position=1-561
SARPCGIMQATPAEVFPVFFGEMDLQGNTQATVLHQIGNFRGKFQGQIQQNMLAAAQFSLEHRGRLSTYGLTFANPSVSANNCQGTLVAQMLRRVTKNLDLGAEYIYHRDERFPGKQSNTLSYALRYIQPTWIFSGTLAPTELHLCYYHKQSEHLQFGVEFEANFKLQEVNTTFAYQIEVPDSLTLR

SEQ ID NO: 121576 - protein, 194 aa, Heterodera glycines
  Homolog annotation: Hit_ID=CAE60299.1; Match level="QueryCoverage =100%, HitCoverage=41%, E-value=5e-95, Identity=82%"; Hit description= Hypothetical protein CBG03884 [Caenorhabditis briggsae]
  Gene Ontology: Mol. function=translation factor activity, nucleic acid binding; Cellular component=eukaryotic translation initiation factor 2 complex; Biological process=locomotory behavior
  Essential gene: C elegans homolog=Y39G10AR.8; Phenotype=Emb,Lva
  Coding regions on vcDNA: vcDNA=SeqID_47999; Strand=+; Position=2-583
KAISGVHRVKFKNELERNITIKLGYANAKIFRCSNIKCPRPHCYRSAGSSTPDRFPCERPNCGGDFVCVRHVSFVDCPGHDILMATMLNGAAVMDAALLLVAGNEPCPQPQTSEHLAAVEIMKLKHLLILQNKIDLINESQAKDQHDQIKSFVEGTVADSAPIIPISAQLKYNIDVICEYLCKKVPIPPRDFSS

SEQ ID NO: 121577 - protein, 192 aa, Heterodera glycines
  misc_feature (16)..(16): Xaa can be any naturally occurring amino acid
  Homolog annotation: Hit_ID=AAO14563.2; Match level="QueryCoverage =99%, HitCoverage=26%, E-value=1e-102, Identity=97%"; Hit description= Hsp90 [Heterodera glycines]
  Gene Ontology: Biological process=reproduction
  Essential gene: C elegans homolog=C47E8.5; Phenotype=Emb,Ste
  Coding regions on vcDNA: vcDNA=SeqID_48000; Strand=+; Position=3-576
LDFLRYYTSASGEEPXQLQDYVSRMKENQTCIYYITGESKDVVQNSSFVERVKKRGFEVIYMVDPIDEYCVQQLKEYDGKKLVSVTKEGLELPESEEEKKKFEEDKVKFEKLCKVIKDILDKKVQKVSVSNRLVSSPCCIVTGEYGWSANMERIMKAQALRDSSTMGYMASKKNLEINPDHSIIKSLRDRVE

SEQ ID NO: 121578 - protein, 153 aa, Heterodera glycines
  Homolog annotation: Hit_ID=AAL78224.1; Match level="QueryCoverage =100%, HitCoverage=69%, E-value=5e-81, Identity=98%"; Hit description= hypothetical protein Hgg-30 [Heterodera glycines]
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_48001; Strand=+; Position=17-475
MHEVSVPGSEKVEQKFTVCRAQKKSERQAELKRRYEQYKAERIQRYRGVNLYVKNLHDTINDETLRSNFESYGNITSAKVMCDEHGRSKGFGFVCFEKADEATNAVVEMNNKIIENKPLYVALAQRKEDRKAQLASQYMQRLAAMRMQNPAGL

SEQ ID NO: 121579 - protein, 224 aa, Heterodera glycines
  Homolog annotation: Hit_ID=NP_507909.1; Match level="QueryCoverage =95%, HitCoverage=61%, E-value=2e-92, Identity=73%"; Hit description =heterogeneous nuclear ribonucleoproteins methyltransferase-like 2 (39.8 kD) (5U738) [Caenorhabditis elega
  Gene Ontology: Mol. function=protein methyltransferase activity; Cellular component=nucleus; Biological process=organogenesis
  Essential gene: C elegans homolog=Y113G7B.17; Phenotype=Gro,Rup
  Coding regions on vcDNA: vcDNA=SeqID_48002; Strand=+; Position=36-707
MSQTHILNGDCGVSTSTAVKSQQINEMTSKDYYFDSYAHFGIHEEMLKDEVRTVTYRNAIYHNRHLFKNKVVMDVGSGTGILSMFAARAGAKKVFAVEYSKMATQSKKIIKDNQMDGVIEVIHSKIEDIEQLPGGIEHVDVIVSEWMGYCLFYESMLNTVIYARDKWLASDGILFPDKATLFLCAIEDRQYKDEKINWWDNVYGFNMSSIRQLAITEPLVDVVD

SEQ ID NO: 121580 - protein, 211 aa, Heterodera glycines
  Homolog annotation: Hit_ID=CAE65710.1; Match level="QueryCoverage =100%, HitCoverage=43%, E-value=9e-92, Identity=73%"; Hit description= Hypothetical protein CBG10789 [Caenorhabditis briggsae]
  Gene Ontology: Mol. function=phospholipase C activity; Cellular component=mitochondrion; Biological process=protein-nucleus import
  Essential gene: C elegans homolog=H06O01.1; Phenotype=Sma
  Coding regions on vcDNA: vcDNA=SeqID_48003; Strand=+; Position=2-634
GIVKYMRGQAGPSSKELKSISDFDKFVDGDDVSVIGLFEGESKLKDSFHKVADTERDRFRFAHSSNPDLLKKTGYTDDIVVFVSKKLHNKFEPNEFHYDGNYDTDKIKNFLLYETNGLAGIRTQGNLFQFTHRPLVVVYYTVDYLKDPKGSNYWRNRVLKVAQDYKRKVHFAVSDKEEFAQEVEQNGLADRKESDKPLVAAITVDGKYPMN

SEQ ID NO: 121581 - protein, 150 aa, Heterodera glycines
  misc_feature (12)..(12): Xaa can be any naturally occurring amino acid
  Homolog annotation: Hit_ID=A48449; Match level="QueryCoverage=100%, HitCoverage=39%, E-value=9e-83, Identity=98%"; Hit description=Actin- 1A - nematode (Onchocerca volvulus)
  Gene Ontology: Biological process=reproduction
  Essential gene: C elegans homolog=T04C12.6; Phenotype=Ste
  Coding regions on vcDNA: vcDNA=SeqID_48004; Strand=+; Position=3-451
MCDEEVAVLVVXNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTT

SEQ ID NO: 121582 - protein, 164 aa, Heterodera glycines
  misc_feature (34)..(34): Xaa can be any naturally occurring amino acid
  Homolog annotation: Hit_ID=XP_393534.1; Match level="QueryCoverage =97%, HitCoverage=34%, E-value=4e-55, Identity=64%"; Hit description =similar to ENSANGP00000003194 [Apis mellifera]
  Gene Ontology: Mol. function=1-phosphatidylinositol 4-kinase activity; Cellular component=plasma membrane; Biological process =actin filament organization
  Essential gene: C elegans homolog=C56A3.8; Phenotype=Let,Ste
  Coding regions on vcDNA: vcDNA=SeqID_48005; Strand=+; Position=3-495
SGEDFAACLVEAIRAINRGTNPERIPQGSSGYIXKNLQGEVIGVFKPKNEEPYGSLNPKWVKWAHKLLCPCCFGRSCLVPNQGYLSEAGASLVDQKLGLDIVPRTAIVALAAPTFYYGRIDRTVTNTKEQIARNYPDLGRHFKRIGLPPKRGSFQLFVRGFKDA

SEQ ID NO: 121583 - protein, 204 aa, Heterodera glycines
  misc_feature (108)..(108): Xaa can be any naturally occurring amino acid
  Homolog annotation: Hit_ID=AAL78213.1; Match level="QueryCoverage =82%, HitCoverage=67%, E-value=5e-43, Identity=53%"; Hit description =probable protein kinase Hgg-20 [Heterodera glycines]
  Gene Ontology: Mol. function=casein kinase I activity; Biological process=signal transduction
  Essential gene: C elegans homolog=B0218.5; Phenotype=Unclassified
  Coding regions on vcDNA: vcDNA=SeqID_48006; Strand=+; Position=1-611
TLILRHQRQQQQQHIDNDLVSQSPGTLSEERFASDYELVSLSPGTRVCGRWTIIKELGQGAFGTVFLCKDTTTGRQAAMKTESADAEPFLWQEAAIMRSVHSRGAQAXEHFCRCFDEGKDIQRDAKRGTLVSFNYIVMSLIGRGLFGLLSKANDKFSPGTAIGVSIQLLQALKTLHNIGYLHLDVKPENAVIGRRESNERQLIF

SEQ ID NO: 121584 - protein, 165 aa, Heterodera glycines
  Homolog annotation: Hit_ID=AAH65442.1; Match level="QueryCoverage =88%, HitCoverage=30%, E-value=3e-27, Identity=47%"; Hit description =Zgc:77730 protein [Danio rerio]
  Gene Ontology: Mol. function=RNA binding; Cellular component=nucleus; Biological process=embryogenesis and morphogenesis
  Essential gene: C elegans homolog=F56A8.6; Phenotype=Emb
  Coding regions on vcDNA: vcDNA=SeqID_48007; Strand=+; Position=1-495
PELEPGKAPEVIARTVASMPPEKMFELMRSMKETVNNNPQMARQLLMENPQLSYALLQAQVVMRVVDPKIAYQMLHREHAQPLVPPTSIPTHIPQQFAGKPPQLPPQFNIPPPSVPSHQFQMQPPPLVPGQFHHRFPSMGMAPPSLLQQQQQQTPFTQQKPTPIA

SEQ ID NO: 121585 - protein, 213 aa, Heterodera glycines
  misc_feature (7)..(7): Xaa can be any naturally occurring amino acid
  misc_feature (16)..(16): Xaa can be any naturally occurring amino acid
  Homolog annotation: Hit_ID=NP_501440.1; Match level="QueryCoverage =99%, HitCoverage=97%, E-value=3e-99, Identity=57%"; Hit description =ADP ATP carrier protein family member (4J224) [Caenorhabditis elegans] gb|AAB38001.1| Hypothetical protei
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_48008; Strand=+; Position=2-641
ALNFAFXDTYKRVFTXGVDKEKQFLKFFAMNLASGGAAGATSLCFVYPLDFARTRLAADVGKADAREFKGLADCIMKILKSDGPIGLYRGFFVSVQGIIIYRAAYFGCFDTAKMLFSPEGKQMNFFVNWAIAQVVTVSSGVLSYPWDTVRRRMMMQSGRKDIMYKNTLDCAIKIIKNEGLLKGMFKGALSNVFRGTGGALVLAFYDEIQKYIH

SEQ ID NO: 121586 - protein, 163 aa, Heterodera glycines
  misc_feature (51)..(51): Xaa can be any naturally occurring amino acid
  Homolog annotation: Hit_ID=CAE58420.1; Match level="QueryCoverage =90%, HitCoverage=52%, E-value=6e-29, Identity=43%"; Hit description =Hypothetical protein CBG01551 [Caenorhabditis briggsae]
  Gene Ontology: Mol. function=ubiquinol-cytochrome c reductase activity; Cellular component=respiratory chain complex III (sensu Eukarya); Biological process=reproduction
  Essential gene: C elegans homolog=F42G8.12; Phenotype=Emb,Ste
  Coding regions on vcDNA: vcDNA=SeqID_48009; Strand=+; Position=3-492
KTTLLIVLPNSSPIVLLHNLGKQSVNALALGRKSVHNDVQLPNFDAYPNDXTKDPAQRFHVTEDRRKGVSSFIFYGVGGAITLMTAKFGVRKAVTYKWMPRDQAAMASTEIDLSLGPLGKTKTFDWSGKAVFVKHRTDKEIERERAVEVGKLRHPERDEDRVL

SEQ ID NO: 121587 - protein, 218 aa, Heterodera glycines
  Homolog annotation: Hit_ID=NP_871868.1; Match level="QueryCoverage =100%, HitCoverage=37%, E-value=6e-62, Identity=55%"; Hit description= lipolytic enzyme, G-D-S-L family (1J397) [Caenorhabditis elegans] emb|CAD56582.1| Hypothetical protein F
  Essential gene: C elegans homolog=T19D7.7; Phenotype=Dpy,Unc
  Coding regions on vcDNA: vcDNA=SeqID_48010; Strand=+; Position=2-655
SEERNPEDLINSELSAVKLPDSEQQRPDDAVSIINSAFSNRKSFSCPKTKSDLLTGTSTANLSPEDIGIIASMGDSLATGAGLWPRTDIEFRGAAFPIGGDATIDGLVTVPNILREFIDSNLLFGVSHGMGQRDQLPENQLNVAVSGASSSSMPGQAVELVRRMKRLRELDVFNTWALIIVTIGTEEVCKNCTGPNTKALVQALDILNRGIHKALVIL

SEQ ID NO: 121588 - protein, 125 aa, Heterodera glycines
  Homolog annotation: Hit_ID=CAE71230.1; Match level="QueryCoverage =100%, HitCoverage=39%, E-value=2e-28, Identity=52%"; Hit description= Hypothetical protein CBG18099 [Caenorhabditis briggsae]
  Gene Ontology: Mol. function=protein phosphatase type 1 intrinsic catalyst activity; Cellular component=chromosome; Biological process= cell cycle
  Essential gene: C elegans homolog=W09C3.6; Phenotype=Ste
  Coding regions on vcDNA: vcDNA=SeqID_48011; Strand=-; Position=1-375
NRVYGFYDEIDRRYPRPGARRLFDLFNQVFAWMPFVGLVGEKILCMHGGISNQICSLDQLSNLLRPQTEPLLRSLEIDLLWADPSTSITGVAPNNRGAGVMFGADVVESVRNPLGIDYIVRAHQL

SEQ ID NO: 121589 - protein, 212 aa, Heterodera glycines
  misc_feature (44)..(44): Xaa can be any naturally occurring amino acid
  misc_feature (61)..(61): Xaa can be any naturally occurring amino acid
  Homolog annotation: Hit_ID=CAE60550.1; Match level="QueryCoverage =98%, HitCoverage=36%, E-value=7e-57, Identity=55%"; Hit description =Hypothetical protein CBG04177 [Caenorhabditis briggsae]
  Gene Ontology: Biological process=positive regulation of growth rate
  Essential gene: C elegans homolog=K09H9.6; Phenotype=Lpd
  Coding regions on vcDNA: vcDNA=SeqID_48012; Strand=+; Position=2-637
TFPHLRIIRNPQGPTLHFRVEKYSLARDVLSVQKRPVIYEELFXHAPLVVMNGFSSEDGSXKKHLQLVQTVVQNMFPSIDVDRVKLASIRRTLLLNYDTEDGLMEFRQYSIKSVPAGVSRSAKKLMQSKVPDLSKYKDISDFMLKPEQLSDSEFEGEQTELELTQDIGGRGKKRGQQTKLRLMEIGPRMTLRLMKIEEGVNAGTALWTHSST

SEQ ID NO: 121590 - protein, 112 aa, Heterodera glycines; identical to SEQ ID NO: 121566
  misc_feature (31)..(31): Xaa can be any naturally occurring amino acid
  Homolog annotation: Hit_ID=CAE67341.1; Match level="QueryCoverage =99%, HitCoverage=97%, E-value=4e-21, Identity=42%"; Hit description =Hypothetical protein CBG12804 [Caenorhabditis briggsae]
  Gene Ontology: Cellular component=integral to endoplasmic reticulum membrane; Biological process=proteolysis and peptidolysis
  Essential gene: C elegans homolog=C34B2.10; Phenotype=Lva,Lvl,Unc
  Coding regions on vcDNA: vcDNA=SeqID_48013; Strand=+; Position=50-389

SEQ ID NO: 121591 - protein, 188 aa, Heterodera glycines
  Homolog annotation: Hit_ID=SYHUDT; Match level="QueryCoverage=100%, HitCoverage=38%, E-value=4e-70, Identity=69%"; Hit description =aspartate-tRNA ligase (EC 6.1.1.12) [similarity] - human gb|AAA35567.1| aspartyl-tRNA synthetase
  Gene Ontology: Mol. function=ATP binding; Cellular component =intracellular; Biological process=aspartyl-tRNA aminoacylation
  Essential gene: C elegans homolog=B0464.1; Phenotype=Emb,Ste
  Coding regions on vcDNA: vcDNA=SeqID_48014; Strand=+; Position=2-565
NIPKESIVDVYGLVARTPQPVTACTQSDVEIKVHKFFIVSQAEPRLPLQLEDAVRPDNDQEELAVVKLDTRLDNRVLDLRTPTSQAIFRLQGGVCDAFRKILSSRGFMEIHTPKIISAASEGGANVFEVSYFKGHAFLAQSPQLYKQMAIAGDFGRVFTIGSVFRAEDSNTHRHLTEFIGLDLEMAFN

SEQ ID NO: 121592 - protein, 160 aa, Heterodera glycines
  misc_feature (160)..(160): Xaa can be any naturally occurring amino acid
  Homolog annotation: Hit_ID=XP_311177.1; Match level="QueryCoverage =92%, HitCoverage=36%, E-value=3e-82, Identity=99%"; Hit description =ENSANGP00000019055 [Anopheles gambiae]
  Gene Ontology: Biological process=reproduction
  Essential gene: C elegans homolog=T04C12.6; Phenotype=Ste
  Coding regions on vcDNA: vcDNA=SeqID_48015; Strand=+; Position=1-480
LTFFLVLNSWTKMCDEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPNANREKMTQIMFETFNTPAMYVAIQAVLSLYASGX

SEQ ID NO: 121593 - protein, 126 aa, Heterodera glycines
  Homolog annotation: Hit_ID=NP_498516.1; Match level="QueryCoverage =39%, HitCoverage=2%, E-value=6e-11, Identity=62%"; Hit description =NOT-like, component of CCR4/NOT complex (ntl-1) [Caenorhabditis elegans] gb|AAA21168.1| Not-like (yeast cc
  Gene Ontology: Biological process=reproduction
  Essential gene: C elegans homolog=F57B9.2; Phenotype=Emb
  Coding regions on vcDNA: vcDNA=SeqID_48016; Strand=+; Position=1-378
LKVLAEIHNEPDLKLILRFEIEVLCRELNVNLRSIEVGGYLNDQRRLPRLVPPSKLGTFLASSTLAQCQLPPIQPPHIGAGISSHSTADYTPTDIANILAEMSISRKYSPASYTPGGSQQQVSSIT

SEQ ID NO: 121594 - protein, 182 aa, Heterodera glycines
  Homolog annotation: Hit_ID=XP_225387.2; Match level="QueryCoverage =92%, HitCoverage=93%, E-value=2e-33, Identity=50%"; Hit description =similar to histone protein Hist2h3c1 [Rattus norvegicus]
  Gene Ontology: Mol. function=DNA binding; Cellular component =nucleosome; Biological process=embryogenesis and morphogenesis
  Essential gene: C elegans homolog=ZK131.7; Phenotype=Emb,Gro
  Coding regions on vcDNA: vcDNA=SeqID_48017; Strand=+; Position=7-555
KFWVVHMLSIFLQNMARTKQTARKTQSQKGFSSSSGSQHMQSQLHNLRKQLATKRPNPKRGIGYKELPPVKIAQKRHHKKGALALKEIRKYQKSVNLLIPRRPFMRLVREVTQDMSQSTDLRWQGLALLAIQEAAELYLVSLFDDTNLCAIHASRVTIMPKDMQLVRKIRGETFLKPLSSQY

SEQ ID NO: 121595 - protein, 197 aa, Heterodera glycines
  Homolog annotation: Hit_ID=CAE72892.1; Match level="QueryCoverage =99%, HitCoverage=53%, E-value=1e-88, Identity=79%"; Hit description =Hypothetical protein CBG20205 [Caenorhabditis briggsae]
  Gene Ontology: Mol. function=ribonucleoside-diphosphate reductase activity; Cellular component=nucleus; Biological process=DNA replication
  Essential gene: C elegans homolog=C03C10.3; Phenotype=Emb
  Coding regions on vcDNA: vcDNA=SeqID_48018; Strand=+; Position=13-603
MDEPLLQENPNRFVIFPIKYHDIWQFYKKAVASFWTVEEVDLSKDISDWKSLTDNERFFISRVLAFFAASDGIVNENLVERFAQEVQVPEARCFYGFQIAIENIHSEMYSLLINSYVKDLEERAKLFNAIFEFEFIKKKADWALRWIASSEASFAERLVAFAAVGGIFFSGSFAAIFWLKKRGLLPGLTHSNELISR

SEQ ID NO: 121596 - protein, 236 aa, Heterodera glycines
  Homolog annotation: Hit_ID=NP_499734.1; Match level="QueryCoverage =95%, HitCoverage=59%, E-value=4e-34, Identity=39%"; Hit description =cleavage and Polyadenylation Factor (cpf-2) [Caenorhabditis elegans] emb|CAB05746.1| Hypothetical protein
  Gene Ontology: Mol. function=RNA binding; Cellular component=nucleus; Biological process=embryogenesis and morphogenesis
  Essential gene: C elegans homolog=F56A8.6; Phenotype=Emb
  Coding regions on vcDNA: vcDNA=SeqID_48019; Strand=+; Position=4-711
MTLTRPQNPTDELSPYGPELEPGKAPEVIARTVASMPPEKMFELMRSMKETVNNNPQMARQLLMENPQLSYALLQAQVVMRVVDPKIAYQMLHREHAQPLVPPTSIPTHIPQQFAGKPPQLPPQFNIPPPSVPSHQFQMQPPPLVPGQFHHGFPSMGMAPPSLLQQQQQQTPFTQQKPTPIAPLAVPPAATAPQQQQAVTPPPLSQQAQQSNSDNLDDEQHAQMLIRVLQLTDEQI

SEQ ID NO: 121597 - protein, 192 aa, Heterodera glycines
  Homolog annotation: Hit_ID=CAE75506.1; Match level="QueryCoverage =95%, HitCoverage=39%, E-value=1e-51, Identity=56%"; Hit description =Hypothetical protein CBG23516 [Caenorhabditis briggsae]
  Gene Ontology: Cellular component=extracellular space; Biological process=embryogenesis and morphogenesis
  Essential gene: C elegans homolog=T28H10.3; Phenotype=Emb
  Coding regions on vcDNA: vcDNA=SeqID_48020; Strand=+; Position=1-576
TRKNRLSGTEVNPENFEAVLLGDEQRSEGKPVLKSTEKDKVFVYFSDHGAVGVIGFPAADLTVKQLTQTLKEMHAKKMYGELTFYLEACESGSMFDHTLAQSLKIYAVTAANGDESSWGCFCDTKFLPGNCLGDLFSVNWMQDSDQENLRTETLRKQFGIVREETNKSHVMHYGDLQIQDEHVSEFMGKEQA

SEQ ID NO: 121598 - protein, 212 aa, Heterodera glycines
  Homolog annotation: Hit_ID=NP_501001.1; Match level="QueryCoverage =98%, HitCoverage=21%, E-value=8e-40, Identity=45%"; Hit description =bicaudal D like (4H330) [Caenorhabditis elegans] gb|AAB09108.1| Hypothetical protein C43G2.2 [Caenorhabdi
  Gene Ontology: Mol. function=protein binding; Cellular component =Golgi apparatus; Biological process=oocyte cell fate determination (sensu Insecta)
  Essential gene: C elegans homolog=C43G2.2; Phenotype=Pvl,Unc
  Coding regions on vcDNA: vcDNA=SeqID_48021; Strand=+; Position=1-636
QNFLKELEGIKIGADAQKENFALNELVSEGDLRECLLLAGGDGTDTDDSQMAYGLAGELLKAVRNEAEQRISARMALEDKDKADLYQNITKLKSQLAIKREQVSSLRSVLRSNKSSTESVLQCLREKFESEFRLKDEANEVLRNQLKQFKEDAATFASHRATFTARSEELQQQVESLQDSLKMAEEEKKTINQLLRMSIQQKLALTQRLEEL

SEQ ID NO: 121599 - protein, 229 aa, Heterodera glycines
  Homolog annotation: Hit_ID=NP_503036.1; Match level="QueryCoverage =86%, HitCoverage=69%, E-value=2e-88, Identity=75%"; Hit description =auxiliary factor (30.9 kD) (4S62) [Caenorhabditis elegans] emb|CAB55137.1| Hypothetical protein Y116A8C.3
  Gene Ontology: Mol. function=pre-mRNA splicing factor activity; Cellular component=Cajal body; Biological process=mRNA splicing
  Essential gene: C elegans homolog=Y116A8C.35; Phenotype=Ste
  Coding regions on vcDNA: vcDNA=SeqID_48022; Strand=+; Position=7-693
MPRYDATDDLSGAEYLASIYGTEKDKVNCSFFFKIGACRHGDNCLRAHHRPTFSNTVLLKHFYQSPIVNPAQADAFDKVGKKDELEQRHFDEFYEEVFTELQRTYGPVEELNVCENIGEHMIGNVYVKFVYEEDAEKAVQGLENRWFNGQPIYAELSPVSDFREARCRQHEISTCSKGGFCNFMHLKDVSDEVYERCYANRGARYRSTRRHDRFYADDGYDRREGGNRD

SEQ ID NO: 121600 - protein, 217 aa, Heterodera glycines
  Homolog annotation: Hit_ID=NP_492727.1; Match level="QueryCoverage =95%, HitCoverage=59%, E-value=1e-80, Identity=42%"; Hit description =polyadenylate-binding protein, PolyA Binding protein (71.6 kD) (pab -1) [Caenorhabditis elegans] emb|CAA21
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_48023; Strand=+; Position=76-726
MAQAVAAVAPAPNANAASAQATQPQVMAPSYPLASLYVGDLHPDVTEAMLFERFSNAGPVLSIRVCRDAITRRSLGYAYVNFQQPADAERALDTMNFDMILNKPIRIMWSQRDPSIRRSGAGNIFIKNLGKEIDTKAIYDTFSMFGSILSCKISTDIDGGSKGYGFIHFETEEAANSAIAKVNGMLLDGKKVFVGKFLPRSARDKQIGDPSSRFTNV

SEQ ID NO: 121601 - protein, 113 aa, Heterodera glycines
  misc_feature (102)..(102): Xaa can be any naturally occurring amino acid
  Homolog annotation: Hit_ID=I59348; Match level="QueryCoverage=99%, HitCoverage=31%, E-value=2e-28, Identity=58%"; Hit description=CCAAT binding transcription factor CBF subunit C - rat
  Gene Ontology: Mol. function=transcriptional activator activity; Cellular component=CCAAT-binding factor complex; Biological process =cell organization and biogenesis
  Essential gene: C elegans homolog=F23F1.1; Phenotype=Lva
  Coding regions on vcDNA: vcDNA=SeqID_48024; Strand=+; Position=2-340
VLEEFWPGQNVKIGHMTMNSFREVNRHSELPIARIKKIMKIEEGVKTQMISAEAPVLLAKAAELFIEELTLRAWLNTNDNRRKTIQKSDIAAGAAKSEMFDXLIDILPRDELQ

SEQ ID NO: 121602 - protein, 149 aa, Heterodera glycines
  Homolog annotation: Hit_ID=NP_498660.1; Match level="QueryCoverage =97%, HitCoverage=77%, E-value=4e-59, Identity=76%"; Hit description =ribosomal Protein, Large subunit (21.5 kD) (rpl-9) [Caenorhabditis elegans] gb|AAK84469.1| Ribosomal prot
  Gene Ontology: Mol. function=RNA binding; Cellular component =cytosolic ribosome (sensu Eukarya); Biological process=reproduction
  Essential gene: C elegans homolog=R13A5.8; Phenotype=Emb,Ste
  Coding regions on vcDNA: vcDNA=SeqID_48025; Strand=+; Position=2-451
HLNIEIMRENPKLLRVRKWFGIRKELAAIRTVCSHIENMIKGVTVGFRYKMRSVYAHFPINITLQENNTVVEIRNFLGEKFVRRVGLPQGVSAVMSTKQKDELIIDGTDIQKVSQAAARIQQSTTVKNKDIRKFLDGIYVSEKVAIADE

SEQ ID NO: 121603 - protein, 164 aa, Heterodera glycines
  Homolog annotation: Hit_ID=NP_498923.1; Match level="QueryCoverage =100%, HitCoverage=84%, E-value=4e-49, Identity=57%"; Hit description= ribosomal protein L11 and Ribosomal protein L11 (3J807) [Caenorhabditis elegans] gb|AAA27905.1| Hypothet
  Gene Ontology: Mol. function=RNA binding; Cellular component =mitochondrial large ribosomal subunit; Biological process=protein biosynthesis
  Essential gene: C elegans homolog=B0303.15; Phenotype=Lva
  Coding regions on vcDNA: vcDNA=SeqID_48026; Strand=+; Position=18-512
MASAAPPLGPSLGQRGVNVANFCKEFNNLTSTIRFGTNLPVSIHVKPDRTYEIDISTPTTEWLLQQAAGIRRNRQEEGEIVGMISVKHVYEIAKVKSQDKSLIGVPLKEICQLVIERADSIGIKVQNEDLDPEEYRKFLEHRQEVVQRQLEEIAKQEEAKLART

SEQ ID NO: 121604 - protein, 207 aa, Heterodera glycines
  misc_feature (12)..(12): Xaa can be any naturally occurring amino acid
  Homolog annotation: Hit_ID=AAN78131.1; Match level="QueryCoverage =100%, HitCoverage=72%, E-value=2e-99, Identity=65%"; Hit description= cAMP-dependent protein kinase [Onchocerca volvulus]
  Gene Ontology: Mol. function=cAMP-dependent protein kinase inhibitor activity; Cellular component=cytoplasm; Biological process=protein amino acid phosphorylation
  Essential gene: C elegans homolog=R07E4.6a; Phenotype=Lva,Lvl,Unc
  Coding regions on vcDNA: vcDNA=SeqID_48027; Strand=+; Position=3-625
VIDSGEVDVFVXGEFVLSIKEGGSFGELALIYGTPRAATVVAKTNTVKLWAIDRITYRAILMGSTMRKRRMYDEFLSKVQILADLDKWERANVADALEQCQFPSGTHVVEQGHPGDEFFIIVEGEAEVLQRPNDDAPFEVVGKLGPSDYFGEIALLLDRPRAATVVAKTLLKCLKLDRARFERVMGPVREILKRDVSNYNSYVKLMT

SEQ ID NO: 121605 - protein, 133 aa, Heterodera glycines
  Homolog annotation: Hit_ID=CAE72582.1; Match level="QueryCoverage =98%, HitCoverage=73%, E-value=4e-35, Identity=58%"; Hit description =Hypothetical protein CBG19770 [Caenorhabditis briggsae]
  Gene Ontology: Biological process=positive regulation of growth rate
  Essential gene: C elegans homolog=W09C5.8; Phenotype=Age,Gro,Ste
  Coding regions on vcDNA: vcDNA=SeqID_48028; Strand=+; Position=1-402
PDRLDRWYPSIRFRKNDEVITPIRHKELGDWKKLSIEEKKLIYRYSFRQTLAEFEALTPYGYLTVTLFFSMLGLTILYASFVRTYVTKFNDRLPDTFDDEYKESQAERRVVLERGNPYGPAYYYDYEKNRWKD

SEQ ID NO: 121606 - protein, 172 aa, Heterodera glycines
  misc_feature (141)..(141): Xaa can be any naturally occurring amino acid
  Homolog annotation: Hit_ID=AAL40718.1; Match level="QueryCoverage =99%, HitCoverage=98%, E-value=2e-79, Identity=87%"; Hit description =myosin regulatory light chain [Meloidogyne incognita]
  Gene Ontology: Mol. function=structural constituent of muscle; Cellular component=muscle myosin; Biological process=regulation of muscle contraction
  Essential gene: C elegans homolog=C36E6.3; Phenotype=Gro,Unc
  Coding regions on vcDNA: vcDNA=SeqID_48029; Strand=+; Position=76-593
MSEKKVKKVKKKPRTGSEASSFDQKTIQEFKEAFGIMDQDKDGVISKQDLKDLYATLGVVASDSQMDNMLKEAPGPINFTVFLTLFGERLTGTDPEATIIGAFQMFDKTDCGEITEETLMKILKNKRGEPLTEDEVQGMYXGNPPISGGKVDYKAFAHLITTGAAEELAKVG

SEQ ID NO: 121607 - protein, 180 aa, Heterodera glycines
  Homolog annotation: Hit_ID=XP_413737.1; Match level="QueryCoverage =92%, HitCoverage=48%, E-value=9e-62, Identity=75%"; Hit description =PREDICTED: similar to Electron transfer flavoprotein alpha-subunit, mitochondrial precursor (Alpha-ETF) [
  Gene Ontology: Mol. function=electron carrier activity; Cellular component=mitochondrion; Biological process=electron transport
  Essential gene: C elegans homolog=F27D4.1; Phenotype=Emb
  Coding regions on vcDNA: vcDNA=SeqID_48030; Strand=+; Position=1-543
VRPSNSYCPFPAFEAAPADGGNATVEKAPDFSPPSPDVVELSAFLGQELSKSERPELGGANIVISGGRGLKSGENFSLLYALADVMGAAVGASRAAVDAGYVPNDMQVGQTGKIVAPQLYIAVGTIGAIQHLAGMKDSKVIVAINKDNDAPIFQVADFGLVADLFKAVPELTEQLKKANK

SEQ ID NO: 121608 - protein, 239 aa, Heterodera glycines
  Homolog annotation: Hit_ID=CAE59948.1; Match level="QueryCoverage =100%, HitCoverage=48%, E-value=1e-105, Identity=79%"; Hit description=Hypothetical protein CBG03435 [Caenorhabditis briggsae]
  Gene Ontology: Mol. function=serine-tRNA ligase activity; Cellular component=cytoplasm; Biological process=tRNA processing
  Essential gene: C elegans homolog=C47E12.1; Phenotype=Emb,Lva,Ste,Unc
  Coding regions on vcDNA: vcDNA=SeqID_48031; Strand=+; Position=2-718
RKSYSHVDLVVMCDGFDGERGTNVAGGRGYFLKGPLVFLEQALIALALQMLNKKGFTPLYTPFFMRKDVMQEVAQLSQFDEELYKVTTAKKTDAANEDGSPDEKYLIATSEQPIAAFHRDEWLNPSDLPIKYAGMSTCFRQEVGSHGRDTRGIFRVHQFEKIEQFVICSPFDNESWKHMDEMIDNAEEFCKVLGLPYRIVAIVSAELNNAAAKKLDLEAWFPGSGAFRELVSCSNCTDY

SEQ ID NO: 121609 - protein, 190 aa, Heterodera glycines
  Homolog annotation: Hit_ID=DNHUPA; Match level="QueryCoverage=91%, HitCoverage=55%, E-value=6e-72, Identity=46%"; Hit description =polyadenylate-binding protein - human emb|CAA68428.1| unnamed protein product [Homo sapiens]
  Gene Ontology: Mol. function=poly(A) binding; Cellular component =cytoplasm; Biological process=mRNA metabolism
  Essential gene: C elegans homolog=Y106G6H.2a; Phenotype=Gro,Stp
  Coding regions on vcDNA: vcDNA=SeqID_48032; Strand=+; Position=127-696
MAQAVAAVAPAPNANAASAQTTQPQVMAPSYPLASLYVGDLHPDVTEAMLFERFSNAGPVLSIRVCRDAITRRSLGYAYVNFQQPADAERALDTMNFDMILNKPIRIMWSQRDPSIRRSGAGNIFIKNLGKEIDTKAIYDTFSMFGSILSCKIATDIEGGSKGYGFIHFETEEAANSAIAKVNGMLLDGK

SEQ ID NO: 121610 - protein, 254 aa, Heterodera glycines
  Homolog annotation: Hit_ID=NP_724611.1; Match level="QueryCoverage =79%, HitCoverage=53%, E-value=1e-53, Identity=49%"; Hit description =CG1882-PD, isoform D [Drosophila melanogaster] ref|NP_724610.1| CG1882-PC, isoform C [Drosophila melanoga
  Essential gene: C elegans homolog=C37H5.3a; Phenotype=Unclassified
  Coding regions on vcDNA: vcDNA=SeqID_48033; Strand=+; Position=3-764
IGAVHWVIDTMIMVGHSFGGYLASSYALEHPSRVRHLVLVDPWGFPERPQIEQLHIPIWMRVFGRLLSLFNPLATLRAAGPFGARLVKKLRSDLGIRYAHQDPDAIYEYIYQCNAMEPTGEIAFGTMSKNFGWAKRPMINRFGGISPSVPVTFIWGGKSWMDPGPAYEIQYRRQDAYVDVQIVTRAGHHVYADAPADFCRLLAHVSDMVDGDSDLAGSADMEDAMDRMADTLPSMASQKMAWLMQQSTTATEAA

SEQ ID NO: 121611 - protein, 270 aa, Heterodera glycines
  Essential gene: C elegans homolog=F35G12.12; Phenotype=Emb
  Coding regions on vcDNA: vcDNA=SeqID_48034; Strand=+; Position=1-810
REITSRLKPGIENSERRFDVHKFTCAALELPDFSDFARLRPLIDALIAELDLNDFLGCTAALEMLAETAATAPKCVPFFGQIGLLDKVYALFIRTKEEPDMGIIHIACIRFFAYLCTTDDNALTKFPKFTADVFDAVFRFDAFDVTRRQLAFETLAVISSTSGAKQIFSQNETLYNMQRAMSNLAVAVATAAEPSLKARHLEAVRMFFDRIADESGCQPEQKCTAASAAEEQLLHRWFRWLGEPFPRLLLQCVRDPIEVQLAALRVLMAL

SEQ ID NO: 121612 - protein, 228 aa, Heterodera glycines
  misc_feature (11)..(11): Xaa can be any naturally occurring amino acid
  misc_feature (33)..(33): Xaa can be any naturally occurring amino acid
  Homolog annotation: Hit_ID=XP_394536.1; Match level="QueryCoverage =96%, HitCoverage=53%, E-value=1e-52, Identity=46%"; Hit description =similar to ENSANGP00000012356 [Apis mellifera]
  Gene Ontology: Mol. function=cyclin-dependent protein kinase, intrinsic regulator activity; Cellular component=transcription factor complex; Biological process=cell cycle
  Essential gene: C elegans homolog=F43D2.1; Phenotype=Gro,Pvl,Rup,Unc
  Coding regions on vcDNA: vcDNA=SeqID_48035; Strand=+; Position=2-686
NFRREGVRVIXDIGKTMNLKACPTLATATVFFXRFYMFHTFDEHHLHMTALACIFLAGKVEETPKKCKDLLTVARELYPHHFTAKVTPDDLMLMERVLLQTIRFDLHVEHPYTFLVQYAKGFRMDKEYMSKIVTNAWTFVNDSLGTTLCLLWEPEVIAIALLYMSFKMERMEEQQIGRTFHFDASTEWWNLYVQNLTVPMMDDICHKVLDSIAPANGEDAPMANGTKN

SEQ ID NO: 121613 - protein, 206 aa, Heterodera glycines
  misc_feature (12)..(12): Xaa can be any naturally occurring amino acid
  Homolog annotation: Hit_ID=NP_503397.1; Match level="QueryCoverage =100%, HitCoverage=100%, E-value=4e-99, Identity=87%"; Hit description=RAB family member (22.5 kD) (rab-1) [Caenorhabditis elegans] gb|AAC69218.1| Rab family protein 1 [Caeno
  Gene Ontology: Mol. function=RAB small monomeric GTPase activity; Cellular component=endoplasmic reticulum membrane; Biological process=signal transduction
  Essential gene: C elegans homolog=C39F7.4; Phenotype=Ste
  Coding regions on vcDNA: vcDNA=SeqID_48036; Strand=+; Position=51-670
MAAMNPEYDYLXKLLLIGDSGVGKSCLLLRFADDTYTESYISTIGVDFKIRTIELEGKTIKLQIWDTAGQERFRTITSSYYRGAHGIIVVYDITDQDSFNNVKQWLQEIDRYASESVNKLLVGNKCDLTTKRAIETNVAKEYADQLNIPFLETSAKNSTNVEQAFITMATEIKNRMGPLQQAGGNASAVRIGPSQPVQDKKTGGCC

SEQ ID NO: 121614 - protein, 188 aa, Heterodera glycines
  Homolog annotation: Hit_ID=NP_495784.1; Match level="QueryCoverage =95%, HitCoverage=32%, E-value=5e-36, Identity=42%"; Hit description =component of the meiotic and mitotic spindle poles, ZYGote defective : embryonic lethal ZYG-9 (156.2 kD)
  Gene Ontology: Mol. function=microtubule binding; Cellular component =spindle pole; Biological process=meiotic spindle assembly
  Essential gene: C elegans homolog=F22B5.7; Phenotype=Emb
  Coding regions on vcDNA: vcDNA=SeqID_48037; Strand=+; Position=33-599
FANYRELIGRLPKIMANDANIFVAASATKCVMLFAKGLRAEFTPHVSLVVPVIFDKFKVEKRLLRDALVECIDVIAAYTSFDHLSKALLEAMTSKQNPSQKSQTDLFIYRLFRSLPAKDVPKGLLKDLVAILSKHGFDAASEVRDSSFAALGAIMKCIGEKALGCFISPELAKDANKMAKIALKRDTA

SEQ ID NO: 121615 - protein, 225 aa, Heterodera glycines
  Homolog annotation: Hit_ID=NP_499704.1; Match level="QueryCoverage =78%, HitCoverage=33%, E-value=6e-33, Identity=40%"; Hit description =cytochrome P450 precursor family member (3O111) [Caenorhabditis elegans] emb|CAB04112.1| Hypothetical pro
  Gene Ontology: Mol. function=oxidoreductase activity; Biological process=epoxygenase P450 pathway
  Essential gene: C elegans homolog=T10B9.1; Phenotype=Gro,Sma,Unc
  Coding regions on vcDNA: vcDNA=SeqID_48038; Strand=+; Position=3-677
IGTDFALFGVCFYCLISGNFGSLYGDYPSMFQLRDWTRQYGKQYGIQYGWRNALVISDPAMVHELLVTKFEYFHARNLSPIFGNLDTNKWISMFLARGGRWKRLRTIANPAFSVANLKKCMWLIDDSVKNAINFLEKARNEGKSFNIQRHFVEMSFDVIARVALGQRESRQFETEMAHLAIESMQKYNNTPFDYVGFAFPWFGIHFLEPFISWSGILRKDPLIIL

SEQ ID NO: 121616 - protein, 213 aa, Heterodera glycines
  Homolog annotation: Hit_ID=NP_491890.2; Match level="QueryCoverage =85%, HitCoverage=32%, E-value=1e-73, Identity=66%"; Hit description =trehalase (66.9 kD) (tre-1) [Caenorhabditis elegans] gb|AAB96724.2| Trehalase protein 1 [Caenorhabditis e
  Gene Ontology: Mol. function=alpha,alpha-trehalase activity; Cellular component=extrinsic to plasma membrane, GPI-anchored; Biological process=trehalose catabolism
  Essential gene: C elegans homolog=F57B10.7; Phenotype=Emb
  Coding regions on vcDNA: vcDNA=SeqID_48039; Strand=+; Position=7-648
MKLAIKRLHWNETDGIWYDYDLEREAHSNTYYVSNALPLYSKCYDDEDDVTPYKVFEYLKREGVLNFTRGIPTSLAMGSIQQWDKENAWPPMVHMVVEAFRTSGDLSLMKAAEQMATQWLVVNYKGYVSTYAMFEKYNVSMINEEGVGGSGGEYEVQKGFGWTNGVILDLLDKYGSKISVSGAAVPNGVRFLPLALVVLLFMTVVEIAIAQCF

SEQ ID NO: 121617 - protein, 191 aa, Heterodera glycines
  Homolog annotation: Hit_ID=CAE72700.1; Match level="QueryCoverage =69%, HitCoverage=24%, E-value=5e-15, Identity=37%"; Hit description =Hypothetical protein CBG19924 [Caenorhabditis briggsae]
  Gene Ontology: Mol. function=death receptor interacting protein activity; Cellular component=synaptic junction; Biological process =induction of apoptosis
  Essential gene: C elegans homolog=F35D6.1a; Phenotype=Stp
  Coding regions on vcDNA: vcDNA=SeqID_48040; Strand=+; Position=70-642
MADAEHPTDAAVVDNFETRARRFFDLINDGNIQQLRVLIDALDADELNILLRWMVDPVERDYTRSRSALWSAFFRQHIDIVDLLLEKGADPNEPVVGRENDINTNLTPLFVAALHAHFPLCRVLVDRGANVDLGSDFATTPLMMACKRSQMEIVAFLIENGADINLQNGDGETALMIACSRANVDIVRLLL

SEQ ID NO: 121618 - protein, 219 aa, Heterodera glycines
  misc_feature (208)..(208): Xaa can be any naturally occurring amino acid
  Homolog annotation: Hit_ID=CAE66491.1; Match level="QueryCoverage =95%, HitCoverage=50%, E-value=1e-109, Identity=95%"; Hit description= Hypothetical protein CBG11771 [Caenorhabditis briggsae]
  Gene Ontology: Mol. function=protein binding; Cellular component =proteasome regulatory particle (sensu Eukarya); Biological process =embryogenesis and morphogenesis
  Essential gene: C elegans homolog=Y49E10.1; Phenotype=Emb
  Coding regions on vcDNA: vcDNA=SeqID_48041; Strand=+; Position=3-659
SLLTLQTDPGCRVALRADSYALHMILPNKVDPLVSLMMVEKVPDSTYEMIGGLDTQIKEIKEVIELPVKHPELFEALGIAQPKGVLLYGPPGTGKTLLARAVAHHTECTFIRVSGSELVQKFIGEGARMVRELFVMAREHSPSIIFMDEIDSIGSSRVEGSHGGDSEVQRTMLELLNQLDGFEPTKNIKVIMATNRIDILDPALLRPXRIDRKIEFPAP

SEQ ID NO: 121619 - protein, 83 aa, Heterodera glycines
  Homolog annotation: Hit_ID=NP_497291.1; Match level="QueryCoverage =68%, HitCoverage=59%, E-value=8e-13, Identity=57%"; Hit description =putative mitochondrial protein (11.0 kD) (3B528) [Caenorhabditis elegans] gb|AAC71133.1| Bmp receptor ass
  Essential gene: C elegans homolog=F23H11.5; Phenotype=Emb,Lva
  Coding regions on vcDNA: vcDNA=SeqID_48042; Strand=+; Position=129-377
MLCLEAMRLKSTSIVQDDAITEHGHDDHGHGHHAVNYGPPITYDYTPIPSQPYKKVYKELKQKFITYLAMSFVFFMFCCYVGY

SEQ ID NO: 121620 - protein, 204 aa, Heterodera glycines
  Homolog annotation: Hit_ID=CAE61727.1; Match level="QueryCoverage =99%, HitCoverage=57%, E-value=8e-45, Identity=46%"; Hit description =Hypothetical protein CBG05678 [Caenorhabditis briggsae]
  Gene Ontology: Mol. function=ATP binding; Cellular component =extracellular space; Biological process=amino acid activation
  Essential gene: C elegans homolog=F18E3.7a; Phenotype=Emb
  Coding regions on vcDNA: vcDNA=SeqID_48043; Strand=+; Position=2-613
FPLMKAAVVGEGAVGASVALAIRRAHPNANITVFSDRDFEKTTSYGPEGIFRVDVPGTERLAKESFEFWAKTERDELAHKTGVRLISGYCQSNDRKWIEAQESSMSDIVYNWKWLSERELRTLFVRPYCYGAHYTTYAAEGRLYVPWLRAQLVAESGQGLLHFQRQRIESLEQLIDSGQFTLVVNCAGLEGGRLAGDDGTSVYP

SEQ ID NO: 121621 - protein, 188 aa, Heterodera glycines
  Homolog annotation: Hit_ID=CAE58953.1; Match level="QueryCoverage =39%, HitCoverage=6%, E-value=1e-11, Identity=42%"; Hit description =Hypothetical protein CBG02221 [Caenorhabditis briggsae]
  Gene Ontology: Mol. function=protein C-terminus binding; Cellular component=nucleus; Biological process=DNA replication and chromosome cycle
  Essential gene: C elegans homolog=F37D6.1; Phenotype=Unc
  Coding regions on vcDNA: vcDNA=SeqID_48044; Strand=+; Position=114-677
MENVPEKYLPETEIKGLTFTVAIEPLDQEEKKDESVTDEREPRADKEELSGPSEVEHAQNDVENMPENCLLSDDTETKGLTNSHKTPLLAGCQITASGFMGTDRVKIGRLVELHGGVFTGQMSRATCTHLIAAASSGEKYRRAREWGTVKVVTSEWLFKCDEMGYRLREDHFLLDNDGEKRRSSADIE

SEQ ID NO: 121622 - protein, 216 aa, Heterodera glycines
  Homolog annotation: Hit_ID=AAL78213.1; Match level="QueryCoverage =98%, HitCoverage=85%, E-value=1e-76, Identity=69%"; Hit description =probable protein kinase Hgg-20 [Heterodera glycines]
  Gene Ontology: Mol. function=casein kinase I activity; Biological process=signal transduction
  Essential gene: C elegans homolog=B0218.5; Phenotype=Unclassified
  Coding regions on vcDNA: vcDNA=SeqID_48045; Strand=+; Position=55-702
MPEELVALSPGTRVSGRWTIIKKLGAGAFGAVYLCQDRDGRTMAALKTEPIDAQRPLLYMEAHVLLSLNELRSNSGRHFCRCLDLGRDEQPDADSGQTMEFNYVVMSLVGRPMDKLLHESGDRFSPGTAIGTSIQLLKALKALHSVGYLHRDIKPANSAIGTPETNEQRLLYLLDFGMARKYVREDGTHRRQRDTARFRWTPIYAPISAHIKRDYS

SEQ ID NO: 121623 - protein, 205 aa, Heterodera glycines
  Homolog annotation: Hit_ID=AAF81283.1; Match level="QueryCoverage =99%, HitCoverage=98%, E-value=2e-38, Identity=42%"; Hit description =glutathione S-transferase [Haemonchus contortus]
  Gene Ontology: Mol. function=glutathione transferase activity; Biological process=glutathione conjugation reaction
  Essential gene: C elegans homolog=R05F9.5a; Phenotype=Unclassified
  Coding regions on vcDNA: vcDNA=SeqID_48046; Strand=+; Position=16-630
MVQYKLYYFDGRGLGESIRLLLHYVGQPFEDIRIKDMEEWEKTYKPKFFYGKVPVLEVDGKPLGQSATILRYLAEKFGLAGKDECEKAKANEIIDFQKDANTDLAPYLYVKMGSRQGDLDKLRAEVFEPGVKHILPLFEKLLKESGSGYMLKSGLSMVDFQVANFLYTFTKLEPETINAFPELIKYVDRVHALPQLQQYLKQRPQ

SEQ ID NO: 121624 - protein, 140 aa, Heterodera glycines
  misc_feature (10)..(10): Xaa can be any naturally occurring amino acid
  misc_feature (129)..(129): Xaa can be any naturally occurring amino acid
  Homolog annotation: Hit_ID=CAE63549.1; Match level="QueryCoverage =100%, HitCoverage=13%, E-value=2e-58, Identity=75%"; Hit description= Hypothetical protein CBG08035 [Caenorhabditis briggsae]
  Gene Ontology: Mol. function=valine-tRNA ligase activity; Cellular component=intracellular; Biological process=reproduction
  Essential gene: C elegans homolog=Y87G2A.5; Phenotype=Gro,Sma
  Coding regions on vcDNA: vcDNA=SeqID_48047; Strand=+; Position=3-422
PNVTGTLHLXHALSTAVEDTIARWHRMCGRTVLFVPGCDHAGIATQVVVEKKLKRERGLSRHDLGRADFVKEVWKWKNEKGHIIYDQLKKMGAGVDWDRVVFMMDPKIMRAVTEAFVRMHEKGVIYRSXRLVNWSCALSS

SEQ ID NO: 121625 - protein, 253 aa, Heterodera glycines
  Homolog annotation: Hit_ID=CAE73788.1; Match level="QueryCoverage =77%, HitCoverage=19%, E-value=7e-42, Identity=47%"; Hit description =Hypothetical protein CBG21338 [Caenorhabditis briggsae]
  Gene Ontology: Mol. function=protein serine/threonine kinase activity; Cellular component=nucleus; Biological process=regulation of mitosis
  Essential gene: C elegans homolog=T20F10.1; Phenotype=Gro,Slu,Unc
  Coding regions on vcDNA: vcDNA=SeqID_48048; Strand=+; Position=3-761
WHPEVVQKIGHTQLCDWWSVGVILYEMVYGRPPFLSQRDDPAETQFMIVHWRRFLDLRNAMGVRLSKQCVDCVAKLCCDQENRLGHRNGAKDIKAHPWFKGIDFANLRNTFPEYVPRVQNPEDTSNFDTFEVENEELIRTNGNGNDRLKCAAYGGGKPLGPNFIDFTFRHFFSEGMCPPARGRSPQVRPSLAPLMESSTEGGNAAKSPAGEVFAKPKQIVTITGKAKVVPFTSSKRVPAPSIPSDSSKATTVN

SEQ ID NO: 121626 - protein, 221 aa, Heterodera glycines
  Homolog annotation: Hit_ID=NP_498134.1; Match level="QueryCoverage =91%, HitCoverage=43%, E-value=4e-30, Identity=40%"; Hit description =putative nuclear protein, with a coiled coil domain, of bilaterial origin (52.8 kD) (3G399) [Caenorhabdit
  Essential gene: C elegans homolog=F52C9.7; Phenotype=Dpy,Emb,Sle
  Coding regions on vcDNA: vcDNA=SeqID_48049; Strand=+; Position=40-702
MKPISAQDGGGKNMQWMYEGAKSVVNREDYLLGKKIDKNFEMFSDVVVHDQEEEKRDAFFQQSLLKPSTSAHTAPSAARNQHKVSALDTRVVRTEDPLVALKFQEEHRRRQLLENPLLKLKAQRVLRKAFEKELKKAVKKKSSKRKKRKRSSSPSSSSSFSSPERRKEEQKRRRHHHHHRRSEGRKSGDSEREGRAKRSSRSSSRTERHRRRRSSAGSSRR

SEQ ID NO: 121627 - protein, 237 aa, Heterodera glycines
  misc_feature (237)..(237): Xaa can be any naturally occurring amino acid
  Homolog annotation: Hit_ID=NP_509748.2; Match level="QueryCoverage =98%, HitCoverage=37%, E-value=1e-104, Identity=78%"; Hit description= abnormal cell MIGration MIG-15, serine threonine protein kinase involved in cell migration and signal tr
  Gene Ontology: Mol. function=ATP binding; Biological process=protein kinase cascade
  Essential gene: C elegans homolog=ZC504.4a; Phenotype=Unclassified
  Coding regions on vcDNA: vcDNA=SeqID_48050; Strand=+; Position=12-722
AGPGLMLLDRSGQGKVYHLITRRRFDQMSVMEGQNILVTISGKKRRVRVYYLSWLKQKILRTEGLQQTEKRNGWTNVGEFQCATHFKIVRYERIKFLVIGIEDSISIYAWAPKPYNKFMAFKSFGQLSHAPVIVDLTIEENARLKVLYGSLAGFHAIDLDSASIYDIYSPQQSTMCQGMCPHCIVILPNTNGMQLLLCYDNEGVYVNTYGKIVKNVQLQWSEIPSSVAYISTNQIMX

SEQ ID NO: 121628 - protein, 224 aa, Heterodera glycines
  Homolog annotation: Hit_ID=NP_740850.1; Match level="QueryCoverage =91%, HitCoverage=82%, E-value=6e-13, Identity=26%"; Hit description =putative protein, with a transmembrane domain (27.7 kD) (1F933C) [Caenorhabditis elegans] gb|AAM15579.1|
  Essential gene: C elegans homolog=F55A12.2a; Phenotype=Gro
  Coding regions on vcDNA: vcDNA=SeqID_48051; Strand=+; Position=63-734
KLCQPVGAARKSIWSSLNGMNSEQRQLFFGRILHVWPYPWERRAITLPQTTLAFTNICCSGYITAKVCGDVFLVDPKIGWLSSLRSVPTLIPNVVVAFSTVVASSLLFHRFVYVPFIEHEGLLHTKSIFWRTFGINFMTAAAVPCMFAPVAAHYHNIRILAAAGKPPIPANAVLDLIVTCWESTRSVWRKLPLIVAINFTTVLLATVAMAWGCDRLHTTMHLDS

SEQ ID NO: 121629 - protein, 216 aa, Heterodera glycines
  Homolog annotation: Hit_ID=CAE57411.1; Match level="QueryCoverage =95%, HitCoverage=28%, E-value=7e-31, Identity=33%"; Hit description =Hypothetical protein CBG00366 [Caenorhabditis briggsae]
  Essential gene: C elegans homolog=ZK550.3; Phenotype=Emb,Sck,Sma,Stp
  Coding regions on vcDNA: vcDNA=SeqID_48052; Strand=+; Position=1-648
NFFQMAGSPQLSASLSTTFRRFRPVFFSRLEGAWKTYAEEQEERVISDLEAFDLFYICRKEAEHNQNVDSLELMKHFPVLSTFDKMLLLSSELFNIEFREVTNDYENQSFERCDPSVRLFDVTDNATNSRIGFLYVDIFSRETKKIGRGQWLSMLGRPPNQLRDLDALVYFLGAHPHSENEHESFLHHEELSEMLSAFGRALQLLLSRAPCHFLSL

SEQ ID NO: 121630 - protein, 199 aa, Heterodera glycines
  Homolog annotation: Hit_ID=NP_506619.1; Match level="QueryCoverage =94%, HitCoverage=21%, E-value=7e-32, Identity=41%"; Hit description =DNA Replication Factor C (rfc-1) [Caenorhabditis elegans] emb|CAA99812.1| Hypothetical protein C54G10.2 [
  Gene Ontology: Mol. function=DNA binding; Cellular component=DNA replication factor C complex; Biological process=DNA replication
  Essential gene: C elegans homolog=C54G10.2; Phenotype=Emb,Lva
  Coding regions on vcDNA: vcDNA=SeqID_48053; Strand=+; Position=20-619
MFSSALPSARMDGYLTAQIQFPAWFGKRSTGQKRQRLMRQPLLHTHLKITGSSQALVQDYLSILRDRLYRPLVEKESGGVKDVLEVFNNYFLLREDTEAISELGVWPLAGKTRKDLAAMVSTKAKSALTRQLNKEKRVLPFSQGVMVKTGARRKGGGESSKGGGVMELKEEKNDDIEEEEEFNNPDEEEDEALLIGLDF

SEQ ID NO: 121631 - protein, 238 aa, Heterodera glycines
  Homolog annotation: Hit_ID=NP_490830.2; Match level="QueryCoverage =92%, HitCoverage=34%, E-value=2e-43, Identity=41%"; Hit description =protein nucleolar (1B671) [Caenorhabditis elegans] gb|AAK29904.3| Hypothetical protein Y48G8AL.5 [Caenorh
  Gene Ontology: Mol. function=tRNA (cytosine-5-)-methyltransferase activity; Cellular component=nucleus; Biological process=tRNA methylation
  Essential gene: C elegans homolog=Y48G8AL.5; Phenotype=Ste
  Coding regions on vcDNA: vcDNA=SeqID_48054; Strand=+; Position=7-720
VEVSPKSDSNAFDSKHRQKTCTISKQRQPEKGIRQNSELNKFERRNDSLFGFYKKQRIVPDSEWDRFCEIFATELPSSFRIQRSLPERDCLANFLEQHFFKQIASIAATSESDGVGIHPPKSVPFVPYAYQTKMPRSMLRRHPILKEFHEFLVNETELGNMSRQETCSMVPPLLLDVQPHHRVLDACAAPGSKTMQIIELMHEHCPNPEWFVLANDSDYKRCYLLVRQTLKRMPTANV

SEQ ID NO: 121632 - protein, 205 aa, Heterodera glycines
  Homolog annotation: Hit_ID=CAE65324.1; Match level="QueryCoverage =91%, HitCoverage=42%, E-value=1e-70, Identity=64%"; Hit description =Hypothetical protein CBG10258 [Caenorhabditis briggsae]
  Gene Ontology: Cellular component=integral to plasma membrane; Biological process=fatty acid desaturation
  Essential gene: C elegans homolog=W08D2.4; Phenotype=Unc
  Coding regions on vcDNA: vcDNA=SeqID_48055; Strand=+; Position=5-619
LTVLLRSPSVALPHLYWSFALPLLRFSWLLQSVQFVCQMRHSFYDIHRQRALVEQCSLALHWSLVLVQLYFLPDNLARLQYFLVSNLFAGFLIAHVVTYNHYSTDKFAYDDPILENFACLQLYTTRNMRPGPFIDWLWGGLNYQIEHHLFPTMPRHNLKKVMPLVKEFCAENDIPYMVDDYFTGFRLVIEHLRRVAEAATETLVS

SEQ ID NO: 121633 - protein, 140 aa, Heterodera glycines
  Homolog annotation: Hit_ID=NP_503386.1; Match level="QueryCoverage =97%, HitCoverage=100%, E-value=2e-72, Identity=73%"; Hit description= calmodulin (16.8 kD) (cmd-1) [Caenorhabditis elegans] gb|AAB65364.1| Calmodulin protein 1 [Caenorhabditi
  Gene Ontology: Mol. function=calcium ion binding
  Essential gene: C elegans homolog=T21H3.3; Phenotype=Emb,Ste
  Coding regions on vcDNA: vcDNA=SeqID_48056; Strand=+; Position=3-425
NCRVKEAFSLFDKDGDGTITTKELGTVMRSLGQNPTEAELQDMINEVDADGNGTIDFPEFLTMMARKMKDTDSEEEIREAFRVFDKDGNGFISAAELRHVMTNLGEKLTDEEVDEMIREADIDGDGQVNYEEFVTMMTTK

SEQ ID NO: 121634 - protein, 106 aa, Heterodera glycines
  misc_feature (80)..(82): Xaa can be any naturally occurring amino acid
  misc_feature (106)..(106): Xaa can be any naturally occurring amino acid
  Homolog annotation: Hit_ID=AAK94490.1; Match level="QueryCoverage =99%, HitCoverage=10%, E-value=2e-52, Identity=96%"; Hit description =PAZ/Piwi domain protein [Heterodera glycines]
  Gene Ontology: Mol. function=translation initiation factor activity; Biological process=gametogenesis
  Essential gene: C elegans homolog=F55A12.1; Phenotype=Emb
  Coding regions on vcDNA: vcDNA=SeqID_48057; Strand=+; Position=3-321
EDKSNEQNIPPGTVVDTVVVHPKRSEFFLNSHVAIKGTARTPHYTVLRDENDMSMDTLQTMVHYLCFGHQIVTKPTSLPXXXVYIADEYAKRGRNIYSHYAKNGIX

SEQ ID NO: 121635 - protein, 154 aa, Heterodera glycines
  misc_feature (85)..(85): Xaa can be any naturally occurring amino acid
  Homolog annotation: Hit_ID=NP_499296.1; Match level="QueryCoverage =94%, HitCoverage=26%, E-value=6e-19, Identity=34%"; Hit description =histone (3L496) [Caenorhabditis elegans] emb|CAA88954.1| Hypothetical protein M03C11.4 [Caenorhabditis el
  Essential gene: C elegans homolog=M03C11.4; Phenotype=Emb
  Coding regions on vcDNA: vcDNA=SeqID_48058; Strand=+; Position=2-592
RALFGSTLFLTSFYECEQKEGDSTKCDDIEYRIKDALPQTQLNAYLTIEKFRQKLSEQKNFVPFGELITKFCLKGGEKKTAKRCXQFDQGCKFLERVQALAHWYIDAVSYTDNDDHRYFNYFLFAVRPSSDGDGSSVHRFAGYVNLYRFYHHPD

SEQ ID NO: 121636 - protein, 219 aa, Heterodera glycines
  Homolog annotation: Hit_ID=CAE68452.1; Match level="QueryCoverage =91%, HitCoverage=67%, E-value=3e-55, Identity=50%"; Hit description =Hypothetical protein CBG14242 [Caenorhabditis briggsae]
  Gene Ontology: Mol. function=protein binding
  Essential gene: C elegans homolog=D2013.6; Phenotype=Gro,Stp
  Coding regions on vcDNA: vcDNA=SeqID_48059; Strand=+; Position=93-749
MSLNTANTPDGRGVIIYSGEMILLFVREVNLSFDKFTNAAFKGTKKGNLYLTTHRIIFNNTETSSRGNFKSLSMPFGCIRNVKLEQPTFGANYLAGELVAQPDGNWEGGVNWKLTFNRGGCIEFGQALQKTSEMANNFCPRPANAPPPYAPPPGAYYSPPPAYYWSGGQFNGYQAPVHAFPDQPPPESVFMYEQPPPYAGDWANSWSKSGPIPVEYAPV

SEQ ID NO: 121637 - protein, 217 aa, Heterodera glycines
  Homolog annotation: Hit_ID=XP_354754.2; Match level="QueryCoverage =90%, HitCoverage=18%, E-value=9e-31, Identity=39%"; Hit description =RIKEN cDNA 3010025E17 [Mus musculus]
  Gene Ontology: Mol. function=actin binding; Cellular component =cytoskeleton; Biological process=intracellular protein transport
  Essential gene: C elegans homolog=C47D12.7; Phenotype=Unclassified
  Coding regions on vcDNA: vcDNA=SeqID_48060; Strand=+; Position=28-678
MLNRRPRKFENKLSACGDQKNFKAMLENFNSLRVNRQLCDVEIECQGKSLLVHKVVLAATIDYFRGLYNFGMVDAQADKIEIKEVSFIGLSQIIDFAYTYEVKINEENVRELLHAANYLGVTFVKDGCEHFLIKLMTIENCLGLRELSDQHSCEQLLAAIEAFMLEHFMEICHKEEFMALDSVTTLERLAKSDDLNITDERFLFEFLVKWVEMDKTG

SEQ ID NO: 121638 - protein, 218 aa, Heterodera glycines
  Homolog annotation: Hit_ID=NP_509702.2; Match level="QueryCoverage =99%, HitCoverage=34%, E-value=5e-88, Identity=68%"; Hit description =UNCoordinated locomotion UNC-115, putative actin-binding protein family member (72.2 kD) (unc-115) [Caeno
  Gene Ontology: Mol. function=actin binding; Cellular component=actin cytoskeleton; Biological process=histogenesis and organogenesis
  Essential gene: C elegans homolog=F09B9.2a; Phenotype=Gro,Lon,Unc
  Coding regions on vcDNA: vcDNA=SeqID_48061; Strand=+; Position=1-654
GQILLALGTSWHVWCFKCAECAAVLQGEYMAHSGRPLCLRDYNQMFGVRCCECDRFIAGRVLEAGGYKFHPTCARCSRCQLPFDDGAEMYMQGNEIWHPNCEHYRTTENIAISKPSVKGSKFQSQFGQHLTYMYMLPETEQTLLKHPIAPNPPQPTQYHTPQGPVIKIRKSRYSMLKTGMQRLTEDLERTRPRSRSSSVDNDEPIELAHFPGAKVPDK

SEQ ID NO: 121639 - protein, 86 aa, Heterodera glycines
  Homolog annotation: Hit_ID=AAH06182.1; Match level="QueryCoverage =95%, HitCoverage=55%, E-value=2e-39, Identity=97%"; Hit description =CALM3 protein [Homo sapiens]
  Gene Ontology: Mol. function=calcium ion binding
  Essential gene: C elegans homolog=T21H3.3; Phenotype=Emb,Ste
  Coding regions on vcDNA: vcDNA=SeqID_48062; Strand=+; Position=3-260
NCRVQEAFSLFDKDGDGTITTKELGTVMRSLGQNPTEAELHDMINEVDADGNGTIDFPEFLTMMARKMKDTDSEEEIREAFRVFDK

SEQ ID NO: 121640 - protein, 236 aa, Heterodera glycines
  Homolog annotation: Hit_ID=CAE59917.1; Match level="QueryCoverage =96%, HitCoverage=71%, E-value=1e-103, Identity=76%"; Hit description= Hypothetical protein CBG03402 [Caenorhabditis briggsae]
  Gene Ontology: Cellular component=actin filament; Biological process =signal transduction
  Essential gene: C elegans homolog=K04D7.1; Phenotype=Gro,Slu
  Coding regions on vcDNA: vcDNA=SeqID_48063; Strand=+; Position=2-709
GGLPPWPNGWVTQIATNPLYKNMLVSASRDKTIIVWMLDESGSVLNGKPIKSLHGHGHFVSDVVMSSDGQYALSGSWDKTLRLWDLNTGQTTRQFVSHTQDVLSVAFSADNRQIVSGSRDKKIKLWNTLAQCKHTIVEECHSDWVSTVRFSPSHANPVIVSAGWDKIVKVWNLATCRLKTNHFGHTGYINSVTVSPDGSLCASGGKDGSAMLWDLNDGKHLYTLGGNDVINALAFS

SEQ ID NO: 121641 - protein, 212 aa, Heterodera glycines
  misc_feature (35)..(35): Xaa can be any naturally occurring amino acid
  Homolog annotation: Hit_ID=AAK55116.1; Match level="QueryCoverage =100%, HitCoverage=100%, E-value=1e-128, Identity=98%"; Hit description=venom allergen-like protein [Heterodera glycines]
  Gene Ontology: Cellular component=intracellular
  Essential gene: C elegans homolog=F49E11.9; Phenotype=Unclassified
  Coding regions on vcDNA: vcDNA=SeqID_48064; Strand=+; Position=9-645
MHLINLIALFFMLFGPSVQQYTKTPTNEDKEAAVXLYNKFRSQLALGNADNKLGGNKMPKAGNMRKFEWDENLAKLADEWANKCTLSHSWNGWAGENLAMNGGTFSNKDGFEYACGRWWDELNRYGFNPDLIMTGENFSGIGHWTQMAWADTDRIGCAMAQNCPNTNWKTYVVCWYYTGGNYFGAPVYLAGEPCSKCKANDKCDKATGLCSQ

SEQ ID NO: 121642 - protein, 47 aa, Heterodera glycines
  Homolog annotation: Hit_ID=NP_496200.1; Match level="QueryCoverage =100%, HitCoverage=31%, E-value=1e-09, Identity=57%"; Hit description= thioredoxin family member (17.3 kD) (2K489) [Caenorhabditis elegans] emb|CAA88726.1| Hypothetical protei
  Essential gene: C elegans homolog=R05H5.3; Phenotype=Emb
  Coding regions on vcDNA: vcDNA=SeqID_48065; Strand=+; Position=19-159
MAQLLAGEKVVLSDGSKVEAEVFLKDKVVAVYFSAGWCPPCRAFTPK

SEQ ID NO: 121643 - protein, 130 aa, Heterodera glycines
  Homolog annotation: Hit_ID=P02270; Match level="QueryCoverage=96%, HitCoverage=100%, E-value=4e-53, Identity=83%"; Hit description =Histone H2A pir||HSIN21 histone H2A - sipunculid (Sipunculus nudus)
  Gene Ontology: Mol. function=DNA binding; Cellular component =nucleosome; Biological process=nucleosome assembly
  Essential gene: C elegans homolog=T23D8.6; Phenotype=Emb
  Coding regions on vcDNA: vcDNA=SeqID_48066; Strand=+; Position=152-544
MSGRGKGGKAKTEDGKNKSRSSRAGLQFPVGRLHRLLRKGHYAERVGVGAPVYLAAVLEYLTAEVLELAGNASRDNRKTRINPRHLQLAVRNDEELNKLLSGVTISEGGVLPNINPVLLPKKSQHSEVSE

SEQ ID NO: 121644 - protein, 164 aa, Heterodera glycines
  Homolog annotation: Hit_ID=CAA60629.1; Match level="QueryCoverage =84%, HitCoverage=99%, E-value=3e-60, Identity=81%"; Hit description =unnamed protein product [Acanthamoeba sp. 4b3]
  Essential gene: C elegans homolog=F25B5.4a; Phenotype=Emb
  Coding regions on vcDNA: vcDNA=SeqID_48067; Strand=+; Position=85-579
MACKFSSKHNWPSNTLEVESSDSIENLKRKITDKEGIPADDQRLIFAGKQLEDGRTLADYGVQKEAKIHLVLRLRGGMQIFIKTLTGKVITLEVDSMDSVENVKRKITDKEGIPADHQRLVFAGKQLEDGRTLADYGVQKEATVHLVLRLRGGGSMMNFDDDVL

SEQ ID NO: 121645 - protein, 236 aa, Heterodera glycines
  misc_feature (218)..(218): Xaa can be any naturally occurring amino acid
  Homolog annotation: Hit_ID=NP_501804.1; Match level="QueryCoverage =100%, HitCoverage=47%, E-value=1e-102, Identity=78%"; Hit description=seryl tRNA Synthetase (55.2 kD) (srs-2) [Caenorhabditis elegans] emb|CAA93105.1| Hypothetical protein C
  Gene Ontology: Mol. function=serine-tRNA ligase activity; Cellular component=cytoplasm; Biological process=tRNA processing
  Essential gene: C elegans homolog=C47E12.1; Phenotype=Emb,Lva,Ste,Unc
  Coding regions on vcDNA: vcDNA=SeqID_48068; Strand=+; Position=2-707
KSYSHVDLVVMCDGFDGERGTNVAGGRGYFLKGPLVFLEQALIALALQMLNKKGFTPLYTPFFMRKDVMQEVAQLSQFDEELYKVTTAKKTDAANEDGSPDEKYLIATSEQPIAAFHRDEWLNPSDLPIKYAGMSTCFRQEVGSHGRDTRGIFRVHQFEKIEQFVICSPFDNESWKHMDEMIDNAEEFCKVLGLPYRIVAIVSAELNNAAAKKLDLEXAWFPGSGAFRELVSCSNC

SEQ ID NO: 121646 - protein, 201 aa, Heterodera glycines
  Homolog annotation: Hit_ID=CAE57411.1; Match level="QueryCoverage =95%, HitCoverage=23%, E-value=2e-29, Identity=35%"; Hit description =Hypothetical protein CBG00366 [Caenorhabditis briggsae]
  Essential gene: C elegans homolog=ZK550.3; Phenotype=Emb,Sck,Sma,Stp
  Coding regions on vcDNA: vcDNA=SeqID_48069; Strand=+; Position=1-603
FFQMAGSPKLSASLSTTFRRFRPVFFSRLEGAWKTYAEEQEERVISDLEAFDLFYICRKEAEHNQNVDSLELMKHFPVLSTFDKMLLLSSELFNIEFREVTNDYENQSFERCDPSVRLFDVTDNATNSRIGFLYVDIFSRETKKIGRGQWLSMLGRPPNQLRDLDALVYFLGAHPHSENEHESFLHHEELSEMLSAFGRAL

SEQ ID NO: 121647 - protein, 200 aa, Heterodera glycines
  misc_feature (42)..(42): Xaa can be any naturally occurring amino acid
  Homolog annotation: Hit_ID=AAQ89579.1; Match level="QueryCoverage =98%, HitCoverage=29%, E-value=1e-107, Identity=99%"; Hit description= heat shock protein 70-C [Heterodera glycines] gb|AAM93256.1| heat shock protein 70-C [Heterodera glycines
  Gene Ontology: Mol. function=Hsp70/Hsp90 organizing protein activity; Cellular component=endoplasmic reticulum lumen; Biological process =SRP-dependent cotranslational membrane targeting, translocation
  Essential gene: C elegans homolog=C15H9.6; Phenotype=Dpy,Lva
  Coding regions on vcDNA: vcDNA=SeqID_48070; Strand=+; Position=32-630
GILNGKEPSRGINPDEAVAYGAAVQAGVISGEENSEIVLLDXNPLTMGIETVGGVMTKLITRNTVIPTKKSQIFSTAADNQPTVTIQVFEGERPMTKDNHLLGKFDLTGIPPAPRGVPQIEVTFEIDVNGILHVTAEDKGTGNKNKITITNDHNRLSPEEIERMINDAEKFAEEDKKTKEVVEARNEFESYAYSLKNQLG

SEQ ID NO: 121648 - protein, 203 aa, Heterodera glycines
  Homolog annotation: Hit_ID=CAB60439.2; Match level="QueryCoverage =99%, HitCoverage=48%, E-value=2e-83, Identity=71%"; Hit description =Hypothetical protein Y80D3A.1 [Caenorhabditis elegans] emb|CAE17953.1| Hypothetical protein Y80D3A.1 [Caen
  Gene Ontology: Mol. function=tryptophan-tRNA ligase activity; Cellular component=cytoplasm; Biological process=tRNA modification
  Essential gene: C elegans homolog=Y80D3A.1; Phenotype=Lva
  Coding regions on vcDNA: vcDNA=SeqID_48071; Strand=+; Position=2-610
QKTFIFLDTEYMRPSFYENVLKVWKSVTNNQSRAIFGFTGEDSMGKSAFPAIEAAPCFSSSFPEIFNGRRDIPCLIPCAIDQDPYFRMSRDVAPRLKYPKPSLIYSTFLPALQGAQSKMAASEANSCIYLDDTPKKIKEKINKYAFSGGRDTKEEHRQFGGDCTVDTSFQFLRFFLDDDERLEDIREQYASGAMFSGELKAIA

SEQ ID NO: 121649 - protein, 238 aa, Heterodera glycines
  Homolog annotation: Hit_ID=NP_497675.1; Match level="QueryCoverage =85%, HitCoverage=47%, E-value=9e-63, Identity=60%"; Hit description =nadh dehydrogenase (48.3 kD) (3E332) [Caenorhabditis elegans] gb|AAF59528.2| Hypothetical protein Y53G8AL
  Gene Ontology: Mol. function=NADH dehydrogenase (ubiquinone) activity; Cellular component=mitochondrial matrix; Biological process=sodium ion transport
  Essential gene: C elegans homolog=Y53G8AL.2; Phenotype=Emb,Lva
  Coding regions on vcDNA: vcDNA=SeqID_48072; Strand=+; Position=17-730
MIIRSKAVQLLTCYRNRITRKLQYSTTENVPVNVPEPVISSSNMAQFRKGAGGRSSFSGNVITVFGNTGFTGRRVVNRLARHANQLILPYRCDSYFLRELKVPCDLGQVLFFPFQLDDDESIRKAVKYSNVVINMIGTYVDTPNYSIYDANVEGAWRIARICREMGVERLIHVSALNADPSYKTQFIKNGAFLKSKGMAEHAVHAEFPSATIIRPSVMYGDIDRLIYNLITRWRVDPF

SEQ ID NO: 121650 - protein, 245 aa, Heterodera glycines
  Homolog annotation: Hit_ID=CAE63617.1; Match level="QueryCoverage =68%, HitCoverage=49%, E-value=1e-22, Identity=41%"; Hit description =Hypothetical protein CBG08110 [Caenorhabditis briggsae] emb|CAE56356.1| Hypothetical protein CBG24030 [Cae
  Gene Ontology: Mol. function=acyl-CoA thioesterase activity; Biological process=acyl-CoA metabolism
  Essential gene: C elegans homolog=C17C3.1a; Phenotype=Unclassified
  Coding regions on vcDNA: vcDNA=SeqID_48073; Strand=+; Position=59-793
MRSFCTSNSLSVFSNFRFIQKLLSVLRKVAGKCHLSQIWRISPSNWTWIISNGWHASNGPALSLLGYRKAVNRDVFGGQMFAQAIAAAEATVDGDEFAPNAAHSMFIRKAFIDHPIEYIVTRTRDGRSFCTRTVEARQNGEAVFCAQISLCVKERSSIEHQTEMPAEVPEPEELVPFFETVRRVVTEHDEGRTERNGRTIANLRAVLEDEQQPSVFEFRPIHSDIFLGIRPHSPTPIRYWLKCAV

SEQ ID NO: 121651 - protein, 166 aa, Heterodera glycines
  Homolog annotation: Hit_ID=NP_741609.1; Match level="QueryCoverage =88%, HitCoverage=52%, E-value=8e-31, Identity=45%"; Hit description =i-90 protein precursor family member (30.7 kD) (5K464) [Caenorhabditis elegans] emb|CAB02796.1| Hypotheti
  Essential gene: C elegans homolog=T05G5.7; Phenotype=Emb
  Coding regions on vcDNA: vcDNA=SeqID_48074; Strand=+; Position=3-503
SRLLRLQLCATLHVLKWTAAAVGSRTDFLGTKERIEQGNFFRDVLDKALAINPEEYTLLHMRGRLVLSVASLSWIERKAATVLFGPPPEVSLNEATRDFTAVLELAPDWLENTLFLAKAYLANSDRESAVHHLKQLIDSYQQNENDKDQPEALKEAKALLKKHGRK

SEQ ID NO: 121652 - protein, 211 aa, Heterodera glycines
  misc_feature (13)..(14): Xaa can be any naturally occurring amino acid
  Homolog annotation: Hit_ID=NP_491654.1; Match level="QueryCoverage =96%, HitCoverage=31%, E-value=2e-54, Identity=52%"; Hit description =CBF1 interacting corepressor (65.8 kD) (1G222) [Caenorhabditis elegans] gb|AAB37808.1| Hypothetical prote
  Gene Ontology: Biological process=growth
  Essential gene: C elegans homolog=F55F8.4; Phenotype=Emb
  Coding regions on vcDNA: vcDNA=SeqID_48075; Strand=+; Position=38-668
HKALLGDEKARLXXLSFMYDAPAGINKKKEEGPEPKFEWQRKYNAPREEWAKGNELIQDQPFGIQVRNVRCVKCRAWGHLNTDRECPLYGMSGNAEDHGYANNPSDIIRDLNVEKKTKTVSDVTTNEQIDIKPKIEVRKSHEEKKKKRRHYSSEEEEEGTEEEEKKPEPIDQEQLLVNMREEHNLKFKTGILIGLRADEHIKKMSAMVGGW

SEQ ID NO: 121653 - protein, 76 aa, Heterodera glycines
  Homolog annotation: Hit_ID=NP_502542.1; Match level="QueryCoverage =100%, HitCoverage=46%, E-value=1e-26, Identity=71%"; Hit description= ribosomal Protein, Large subunit (17.8 kD) (rpl-12) [Caenorhabditis elegans] emb|CAB05226.1| Hypothetica
  Gene Ontology: Mol. function=structural constituent of ribosome; Cellular component=cytosolic large ribosomal subunit (sensu Eukarya)
  Essential gene: C elegans homolog=JC8.3a; Phenotype=Ste
  Coding regions on vcDNA: vcDNA=SeqID_48076; Strand=+; Position=2-232
RDRKKVENVKHSGNLTIEQVINIARQMRPRSIARKLQGTVKEILGTAQSVGCTVDGQHPHDIVDMTRAGEIEVPEE

SEQ ID NO: 121654 - protein, 171 aa, Heterodera glycines
  Homolog annotation: Hit_ID=CAE59389.1; Match level="QueryCoverage =95%, HitCoverage=11%, E-value=3e-42, Identity=53%"; Hit description =Hypothetical protein CBG02746 [Caenorhabditis briggsae]
  Gene Ontology: Mol. function=DNA topoisomerase type II activity; Cellular component=chromatin accessibility complex; Biological process=chromatin assembly/disassembly
  Essential gene: C elegans homolog=K12D12.1; Phenotype=Emb
  Coding regions on vcDNA: vcDNA=SeqID_48077; Strand=+; Position=13-525
NGRTSRSRTKGIYDVFSLKASVNTSNMVLFDAAGCLRKFDSPEQICLEFFECRRELYKKRKRYLEGMLQAQSDQLSEKARFIVMKIKNEIHIENKRKSAIVEQLQKHKFRPDPVKRWKDEQKRKELELCGEANVSDDEEDEDEHADQAVDEALEKRCSDYDYLVGMAIWKL

SEQ ID NO: 121655 - protein, 240 aa, Heterodera glycines
  misc_feature (23)..(23): Xaa can be any naturally occurring amino acid
  misc_feature (36)..(36): Xaa can be any naturally occurring amino acid
  Homolog annotation: Hit_ID=CAE57680.1; Match level="QueryCoverage =98%, HitCoverage=43%, E-value=6e-98, Identity=74%"; Hit description =Hypothetical protein CBG00674 [Caenorhabditis briggsae]
  Gene Ontology: Mol. function=chaperone activity; Cellular component =actin filament; Biological process=cell organization and biogenesis
  Essential gene: C elegans homolog=K01C8.10; Phenotype=Emb,Lva,Ste
  Coding regions on vcDNA: vcDNA=SeqID_48078; Strand=+; Position=3-720
RWYTPVVVLAGSLLDAAEKLLAXGIHPTTISDSFHXAATFSEKVLEEMATPIDINDDDELVKLAMTSLNSKVVSQYSHLLAPMAVQAVKKLMSSPEDSSVNLKLIKVVKKLGETVEESQLIEGALIDQKSMGHGGPARVEKAKIGLIQFQISPPKPNMENQVVISDYAQMDRALKEERNYILELCKQIKKAGCNVLLIQKSILRDAINEMALHFFAKMKIMVIKDIERDDIEFYAKILGC

SEQ ID NO: 121656 - protein, 134 aa, Heterodera glycines
  Homolog annotation: Hit_ID=NP_502515.1; Match level="QueryCoverage =94%, HitCoverage=31%, E-value=8e-24, Identity=45%"; Hit description =papillary renal cell carcinoma like (44.9 kD) (4N856) [Caenorhabditis elegans] emb|CAA94340.1| Hypothetic
  Gene Ontology: Biological process=embryogenesis and morphogenesis
  Essential gene: C elegans homolog=C39E9.11; Phenotype=Unc
  Coding regions on vcDNA: vcDNA=SeqID_48079; Strand=+; Position=52-456
MGRAEGNEGPIKNARAISDEQAHRLIYEKELAPFGANPMIAQDAVSQMLDVSVDNALGPNVRENLLKNLSGKQLAQLPLAPLPKMKKSDSDKLAKRKHQITHLATVAVSREEQLKDKWADSKQTKKMSRQKLGF

SEQ ID NO: 121657 - protein, 228 aa, Heterodera glycines
  Homolog annotation: Hit_ID=NP_740776.1; Match level="QueryCoverage =99%, HitCoverage=28%, E-value=1e-110, Identity=81%"; Hit description= ubiquitin-protein ligase with C2 and WW domains; suppressor of deltex; atrophin-1 interacting protein Ne
  Gene Ontology: Mol. function=protein binding; Cellular component =ubiquitin ligase complex; Biological process=signal transduction
  Essential gene: C elegans homolog=Y65B4BR.4a; Phenotype=Unclassified
  Coding regions on vcDNA: vcDNA=SeqID_48080; Strand=+; Position=1-684
PPRTGRPVGPLGGPGLHMAADKTFKNKVAQFRYLCYSNSVPNHVKISVTRNNLFEDSFQEIMRKNPFDLRRRLYIQFKAEDGLDYGGIAREWFFLLSHEVLNPMYCLFMYANSSNYSLQINPASFVNPDHLKYFEFIGRFIAMALFHGKFIYSGFTLPFYKKMLNRKITLKDLESVDTEFYNSIVWIRDNDIDECDMELFFVVDYDLLGEVKTHELKENGTEIAVTEA

SEQ ID NO: 121658 - protein, 200 aa, Heterodera glycines
  misc_feature (40)..(40): Xaa can be any naturally occurring amino acid
  Homolog annotation: Hit_ID=XP_417190.1; Match level="QueryCoverage =99%, HitCoverage=81%, E-value=3e-47, Identity=51%"; Hit description =PREDICTED: similar to hypothetical protein [Gallus gallus]
  Gene Ontology: Biological process=mRNA splicing
  Essential gene: C elegans homolog=T10C6.5; Phenotype=Emb
  Coding regions on vcDNA: vcDNA=SeqID_48081; Strand=+; Position=1-599
GYYPVELVSFYYKMTLPSSTFDPAKGGTGRNEGDLAKLSXQYSSRDMPSHMTLKYRQKGQAHPEEVVAKNLRRDIEEREQHSRERRSRDSLDSFGTGPTNKKQRVEDTSSARNLDADEPFDELNEDDTDLDEDSDNEAELMAELERIRKERAAERASKEAKEREEQERIREENILHGNPLLNPASSEFKVKRRWDDDVVF

SEQ ID NO: 121659 - protein, 228 aa, Heterodera glycines
  Homolog annotation: Hit_ID=NP_871804.1; Match level="QueryCoverage =99%, HitCoverage=45%, E-value=1e-101, Identity=77%"; Hit description= phenylalanyl (F) tRNA Synthetase (56.2 kD) (frs-1) [Caenorhabditis elegans] gb|AAO21394.1| Phenylalanyl
  Gene Ontology: Mol. function=phenylalanine-tRNA ligase activity; Cellular component=cytoplasm; Biological process=morphogenesis
  Essential gene: C elegans homolog=T08B2.9a; Phenotype=Emb,Lva
  Coding regions on vcDNA: vcDNA=SeqID_48082; Strand=+; Position=2-688
ARDSMTPFFFKTGTLTEFPEDYLESVRKVHSEGGFGSIGYRYDWKLEEAQKNLLRTHTTAVSARQLYLLAQKPFQPSKMFSIDRVFRNETLDATHLAEFHQVEGVVAERNLSLAHVIGLFTEFFRKCGIENLRFKPTYNPYTEPSMEIYAFHTGLNKWVEIGNSGMFRPEMSLPMGLPEDVAVAGFGLSLERPTMIRYGISNIRELFGHKIDLEMIYRNPLCRLEQKN

SEQ ID NO: 121660 - protein, 183 aa, Heterodera glycines
  Homolog annotation: Hit_ID=XP_309629.1; Match level="QueryCoverage =98%, HitCoverage=18%, E-value=1e-66, Identity=67%"; Hit description =ENSANGP00000011118 [Anopheles gambiae]
  Gene Ontology: Mol. function=DNA topoisomerase type I activity; Cellular component=nucleus; Biological process=chromatin assembly/disassembly
  Essential gene: C elegans homolog=M01E5.5a; Phenotype=Lva,Unc
  Coding regions on vcDNA: vcDNA=SeqID_48083; Strand=+; Position=1-552
EFVEPYLKELMDGLTAKVFRTYNASITLQEQLDKLTNPSDSVHEKMLSYNRANRQVAILCNHQRAVPKTHEKSMENLENKIKEKKQEYKELKDQLKKSKSVDEKMAKKYERLKEQIAKLNTQRTDKDENKQIALGTSKLNYLDPRISVAWCKKNDVPVEKIFSKTQRDKFRWALDMAKEDFIF

SEQ ID NO: 121661 - protein, 199 aa, Heterodera glycines
  Homolog annotation: Hit_ID=AAP51177.1; Match level="QueryCoverage =85%, HitCoverage=36%, E-value=5e-76, Identity=81%"; Hit description =fumarase [Ascaris suum]
  Gene Ontology: Mol. function=fumarate hydratase activity; Cellular component=cytosol; Biological process=fumarate metabolism
  Essential gene: C elegans homolog=H14A12.2a; Phenotype=Emb,Gro
  Coding regions on vcDNA: vcDNA=SeqID_48084; Strand=+; Position=55-651
MLVKSFLGPTKLCQFRLSFFHNSVVKMNSDNFRVERDTFGELRVPSDRYYGAQTARSMQFFKIGGPEERMPLPVIHAFGHLKKAAATVNQDFGLNSKVAAAICEAADDVISGKLDEHFPLVIWQTGSGTQSNMNVNEVISNRAIEILGGELGSKTPVHPNDHVNMSQSSNDTFPTAMHVAVAVEINTRLLPSLRLLHDE

SEQ ID NO: 121662 - protein, 97 aa, Heterodera glycines
  Homolog annotation: Hit_ID=P12431; Match level="QueryCoverage=100%, HitCoverage=25%, E-value=2e-52, Identity=97%"; Hit description =Actin, muscle
  Gene Ontology: Cellular component=actin filament; Biological process =reproduction
  Essential gene: C elegans homolog=T04C12.6; Phenotype=Ste
  Coding regions on vcDNA: vcDNA=SeqID_48085; Strand=+; Position=3-293
MCDEEVAALVVDNGSGMCKAGFAGDDAPRAVFPSIVGRPRHHGVMVGMGQKDSYVGDEAQSKRGILTLKYPIEHGIVTNWDDMEKIWHHTFYNELRV

SEQ ID NO: 121663 - protein, 127 aa, Heterodera glycines
  Homolog annotation: Hit_ID=NP_507032.1; Match level="QueryCoverage =100%, HitCoverage=100%, E-value=7e-60, Identity=91%"; Hit description=histone (13.4 kD) (his-3) [Caenorhabditis elegans] ref|NP_505296.1| histone (13.4 kD) (his-19) [Caenorh
  Gene Ontology: Mol. function=DNA binding; Cellular component =nucleosome; Biological process=nucleosome assembly
  Essential gene: C elegans homolog=T23D8.6; Phenotype=Emb
  Coding regions on vcDNA: vcDNA=SeqID_48086; Strand=+; Position=12-395
MSGRGKGGKAKSGGKAKSRSSRAGLQFPVGRLHRLLRKGHYAERVGAGAPVYLAAVLEYLAAEVLELAGNASRDNKKTRINPRHLQLAVRNDEELNKLLSGVTIAQGGVLPNIQAVLLPKKTHGESQ

SEQ ID NO: 121664 - protein, 97 aa, Heterodera glycines
  misc_feature (7)..(7): Xaa can be any naturally occurring amino acid
  Homolog annotation: Hit_ID=CAB59358.1; Match level="QueryCoverage =100%, HitCoverage=20%, E-value=3e-40, Identity=85%"; Hit description= translation elongation factor eEF-1 alpha chain [Anisakis simplex]
  Gene Ontology: Mol. function=translation factor activity, nucleic acid binding; Biological process=protein biosynthesis
  Essential gene: C elegans homolog=R03G5.1a; Phenotype=Emb,Lva,Unc
  Coding regions on vcDNA: vcDNA=SeqID_48087; Strand=+; Position=1-293
ACKFAEXKEKVDRRSGKKVEDNPKALKTGDAGIVDLIPTKPMCVEAFTDYAPLGRFAVRDTRQTVAVGVIKAVEKTEGGGKVTKSAQKAAAPGGKKK

SEQ ID NO: 121665 - protein, 124 aa, Heterodera glycines
  misc_feature (43)..(43): Xaa can be any naturally occurring amino acid
  Homolog annotation: Hit_ID=XP_392920.1; Match level="QueryCoverage =90%, HitCoverage=69%, E-value=1e-12, Identity=34%"; Hit description =similar to apoptosis inhibitor survivin [Apis mellifera]
  Gene Ontology: Mol. function=apoptosis inhibitor activity; Cellular component=cytoplasm; Biological process=anti-apoptosis
  Essential gene: C elegans homolog=C50B8.2; Phenotype=Emb
  Coding regions on vcDNA: vcDNA=SeqID_48088; Strand=+; Position=27-400
QLYEGRWNYKEGCTAEKMARAGFFCTEKRKKPSDAAKCYICHXHEMYWDPEDEPWEEHKKHRPDCPLVTIGKQNEEEFTVPEVLLLLAYEHSTKMYPVADASMKELDVLMKQLLADTQKAVEGI

SEQ ID NO: 121666 - protein, 185 aa, Heterodera glycines
  misc_feature (11)..(11): Xaa can be any naturally occurring amino acid
  misc_feature (26)..(26): Xaa can be any naturally occurring amino acid
  misc_feature (148)..(148): Xaa can be any naturally occurring amino acid
  Homolog annotation: Hit_ID=NP_501065.1; Match level="QueryCoverage =100%, HitCoverage=30%, E-value=6e-59, Identity=57%"; Hit description= ribophorin I (4H677) [Caenorhabditis elegans] pir||T32708 hypothetical protein T22D1.4 - Caenorhabditis
  Gene Ontology: Mol. function=oligosaccharyl transferase activity; Cellular component=oligosaccharyl transferase complex; Biological process=protein modification
  Essential gene: C elegans homolog=T22D1.4; Phenotype=Unclassified
  Coding regions on vcDNA: vcDNA=SeqID_48089; Strand=+; Position=1-554
IAVAENVEILXKGAKLKGSFSRLDFXMDRRGSRQPVIKNFKTILPAASNDIYYRDEIGNISTSNVYPRADRVEVELRPRFPLYGGWRTNYILGYNVPSTSFLRHSGSNFAIKMKLMDRLYDNAVVEKLCVKIILPETSKNIKLVTPYXTKRLPDEVHKTYLDTFGRPVIVLEKENLINNHIQPFT

SEQ ID NO: 121667 - protein, 203 aa, Heterodera glycines
  misc_feature (191)..(191): Xaa can be any naturally occurring amino acid
  Homolog annotation: Hit_ID=AAH54266.1; Match level="QueryCoverage =100%, HitCoverage=96%, E-value=3e-82, Identity=73%"; Hit description= Rps8-prov protein [Xenopus laevis] sp|Q7SYU0|RS8_XENLA 40S ribosomal protein S8
  Gene Ontology: Cellular component=eukaryotic 48S initiation complex; Biological process=protein biosynthesis
  Essential gene: C elegans homolog=F42C5.8; Phenotype=Lva,Ste
  Coding regions on vcDNA: vcDNA=SeqID_48090; Strand=+; Position=53-662
MGISQDRWHKRRKTGGKRNPIHKKRKFEMGRPAANTKIGPKRIHLVRCRGGNIKHRGLRLDTGNFAWASEGCTRKTRIIDTMYNASNNELVRTKTLVKGMIVSIDAIPFRQWYEAHYALPLARKKGQKLTEDEEARIGGAQKRSKSTLKKYTERQKTAGVEPHLLEQFQAGRLLACISSRPGQSGRCDGYXLEGKELEFYNKK

SEQ ID NO: 121668 - protein, 222 aa, Heterodera glycines
  Homolog annotation: Hit_ID=AAH50916.1; Match level="QueryCoverage =93%, HitCoverage=13%, E-value=5e-20, Identity=32%"; Hit description =Crsp3 protein [Mus musculus]
  Essential gene: C elegans homolog=F39B2.4a; Phenotype=Adl,Egl
  Coding regions on vcDNA: vcDNA=SeqID_48091; Strand=+; Position=1-666
LCPRRFGTPSTDISSTDTLNALGLLLTGLPSSFQAFFLDRIEESFEWSQIASADADPSQLFESLSHEVYLHSDSRILSMLALIHSFCQHGGNNSLSIIPDFVINRLAHKVDNEAQLVYFLRIVVPYLQRIHEKERNKHMPEVSHGHNVRLGQLQISATPYIISIYNVLADLVQKVGRLHYEDSICDLLYQFKYMFVGTTLKEQTEIFILNFPYSMREKLKFL

SEQ ID NO: 121669 - protein, 232 aa, Heterodera glycines
  misc_feature (7)..(7): Xaa can be any naturally occurring amino acid
  Homolog annotation: Hit_ID=CAE64132.1; Match level="QueryCoverage =99%, HitCoverage=28%, E-value=2e-97, Identity=75%"; Hit description =Hypothetical protein CBG08748 [Caenorhabditis briggsae]
  Gene Ontology: Mol. function=transporter activity; Cellular component= clathrin adaptor; Biological process=intracellular protein transport
  Essential gene: C elegans homolog=Y105E8A.9; Phenotype=Emb
  Coding regions on vcDNA: vcDNA=SeqID_48092; Strand=+; Position=3-697
EMNDILXQVATNTETTKNVGNAILYETVLTLMETKSESGLRVLAVNILGRFLLNTDKNIRYVALNTLLKTVAIDFQAVQRHRTTVVECLKDADISIKKRALELCFALMNQTNIASMSKEIIIFLETADSDFKAECSSKMYVATERFSPSLVWHLDTMINVLQLAANHVPDEVVSAMIQLISSQQELQHYATVQLFHASKREHIVNAQPLMQIAFWSIGEFGDLLVTPGNTED

SEQ ID NO: 121670 - protein, 192 aa, Heterodera glycines
  Homolog annotation: Hit_ID=CAA70694.1; Match level="QueryCoverage =100%, HitCoverage=53%, E-value=1e-100, Identity=97%"; Hit description=cathepsin S-like cysteine proteinase [Heterodera glycines]
  Gene Ontology: Mol. function=cathepsin S activity; Cellular component= extracellular space; Biological process=proteolysis and peptidolysis
  Essential gene: C elegans homolog=T03E6.7; Phenotype=Emb,Gro,Unc
  Coding regions on vcDNA: vcDNA=SeqID_48093; Strand=+; Position=28-603
MAFLSRLSILPNSPISLLAVSLAVLAFVALASANPPTARETAPNAQQNNANSVATGEIAKNIAEKMERMNEFINYFRAKKFIDAHNLAFEKGEVSFKVAPNHLMHFTPAQYNRIRGLQMRSNRQRHNMATLAGNSSTLPEKLDWREKGAVTEVKDQGDCGSCWAFSATGAIEGALAQKKASKIISLSEQNLV

SEQ ID NO: 121671 - protein, 195 aa, Heterodera glycines
  Homolog annotation: Hit_ID=CAE57411.1; Match level="QueryCoverage =98%, HitCoverage=27%, E-value=6e-35, Identity=35%"; Hit description =Hypothetical protein CBG00366 [Caenorhabditis briggsae]
  Essential gene: C elegans homolog=ZK550.3; Phenotype=Emb,Sck,Sma,Stp
  Coding regions on vcDNA: vcDNA=SeqID_48094; Strand=+; Position=1-585
TSFERCDPSVRLFDVTDNATNSRIGFLYVDIFSRETKKIGRGQWLSMLGRPPNQLRDLDALVYFLGAHPHSENEHESFLHHEELSEMLSAFGRALQLLLSRAPCHFLSLPLAPYYASDFDANDFMPAFMKFCIYKPRFLGLLSSPNSQNGQQLCDEKATTYAKALQRATFWDSHRILFWTDFDLTIHNMQDWRKK

SEQ ID NO: 121672 - protein, 96 aa, Heterodera glycines
  misc_feature (76)..(76): Xaa can be any naturally occurring amino acid
  Homolog annotation: Hit_ID=CAE67815.1; Match level="QueryCoverage =92%, HitCoverage=17%, E-value=6e-13, Identity=39%"; Hit description =Hypothetical protein CBG13395 [Caenorhabditis briggsae]
  Essential gene: C elegans homolog=M176.2; Phenotype=Emb,Lva
  Coding regions on vcDNA: vcDNA=SeqID_48095; Strand=+; Position=3-291
TAEIVAFSLFPSPFPRQLFEQAKNVQMDFNLLYFRVSNDYEFLVETYVELAKTNEQIRMHLQILKKTHEEGIKQTXPLCWPQSSDYMCHEAKNNDE

SEQ ID NO: 121673 - protein, 229 aa, Heterodera glycines
  misc_feature (54)..(54): Xaa can be any naturally occurring amino acid
  misc_feature (70)..(70): Xaa can be any naturally occurring amino acid
  misc_feature (177)..(177): Xaa can be any naturally occurring amino acid
  Homolog annotation: Hit_ID=CAE66268.1; Match level="QueryCoverage =89%, HitCoverage=25%, E-value=2e-75, Identity=67%"; Hit description =Hypothetical protein CBG11512 [Caenorhabditis briggsae]
  Gene Ontology: Cellular component=nucleus; Biological process =embryogenesis and morphogenesis
  Essential gene: C elegans homolog=H37A05.1; Phenotype=Emb
  Coding regions on vcDNA: vcDNA=SeqID_48096; Strand=+; Position=3-690
MDFELFDEKAKEKRSLRLSRDQLDLLNLNYGSNDARFSITSYYQGTAWCSCHIXKLPLPDKLVIFFIDGXITKSDVLGHVIPAIGGTWAHSGVAELYTGIKKNGYQMVYLSSRAIGQSHYTKTYLQNFAQGSRTLPDGPVLLSPSSVLMAFRKEVIERKPEEFKIACLTDLKSLFPXGQPFFAGFGNRETDVKSSLAVQIPPERIMIIDPQGSLRRADNKAGGYVSDYP

SEQ ID NO: 121674 - protein, 236 aa, Heterodera glycines
  misc_feature (6)..(6): Xaa can be any naturally occurring amino acid
  Homolog annotation: Hit_ID=XP_318051.1; Match level="QueryCoverage =99%, HitCoverage=53%, E-value=1e-84, Identity=64%"; Hit description =ENSANGP00000010668 [Anopheles gambiae]
  Gene Ontology: Mol. function=ATP dependent helicase activity; Biological process=ribosome biogenesis
  Essential gene: C elegans homolog=Y55F3BR.1; Phenotype=Gro,Stp,Unc
  Coding regions on vcDNA: vcDNA=SeqID_48097; Strand=+; Position=13-719
MIVCSXTLHTWQYNGWRLSICTFPQWIDLKGQDSVPETVHQVVCMVDPCEDKSWIRLRSKPGQSVQTDSVHARDQLRPGSDNPETLSEAVKVLKGEYLVKAVEEHKMDQAIVFCRTKLDCDNMEKFLAPRGYKCVCLHGDRSADERTRNLLSFKEKIVRFLICTDVAARGLDIKGVPYVVNVTLPPAEEKANYVHRIGRVGRAERMGLAISLVSTVPEKVWYHQCRSRRANCNNTR

SEQ ID NO: 121675 - protein, 123 aa, Heterodera glycines
  Homolog annotation: Hit_ID=P30757; Match level="QueryCoverage=100%, HitCoverage=100%, E-value=1e-54, Identity=85%"; Hit description =Histone H2B pir||S16084 histone H2B - sipunculid (Sipunculus nudus)
  Gene Ontology: Mol. function=DNA binding; Cellular component =nucleosome; Biological process=nucleosome assembly
  Essential gene: C elegans homolog=H02I12.6; Phenotype=Gro,Pvl,Ste
  Coding regions on vcDNA: vcDNA=SeqID_48098; Strand=+; Position=69-440
MPPKPSGKGAKRAVKSTKTVRTADKKRKKSRKESYSVYIYRVLKQVHPDTGISSKAVSIMNSFVNDVFERIAAEASRLAHYNKRSTISSREIQTAVRLILPGELAKHAVSEGTKAVTKYTSSK

SEQ ID NO: 121676 - protein, 235 aa, Heterodera glycines
  Homolog annotation: Hit_ID=XP_425939.1; Match level="QueryCoverage =82%, HitCoverage=30%, E-value=1e-23, Identity=35%"; Hit description =PREDICTED: similar to chronic myelogenous leukemia tumor antigen 66 short form [Gallus gallus]
  Essential gene: C elegans homolog=C44E4.5; Phenotype=Unclassified
  Coding regions on vcDNA: vcDNA=SeqID_48099; Strand=+; Position=52-756
MEVVPQQPADVAEEHKAIGGAEEIAVNDVQPSAAGDAQQQFNSEQLEECDRPPDAEDDVSAFWVDGDSHELVAMTIVNELLFTQKISPGGAPVFATRYDVDTIVWQLDPNVSPSDQKQNNVLVNHLFTLNAFGYIQAGHQDKRFLGCSPDGRYAALINRTNHCFLYFQNSAISSEHELKNRRTGKRAEHIAKQLVLSMSDLDKEFDPNDSSNEFIAFHATAETLFLLTRCAIYAV

SEQ ID NO: 121677 - protein, 230 aa, Heterodera glycines
  Homolog annotation: Hit_ID=NP_073153.1; Match level="QueryCoverage =71%, HitCoverage=8%, E-value=4e-19, Identity=32%"; Hit description =anaphase promoting complex subunit 1 [Homo sapiens] emb|CAC19484.1| Tsg24 protein [Homo sapiens] sp|Q9H1A4
  Gene Ontology: Mol. function=ATP binding; Cellular component=anaphase- promoting complex; Biological process=cell organization and biogenesis
  Essential gene: C elegans homolog=W10C6.1; Phenotype=Mei,Ste
  Coding regions on vcDNA: vcDNA=SeqID_48100; Strand=+; Position=3-692
MPLHACHNVVGPRMGGANSSLGRAYTPGGGGANHNNGGTSGQSVARHADHSGIGQPCSIHLRELPTLNTHLTSPAAAVALGLIYLRTGDCWIRETLAIADTFYEIDQIRPDMLMIRTFSRCLVDFEDIKCTREWVDAQIPQIIRKYVKRFLEVKSKEDMWWSDFNDMATVAKAYFYGFAGASFAMALRFASKWEIKALQVIQSFYEILKTDTSELATSTEGHSPVDLAHQ

SEQ ID NO: 121678 - protein, 206 aa, Heterodera glycines
  misc_feature (13)..(13): Xaa can be any naturally occurring amino acid
  Homolog annotation: Hit_ID=NP_501440.1; Match level="QueryCoverage =99%, HitCoverage=93%, E-value=1e-96, Identity=57%"; Hit description =ADP ATP carrier protein family member (4J224) [Caenorhabditis elegans] gb|AAB38001.1| Hypothetical protei
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_48101; Strand=+; Position=1-617
CYFPTHALNFAFXDTYKRVFTQGVDKEKQFLKFFAMNLASGGAAGATSLCFVYPLDFARTRLAADVGKADAREFKGLADCIMKILKSDGPIGLYRGFFVSVQGIIIYRAAYFGCFDTAKMLFSPEGKQMNFFVNWAIAQVVTVSSGVLSYPWDTVRRRMMMQSGRKDIMYKNTLDCAIKIIKNEGLLKGMFKGALSNVFRGTGGAL

SEQ ID NO: 121679 - protein, 174 aa, Heterodera glycines
  Homolog annotation: Hit_ID=CAA70694.1; Match level="QueryCoverage =100%, HitCoverage=49%, E-value=4e-94, Identity=100%"; Hit description=cathepsin S-like cysteine proteinase [Heterodera glycines]
  Gene Ontology: Mol. function=cathepsin K activity; Cellular component= lysosome; Biological process=proteolysis and peptidolysis
  Essential gene: C elegans homolog=T03E6.7; Phenotype=Emb,Gro,Unc
  Coding regions on vcDNA: vcDNA=SeqID_48102; Strand=+; Position=26-547
MAFLSRLSILPNSPISLLAVSLAVLAFVALASANPPTARETAPNAQQNNANSVATGEIAKNIAEKMERMNEFIKAKKFIDAHNLAFEKGEVSFKVAPNHLMHFTPAQYNRIRGLQMRSNRQRHNMATLAGNSSTLPEKLDWREKGAVTEVKDQGDCGSCWAFSATGAIEGALAQ

SEQ ID NO: 121680 - protein, 213 aa, Heterodera glycines
  Homolog annotation: Hit_ID=AAL06642.1; Match level="QueryCoverage =62%, HitCoverage=21%, E-value=1e-34, Identity=54%"; Hit description =serine-threonine protein kinase [Ancylostoma caninum]
  Gene Ontology: Mol. function=transmembrane receptor protein serine/threonine kinase activity; Cellular component=integral to plasma membrane; Biological process=TGFbeta receptor signaling pathway
  Essential gene: C elegans homolog=C32D5.2; Phenotype=Sma
  Coding regions on vcDNA: vcDNA=SeqID_48103; Strand=+; Position=3-641
LSLRAQFAPRHRPSPAFPVPSFAPFAFLLFGFLVGLCLLLTFAVPFRCWLLKKKGIPSGVVGSSSSTDSAIALLKQFQQKRHSPAPLQRQAPLGFEQSCSASVDGVTLVQRSIALDLQLMEVFARGRYGELRKAFYRGTVVAVKIFYTTEEESWQNERDIYQCQMLNHENILQFVAADILSSVESLTQMLLITDFHPLGPLYDFLRANGRLSL

SEQ ID NO: 121681 - protein, 230 aa, Heterodera glycines
  misc_feature (18)..(18): Xaa can be any naturally occurring amino acid
  Homolog annotation: Hit_ID=NP_491363.1; Match level="QueryCoverage =100%, HitCoverage=4%, E-value=8e-68, Identity=59%"; Hit description =dynein heavy chain, LEThal LET-354 (dhc-1) [Caenorhabditis elegans] gb|AAK21472.1| Dynein heavy chain pro
  Gene Ontology: Mol. function=dynein ATPase activity; Cellular component=cytoplasmic dynein complex; Biological process=oocyte cell fate determination (sensu Insecta)
  Essential gene: C elegans homolog=T21E12.4; Phenotype=Emb
  Coding regions on vcDNA: vcDNA=SeqID_48104; Strand=+; Position=2-690
VDLVAQSLTVNPNMAIFXTMNPGHSGRSNLPDNLMQQFRSLTMTSPDRGLIAEVMLFSQGFQSFERLANKIVLLFTLCKEQLSNQCHYDFGLRALKYVLVSAGNIKRDAIQRSYDEPSQSGDGAGEQAVASQMSEQQMLFQSVYDTLTPKLVSEDITLFKSPLHQFFPDNSPKQVESLKNEVLSICKTEHFSCSPITGEKGNLWLEKVLHVYQITNRNHGLMLVGASGSG

SEQ ID NO: 121682 - protein, 227 aa, Heterodera glycines
  Homolog annotation: Hit_ID=NP_036172.1; Match level="QueryCoverage =93%, HitCoverage=27%, E-value=1e-49, Identity=44%"; Hit description =cullin 1 [Mus musculus] gb|AAH29260.1| Cullin 1 [Mus musculus] gb|AAD16038.1| SCF complex protein cul-1 [
  Gene Ontology: Mol. function=protein binding; Cellular component =ubiquitin ligase complex; Biological process=apoptosis
  Essential gene: C elegans homolog=D2045.6; Phenotype=Emb
  Coding regions on vcDNA: vcDNA=SeqID_48105; Strand=+; Position=19-699
MDCAFRSSYLQRNTAMARNASKSPQLLVLYCDQLFFISARNMEDEKMDENLDALMTVFIYIDDKDMFQAFFHKFLCKRLVYDTSASEEQERCMIAKLKHMCGFEYTSKLERLLTDVALSRDHSEQFKQQPRTSNVDFSVIVVMSSVWPLQQPVKFEIPRPLLDCIDSYTQYYTNRFNGRKLTWALQMCRGELVSTSNTFPSKYSFLCNTQHIAVLMQFNERNTYTLG

SEQ ID NO: 121683 - protein, 69 aa, Heterodera glycines
  Homolog annotation: Hit_ID=NP_509231.1; Match level="QueryCoverage =100%, HitCoverage=66%, E-value=1e-30, Identity=95%"; Hit description= histone (his-38) [Caenorhabditis elegans] ref|NP_507034.1| histone (his-1) [Caenorhabditis elegans] ref|
  Essential gene: C elegans homolog=ZK131.1; Phenotype=Unclassified
  Coding regions on vcDNA: vcDNA=SeqID_48106; Strand=+; Position=2-211
IRRLARRGGVKRISGLIYEETRSVLKVFLENVIRDAVTYCEHARRKTVAAMDVVYALKRQGRTLYGFGG

SEQ ID NO: 121684 - protein, 164 aa, Heterodera glycines
  Homolog annotation: Hit_ID=P30757; Match level="QueryCoverage=75%, HitCoverage=100%, E-value=1e-55, Identity=88%"; Hit description =Histone H2B pir||S16084 histone H2B - sipunculid (Sipunculus nudus)
  Gene Ontology: Mol. function=DNA binding; Cellular component =nucleosome; Biological process=nucleosome assembly
  Essential gene: C elegans homolog=H02I12.6; Phenotype=Gro,Pvl,Ste
  Coding regions on vcDNA: vcDNA=SeqID_48107; Strand=+; Position=48-539
MPPKPSGKGAKKAVKSTKAVRTGDLKRRKARKESYSVYIYLVLKQVHPDTGISSKAMSIMNSFVNDVFERIAAEASRLAHYNKRSTISSREIQTAVRLILPGELAKHAVSEGTKAVTKYTSSKSTSVSGKGARRVNNRDVSQKDSTAHASNHSAETFSDSLVTE

SEQ ID NO: 121685 - protein, 174 aa, Heterodera glycines
  Homolog annotation: Hit_ID=BAB84191.1; Match level="QueryCoverage =91%, HitCoverage=24%, E-value=6e-76, Identity=83%"; Hit description =flavoprotein subunit of succinate dehydrogenase [Ascaris suum]
  Gene Ontology: Mol. function=succinate dehydrogenase (ubiquinone) activity; Cellular component=mitochondrial inner membrane; Biological process=tricarboxylic acid cycle
  Essential gene: C elegans homolog=C34B2.7; Phenotype=Egl
  Coding regions on vcDNA: vcDNA=SeqID_48108; Strand=+; Position=4-525
KHSASFPISAFTLLFSKNVSGYKIVDHTFDAIVVGAGGACLRAAMGLSEGGMKTFATTKLFPTFSHTVAAQGGINAALGNMNPDDWRWHSYDTVKGSDWLGDQDALPYMTREAPRAAIDSENYGMPFSRTEEGKIYQRAFGGQSNDFGRGGQAHRTCCVADRTGPSLLHTLYGA

SEQ ID NO: 121686 - protein, 116 aa, Heterodera glycines
  Homolog annotation: Hit_ID=CAE60581.1; Match level="QueryCoverage =81%, HitCoverage=18%, E-value=1e-19, Identity=51%"; Hit description =Hypothetical protein CBG04215 [Caenorhabditis briggsae]
  Gene Ontology: Biological process=negative regulation of FGF receptor signaling pathway
  Essential gene: C elegans homolog=Y71F9AM.4a; Phenotype=Lva,Unc
  Coding regions on vcDNA: vcDNA=SeqID_48109; Strand=+; Position=2-349
LRLCDHAFRLYRQFFVLDDSAGTRASMTPTTPASLLFSFWPVQPHSNHFEAFIEGLCRVLYDTLRPLVVHNPHLETLAQLCTLLKVEMIDERCAALPSSHPNAFPPPFSATSPTDA

SEQ ID NO: 121687 - protein, 212 aa, Heterodera glycines
  Homolog annotation: Hit_ID=CAE57582.1; Match level="QueryCoverage =99%, HitCoverage=70%, E-value=5e-74, Identity=66%"; Hit description =Hypothetical protein CBG00561 [Caenorhabditis briggsae]
  Gene Ontology: Mol. function=rRNA binding; Cellular component =ribosome; Biological process=protein biosynthesis
  Essential gene: C elegans homolog=F54C9.5; Phenotype=Lva,Ste
  Coding regions on vcDNA: vcDNA=SeqID_48110; Strand=+; Position=2-637
RDMVVCSAYGHELPKYGIKVGLTNYAAAYATGLLLARRHLNKLKLDSVYKGKENVDGEDFDVEQEGDNPNPFTCVLDTGLARTTTGAKLFGVMKGVADGGIHVPHSETRFFGYDPEEKKYSAEAHRDRIFGKHVADYMAHLKEEDEEAYKRQFSQFIKNGIESGTLEEMYKKAHDAIRADPSFTKKEPKKPKEQKHWNKKKYTLTERKHRVA

SEQ ID NO: 121688 - protein, 141 aa, Heterodera glycines
  Homolog annotation: Hit_ID=AAH46078.1; Match level="QueryCoverage =90%, HitCoverage=89%, E-value=1e-19, Identity=37%"; Hit description =Similar to H2A histone family, member X [Danio rerio] ref|NP _957367.1| similar to H2A histone family, memb
  Gene Ontology: Mol. function=DNA binding; Cellular component =nucleosome; Biological process=nucleosome assembly
  Essential gene: C elegans homolog=T23D8.6; Phenotype=Emb
  Coding regions on vcDNA: vcDNA=SeqID_48111; Strand=+; Position=35-460
MPRHCAKPRSFHAGLKFPVGRVHRKMKKGPFAKRLANGVPVYMTAVSVHITGDLLKIIGDITQSEGMKRLSAFHIRSAARENDELRKLFSGVSLAEVCVLPELESDVEQSSEGSGESDSDESTEGSASGSHEGGGAAGAQQ

SEQ ID NO: 121689 - protein, 185 aa, Heterodera glycines
  Homolog annotation: Hit_ID=AAL78223.1; Match level="QueryCoverage =95%, HitCoverage=71%, E-value=1e-42, Identity=53%"; Hit description =hypothetical protein Hgg-29 [Heterodera glycines]
  Essential gene: C elegans homolog=ZC373.5; Phenotype=Unc
  Coding regions on vcDNA: vcDNA=SeqID_48112; Strand=+; Position=2-556
KGEEWSDIPISECRMAELVRHFFALGWMCDNGSGMAVRVKDYRTGEHLILNSSNSLDIDIFSENDLFVMKMNGEILKSPSKSDRSPTAPFYLLRDNPDLACVIHTHSKWANLITQLIRGDEFKISNQEMIQGCENRLTKGRLDNIDVLVVPIVQTEINEHLLYPILLRTLKQNAGASGILVRGHG

SEQ ID NO: 121690 - protein, 200 aa, Heterodera glycines
  Homolog annotation: Hit_ID=XP_311177.1; Match level="QueryCoverage =99%, HitCoverage=48%, E-value=1e-106, Identity=94%"; Hit description= ENSANGP00000019055 [Anopheles gambiae]
  Gene Ontology: Biological process=reproduction
  Essential gene: C elegans homolog=T04C12.6; Phenotype=Ste
  Coding regions on vcDNA: vcDNA=SeqID_48113; Strand=+; Position=43-642
KHQSQPEKMCDEEVAALVVDNGSGMCKAGFAGDDAPRAVFPSIVVFSRHQGVLVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGLVLDSGDGVTHTVPIYEGYALPHAILRLDLAGRDLTDYLMK

SEQ ID NO: 121691 - protein, 154 aa, Heterodera glycines
  Homolog annotation: Hit_ID=NP_067259.2; Match level="QueryCoverage =100%, HitCoverage=84%, E-value=1e-61, Identity=72%"; Hit description= c-K-ras2 protein [Mus musculus] gb|AAH10202.1| C-K-ras2 protein [Mus musculus] gb|AAH04642.1| C-K-ras2 p
  Gene Ontology: Mol. function=GTPase activity; Cellular component =plasma membrane; Biological process=regulation of cell cycle
  Essential gene: C elegans homolog=ZK792.6; Phenotype=Lva,Lvl,Unc
  Coding regions on vcDNA: vcDNA=SeqID_48114; Strand=+; Position=2-466
EEYDPTIEDSYRKQVLIDGETCLLDILDTAGQEEYSAMRDQYFRTGEGFLLVFALNDVLFFENIHAYREQIRRVKDSDEVPMVLVGNKCDLAQRAMDQRSIQELARSFGIPFIETSAKTRRHVDEAFHALVREIRKHKDKHRERPKRRKRCAVL

SEQ ID NO: 121692 - protein, 226 aa, Heterodera glycines
  Homolog annotation: Hit_ID=CAE72532.1; Match level="QueryCoverage =99%, HitCoverage=51%, E-value=2e-41, Identity=41%"; Hit description =Hypothetical protein CBG19712 [Caenorhabditis briggsae]
  Essential gene: C elegans homolog=K11B4.1; Phenotype=Emb,Lva
  Coding regions on vcDNA: vcDNA=SeqID_48115; Strand=+; Position=2-679
LPAEWDGRLGTLSVEQLGGDNFEWTVAVQKKFTGVGKASAIDLDLACSVPVGSDHLADLVDLCYKFRHTDSAGDLLPSTEYTLCRLLLEFGEFGVFMNLLNDPINYGIFPNEHICCMFLDHFLGSAQLQYAAKIAIYVMLQEMFDFPLLTFLATRALLEWTQGERKLDEQIHPKMAPSLEDETNFNEENVRLFRYPFLKNPFWDGHFDENDSDRMAGKALEWLSYH

SEQ ID NO: 121693 - protein, 255 aa, Heterodera glycines
  Homolog annotation: Hit_ID=AAC36343.1; Match level="QueryCoverage =97%, HitCoverage=68%, E-value=1e-106, Identity=72%"; Hit description= AJH2 [Arabidopsis thaliana] pir||T52042 constitutive photomorphogenic 9 complex chain AJH2 [validated] -
  Gene Ontology: Mol. function=metalloendopeptidase activity; Cellular component=signalosome complex; Biological process=glia cell migration
  Essential gene: C elegans homolog=B0547.1; Phenotype=Emb
  Coding regions on vcDNA: vcDNA=SeqID_48116; Strand=+; Position=1-765
DDTEEQRVIRNVKSWEQDPHYFKEVKISALALVKMVMHARSGGNIEIMGLMQGRVDANTIIVLDAFALPVEGTETRVNAQAQAYEFMTNFSESCEAVGRLEKVVGWYHSHPGYGCWLSGIDVNTQSINQQFQEPFVAIVIDPIRTVSAGKVDIGAFRTYPKGYKPPDEPPSEYQTIPLNKIEDFGVHCKQYYSLDVTYFKSSLDSKMFDAFWNTYWVSTLCANPLRTNADYITAQLADLGAKLQHVNTRHGASFR

SEQ ID NO: 121694 - protein, 163 aa, Heterodera glycines
  Homolog annotation: Hit_ID=CAE66921.1; Match level="QueryCoverage =94%, HitCoverage=74%, E-value=1e-42, Identity=55%"; Hit description =Hypothetical protein CBG12309 [Caenorhabditis briggsae]
  Gene Ontology: Mol. function=hydrogen-transporting ATP synthase activity, rotational mechanism; Cellular component=proton -transporting ATP synthase, stator stalk (sensu Eukarya); Biological process=growth
  Essential gene: C elegans homolog=F27C1.7a; Phenotype=Emb,Lva
  Coding regions on vcDNA: vcDNA=SeqID_48117; Strand=+; Position=5-496
EKKLENIEKELRQVKELYDTNKEFKSFIDNPILNKQKKKEAVEDVLKKQGVSQQVQNFFGLLAENGRINKLTGVVSSFETIMRAHRGELHVEVASAEPLDKKHEQSLNDALQKFATRGQKLNLTFTVKPDLVGGLVVNIGDKYIDLSMATRLKKMDAVVKGSI

SEQ ID NO: 121695 - protein, 213 aa, Heterodera glycines
  misc_feature (34)..(34): Xaa can be any naturally occurring amino acid
  Homolog annotation: Hit_ID=NP_741578.1; Match level="QueryCoverage =44%, HitCoverage=10%, E-value=1e-25, Identity=52%"; Hit description =C2H2 type zinc finger containing protein (103.5 kD) (5J271) [Caenorhabditis elegans] gb|AAA96114.2| Hypot
  Essential gene: C elegans homolog=C01B7.1a; Phenotype=Lva
  Coding regions on vcDNA: vcDNA=SeqID_48118; Strand=+; Position=2-639
ISRSSGLPIYDSANRRVEDLECRLCNKFILNRIXGFHILWHLNTDLNIVRYGCKHCNFKHDRPQSVAAHGIREHGDEASCEDLLYNFEDELKQMSKACFGVERLFEKEIRRRNRLERFARCSTENSSAGRAEDDDNSQHGNNESKLSQQIVRRRSQQHIMNLRVSLKSENVDRDWTPKEPVRKRRSGGRRFFGSRGRKPMSRKARDVMIKLRD

SEQ ID NO: 121696 - protein, 242 aa, Heterodera glycines
  misc_feature (155)..(155): Xaa can be any naturally occurring amino acid
  Homolog annotation: Hit_ID=NP_491363.1; Match level="QueryCoverage =100%, HitCoverage=5%, E-value=1e-76, Identity=57%"; Hit description =dynein heavy chain, LEThal LET-354 (dhc-1) [Caenorhabditis elegans] gb|AAK21472.1| Dynein heavy chain pro
  Gene Ontology: Mol. function=dynein ATPase activity; Cellular component=fusome; Biological process=oocyte cell fate determination (sensu Insecta)
  Essential gene: C elegans homolog=T21E12.4; Phenotype=Emb
  Coding regions on vcDNA: vcDNA=SeqID_48119; Strand=+; Position=2-727
IICWFLPCAERLRYQPLGWANSYEFTDADFRVACDTLDSTVDMVAQNRANVKPDKLPWLALRTLLSQCIYGGKIDNDFDQVLLDTLLDKLFTSNSFDADFILIENIGVNALNMPDETNSKDGLINWVINIKALQKPNWIGLPNNAEKVLIAERGXEFIRKMIKMSDDELAYEADDLERNKQAPTWMVQFSGQCKSWLDALPQQLQRLRRTKENVRDPLFRFFEREINLGARLLSDIRRDLNE

SEQ ID NO: 121697 - protein, 174 aa, Heterodera glycines
  misc_feature (128)..(128): Xaa can be any naturally occurring amino acid
  Homolog annotation: Hit_ID=AAL78224.1; Match level="QueryCoverage =97%, HitCoverage=77%, E-value=1e-87, Identity=94%"; Hit description =hypothetical protein Hgg-30 [Heterodera glycines]
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_48120; Strand=+; Position=2-525
NLYVKNLHDTINDETLRSNFESYGNITSAKVMCDEHGRSKGFGFVCFEKADEATKAVVEMNNKIIENKPLYVALAQRKEDRKAQLASQYMQRLAAMRMQNPAGLMGTMYAPASGGFFLPQAIQNQRAXAVHANTESVRGTNAWRCPSLEQYGRFQPSNARLHDGSSCWRSVRRC

SEQ ID NO: 121698 - protein, 139 aa, Heterodera glycines; identical to SEQ ID NO: 119931
  Homolog annotation: Hit_ID=NP_491926.1; Match level="QueryCoverage =98%, HitCoverage=99%, E-value=1e-28, Identity=46%"; Hit description =lipid Binding Protein LBP-6, adipocyte P2 family member (15.6 kD) (lbp-6) [Caenorhabditis elegans] gb|AAK
  Gene Ontology: Mol. function=lipid binding; Cellular component =cytoplasm; Biological process=lipid binding
  Essential gene: C elegans homolog=W02D3.7; Phenotype=Unc
  Coding regions on vcDNA: vcDNA=SeqID_48121; Strand=+; Position=24-443

SEQ ID NO: 121699 - protein, 99 aa, Heterodera glycines
  misc_feature (49)..(49): Xaa can be any naturally occurring amino acid
  Homolog annotation: Hit_ID=NP_495447.1; Match level="QueryCoverage =85%, HitCoverage=24%, E-value=1e-10, Identity=39%"; Hit description =BRCA2 protein BCCIPbeta like (39.5 kD) (2H343) [Caenorhabditis elegans] gb|AAB93435.1| Hypothetical prote
  Essential gene: C elegans homolog=ZK1127.4; Phenotype=Emb,Gro
  Coding regions on vcDNA: vcDNA=SeqID_48122; Strand=+; Position=2-300
SPNTEKKRKLGKAARKRLAVERTIESDIIFDNLEEQMLFQHSSDFPFFXYPVESEIEKSSKFHSLRRDGRIFRPFRRVCLLSVDQFLQFASSVVRSFSV

SEQ ID NO: 121700 - protein, 226 aa, Heterodera glycines
  misc_feature (29)..(29): Xaa can be any naturally occurring amino acid
  Homolog annotation: Hit_ID=AAO85519.1; Match level="QueryCoverage =91%, HitCoverage=65%, E-value=1e-55, Identity=52%"; Hit description =putative serine/threonine phosphatase [Oesophagostomum dentatum] gb|AAO85518.1| putative serine/threonine
  Gene Ontology: Mol. function=protein phosphatase type 1 intrinsic catalyst activity; Cellular component=bud neck; Biological process =cellular morphogenesis during vegetative growth
  Essential gene: C elegans homolog=W09C3.6; Phenotype=Ste
  Coding regions on vcDNA: vcDNA=SeqID_48123; Strand=+; Position=3-682
LPRDPAGEEILFLGDYVDRGAQSVETICXLLCYKVKYPTSIVLLRGNHETSNINATYGFKKELEERYPAHSQALFDSFNDTFAWMPLTGLIGQKILCMHGGISDKIRSIEQLKQLERPMLLPPTDSLHIDLMWADPMEAQGQLPNPRGAGVLFGEDVVIRTCQLLKISCIIRAHQFIQSGYEPMFNQRLITVFSAPAYTGQTNTGAVLEVKTSSHFTTHFFPPQSQ

SEQ ID NO: 121701 - protein, 202 aa, Heterodera glycines
  Homolog annotation: Hit_ID=CAE57973.1; Match level="QueryCoverage =74%, HitCoverage=29%, E-value=4e-31, Identity=43%"; Hit description =Hypothetical protein CBG01034 [Caenorhabditis briggsae]
  Gene Ontology: Mol. function=oxidoreductase activity; Biological process=epoxygenase P450 pathway
  Essential gene: C elegans homolog=T10B9.1; Phenotype=Gro,Sma,Unc
  Coding regions on vcDNA: vcDNA=SeqID_48124; Strand=+; Position=1-606
GGIGTDFALFGVCFYCLISGNFGSLYGDYPSMFQLRDWTRQYGKQYGIQYGWRNALVISDPAMVHELLVTKFEYFHARNLSPIFGNLDTNKWISMFLARGGRWKRLRTIANPAFSVANLKKCMWLIDDSVKNAINFLEKARNEGKSFNIQRHFVEMSFDVIARVALGQRESRQFETEMAHLAIESMQKYNNTPFDYVGFAFP

SEQ ID NO: 121702 - protein, 190 aa, Heterodera glycines
  Homolog annotation: Hit_ID=NP_495248.1; Match level="QueryCoverage =83%, HitCoverage=98%, E-value=9e-29, Identity=41%"; Hit description =putative protein family member of bilaterial origin (17.5 kD) (2G537) [Caenorhabditis elegans] gb|AAA6835
  Essential gene: C elegans homolog=T24H7.3; Phenotype=Emb
  Coding regions on vcDNA: vcDNA=SeqID_48125; Strand=+; Position=58-630
MTTKSEGDENNSVDENGEPSGNHAENCSTGPSSPAPSVSCEACGTNFSQLEKDAFAAVREMAPYVKTIAISEILSRTPELIFLNIVTLENESYCVELTQRGWRVSSDRLDCMNGDIQKLEMHVTYYDAIEQLLDSLSEQYRENFGAALSSKLAALQTEQKQRQQDGESEGNGGGAAERSDAGQRTDDEPN

SEQ ID NO: 121703 - protein, 130 aa, Heterodera glycines
  Homolog annotation: Hit_ID=NP_502655.1; Match level="QueryCoverage =90%, HitCoverage=62%, E-value=3e-43, Identity=72%"; Hit description =ribosomal Protein, Large subunit (21.0 kD) (rpl-18) [Caenorhabditis elegans] emb|CAA16387.1| Hypothetical
  Gene Ontology: Cellular component=cytosolic ribosome (sensu Eukarya); Biological process=protein biosynthesis
  Essential gene: C elegans homolog=Y45F10D.12; Phenotype=Ste
  Coding regions on vcDNA: vcDNA=SeqID_48126; Strand=+; Position=1-393
PSPFHCAGCALCEKAGNEKKLVVCVGSVTDDKRIYTVPAMTVCALRFTDAARARIIAAGGECITFDQLALRAPKGENTLLLQGRRKAREAEKHFGPPPGVPGSHAKPLVRAKGRKFERARGRRKSRGYKN

SEQ ID NO: 121704 - protein, 209 aa, Heterodera glycines
  Homolog annotation: Hit_ID=CAE74365.1; Match level="QueryCoverage =91%, HitCoverage=22%, E-value=1e-22, Identity=36%"; Hit description =Hypothetical protein CBG22089 [Caenorhabditis briggsae]
  Gene Ontology: Biological process=embryogenesis and morphogenesis
  Essential gene: C elegans homolog=Y37E3.15a; Phenotype=Emb
  Coding regions on vcDNA: vcDNA=SeqID_48127; Strand=+; Position=3-629
NRKGRALCCSGSEYIVHAVHLAILAHQLRLLMTVPKVSDELLTTDVHEPSVCRLNLARLLLLFVKDFELSNIEYAINYCFFARDFKLDTPSADNATIRQEGRSVFVAAVSRIVFMSGHREAILGRLDSQGNRVPGLIDKFKDAMDICELIASIAFDTHVQGHSLAACHLYALAKCHEKAIKLANCQLSMCVSNPMAKETCEMVECAKWL

SEQ ID NO: 121705 - protein, 117 aa, Heterodera glycines
  misc_feature (14)..(14): Xaa can be any naturally occurring amino acid
  misc_feature (21)..(21): Xaa can be any naturally occurring amino acid
  misc_feature (27)..(27): Xaa can be any naturally occurring amino acid
  Homolog annotation: Hit_ID=I50244; Match level="QueryCoverage=100%, HitCoverage=86%, E-value=5e-57, Identity=97%"; Hit description =histone 3.3A - chicken gb|AAA48793.1| histone 3.3A
  Gene Ontology: Mol. function=DNA binding; Cellular component =nucleosome; Biological process=embryogenesis and morphogenesis
  Essential gene: C elegans homolog=F45E1.6; Phenotype=Emb,Gro
  Coding regions on vcDNA: vcDNA=SeqID_48128; Strand=+; Position=1-351
QLATKAARKSAPSXGGVKKPXRYRPGXVALREIRRYQKSTELLIRKLPFQRLVREIAQDFKTDLRFQSAAIGALQEASEAYLVGLFEDTNLCAIHAKRVTIMPKDIQLARRIRGERA

SEQ ID NO: 121706 - protein, 150 aa, Heterodera glycines
  Homolog annotation: Hit_ID=XP_227461.2; Match level="QueryCoverage =92%, HitCoverage=73%, E-value=7e-70, Identity=97%"; Hit description =similar to histone protein Hist2h3c1 [Rattus norvegicus]
  Gene Ontology: Mol. function=DNA binding; Cellular component =nucleosome; Biological process=embryogenesis and morphogenesis
  Essential gene: C elegans homolog=F45E1.6; Phenotype=Emb,Gro
  Coding regions on vcDNA: vcDNA=SeqID_48129; Strand=+; Position=3-455
LSFCVTTTFIALSPMARTKQTARKSTGGKAPRKQLATKAARKSAPATGGVKKPHRYRPGTVALREIRRYQKSTELLIRKLPFQRLVREIAQDFKTDLRFQSSAVLALQEASEAYLVGLFEDTNLCAIHAKRVTIMPKDIQLARRIRGERT

SEQ ID NO: 121707 - protein, 81 aa, Heterodera glycines
  misc_feature (25)..(25): Xaa can be any naturally occurring amino acid
  Homolog annotation: Hit_ID=NP_506751.1; Match level="QueryCoverage =98%, HitCoverage=46%, E-value=2e-25, Identity=72%"; Hit description =CYcloPhilin, peptidyl-prolyl cis-trans isomerase (18.6 kD) (cyp-3) [Caenorhabditis elegans] emb|CAA21762.
  Gene Ontology: Mol. function=peptidyl-prolyl cis-trans isomerase activity; Cellular component=extracellular space; Biological process= protein folding
  Essential gene: C elegans homolog=Y75B12B.2; Phenotype=Emb
  Coding regions on vcDNA: vcDNA=SeqID_48130; Strand=+; Position=3-246
DENLTEKPPSPGFSHGHAGPNTNGXSQFFVTTVKTEWLDGKHVVFGRVTDGMDVVKAVEAQGSQSGRASKDIMIADCGQLS

SEQ ID NO: 121708 - protein, 188 aa, Heterodera glycines
  Homolog annotation: Hit_ID=NP_495784.1; Match level="QueryCoverage =95%, HitCoverage=32%, E-value=7e-36, Identity=42%"; Hit description =component of the meiotic and mitotic spindle poles, ZYGote defective : embryonic lethal ZYG-9 (156.2 kD)
  Gene Ontology: Mol. function=microtubule binding; Cellular component =spindle pole; Biological process=meiotic spindle assembly
  Essential gene: C elegans homolog=F22B5.7; Phenotype=Emb
  Coding regions on vcDNA: vcDNA=SeqID_48131; Strand=+; Position=33-599
FANYRELIGRLPKIMANDANIFVAASATKCVMLFAKGLRAEFTPHVSLVVPVIFDKFKVEKRLLRDALVECIDVIAAYTSFDHLSKALLEAMTSKQNPSQKSQTDLFIYRLFRSLPAKDVPKGLLKDLVAILSKHGFDAASEVRDSSFAALGAIMQCIGEKALGCFISPELAKDANKMAKIALKRDTA

SEQ ID NO: 121709 - protein, 202 aa, Heterodera glycines
  Homolog annotation: Hit_ID=NP_509323.1; Match level="QueryCoverage =100%, HitCoverage=43%, E-value=1e-109, Identity=94%"; Hit description=translation Elongation FacTor (50.7 kD) (eft-4) [Caenorhabditis elegans] ref|NP_498520.1| translation E
  Gene Ontology: Mol. function=translation factor activity, nucleic acid binding; Biological process=protein biosynthesis
  Essential gene: C elegans homolog=R03G5.1a; Phenotype=Emb,Lva,Unc
  Coding regions on vcDNA: vcDNA=SeqID_48132; Strand=+; Position=33-638
MGKEKIHINIVVIGHVDSGKSTTTGHLIYKCGGIDKRTIEKFEKEAQEMGKGSFKYAWVLDKLKAERERGITIDIALWKFETSKYYVTIIDAPGHRDFIKNMITGTSQADCAVLVVACGTGEFEAGISKNGQTREHALLAQTLGVKQLIVACNKMDTTEPPFAEARYTEVMTEVSNFIKKIGYNPATVPFVPISGFNGDNML

SEQ ID NO: 121710 - protein, 172 aa, Heterodera glycines
  Homolog annotation: Hit_ID=XP_392232.1; Match level="QueryCoverage =99%, HitCoverage=15%, E-value=5e-35, Identity=43%"; Hit description =similar to CG10249-PA [Apis mellifera]
  Essential gene: C elegans homolog=T22D2.1; Phenotype=Emb,Pvl
  Coding regions on vcDNA: vcDNA=SeqID_48133; Strand=+; Position=197-712
MSDEERAEFEVSAPLRDALETIDTHLAGGANANTKEEQAEMEWAYKYCQHEWMKLTIKENANAYIVEQFIDALEAFSNRLMEKVVNMTDQNGNTALHYAVSNENFDVVSVLLDSKVCRVDEMNKAGYSALVLGALCELRNETECAIVQRLFQMGNVNAKAMKHSQTALMLAA

SEQ ID NO: 121711 - protein, 206 aa, Heterodera glycines
  misc_feature (12)..(12): Xaa can be any naturally occurring amino acid
  Homolog annotation: Hit_ID=AAP94888.1; Match level="QueryCoverage =95%, HitCoverage=62%, E-value=1e-46, Identity=45%"; Hit description =P34 [Ascaris suum]
  Gene Ontology: Mol. function=casein kinase activity; Cellular component=nucleus; Biological process=signal transduction
  Essential gene: C elegans homolog=R90.1; Phenotype=Lva,Unc
  Coding regions on vcDNA: vcDNA=SeqID_48134; Strand=+; Position=2-621
SPGTAIGTSINXLKALKALHSVGYLHRDIKPANSALGTPETNEQRLLYLLDFGMARKYVREDGTHRRQRDTARFRGTPIYAPISAHIKRDYSRRDDIESWFYMLIKFYKGSVPWNSLRDKNEIGLYKCRRMEDQPPEVRRQAIDELTAGCPPEFTEILSYIDGLQPESRPDYEMIERLLRGYLTRKNIQEHPYDWEEGRKKTQSAQ

SEQ ID NO: 121712 - protein, 208 aa, Heterodera glycines
  misc_feature (7)..(7): Xaa can be any naturally occurring amino acid
  Homolog annotation: Hit_ID=CAE59883.1; Match level="QueryCoverage =100%, HitCoverage=5%, E-value=4e-81, Identity=68%"; Hit description =Hypothetical protein CBG03363 [Caenorhabditis briggsae]
  Gene Ontology: Mol. function=ubiquitin-protein ligase activity; Cellular component=ubiquitin ligase complex; Biological process =protein modification
  Essential gene: C elegans homolog=Y67D8C.5; Phenotype=Emb
  Coding regions on vcDNA: vcDNA=SeqID_48135; Strand=+; Position=2-625
TAPGDRXLNDHKTSYVNPEHLDYFRFVGRVIAKAIYDNKQLDCYFTRAFYKHILNKHVRYQDIESEDPDLFKSLEFLLNNAVEDLGAELTFTVEVEEFGVRSTRQLLENGNKTTVTDANNHEYVHLMCQMKMTGSIRQQLNAFLEGFYEVIPKKLISIFNEQELELLISGLPDIDIDDLCANTEYKTYTRTSPQIQWFWRALKAFDAE

SEQ ID NO: 121713 - protein, 203 aa, Heterodera glycines
  Homolog annotation: Hit_ID=NP_505762.1; Match level="QueryCoverage =95%, HitCoverage=60%, E-value=5e-73, Identity=67%"; Hit description =PRP38 family (38.2 kD) (5L286) [Caenorhabditis elegans] emb|CAA98434.1| Hypothetical protein D1054.14 [Ca
  Gene Ontology: Biological process=mRNA splicing
  Essential gene: C elegans homolog=D1054.14; Phenotype=Emb
  Coding regions on vcDNA: vcDNA=SeqID_48136; Strand=+; Position=1-609
KCFGLSAETVVDRATELRYIGGIYAGNIKPAQFLCLTLKLLQLQPDKDIIIEFIRQDDFKYVRALGAMYIRLVFNSVEVFKYLEPLYNDYRKLRYMNRMGKFELLYMDEFVDNLLREDHYCDIQLPRLQKRQALEEKDQLELYASALDEDLERLSTDSEDEQETRKARPIIVSRRRSRSRSRGRSRSKSRERRRRSLSTDDRR

SEQ ID NO: 121714 - protein, 200 aa, Heterodera glycines
  Homolog annotation: Hit_ID=AAF00540.1; Match level="QueryCoverage =100%, HitCoverage=59%, E-value=3e-96, Identity=85%"; Hit description= casein kinase I [Ancylostoma caninum]
  Gene Ontology: Mol. function=casein kinase activity; Cellular component=nucleus; Biological process=signal transduction
  Essential gene: C elegans homolog=C03C10.1; Phenotype=Emb
  Coding regions on vcDNA: vcDNA=SeqID_48137; Strand=+; Position=74-673
MAAVVTNNSKEFIVGVKYKLKRKIGSGSFGDIYLAINIHNGEEVAVKLESVKARHPQLLYESKVYKILQGGVGIPHIRYYGIERDYHCLVMDLLGPSLEDLFNFCCRRFTMKTVLMLADQMIGRIEYMHVKNFIHRDIKPDNFLMGIGRHCNKLFIIDFGLAKKYRDSRTRIHIPYRDNKNLTGTARYASINAHMGIEQS

SEQ ID NO: 121715 - protein, 116 aa, Heterodera glycines
  misc_feature (7)..(7): Xaa can be any naturally occurring amino acid
  Homolog annotation: Hit_ID=EAL32779.1; Match level="QueryCoverage =98%, HitCoverage=18%, E-value=2e-21, Identity=47%"; Hit description =GA19893-PA [Drosophila pseudoobscura]
  Gene Ontology: Mol. function=glutathione synthase activity; Cellular component=intracellular; Biological process=MAPKKK cascade
  Essential gene: C elegans homolog=M176.2; Phenotype=Emb,Lva
  Coding regions on vcDNA: vcDNA=SeqID_48138; Strand=+; Position=3-352
IFVMKPXREGGGNNFWGDEIPKKLREMSRAELSGHILMQKVHPFSAPNYMVRPNERVQHGNVVTELSTFGTLLGHVNTKAVLHNAQQGHYARSKPEGATEGGVYGGGGVVDSPFLF

SEQ ID NO: 121716 - protein, 185 aa, Heterodera glycines
  Homolog annotation: Hit_ID=CAG05954.1; Match level="QueryCoverage =93%, HitCoverage=16%, E-value=1e-20, Identity=36%"; Hit description =unnamed protein product [Tetraodon nigroviridis]
  Gene Ontology: Cellular component=synaptic junction; Biological process=protein targeting
  Essential gene: C elegans homolog=F35D6.1a; Phenotype=Stp
  Coding regions on vcDNA: vcDNA=SeqID_48139; Strand=+; Position=2-556
WKGADPNEPVVGRENDINTNLTPLFVAALHAHFPLCRVLVDRGANVDLGSDCPTPLMMACKRSQMEIVAFLIENGADINLQNGDGETALMIACSRANVDIVRLLLSHGANVEQTDYEGFRFALKNAANEGHLEVCRLLVEEWAADVNQQTIQDRTTALICAASRGDLAIANFLIEHGADLQHVDV

SEQ ID NO: 121717 - protein, 200 aa, Heterodera glycines
  Homolog annotation: Hit_ID=NP_509323.1; Match level="QueryCoverage =100%, HitCoverage=43%, E-value=1e-107, Identity=93%"; Hit description=translation Elongation FacTor (50.7 kD) (eft-4) [Caenorhabditis elegans] ref|NP_498520.1| translation E
  Gene Ontology: Mol. function=translation factor activity, nucleic acid binding; Biological process=protein biosynthesis
  Essential gene: C elegans homolog=R03G5.1a; Phenotype=Emb,Lva,Unc
  Coding regions on vcDNA: vcDNA=SeqID_48140; Strand=+; Position=55-654
MGKEKIHINIVVIGHVDSGKSTTTGHLIYKCGGIDKRTIEKFEKEAQEMGKGSFKYAWVLDKLKAERERGITIDIALWKFETSKYYVTIIDAPGHRDFIKNMITGTSQADCAVLVVACGTGEFEAGISKNGQTREHALLAQTLGVKQLIVACNKMDTTEPPFAEARYTEVMTEVSNFIKKIGYNPATAPFVPISGFNGDN

SEQ ID NO: 121718 - protein, 199 aa, Heterodera glycines
  Homolog annotation: Hit_ID=NP_723014.1; Match level="QueryCoverage =63%, HitCoverage=22%, E-value=4e-15, Identity=34%"; Hit description =CG15626-PB, isoform B [Drosophila melanogaster] ref|NP_608864.1| CG15626-PA, isoform A [Drosophila melano
  Essential gene: C elegans homolog=F37C12.2; Phenotype=Emb,Lva
  Coding regions on vcDNA: vcDNA=SeqID_48141; Strand=+; Position=82-678
MHQTVLENRRQREHDKKFGKTVQNEVVDRNSTLKRVFRCIFVNIASVLLVLALTLFIDLIGPSFFSKFVKYLGSLLLVPIFGTVRLLSILWFADVASAALKYRGQFGQKITDLSHAASDFVHAIFLELIFLLQAMFIISIEVPILSNWSCCFASFLFHLTFSLGFVYMSLLHSLYSFDYIWMSNGVTLNSRLALIERRW

SEQ ID NO: 121719 - protein, 177 aa, Heterodera glycines
  Homolog annotation: Hit_ID=CAE59836.1; Match level="QueryCoverage =73%, HitCoverage=75%, E-value=2e-30, Identity=50%"; Hit description =Hypothetical protein CBG03308 [Caenorhabditis briggsae]
  Essential gene: C elegans homolog=T09A5.6; Phenotype=Emb,Gro,Slu,Stp
  Coding regions on vcDNA: vcDNA=SeqID_48142; Strand=+; Position=6-539
WRKLCKCGERRLSSTAPDQSSESRFNQLERNLELFQENARHMGVIASDFTSKSQEPLNQKIHTLISGLQVLDQLKSQFTDVRVPIELLDYLDRGQNPQLYTKELLERTRQRNKELNGKTEMYRKFQACLLQELHREMPSDVEEYVRIRKPSGMNGAAAGNAMANSAMAAEETQHAME

SEQ ID NO: 121720 - protein, 185 aa, Heterodera glycines
  Homolog annotation: Hit_ID=AAR85527.1; Match level="QueryCoverage =99%, HitCoverage=73%, E-value=3e-96, Identity=96%"; Hit description =14-3-3b protein [Meloidogyne incognita]
  Gene Ontology: Mol. function=protein domain specific binding; Cellular component=cytoplasm; Biological process=protein targeting
  Essential gene: C elegans homolog=M117.2; Phenotype=Emb
  Coding regions on vcDNA: vcDNA=SeqID_48143; Strand=+; Position=22-576
HKEELVQRAKLAEQAERYDDMAQSMKKVTELGAELSNDERNLLSVAYKNVVGARCSSWRVISSIEQKTEGSEKKQQMAKEYREKVEQELREICHDVLDLLDKYLIPKAGNPESKVFYLKMKGDYYRYLAEVATGDDRNAVVEKSQQSYQEAFDIAKDKMQPTHPIRLGLALNFSVFYYEILNSPG

SEQ ID NO: 121721 - protein, 220 aa, Heterodera glycines
  Homolog annotation: Hit_ID=CAE75506.1; Match level="QueryCoverage =95%, HitCoverage=45%, E-value=8e-59, Identity=54%"; Hit description =Hypothetical protein CBG23516 [Caenorhabditis briggsae]
  Gene Ontology: Mol. function=GPI-anchor transamidase activity; Cellular component=integral to endoplasmic reticulum membrane; Biological process=embryogenesis and morphogenesis
  Essential gene: C elegans homolog=T28H10.3; Phenotype=Emb
  Coding regions on vcDNA: vcDNA=SeqID_48144; Strand=+; Position=2-661
PRKTLYEPGGKDVYEGVKIDYSGTEVNPENFEAVLLGDEQRSEGKPVLKSTEKDKVFVYFSDHGAVGVIGFPAADLTVKQLTQTLKEMHAKKMYGELTFYLEACESGSMFDHTLAQSLKIYAVTAANGDESSWGCFCDTKFLPGNCLGDLFSVNWMQDSDQENLRTETLRKQFGIVREETNKSHVMHYGDLQIQDEHVSEFMGKEHAQKRNERPPSPHKF

SEQ ID NO: 121722 - protein, 195 aa, Heterodera glycines
  misc_feature (55)..(55): Xaa can be any naturally occurring amino acid
  Homolog annotation: Hit_ID=NP_496488.1; Match level="QueryCoverage =92%, HitCoverage=45%, E-value=6e-22, Identity=32%"; Hit description =protein RAD23 repair 23 (2L942) [Caenorhabditis elegans] emb|CAA93780.1| Hypothetical protein ZK20.3 [Cae
  Gene Ontology: Mol. function=damaged DNA binding; Cellular component =nucleotide excision repair factor 2 complex; Biological process =reproduction
  Essential gene: C elegans homolog=ZK20.3; Phenotype=Sck,Ste
  Coding regions on vcDNA: vcDNA=SeqID_48145; Strand=+; Position=2-586
HAAIVPIEVEETATIGEVKRKIQQVKGAEYPAENQKLFFNGRVLEDAMLVSELYXSAPKFIVFMVMRKPAQASSTVRPATSSASPQKNTSTADGQAPKAEKSAENKATGATSNTSVAQPGAATGVPAEHAQTVANIEAMGYPRQEVVRALQAAFFDADRAVEYLCNGIPEGLSLQKSNSDADNDAVNEEWELMES

SEQ ID NO: 121723 - protein, 212 aa, Heterodera glycines
  Homolog annotation: Hit_ID=NP_500820.1; Match level="QueryCoverage =96%, HitCoverage=41%, E-value=1e-20, Identity=33%"; Hit description =PUmilio and FBF family member (54.8 kD) (puf-7) [Caenorhabditis elegans] gb|AAB88353.1| Puf (pumilio/fbf)
  Gene Ontology: Mol. function=RNA binding; Cellular component =cytoplasm; Biological process=embryogenesis and morphogenesis
  Essential gene: C elegans homolog=Y73B6BL.38; Phenotype=Emb
  Coding regions on vcDNA: vcDNA=SeqID_48146; Strand=+; Position=2-637
NGGKERFLQLCIDCNGCFVIQKLVENGSKETNQMLLNLVRPFAFKMVLNRFACRIVHMLVVNLSGSQVRQLFCQQFKGHENTLVTDQNGNHFVQCVVDHFAPDVYGPFILALANCPTRLSAVFENKYGCRVIQFVLENVVQLVHGTANANNSLEKEISIQILHVLIEPILKNAYSLAQNEFANYLVQFIIKSPYLRRQRCYIIKTHIIRNVY

SEQ ID NO: 121724 - protein, 137 aa, Heterodera glycines
  Homolog annotation: Hit_ID=CAB62552.1; Match level="QueryCoverage =100%, HitCoverage=60%, E-value=7e-67, Identity=95%"; Hit description= vacuolar ATPase subunit E [Heterodera schachtii] sp|Q9U1G5|VATE_HETSC Vacuolar ATP synthase subunit E (V-
  Gene Ontology: Mol. function=hydrogen-transporting ATPase activity, rotational mechanism; Cellular component=vacuolar membrane (sensu Fungi); Biological process=proton transport
  Essential gene: C elegans homolog=C17H12.14; Phenotype=Emb,Lva
  Coding regions on vcDNA: vcDNA=SeqID_48147; Strand=+; Position=11-421
MGIFDNDVQKQLRHMMAFIEQEANEKAEDIYAKAEEEFNIEKGKLVSHQRQKILEYYEKKEKQVELQRKIQRSNMQNQSRLKCLKARDDHLKNVLEEARANLSKISADRERYPAILKGLLLQGLFQLLESKVVLRCR

SEQ ID NO: 121725 - protein, 112 aa, Heterodera glycines
  Homolog annotation: Hit_ID=NP_997676.1; Match level="QueryCoverage =100%, HitCoverage=91%, E-value=6e-34, Identity=68%"; Hit description= similar to 60S RIBOSOMAL PROTEIN L35 [Rattus norvegicus] gb|AAH86116.1| Unknown (protein for MGC:98516)
  Gene Ontology: Mol. function=structural constituent of ribosome; Cellular component=cytosolic ribosome (sensu Eukarya); Biological process=protein biosynthesis
  Essential gene: C elegans homolog=ZK652.4; Phenotype=Emb,Ste
  Coding regions on vcDNA: vcDNA=SeqID_48148; Strand=+; Position=2-340
KKKEELMKMLEEQKTELASLQVSKVTNGAVSKLSSIHVVRIIIARILTVINQAQKMILLKFYKGKKYRPIDLRFKKTRAMRRELTKHELSLKTHKQKVKERRCPTRIYALKA

SEQ ID NO: 121726 - protein, 127 aa, Heterodera glycines
  misc_feature (62)..(62): Xaa can be any naturally occurring amino acid
  Homolog annotation: Hit_ID=NP_503446.1; Match level="QueryCoverage =74%, HitCoverage=18%, E-value=3e-13, Identity=40%"; Hit description =cell Division Cycle related (55.7 kD) (cdc-25.2) [Caenorhabditis elegans] gb|AAB94237.2| Cell division cy
  Gene Ontology: Mol. function=protein phosphatase activity; Cellular component=nucleus; Biological process=meiotic spindle assembly
  Essential gene: C elegans homolog=F16B4.8; Phenotype=Bmd,Emb,Lvl
  Coding regions on vcDNA: vcDNA=SeqID_48149; Strand=+; Position=3-382
RDSGISLAQSTTSHYSCFAKIYFPTLFDFGFKQYSLDTVELSQVPHKAFRSINADRFYTLWXSLTEEQFQRRFILIDCRYPYEYDAGHIWYSLNLWETTSIEKLFYPEEEERFGEIIVRTPIFYCEY

SEQ ID NO: 121727 - protein, 100 aa, Heterodera glycines
  Homolog annotation: Hit_ID=NP_499741.1; Match level="QueryCoverage =100%, HitCoverage=16%, E-value=4e-32, Identity=61%"; Hit description= phosphomannomutase 45A (66.6 kD) (3O391) [Caenorhabditis elegans] emb|CAA16334.1| Hypothetical protein Y
  Gene Ontology: Biological process=growth
  Essential gene: C elegans homolog=Y43F4B.5a; Phenotype=Emb
  Coding regions on vcDNA: vcDNA=SeqID_48150; Strand=+; Position=3-302
NGEWRVFSGNEMGILLTWWAWTNWRAANPTADSSRVFVLHSAVSSQMVATMAKKEGFKAAHSSTGSKYISNLAHKLRSERNTVIAGWEESIGFTPGSTLD

SEQ ID NO: 121728 - protein, 189 aa, Heterodera glycines
  Essential gene: C elegans homolog=ZK381.1; Phenotype=Emb,Him
  Coding regions on vcDNA: vcDNA=SeqID_48151; Strand=+; Position=2-568
PPLFPEKVESIRYLSTKSWEATFTKDYLSNEGQLRFLSFMCYLAMAHYLLYRGFFSKGVFKLRKLEDLAIYCFDGNTRWGRKLSEMMKGIREAIDQKYIKQAFVMINEDKEDPDVATEVFSVGFCYNEQHTMTVLDDKGNRIVSFGYKGEKVFRMQVKHIIKKLSVVTKNLEPLKKGAVPYLKLTYYEN

SEQ ID NO: 121729 - protein, 184 aa, Heterodera glycines
  Homolog annotation: Hit_ID=CAE67815.1; Match level="QueryCoverage =98%, HitCoverage=36%, E-value=2e-10, Identity=28%"; Hit description =Hypothetical protein CBG13395 [Caenorhabditis briggsae]
  Essential gene: C elegans homolog=M176.2; Phenotype=Emb,Lva
  Coding regions on vcDNA: vcDNA=SeqID_48152; Strand=+; Position=77-628
MLESRQIVNTLEEITSRKIKSRFITLKEAFSRLKIDPVDKSLIFDDKYVVAVLVDRIGREISDAELALCVEFERSTAIKSRPMSFFVSHTKRMQQVLSTPGIVERFFTGPGEEGMAQAIRKVQIKGWPIGADENIEEGIRQKAMENPQDYVLKANDCGPTGTYFNEDMVKKLKSMAPAERDFYY

SEQ ID NO: 121730 - protein, 176 aa, Heterodera glycines
  misc_feature (47)..(47): Xaa can be any naturally occurring amino acid
  Homolog annotation: Hit_ID=AAL40718.1; Match level="QueryCoverage =97%, HitCoverage=98%, E-value=3e-76, Identity=84%"; Hit description =myosin regulatory light chain [Meloidogyne incognita]
  Gene Ontology: Mol. function=structural constituent of muscle; Cellular component=muscle myosin; Biological process=regulation of muscle contraction
  Essential gene: C elegans homolog=C36E6.3; Phenotype=Gro,Unc
  Coding regions on vcDNA: vcDNA=SeqID_48153; Strand=+; Position=44-574
HTTILSEKKVKKVKKKSRTGSEASSFDQETFYEFKEAFGIMDQDKDXSISKQDLIDLYATLGVVASDSQMDNMLKEAPGPINFTVFLTLFGERLTGTDPEATIIGAFQMFDKTDCGEITEETLMKILKNKRGEPLTEDEVQGMYKGNPPISGGKVDYKAFAHLITTGAAEELAKVG

SEQ ID NO: 121731 - protein, 141 aa, Heterodera glycines
  Homolog annotation: Hit_ID=CAE59176.1; Match level="QueryCoverage =97%, HitCoverage=33%, E-value=8e-45, Identity=64%"; Hit description =Hypothetical protein CBG02484 [Caenorhabditis briggsae]
  Gene Ontology: Mol. function=poly(A) binding; Cellular component =cytoplasm; Biological process=induction of apoptosis
  Essential gene: C elegans homolog=C18A3.5a; Phenotype=Rup
  Coding regions on vcDNA: vcDNA=SeqID_48154; Strand=+; Position=1-423
PQTFPIFVGDLSPEIDNKTLKDAFVPFGDVSDSKVIRDPTTLMSKGYGFVSFPKREEAERAIEQMNGQWLGRRTIRTNWATRKPGAMGGGVEYSSKPTVDEIMAQTSPENTSVYVGGVPPGATEEDIRSTFRRFGNIVDIR

SEQ ID NO: 121732 - protein, 171 aa, Heterodera glycines
  Homolog annotation: Hit_ID=CAE58420.1; Match level="QueryCoverage =85%, HitCoverage=52%, E-value=8e-41, Identity=52%"; Hit description =Hypothetical protein CBG01551 [Caenorhabditis briggsae]
  Gene Ontology: Mol. function=ubiquinol-cytochrome c reductase activity; Cellular component=respiratory chain complex III (sensu Eukarya); Biological process=reproduction
  Essential gene: C elegans homolog=F42G8.12; Phenotype=Emb,Ste
  Coding regions on vcDNA: vcDNA=SeqID_48155; Strand=+; Position=17-529
MLPNSSSILLLHNLRKQSVNALPLGRQAVHNDVQFPNFDAYRNELTKDPAQPSHVTEDRRKGVSSFIFYGVGGAITLMTAKFAVRKAVTYKWMPRDQAAMAATEIDLSLVPLGKTKTFEWRGKPVFVKHRTAKEIERERAAEVGKLRHPERDEDRVLKPEWSVLIGVCTHL

SEQ ID NO: 121733 - protein, 161 aa, Heterodera glycines
  misc_feature (62)..(62): Xaa can be any naturally occurring amino acid
  Homolog annotation: Hit_ID=CAE72854.1; Match level="QueryCoverage =91%, HitCoverage=39%, E-value=3e-23, Identity=38%"; Hit description =Hypothetical protein CBG20153 [Caenorhabditis briggsae]
  Essential gene: C elegans homolog=C16C10.6; Phenotype=Emb
  Coding regions on vcDNA: vcDNA=SeqID_48156; Strand=+; Position=11-493
GNQQQRDQKVAAQKEADKEKKPKYAHLLAKAHKQRELSKLLVEDNTYKKEREKEAGQFEDEXLFVTGAYRQQIEERERHKTEMEREEALEKMRDVRDQKMWRQAFNRTMLENISRGPLTEEGKMEEDDGAEEKRIKTEAKTEKMAKMGVKEEAIYKKKNKK

SEQ ID NO: 121734 - protein, 168 aa, Heterodera glycines
  Homolog annotation: Hit_ID=NP_492356.1; Match level="QueryCoverage =69%, HitCoverage=23%, E-value=3e-32, Identity=53%"; Hit description =TATA box binding protein-Like Factor, transcription initiation factor TFIID required to activate RNA poly
  Gene Ontology: Cellular component=cytoplasm; Biological process =regulation of protein activity, epigenetic
  Essential gene: C elegans homolog=F39H11.2; Phenotype=Emb,Lva,Unc
  Coding regions on vcDNA: vcDNA=SeqID_48157; Strand=+; Position=97-600
MDHNYWQAHPNNPLVNRPERNGTTEQNGAMSSCSHPQRASGEPNQLNVVLVDGTEVVVKIHNVLCCYELPMHIDLRQVAYGSINVDYNRAKGILHKQLRKPSCSIRIANSGKVVIHGCKSEEDCKRVARAIGRMIQRNTGRLDQRICIRNYRVSNILATCRMPFDIRI

SEQ ID NO: 121735 - protein, 113 aa, Heterodera glycines
  misc_feature (27)..(27): Xaa can be any naturally occurring amino acid
  Homolog annotation: Hit_ID=CAE67745.1; Match level="QueryCoverage =88%, HitCoverage=33%, E-value=4e-31, Identity=60%"; Hit description =Hypothetical protein CBG13320 [Caenorhabditis briggsae] emb|CAE67740.1| Hypothetical protein CBG13315 [Cae
  Gene Ontology: Mol. function=transcription factor activity; Cellular component=CCR4-NOT core complex; Biological process=regulation of transcription, DNA-dependent
  Essential gene: C elegans homolog=Y56A3A.20; Phenotype=Emb
  Coding regions on vcDNA: vcDNA=SeqID_48158; Strand=+; Position=103-442
HRQKNNSFSISFKDITLHDVWASNLFXEFAKLLDLIDDYPFVAMDTEYPGVIATPVGQFRSKEDFNYQQLRLNVDCLKLIQVGFTLMNEKGQLPPARDIFQFNLHFDPSTDSF

SEQ ID NO: 121736 - protein, 186 aa, Heterodera glycines
  Homolog annotation: Hit_ID=CAE66740.1; Match level="QueryCoverage =84%, HitCoverage=43%, E-value=3e-61, Identity=71%"; Hit description =Hypothetical protein CBG12090 [Caenorhabditis briggsae]
  Gene Ontology: Mol. function=endopeptidase activity; Cellular component=proteasome regulatory particle, lid subcomplex (sensu Eukarya); Biological process=embryonic cleavage
  Essential gene: C elegans homolog=R12E2.3; Phenotype=Emb
  Coding regions on vcDNA: vcDNA=SeqID_48159; Strand=+; Position=17-574
MAPAPEKEKTEDKKLKDGQKPNVTTDHAHCLSNVQPNLPVNKVVVHPLVLLSVVDHFNRVNKTHKVNRVVGVLLGCMKHDKTLDIANCFAVPYDEDSENSNIFFLDADFLEDMFGMFYKVAARERIVGWYHSGPRLCKNDILINEVIKRFTPNPVLVIIQASQGRQDLALPTDAYVEVQEVHNDGS

SEQ ID NO: 121737 - protein, 134 aa, Heterodera glycines
  Homolog annotation: Hit_ID=AAQ97763.1; Match level="QueryCoverage =86%, HitCoverage=19%, E-value=2e-12, Identity=31%"; Hit description =cleavage and polyadenylation specific factor 6, 68kDa [Danio rerio]
  Gene Ontology: Mol. function=RNA binding; Cellular component=nucleus; Biological process=mRNA processing
  Essential gene: C elegans homolog=D1046.1; Phenotype=Slu,Stp
  Coding regions on vcDNA: vcDNA=SeqID_48160; Strand=+; Position=2-403
INAILDGTDGDEALNLNDLDEKEVLGDDEEDQHQNQHTTKEEVEDLYDEAMAPSGALSEKRESAEVISSLPSSIQHKSSFAMPMMIKSEPGIAGGSQSGKRYCCYIGNMTWWTTDDQLQKLIQTLGVDDMIDVK

SEQ ID NO: 121738 - protein, 147 aa, Heterodera glycines
  Homolog annotation: Hit_ID=AAO85519.1; Match level="QueryCoverage =78%, HitCoverage=37%, E-value=2e-30, Identity=52%"; Hit description =putative serine/threonine phosphatase [Oesophagostomum dentatum] gb|AAO85518.1| putative serine/threonine
  Gene Ontology: Mol. function=protein serine/threonine phosphatase activity; Cellular component=cytoplasm; Biological process=protein amino acid dephosphorylation
  Essential gene: C elegans homolog=W09C3.6; Phenotype=Ste
  Coding regions on vcDNA: vcDNA=SeqID_48161; Strand=+; Position=83-523
MNEEYCFSTSTVVAQSWAQTNFRPVDEQPNSLVDTLIAKLSCTTFEQFTSEVSAQDIHKLCDVTVGVLQQQSMLIHLQPPVVLCGDIHGQFRDLLRIFKTMGFPPDKKYLFLGDYVDRGTQSLETMVLLFCYKVKYPDSVILLRGNH

SEQ ID NO: 121739 - protein, 194 aa, Heterodera glycines
  misc_feature (19)..(19): Xaa can be any naturally occurring amino acid
  Homolog annotation: Hit_ID=NP_496488.1; Match level="QueryCoverage =92%, HitCoverage=45%, E-value=1e-27, Identity=37%"; Hit description =protein RAD23 repair 23 (2L942) [Caenorhabditis elegans] emb|CAA93780.1| Hypothetical protein ZK20.3 [Cae
  Gene Ontology: Mol. function=damaged DNA binding; Cellular component =nucleotide excision repair factor 2 complex; Biological process =reproduction
  Essential gene: C elegans homolog=ZK20.3; Phenotype=Sck,Ste
  Coding regions on vcDNA: vcDNA=SeqID_48162; Strand=+; Position=24-604
MPELPFKTITQQSFQLKLXETATIGEVKRKIQQVKGAEYPAENQKLIFNGRVLEDAMLVSELNFAAPKFIVIMVMRKPAQASSTVRPATSSASPQKNTSTADGQAPKAEKSAENKATGATSNTSVAQPGAATGVPAEHAQTVANIEAMGYPRQEVVRALQAAFFDADRAVEYLCNGIPEGLSLQESNSDADNDA

SEQ ID NO: 121740 - protein, 210 aa, Heterodera glycines
  misc_feature (7)..(7): Xaa can be any naturally occurring amino acid
  Homolog annotation: Hit_ID=NP_509323.1; Match level="QueryCoverage =100%, HitCoverage=45%, E-value=1e-111, Identity=92%"; Hit description=translation Elongation FacTor (50.7 kD) (eft-4) [Caenorhabditis elegans] ref|NP_498520.1| translation E
  Gene Ontology: Mol. function=translation factor activity, nucleic acid binding; Biological process=protein biosynthesis
  Essential gene: C elegans homolog=R03G5.1a; Phenotype=Emb,Lva,Unc
  Coding regions on vcDNA: vcDNA=SeqID_48163; Strand=+; Position=27-655
MGKEKIXINIVVIGHVDSGKSTTTGHLIYKCGGIDKRTIEKFEKEAQEMGKGSFKYAWVLDKLKAERERGITIDIALWKFETSKYYVTIIDAPGHRDFIKNMITGTSQADCAVLVVACGTGEFEAGISKNGQTREHALLAQTLGVKQLIVACNKMDTTEPPFAEARYTEVMTEVSNFIKKIGYNPATVPFVPISGFNGDNMLEPSDRMPW

SEQ ID NO: 121741 - protein, 205 aa, Heterodera glycines
  misc_feature (9)..(9): Xaa can be any naturally occurring amino acid
  Homolog annotation: Hit_ID=NP_499239.1; Match level="QueryCoverage =99%, HitCoverage=48%, E-value=6e-37, Identity=39%"; Hit description =transcription factor (41.6 kD) (3L178) [Caenorhabditis elegans] emb|CAA83139.3| Hypothetical protein T16H
  Gene Ontology: Mol. function=general RNA polymerase II transcription factor activity; Cellular component=transcription factor TFIIH complex; Biological process=negative regulation of transcription from Pol II promoter, mitotic
  Essential gene: C elegans homolog=T16H12.4; Phenotype=Emb,Gro,Unc
  Coding regions on vcDNA: vcDNA=SeqID_48164; Strand=+; Position=2-615
HCGGEFSLXSVLHALLLFPGLPAHSSKECILLIASLSSVDASPLRHTFEQLKMRSVRCSIVSFGAEVFAFKRLCATTEGKYSVALDEQHLELLLDEHVQPPPVQRRPGQQDSIVRMGFPQLRRVTEPSFCACHELNGEAAPPSAIDGAADEKASSSALPRAFFCPQCGSRYCQTPVECRICGLLLLTAPQLARAHQHLEALPTFA

SEQ ID NO: 121742 - protein, 172 aa, Heterodera glycines
  misc_feature (164)..(164): Xaa can be any naturally occurring amino acid
  Homolog annotation: Hit_ID=CAE73046.1; Match level="QueryCoverage =97%, HitCoverage=37%, E-value=6e-59, Identity=64%"; Hit description =Hypothetical protein CBG20416 [Caenorhabditis briggsae]
  Gene Ontology: Mol. function=cyclin-dependent protein kinase activity; Cellular component=transcription elongation factor complex; Biological process=regulation of cell cycle
  Essential gene: C elegans homolog=H25P06.2a; Phenotype=Emb,Gro,Unc
  Coding regions on vcDNA: vcDNA=SeqID_48165; Strand=+; Position=10-526
MPNIQKLLNYTEHFNYPYVSEVTYYEQLLKIGQGTFGEVFKARCKRTGKLVALKKILMENEKEGFPITALREIKMLQRLRHQHITELVEVCTSKQKSGKEKFCFYLVFTFCEHDLAGLLSNTQVKIRLVDIKTMMQHILRGLHKIHSSQILHRDMKAANVLITXTGVLKLAD

SEQ ID NO: 121743 - protein, 143 aa, Heterodera glycines
  Homolog annotation: Hit_ID=CAE62748.1; Match level="QueryCoverage =72%, HitCoverage=36%, E-value=7e-25, Identity=57%"; Hit description =Hypothetical protein CBG06912 [Caenorhabditis briggsae]
  Essential gene: C elegans homolog=K02D10.5; Phenotype=Ste
  Coding regions on vcDNA: vcDNA=SeqID_48166; Strand=+; Position=83-511
TDKKFTTPAASQNIEDQIAADEKAIERYLQASLDSTQRSRQQLSSSEGLAESTARELLEQREKLERAEQNLDTIHHTTQHTQRSLNSLKSWFGGLVRNKLSRAPKGLGTANANANNQQQQLEQTVQQQHQQRPLHAHLVQSSA

SEQ ID NO: 121744 - protein, 164 aa, Heterodera glycines
  Homolog annotation: Hit_ID=NP_506083.1; Match level="QueryCoverage =85%, HitCoverage=22%, E-value=8e-15, Identity=31%"; Hit description =signal recognition particle 68kDa (70.6 kD) (5M770) [Caenorhabditis elegans] emb|CAB01573.1| Hypothetical
  Essential gene: C elegans homolog=F55C5.8; Phenotype=Emb,Lva,Ste
  Coding regions on vcDNA: vcDNA=SeqID_48167; Strand=+; Position=28-519
SEIKISPIAVFEVERNWAYAMQMKFEMIDSPLSRKKFHMRQKLRRAVKSAHFLHSLIDDNPLVHEVTRVETVSYVSFIFGSLELELKNWKRAIETFDRARIGYSELLEQVRNSDLSETYATKCREVENLLILCRAQTGDANVLLSTVSSVNLNASEDDRKPSPE

SEQ ID NO: 121745 - protein, 80 aa, Heterodera glycines
  Homolog annotation: Hit_ID=CAE57827.1; Match level="QueryCoverage =97%, HitCoverage=64%, E-value=1e-28, Identity=75%"; Hit description =Hypothetical protein CBG00852 [Caenorhabditis briggsae]
  Gene Ontology: Mol. function=hydrogen-transporting ATPase activity, rotational mechanism; Cellular component=vacuolar membrane (sensu Fungi); Biological process=hydrogen transport
  Essential gene: C elegans homolog=ZK970.4; Phenotype=Emb
  Coding regions on vcDNA: vcDNA=SeqID_48168; Strand=+; Position=194-433
QLSVLGQLNKARKPNFVIVDKNTSVAEIEDAFRTFCTRDDIAIILINQHVAEMIRYQVDQHVASIPAVLEIPSKEMPYDA

SEQ ID NO: 121746 - protein, 176 aa, Heterodera glycines
  misc_feature (12)..(12): Xaa can be any naturally occurring amino acid
  Homolog annotation: Hit_ID=NP_491237.1; Match level="QueryCoverage =100%, HitCoverage=56%, E-value=3e-52, Identity=55%"; Hit description= protein phosphatase 1A (34.6 kD) (1E406) [Caenorhabditis elegans] gb|AAB42233.1| Yeast glc seven-like ph
  Gene Ontology: Mol. function=protein serine/threonine phosphatase activity; Cellular component=cytoplasm; Biological process=protein amino acid dephosphorylation
  Essential gene: C elegans homolog=W09C3.6; Phenotype=Ste
  Coding regions on vcDNA: vcDNA=SeqID_48169; Strand=+; Position=1-527
QFSDLQRILQRXGPPPEQQYMFLGDYVDRGAHSMETIILLFCYKIKYPSNFMLLRGNHECSNINKAYGFYEEIDRRYPRPGARRLFDLFNQVFAWMPFVGLIGEKILCMHGGISDKMRSLDQLSTLRRPHTRPPLRSLEIDLLWADPAQGIRGVVPSTRGAGILFGEDLVAQILTR

SEQ ID NO: 121747 - protein, 117 aa, Heterodera glycines
  Homolog annotation: Hit_ID=NP_499156.1; Match level="QueryCoverage =96%, HitCoverage=39%, E-value=2e-35, Identity=69%"; Hit description =Enoyl-CoA hydratase/carnithine racemase, mitochondrial (31.2 kD) (3K842) [Caenorhabditis elegans] emb|CAA
  Gene Ontology: Mol. function=enoyl-CoA hydratase activity; Cellular component=mitochondrion; Biological process=energy pathways
  Essential gene: C elegans homolog=T05G5.6; Phenotype=Lva
  Coding regions on vcDNA: vcDNA=SeqID_48170; Strand=+; Position=149-499
MTNYEMIKVERVGADDVVALITLNRPKALNALCSQLMDELAHSLTYLDKDDGVHAIVLTGSERAFAAGADIKEMVPKKFAEVFGGGFLENWSQVATVRKPTIAAVNGHALGGGCELA

SEQ ID NO: 121748 - protein, 207 aa, Heterodera glycines
  misc_feature (8)..(8): Xaa can be any naturally occurring amino acid
  Homolog annotation: Hit_ID=CAE63445.1; Match level="QueryCoverage =97%, HitCoverage=57%, E-value=3e-48, Identity=46%"; Hit description =Hypothetical protein CBG07904 [Caenorhabditis briggsae]
  Gene Ontology: Mol. function=poly(A) binding; Cellular component =cytoplasm; Biological process=induction of apoptosis
  Essential gene: C elegans homolog=C18A3.5a; Phenotype=Rup
  Coding regions on vcDNA: vcDNA=SeqID_48171; Strand=+; Position=2-624
YGFVSFPXREEAERAIEQMNGQWLGRRTIRTNWATRKPGAMGGGVEYSSKPTVDEIMAQTSPENTSVYVGGVPPGATEEDIRSTFRRFGNIVDIRYFKPQGYAFVKYETKLAAGKAIHEMNSNKFMGQTLRLNWGKVDGGGTKTTEPTSFGTNTAPTGMFNSSSTASSQAASAQMQQYWQYYQQYYQQNPLWNGYWQGGATGNGQQK

SEQ ID NO: 121749 - protein, 200 aa, Heterodera glycines
  misc_feature (190)..(190): Xaa can be any naturally occurring amino acid
  Homolog annotation: Hit_ID=CAE60648.1; Match level="QueryCoverage =97%, HitCoverage=39%, E-value=3e-54, Identity=57%"; Hit description =Hypothetical protein CBG04294 [Caenorhabditis briggsae]
  Gene Ontology: Mol. function=proteasome endopeptidase activity; Cellular component=proteasome regulatory particle (sensu Eukarya); Biological process=proteolysis and peptidolysis
  Essential gene: C elegans homolog=F10G7.8; Phenotype=Emb
  Coding regions on vcDNA: vcDNA=SeqID_48172; Strand=+; Position=57-656
MQTGRFGDGRLVKMEVDYSAQVDSQLIVADNLAKEGKTAEAIESLEKLEKDSRINCDMRSNQRLLCHMVKLAFDANNWQLLCETAKTLCKKRLLIKSSIKKMVQECCEMVPKAPDASSKSTLIDTLRAVTAGKIYLEVERARLTKQVAEKLEAEGKLDEAREMMMELQVETYGTMEVEEKVNYLLHQMRXSIANNHFTRA

SEQ ID NO: 121750 - protein, 162 aa, Heterodera glycines
  Homolog annotation: Hit_ID=NP_505114.1; Match level="QueryCoverage =92%, HitCoverage=25%, E-value=7e-32, Identity=46%"; Hit description =carboxylesterase precursor family member (64.2 kD) (5I685) [Caenorhabditis elegans] gb|AAA96175.1| Hypoth
  Gene Ontology: Mol. function=carboxylesterase activity; Cellular component=endoplasmic reticulum; Biological process=embryogenesis and morphogenesis
  Essential gene: C elegans homolog=K07C11.4; Phenotype=Gro
  Coding regions on vcDNA: vcDNA=SeqID_48173; Strand=+; Position=2-487
LNFLIKKDVAFVLIKPSAEQNKTFPVLVVIHGGAYEIGSSARYTKYEVIGQRFVTDANSRGIVFVSIQYRLGVMGFATTGDEELPGNLGIWDQISALQFVKDNIAEFGGDPSRVTVFGYSAGSGSTALLSISPKSRDLFQQAIRMSGTPFSVSGSGTFVAEE

SEQ ID NO: 121751 - protein, 162 aa, Heterodera glycines
  Homolog annotation: Hit_ID=NP_501727.1; Match level="QueryCoverage =93%, HitCoverage=49%, E-value=2e-68, Identity=85%"; Hit description =adenine nucleotide family member (4K472) [Caenorhabditis elegans] emb|CAA92472.1| Hypothetical protein K0
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_48174; Strand=+; Position=151-636
MSENKSEGGAEKKKSGGFNTKKFLLDLASGGTAAAVSKTAVAPIERVKLLLQVQDASIHITADKRYKGIIDVLVRVPKEQGFLSLWRGNLANVIRYFPTQALNFAFKDTYKRVFTQGVDKEKQFLKFFAMNLASGGAAGATSLCFVYPLDFARTRLAADVGK

SEQ ID NO: 121752 - protein, 217 aa, Heterodera glycines
  Homolog annotation: Hit_ID=NP_502087.1; Match level="QueryCoverage =100%, HitCoverage=63%, E-value=1e-102, Identity=81%"; Hit description=phosphate carrier protein, mitochondrial precursor (36.7 kD) (4L912) [Caenorhabditis elegans] emb|CAA97
  Gene Ontology: Mol. function=phosphate carrier activity; Cellular component=mitochondrial membrane; Biological process=transport
  Essential gene: C elegans homolog=F01G4.6; Phenotype=Emb,Lva
  Coding regions on vcDNA: vcDNA=SeqID_48175; Strand=+; Position=3-653
YGLCGIGGILSCGITHTAIVPLDLVKCRIQVDPAKYKGIIGGFKVTLQEEGVRGLAKGWAPTAIGYSMQGLGKFGLYEMFKNVYAGMIGEELAYSCRTYLYLAASASAEFFADMMLAPMEATKVRIQTSPGAPPTLRGCAPFIYRTEGLMGFYKGLPPLWMRQIPYTMMKFACFERTVELLYKHVVPKPRAECTKPEQLVVTFIAGYIAGVFCAIVS

SEQ ID NO: 121753 - protein, 164 aa, Heterodera glycines
  misc_feature (151)..(151): Xaa can be any naturally occurring amino acid
  Homolog annotation: Hit_ID=CAE65022.1; Match level="QueryCoverage =100%, HitCoverage=96%, E-value=5e-76, Identity=84%"; Hit description= Hypothetical protein CBG09860 [Caenorhabditis briggsae]
  Gene Ontology: Mol. function=structural constituent of muscle; Cellular component=muscle myosin; Biological process=regulation of muscle contraction
  Essential gene: C elegans homolog=C56G7.1; Phenotype=Emb
  Coding regions on vcDNA: vcDNA=SeqID_48176; Strand=+; Position=4-495
MAARKTVARRARPQRATSNVFAMFDQPQIQEFKEAFNMIDQNHDGFIDEHDLKDMFASLGKEVSEKFIENMVNDASGSINFTMFLTLFGEKLTGTDPEEVIKNAFQCFDEDNSGTIAEDRLRELLTTMGDRYTEEQVDELFRDAPIKNGRXDYVEFTRMLKHGT

SEQ ID NO: 121754 - protein, 177 aa, Heterodera glycines
  misc_feature (70)..(70): Xaa can be any naturally occurring amino acid
  Homolog annotation: Hit_ID=CAE58622.1; Match level="QueryCoverage =80%, HitCoverage=38%, E-value=1e-46, Identity=54%"; Hit description =Hypothetical protein CBG01790 [Caenorhabditis briggsae]
  Gene Ontology: Biological process=embryogenesis and morphogenesis
  Essential gene: C elegans homolog=W02A2.1; Phenotype=Emb
  Coding regions on vcDNA: vcDNA=SeqID_48177; Strand=+; Position=2-533
PLPAPFPLPPPPLALTVPHPRPALLSGHVLAPRPLPTWEEIRAAVPKECFEKSLLRSLLYSAMDFLLLGXLYACVPFVDTDFGLIGLFVWYCLLGMYVSSLFCLGHDCGHGTFSDWTWVNDIFGHISHALLMVPFWPWQKSHRQHHQFTSHVDKDKGHPCVLEDDYEGGGWLRKHFA

SEQ ID NO: 121755 - protein, 209 aa, Heterodera glycines
  Homolog annotation: Hit_ID=CAE67815.1; Match level="QueryCoverage =66%, HitCoverage=27%, E-value=1e-22, Identity=35%"; Hit description =Hypothetical protein CBG13395 [Caenorhabditis briggsae]
  Gene Ontology: Mol. function=glutathione synthase activity; Biological process=neurogenesis
  Essential gene: C elegans homolog=M176.2; Phenotype=Emb,Lva
  Coding regions on vcDNA: vcDNA=SeqID_48178; Strand=+; Position=2-628
KKNPSYKKFYGEINFAFGSALLVVLFVICCVNFADATQPNEDDNEAKDQLLAIGAFELKRMAQYAIEWCHNNALILRRKEDEGNRGDAALFPPLTLFPSPFPRDAFEQALKAQKAMNLLYFRVARDYEFLMNAYKDVIKGDEHIAKLVDILKKVHEEGIRQPITVMLQRADYLLDVVENNDTNEVKYEPKQVEVNTGAIGATGLKRRTT

SEQ ID NO: 121756 - protein, 80 aa, Heterodera glycines
  Homolog annotation: Hit_ID=AAL40720.1; Match level="QueryCoverage =100%, HitCoverage=19%, E-value=2e-27, Identity=67%"; Hit description= calreticulin [Meloidogyne incognita]
  Gene Ontology: Mol. function=calcium ion storage activity; Cellular component=endoplasmic reticulum lumen; Biological process=regulation of transcription, DNA-dependent
  Essential gene: C elegans homolog=Y38A10A.5; Phenotype=Unc
  Coding regions on vcDNA: vcDNA=SeqID_48179; Strand=-; Position=1-240
YLRKNWGPIGINIWQVKSGPIFDNILVADSVEDAKKHAADTFDQLKEAEKKQKEAHDEEERKKFEEEEKKRKKKKKKEKK

SEQ ID NO: 121757 - protein, 94 aa, Heterodera glycines
  Homolog annotation: Hit_ID=CAE73543.1; Match level="QueryCoverage =100%, HitCoverage=11%, E-value=2e-23, Identity=60%"; Hit description= Hypothetical protein CBG21011 [Caenorhabditis briggsae]
  Essential gene: C elegans homolog=Y17G7B.15a; Phenotype=Unclassified
  Coding regions on vcDNA: vcDNA=SeqID_48180; Strand=+; Position=200-481
TTMIEFLLLNGAKINGLDGGKNTPLHLAAERGHTIIVYQLLKRNAEKTHQNVNGRTALELAVERCHADIVTLLRLHDMKEEFNDDQNSTMDETV

SEQ ID NO: 121758 - protein, 194 aa, Heterodera glycines
  Homolog annotation: Hit_ID=XP_392128.1; Match level="QueryCoverage =87%, HitCoverage=36%, E-value=6e-12, Identity=30%"; Hit description =similar to ENSANGP00000017216 [Apis mellifera]
  Gene Ontology: Mol. function=ligand-dependent nuclear receptor activity; Cellular component=nucleus
  Essential gene: C elegans homolog=C01H6.5a; Phenotype=Bmd,Let,Lva,Mlt
  Coding regions on vcDNA: vcDNA=SeqID_48181; Strand=+; Position=15-596
TEPCRWVAEVRHELTNVTKCIIEFAKMVKEFLELEQDHKIHALKKTTFDLAIIAMAQHYHQQSQTLHVNNLVLPVYQFRCSDRKDEEFGKEFISRLQYLSSFQLTSTETALLSAFVLMDQSQAPGMEAFVGQLKSCLGGQLHQRMPDGDEALRQLLEFLPRLRELAKTHRKCLGRFRLQMVDQQSEHQTDRGAA

SEQ ID NO: 121759 - protein, 167 aa, Heterodera glycines
  Homolog annotation: Hit_ID=XP_315817.1; Match level="QueryCoverage =100%, HitCoverage=63%, E-value=3e-80, Identity=83%"; Hit description= ENSANGP00000010416 [Anopheles gambiae]
  Gene Ontology: Mol. function=structural constituent of ribosome; Cellular component=cytosolic large ribosomal subunit (sensu Eukarya); Biological process=reproduction
  Essential gene: C elegans homolog=B0250.3; Phenotype=Emb,Ste
  Coding regions on vcDNA: vcDNA=SeqID_48182; Strand=+; Position=1-501
GKKAQVQIGNVMPIGELPEGTTVCNLEEKAGGRGRLARTSGNYAIIVAHNPDTKRTRIRLPSGAKKVVPSANRAMIGIVAGGGRTDKPLLKAGRAYHKYKVKRNCWPKVRGVAMNPVEHPHGGGNHQHIGHPSTVKRGTSAGRKVGLIAARRTGRIRGGKPEKRGKE

SEQ ID NO: 121760 - protein, 119 aa, Heterodera glycines; identical to SEQ ID NO: 121530
  Homolog annotation: Hit_ID=AAN32889.1; Match level="QueryCoverage =100%, HitCoverage=100%, E-value=1e-60, Identity=97%"; Hit description=ubiquitin extension protein [Heterodera glycines]
  Gene Ontology: Biological process=cell cycle
  Essential gene: C elegans homolog=F25B5.4a; Phenotype=Emb
  Coding regions on vcDNA: vcDNA=SeqID_48183; Strand=+; Position=87-446

SEQ ID NO: 121761 - protein, 182 aa, Heterodera glycines
  Homolog annotation: Hit_ID=AAM95353.1; Match level="QueryCoverage =98%, HitCoverage=40%, E-value=1e-100, Identity=97%"; Hit description= beta-tubulin Ccr-1b [Cylicocyclus radiatus]
  Gene Ontology: Mol. function=MHC class I protein binding; Cellular component=tubulin; Biological process=embryogenesis and morphogenesis
  Essential gene: C elegans homolog=C36E8.5; Phenotype=Emb
  Coding regions on vcDNA: vcDNA=SeqID_48184; Strand=+; Position=3-548
QGETDLQLERINVYYNEAHGGKYVPRAVLVDLEPGTMDSIRAGPYGQLFRPDNFVFGQSGAGNNWAKGHYTEGAELVDNVLDVVRKEAEGCDCLQGFQLTHSLGGGTGSGMGTLLISKIREEYPDRIMSSFSVVPSPKASDTVVEPYNATLSVHQLVENTDETFCIDNEALYDICFRTLKLQ

SEQ ID NO: 121762 - protein, 193 aa, Heterodera glycines
  Homolog annotation: Hit_ID=NP_493258.1; Match level="QueryCoverage =68%, HitCoverage=100%, E-value=6e-41, Identity=60%"; Hit description= profilin (14.3 kD) (pfn-1) [Caenorhabditis elegans] emb|CAA22318.1| Hypothetical protein Y18D10A.20 [Cae
  Gene Ontology: Cellular component=actin filament; Biological process =cytokinesis
  Essential gene: C elegans homolog=Y18D10A.20; Phenotype=Emb,Stp,Unc
  Coding regions on vcDNA: vcDNA=SeqID_48185; Strand=+; Position=43-624
MSGWDAYIQSLTSSCAEITRVAIIGNSDASVWARTEGENEFKASEPELKKLVGQFDDLSQVPSVGADLEGIHYIVPRTDENLIFGKRDKTGFFAVKTKSAILIAIYKDEESVVGADVRGAVEKMAKYLEDAGYRAVARFPKRLLCCQTKSAENGDLFFQMHSFSIPNDHLLFYYYTFCEVRVPISFLLFDLWM

SEQ ID NO: 121763 - protein, 132 aa, Heterodera glycines
  Homolog annotation: Hit_ID=CAE60421.1; Match level="QueryCoverage =95%, HitCoverage=6%, E-value=3e-20, Identity=41%"; Hit description =Hypothetical protein CBG04027 [Caenorhabditis briggsae]
  Essential gene: C elegans homolog=C34G6.1; Phenotype=Ste
  Coding regions on vcDNA: vcDNA=SeqID_48186; Strand=+; Position=2-397
CSCSFASAHALTPERVGCAQAMGHCAASLDHADLVLTELENIAKWEHTKKGISGGVGGAAGSGSSSSGGGIFSYIRDYSFGRTVDVEVLNLRATLVLSYGYVVFYCPTEGLVLRLQQTVLPFLRQYTANAKK

SEQ ID NO: 121764 - protein, 133 aa, Heterodera glycines
  Homolog annotation: Hit_ID=NP_499704.1; Match level="QueryCoverage =94%, HitCoverage=24%, E-value=4e-23, Identity=42%"; Hit description =cytochrome P450 precursor family member (3O111) [Caenorhabditis elegans] emb|CAB04112.1| Hypothetical pro
  Gene Ontology: Mol. function=oxidoreductase activity; Biological process=epoxygenase P450 pathway
  Essential gene: C elegans homolog=T10B9.4; Phenotype=Clr,Emb,Slu
  Coding regions on vcDNA: vcDNA=SeqID_48187; Strand=+; Position=104-502
MMRKHREYWSNRGISSPTPQLISGNFGSLYGNYPSMFQLRDWTRQYGKQYGVQYGWRNALVISDPAMVHELLATKFEYFHARNLSPIFGNLDTNKWISMFLARGGRWKRLRTIANPAFSVANLKKCMCPIDDS

SEQ ID NO: 121765 - protein, 230 aa, Heterodera glycines
  Homolog annotation: Hit_ID=CAE63280.1; Match level="QueryCoverage =98%, HitCoverage=15%, E-value=2e-69, Identity=57%"; Hit description =Hypothetical protein CBG07659 [Caenorhabditis briggsae]
  Gene Ontology: Mol. function=15-hydroxyprostaglandin dehydrogenase (NAD+) activity; Cellular component=mitochondrion
  Essential gene: C elegans homolog=F14F4.3a; Phenotype=Bli,Gro,Slu
  Coding regions on vcDNA: vcDNA=SeqID_48188; Strand=+; Position=3-692
SFWFLCSLFGLFLLFFLCFRAGIRCLKRVENVTRSPVFEHLTTSLDALPTIHAFGQTQRFVEQLKQHLDENSGALFLYHSAMRWQAVWLDLLVVGLTFFVSLFIVLLTGRIDPAEAGMAIAFAMQMSGIFQFAVRSQTELEAKLTSVERVSFYYKNIEVESDKDGDDPAELGPAWPQSGTLEFDHVILRYVPQMNPALNDVSFIIYSGQKVGIVGRTGSGKTSLCNALFR

SEQ ID NO: 121766 - protein, 150 aa, Heterodera glycines
  Homolog annotation: Hit_ID=NP_496569.1; Match level="QueryCoverage =77%, HitCoverage=14%, E-value=1e-29, Identity=57%"; Hit description =CeNTaurin, beta (90.6 kD) (cnt-1) [Caenorhabditis elegans] emb|CAA19463.2| Hypothetical protein Y17G7B.15
  Gene Ontology: Cellular component=synaptic junction; Biological process=protein targeting
  Essential gene: C elegans homolog=Y17G7B.15a; Phenotype=Unclassified
  Coding regions on vcDNA: vcDNA=SeqID_48189; Strand=+; Position=177-629
MTTTITLPLHIAVENNQTTMIEFLLLNGAKINGLDGGKNTPLHLAAERGHTIIVYQLLKRNAEKTHQNVNGRTALELAVERCHADIVTLLRLHDMKEEFNDDQNSTMDETVESFIGDLAAKQQHLRIKSGQSEPKPNNEEEGEEKIVEKL

SEQ ID NO: 121767 - protein, 67 aa, Heterodera glycines
  Homolog annotation: Hit_ID=CAF89665.1; Match level="QueryCoverage =68%, HitCoverage=15%, E-value=2e-19, Identity=97%"; Hit description =unnamed protein product [Tetraodon nigroviridis]
  Gene Ontology: Mol. function=translation factor activity, nucleic acid binding; Biological process=protein biosynthesis
  Essential gene: C elegans homolog=R03G5.1a; Phenotype=Emb,Lva,Unc
  Coding regions on vcDNA: vcDNA=SeqID_48190; Strand=+; Position=1-201
LKLRKFVLLFVRLYTVKPAKEMGKEKIHINIVVIGHVDSGKSTTTGHLIYKCGGIDKRTIEKFEKEG

SEQ ID NO: 121768 - protein, 176 aa, Heterodera glycines
  Homolog annotation: Hit_ID=CAE59075.1; Match level="QueryCoverage =91%, HitCoverage=30%, E-value=6e-44, Identity=52%"; Hit description =Hypothetical protein CBG02363 [Caenorhabditis briggsae]
  Essential gene: C elegans homolog=ZK622.3a; Phenotype=Lva,Unc
  Coding regions on vcDNA: vcDNA=SeqID_48191; Strand=+; Position=2-532
YANVVEWRVGDATGLQFDEGSVDLVFTNWLLMYLADQEAVQFVANALQWLRPDGYLHLRESCSEPSTKKSADHSTTTTTTSTSSSSSSSLHNNSKPNPTRYRFSSAYIQLLRSLRHTDVQSGTQWRFDVQWACSVGVYIERQSNWRQVHWLAKKSACNISRKQHPKIYWIVGHPIC

SEQ ID NO: 121769 - protein, 166 aa, Heterodera glycines
  misc_feature (27)..(27): Xaa can be any naturally occurring amino acid
  Homolog annotation: Hit_ID=CAE73166.1; Match level="QueryCoverage =100%, HitCoverage=38%, E-value=5e-58, Identity=66%"; Hit description= Hypothetical protein CBG20562 [Caenorhabditis briggsae]
  Gene Ontology: Mol. function=GTPase activity; Cellular component =eukaryotic translation initiation factor 2B complex; Biological process=translational initiation
  Essential gene: C elegans homolog=C37C3.2a; Phenotype=Emb,Lva,Ste
  Coding regions on vcDNA: vcDNA=SeqID_48192; Strand=+; Position=2-498
KMPRILAKVEGKGNGIKTVIANMPEIXKALSRPPTYPTKYFGCELGAQTNFDLKNERYIVNGEHDANKLQDILDGFIRKFVLCPSCDNPETVLTVKRQVINGKCKACGHAFIVDPKQKLSTFILKNPPPPDNIESEKEVKSDGGLPAEESNDVPVVDNSGGCDAGS

SEQ ID NO: 121770 - protein, 167 aa, Heterodera glycines
  Homolog annotation: Hit_ID=AAO85519.1; Match level="QueryCoverage =80%, HitCoverage=43%, E-value=2e-38, Identity=54%"; Hit description =putative serine/threonine phosphatase [Oesophagostomum dentatum] gb|AAO85518.1| putative serine/threonine
  Gene Ontology: Mol. function=protein serine/threonine phosphatase activity; Cellular component=cytoplasm; Biological process=protein amino acid dephosphorylation
  Essential gene: C elegans homolog=W09C3.6; Phenotype=Ste
  Coding regions on vcDNA: vcDNA=SeqID_48193; Strand=+; Position=83-586
MNEEYCFSTSTVVAQSWAQTNFRPVDEQPNSLVDTLIAKLSCTTFEQFTSEVSAQDIHKLCDVTVGVLQQQSMLIHLQPPVVLCGDIHGQFRDLLRIFKTMGFPPDKKYLFLGDYVDRGTQSLETMVLLFCYKVKYPDSVILLRGNHECSNMNRAYGFFEEVERRYG

SEQ ID NO: 121771 - protein, 123 aa, Heterodera glycines; identical to SEQ ID NO: 121314
  Homolog annotation: Hit_ID=P30757; Match level="QueryCoverage=100%, HitCoverage=100%, E-value=5e-57, Identity=89%"; Hit description =Histone H2B pir||S16084 histone H2B - sipunculid (Sipunculus nudus)
  Gene Ontology: Mol. function=DNA binding; Cellular component =nucleosome; Biological process=nucleosome assembly
  Essential gene: C elegans homolog=H02I12.6; Phenotype=Gro,Pvl,Ste
  Coding regions on vcDNA: vcDNA=SeqID_48194; Strand=+; Position=65-436

SEQ ID NO: 121772 - protein, 178 aa, Heterodera glycines
  misc_feature (7)..(7): Xaa can be any naturally occurring amino acid
  Homolog annotation: Hit_ID=CAE67991.1; Match level="QueryCoverage =94%, HitCoverage=49%, E-value=6e-31, Identity=46%"; Hit description =Hypothetical protein CBG13601 [Caenorhabditis briggsae]
  Gene Ontology: Mol. function=tRNA methyltransferase activity; Cellular component=nucleus; Biological process=gametogenesis
  Essential gene: C elegans homolog=W02A11.1; Phenotype=Gro,Stp
  Coding regions on vcDNA: vcDNA=SeqID_48195; Strand=+; Position=3-535
GSGSLSXAIAPAVAPDGHLYSFDIDEKRAKTVHNDLKLHGLSQNATVLCRDVSQHGFAATDCAEKEWRCDGVFLDLPAPWLAIGHAHKVLLQNGPERRPSRLVSFSPCIEQVQRVCAELEQHGFVDIETVEVVPRKLKVVDLPCESLSEYAAKGANAQTFFQKESQQNNTDCEQQRQK

SEQ ID NO: 121773 - protein, 216 aa, Heterodera glycines
  misc_feature (15)..(15): Xaa can be any naturally occurring amino acid
  Homolog annotation: Hit_ID=AAK94490.1; Match level="QueryCoverage =100%, HitCoverage=21%, E-value=1e-114, Identity=93%"; Hit description=PAZ/Piwi domain protein [Heterodera glycines]
  Gene Ontology: Mol. function=translation initiation factor activity; Biological process=gametogenesis
  Essential gene: C elegans homolog=F55A12.1; Phenotype=Emb
  Coding regions on vcDNA: vcDNA=SeqID_48196; Strand=+; Position=2-648
GGFAPSESAAPITVXNGSVPSGSKAGPTPQNGANGVAATGANTVPLGSNGNVVPSAPVPRVGSSLPPPSCIGWAATIGKRHRDEYIGDFVYQAPRREEKIDVIASVVRRCIESFKKNRNKLPLRVVILRNGCTEGQFEYVMKYEIPLVKKELEELGCTAKLTVIVPNRLQDVRFLRQDAKPEDKSNEQNIPPGTVVDTVVVHPKRSGFFLNSHVAI

SEQ ID NO: 121774 - protein, 210 aa, Heterodera glycines
  Homolog annotation: Hit_ID=AAO14563.2; Match level="QueryCoverage =100%, HitCoverage=29%, E-value=1e-114, Identity=96%"; Hit description=Hsp90 [Heterodera glycines]
  Gene Ontology: Biological process=reproduction
  Essential gene: C elegans homolog=C47E8.5; Phenotype=Emb,Ste
  Coding regions on vcDNA: vcDNA=SeqID_48197; Strand=+; Position=2-631
EEGDKRKRRPEDQEKYTEDEELNKTKPIWTRNPDDISNEEYAEFYKSLSNDWEDHLAVKHFSVEGQLEFRALLFVPQRAPFDLFENKKSKNAIKLYVRRVFIMENCEELMPEYLNFIKGVVDSEDLPLNISRETLQQSKILKVIRKNLVKKCMDLFEEISEDKDNFKKFYEQFAKNIKLGIHEDSVNRKKLSDFLRYYTSASGEEPCSFK

SEQ ID NO: 121775 - protein, 128 aa, Heterodera glycines
  Homolog annotation: Hit_ID=NP_493394.1; Match level="QueryCoverage =75%, HitCoverage=54%, E-value=8e-26, Identity=60%"; Hit description =cytochrome c oxidase subunit IV (1O250) [Caenorhabditis elegans] emb|CAB63334.1| Hypothetical protein W09
  Gene Ontology: Biological process=positive regulation of growth rate
  Essential gene: C elegans homolog=W09C5.8; Phenotype=Age,Gro,Ste
  Coding regions on vcDNA: vcDNA=SeqID_48198; Strand=+; Position=148-534
MSILTASKVCTLPRLSSARSMTWWWGPEKNNGREVVGPTFHGDEFYQDRLDRWYPSIRFRKNDEVITPIRHKELGDWKKLSIEEKKLIYRYSFRQTLVTFRRTFSLALALFRFDSLLLFFLFRPSLRH

SEQ ID NO: 121776 - protein, 173 aa, Heterodera glycines
  misc_feature (168)..(168): Xaa can be any naturally occurring amino acid
  Homolog annotation: Hit_ID=NP_508734.1; Match level="QueryCoverage =100%, HitCoverage=39%, E-value=2e-64, Identity=70%"; Hit description= choline kinase (49.2 kD) (XE909) [Caenorhabditis elegans] gb|AAK39220.1| Choline kinase a protein 2 [Cae
  Gene Ontology: Mol. function=choline kinase activity
  Essential gene: C elegans homolog=B0285.8; Phenotype=Unclassified
  Coding regions on vcDNA: vcDNA=SeqID_48199; Strand=+; Position=1-519
HMLFLCRLTENTPPLKGEPDKVLLRVYFNPETESHLVAESVIFTLLSERHLGPKLYGIFSGGRLEEYIPSRPLTCHEIALPTMANKIAKRLARVHQLEVPIWKEPEYICDALERWLIQLKQMPSGSRDFDLPAESHEWAPPSINCEDLQKEIEHLRRLIVKSRSLVTXCHNDL

SEQ ID NO: 121777 - protein, 148 aa, Heterodera glycines
  misc_feature (42)..(42): Xaa can be any naturally occurring amino acid
  misc_feature (132)..(132): Xaa can be any naturally occurring amino acid
  Homolog annotation: Hit_ID=CAD89885.1; Match level="QueryCoverage =99%, HitCoverage=61%, E-value=3e-58, Identity=66%"; Hit description =ribosomal protein L7 [Crassostrea gigas]
  Gene Ontology: Mol. function=structural constituent of ribosome; Cellular component=cytosolic large ribosomal subunit (sensu Eukarya); Biological process=protein biosynthesis
  Essential gene: C elegans homolog=F53G12.10; Phenotype=Emb,Lva
  Coding regions on vcDNA: vcDNA=SeqID_48200; Strand=+; Position=1-443
ESGQFYVPDEPKLAFVVRIKGINKIHPRPRKVLQLLRLRQIXNGVFVKLNKATIQMLRIADPYIAWGYPSQKIIRQLVYKRGYAKESGQRIPITDNAIVERNMGKSDVICVEDMIHQIWTVGPHFKQVTNFXWPFKLSNPVGGFKKKS

SEQ ID NO: 121778 - protein, 187 aa, Heterodera glycines
  Homolog annotation: Hit_ID=CAA11269.1; Match level="QueryCoverage =81%, HitCoverage=99%, E-value=1e-65, Identity=79%"; Hit description =polyubiquitin [Nicotiana tabacum]
  Essential gene: C elegans homolog=F25B5.4a; Phenotype=Emb
  Coding regions on vcDNA: vcDNA=SeqID_48201; Strand=+; Position=41-604
MKLIELLPFCFAVSALLLPSQTDGMQIFVETLIGRVITLEVESSDSIENLKRKITDKEGIPADDQRLIFAGKQLEDGRTLADYGVQKEAKIHLVLRLRGGMQIFIKTLTGKVITLDVDSMDSVENVKRKITDKEGIPADHQRLVFAGKQLEDGRTLADYGVQKEATVHLVLRLRGGGSMMNFDDDVL

SEQ ID NO: 121779 - protein, 162 aa, Heterodera glycines
  misc_feature (7)..(7): Xaa can be any naturally occurring amino acid
  misc_feature (136)..(136): Xaa can be any naturally occurring amino acid
  Homolog annotation: Hit_ID=AAL78213.1; Match level="QueryCoverage =100%, HitCoverage=65%, E-value=1e-82, Identity=94%"; Hit description= probable protein kinase Hgg-20 [Heterodera glycines]
  Gene Ontology: Mol. function=casein kinase I activity; Cellular component=bud neck; Biological process=signal transduction
  Essential gene: C elegans homolog=B0218.5; Phenotype=Unclassified
  Coding regions on vcDNA: vcDNA=SeqID_48202; Strand=+; Position=1-483
VKNADGXHFCRLLDLGRSEQRNATSGDTVFNYVVMTVVGTPLDKLIRNAGDRFSPGTAIGMSIQLLSAIKALHNVGFLHRDIKPANTAIGRAETNEHRLLYLIDFGMARQFLRPDGTQRRPRASANFRGTPIYAPXSLHISSVTTAAKMTSNRGSMSWSNST

SEQ ID NO: 121780 - protein, 173 aa, Heterodera glycines
  misc_feature (26)..(26): Xaa can be any naturally occurring amino acid
  Homolog annotation: Hit_ID=NP_036172.1; Match level="QueryCoverage =89%, HitCoverage=20%, E-value=4e-33, Identity=44%"; Hit description =cullin 1 [Mus musculus] gb|AAH29260.1| Cullin 1 [Mus musculus] gb|AAD16038.1| SCF complex protein cul-1 [
  Gene Ontology: Mol. function=protein binding; Cellular component=SCF ubiquitin ligase complex; Biological process=apoptosis
  Essential gene: C elegans homolog=D2045.6; Phenotype=Emb
  Coding regions on vcDNA: vcDNA=SeqID_48203; Strand=+; Position=1-518
LCKRLVYDTSASEEQERCMIAKLKPXCGFEYTSKLERLLTDVALSRDHSEQFKQQPRTSNVDFSVIVVMSNVWPLQQPVKFEIPRPLLDCIDSYTQYYTNRFNGRKLTWALQMCRGELVSTSNTFPSKYSFLCNTQQIAVLMQYNERNTYTLGELHVALGTDPGDQLCAAVQS

SEQ ID NO: 121781 - protein, 98 aa, Heterodera glycines
  Homolog annotation: Hit_ID=CAE68356.1; Match level="QueryCoverage =60%, HitCoverage=15%, E-value=7e-17, Identity=64%"; Hit description =Hypothetical protein CBG14093 [Caenorhabditis briggsae]
  Essential gene: C elegans homolog=F49H12.1; Phenotype=Gro,Pvl,Stp,Unc
  Coding regions on vcDNA: vcDNA=SeqID_48204; Strand=+; Position=203-496
MSTGNVMMMMSPKRMDKGNGGEKGQRQKAPGKERPKDGKERVHKCDQCQKAFRFKSNLFEHKSLHLGSSSRNPFVCPFCSKTCRLKGNLKKHLQVHVT

SEQ ID NO: 121782 - protein, 98 aa, Heterodera glycines
  misc_feature (15)..(15): Xaa can be any naturally occurring amino acid
  misc_feature (93)..(93): Xaa can be any naturally occurring amino acid
  Homolog annotation: Hit_ID=AAS84611.1; Match level="QueryCoverage =100%, HitCoverage=26%, E-value=4e-51, Identity=94%"; Hit description= cathepsin L-like cysteine proteinase I variant form precursor [Heterodera glycines]
  Gene Ontology: Mol. function=cathepsin S activity; Cellular component= extracellular space; Biological process=proteolysis and peptidolysis
  Essential gene: C elegans homolog=T03E6.7; Phenotype=Emb,Gro,Unc
  Coding regions on vcDNA: vcDNA=SeqID_48205; Strand=+; Position=2-294
VVWRVKGWVTEVKNXGMCGSCWAFSATGALEGQHVRDKGHLVSLSEQNLIDCSKKYGNMGCNGGIMDNAFQYIKDNKGIDKETDYPYKAKTGXKCLFK

SEQ ID NO: 121783 - protein, 118 aa, Heterodera glycines
  Homolog annotation: Hit_ID=CAE60648.1; Match level="QueryCoverage =94%, HitCoverage=22%, E-value=3e-32, Identity=58%"; Hit description =Hypothetical protein CBG04294 [Caenorhabditis briggsae]
  Gene Ontology: Mol. function=endopeptidase activity; Cellular component=proteasome regulatory particle, lid subcomplex (sensu Eukarya); Biological process=ubiquitin-dependent protein catabolism
  Essential gene: C elegans homolog=F10G7.8; Phenotype=Emb
  Coding regions on vcDNA: vcDNA=SeqID_48206; Strand=+; Position=20-373
MTKDGQKRRERLHDCVGEHNVRMVAKYYSRITFQRMAKLLEFGIEQMEAFVCKMIVDGVIPEVKIHRPSQIIYLSPKKNGAEVLDEWVFNVRKLTDTMNKVSHLIAKEEMVHGLQIPQ

SEQ ID NO: 121784 - protein, 182 aa, Heterodera glycines
  Homolog annotation: Hit_ID=NP_492524.2; Match level="QueryCoverage =96%, HitCoverage=14%, E-value=1e-30, Identity=38%"; Hit description =ubiquitin thiolesterase, family 2 and ubiquitin interacting motif (144.2 kD) (1K87) [Caenorhabditis elega
  Gene Ontology: Mol. function=protein binding; Cellular component =intracellular; Biological process=protein deubiquitination
  Essential gene: C elegans homolog=F30A10.10; Phenotype=Pvl,Stp
  Coding regions on vcDNA: vcDNA=SeqID_48207; Strand=+; Position=2-547
TIERTLEAHPNGRPVLDVIRQLFQSRISQTISCANCLRTSETVGEYRSLQIGIDGHSTLISAIQAFFAPEPLRDFRCDQCRETNCVTRSSRFTQLPELLIVQLNRYVLASNGNLRKLQNAVHYPRLLTELGGEGIPDYELCAVMIHEGKSTNSGHYYDVIRDPVIDRWFTYNDETVNQKRTA

SEQ ID NO: 121785 - protein, 164 aa, Heterodera glycines
  misc_feature (18)..(18): Xaa can be any naturally occurring amino acid
  Homolog annotation: Hit_ID=AAQ89579.1; Match level="QueryCoverage =100%, HitCoverage=24%, E-value=5e-87, Identity=99%"; Hit description= heat shock protein 70-C [Heterodera glycines] gb|AAM93256.1| heat shock protein 70-C [Heterodera glycines
  Gene Ontology: Mol. function=Hsp70/Hsp90 organizing protein activity; Cellular component=endoplasmic reticulum; Biological process=cell organization and biogenesis
  Essential gene: C elegans homolog=C15H9.6; Phenotype=Dpy,Lva
  Coding regions on vcDNA: vcDNA=SeqID_48208; Strand=+; Position=2-491
GIETVGGVMTKLITRNTXVIPTKKSQIFSTAADNQPTVTIQVFEGERPMTKDNHLLGKFDLTGIPPAPRGVPQIEVTFEIDVNGILHVTAEDKGTGNKNKITITNDHNRLSPEEIERMINDAEKFAEEDKKTKEVVEARNEFESYAYSLKNQLGDSEKLGGKLS

SEQ ID NO: 121786 - protein, 155 aa, Heterodera glycines
  Homolog annotation: Hit_ID=AAP51177.1; Match level="QueryCoverage =99%, HitCoverage=32%, E-value=1e-69, Identity=82%"; Hit description =fumarase [Ascaris suum]
  Gene Ontology: Mol. function=fumarate hydratase activity; Cellular component=mitochondrion; Biological process=fumarate metabolism
  Essential gene: C elegans homolog=H14A12.2a; Phenotype=Emb,Gro
  Coding regions on vcDNA: vcDNA=SeqID_48209; Strand=+; Position=1-465
TDFGLNSKVAAAICEAADDVISGKLDEHFPLVIWQTGSGTQSNMNVNEVISNRAIEILGGELGSKTPVHPNDHVNMSQSSNDTFPTAMHVAVAVEINTRLLPSLRLLHDELSKKSKEFEHIIKIGRTHTQDAVPLTLGQEFSAYVTQIGNGISRV

SEQ ID NO: 121787 - protein, 167 aa, Heterodera glycines
  Homolog annotation: Hit_ID=CAE67162.1; Match level="QueryCoverage =92%, HitCoverage=38%, E-value=5e-28, Identity=43%"; Hit description =Hypothetical protein CBG12588 [Caenorhabditis briggsae]
  Gene Ontology: Mol. function=RNA binding; Cellular component=nucleus; Biological process=mRNA metabolism
  Essential gene: C elegans homolog=F26B1.2a; Phenotype=Emb
  Coding regions on vcDNA: vcDNA=SeqID_48210; Strand=+; Position=2-502
VRPEKLADCFAEILEKLTEDQGRDDVDVRVIVYQSHAGAIIGKQGSKIKELRELMQAHIKVFQECAPQSTDRVVLITTQQSKMPDAIKHLMEFMREVPIKGPTKPYDPSSHDPRIVQCYGGFSGPMPPPPMGGPPMGMHGGGGGYASFGPRGGPPMPGGMGMPGGFM

SEQ ID NO: 121788 - protein, 219 aa, Heterodera glycines
  Homolog annotation: Hit_ID=NP_741572.1; Match level="QueryCoverage =100%, HitCoverage=51%, E-value=2e-55, Identity=52%"; Hit description= translation initiation factor IF5 and eIF4-gamma/eIF5/eIF2-epsilon (48.8 kD) (5I337) [Caenorhabditis ele
  Gene Ontology: Mol. function=GTPase activity; Cellular component =eukaryotic translation initiation factor 2B complex; Biological process=translational initiation
  Essential gene: C elegans homolog=C37C3.2a; Phenotype=Emb,Lva,Ste
  Coding regions on vcDNA: vcDNA=SeqID_48211; Strand=+; Position=2-658
RKFVLCPSCDNPETVLTVKRQVINGKCKACGHAFIVDPKQKLSTFILKNPPPPDNIESEKEVKSDGGLPAEESNDVPVVDNSGGCDAGSNGEDDEDWAPEPVEDEEKLSGQIGKLVIDKDLDKSVDERLDLLHQFFLKAVKNNTIQDSKMMLNEAERLELKSKAPLLLADVLFDTNVITQIKQHRNLLLRFCLKDEKAQRILLGGIEQLVQNNKDILMS

SEQ ID NO: 121789 - protein, 236 aa, Heterodera glycines
  misc_feature (134)..(134): Xaa can be any naturally occurring amino acid
  misc_feature (220)..(220): Xaa can be any naturally occurring amino acid
  Homolog annotation: Hit_ID=NP_508770.1; Match level="QueryCoverage =93%, HitCoverage=73%, E-value=3e-51, Identity=48%"; Hit description =ATP Synthase B homolog (34.9 kD) (asb-2) [Caenorhabditis elegans] gb|AAA96210.1| Atp synthase b homolog p
  Gene Ontology: Biological process=embryogenesis and morphogenesis
  Essential gene: C elegans homolog=F02E8.1; Phenotype=Lva
  Coding regions on vcDNA: vcDNA=SeqID_48212; Strand=+; Position=10-715
MLSNIYFTITKCDCMRLSFFPAVRQVHQMHTQSAVEKAKGARPEEGIPLKGEPHRPPSLFDDIGKYHLYEPLPKVPKDFKEFPERDLVNFPYPEKAEYPPRTRFVAIPDSWCREIEKVTGTSGPYLFFGGLLAXFLLNKEIIIMEENFCCFVFGWINIYLFFHTAFRYKFEKYVYKVTRERFGKMKAYIDNELKEAVEFRKTSKEHADSLKAVHENFPTXFQENLALQLEATYRKM

SEQ ID NO: 121790 - protein, 248 aa, Heterodera glycines
  misc_feature (218)..(218): Xaa can be any naturally occurring amino acid
  Homolog annotation: Hit_ID=CAE59917.1; Match level="QueryCoverage =99%, HitCoverage=77%, E-value=1e-111, Identity=75%"; Hit description= Hypothetical protein CBG03402 [Caenorhabditis briggsae]
  Gene Ontology: Cellular component=cytoplasm; Biological process =signal transduction
  Essential gene: C elegans homolog=K04D7.1; Phenotype=Gro,Slu
  Coding regions on vcDNA: vcDNA=SeqID_48213; Strand=+; Position=3-746
NGWVTQIATNPLYKNMLVSASRDKTIIVWMLDESGSVLNGKPIKSLHGHGHFVSDVVMSSDGQYALSGSWDKTLRLWDLNTGQTTRQFVSHTQDVLSVAFSADNRQIVSGSRDKKIKLWNTLAQCKHTIVEECHSDWVSTVRFSPSHANPVIASAGWDKIVKVWNLATCRLKTNHFGHTGYINSVTVSPDGSLCASGRKDGSAMLWDLNDGKHLYTLXGNDVINALAFSPNRYWLCAAGGPVVKNWDL

SEQ ID NO: 121791 - protein, 98 aa, Heterodera glycines
  Homolog annotation: Hit_ID=NP_500630.1; Match level="QueryCoverage =97%, HitCoverage=53%, E-value=5e-36, Identity=69%"; Hit description =ribosomal Protein, Large subunit (21.0 kD) (rpl-20Co) [Caenorhabditis elegans] gb|AAB92041.2| Ribosomal p
  Gene Ontology: Mol. function=structural constituent of ribosome; Cellular component=cytosolic large ribosomal subunit (sensu Eukarya); Biological process=reproduction
  Essential gene: C elegans homolog=E04A4.8; Phenotype=Emb,Gro
  Coding regions on vcDNA: vcDNA=SeqID_48214; Strand=+; Position=18-311
KVIVVGRKLPTANDPNPTLHEMVIFASNHVVAKSRFWYFTSMLRRVKKTHGEIISCQEVFEKKPGSVKNFGIWLRYDSRTGHHNMYREYRDVCEAGAV

SEQ ID NO: 121792 - protein, 247 aa, Heterodera glycines
  misc_feature (27)..(27): Xaa can be any naturally occurring amino acid
  misc_feature (226)..(226): Xaa can be any naturally occurring amino acid
  Homolog annotation: Hit_ID=AAK94490.1; Match level="QueryCoverage =99%, HitCoverage=25%, E-value=4e-44, Identity=39%"; Hit description =PAZ/Piwi domain protein [Heterodera glycines]
  Essential gene: C elegans homolog=F55A12.1; Phenotype=Emb
  Coding regions on vcDNA: vcDNA=SeqID_48215; Strand=+; Position=3-743
KKGVEFVLVGHPKGHSGDSIHHQMKSXELSTEVFTQSVLISTVNRIKNRSSGETMENIVNKTNVKMGGLNYALPIISDGMPMETLVIGFAVNHPAGGFGMDSDQKNGNGSNGTSDTGSDAASDNGNGANGHKPQKKPQVFEKSVPSVVGYSANIGENNNFEFVGDYKYQEARRDEKLQIIDHIVRHCLEMYKQRRNNKNPSSLIIYRNACGEGFYQHLLAYEVPVXKRLLAERCNGTKLTLIVVNKL

SEQ ID NO: 121793 - protein, 106 aa, Heterodera glycines
  misc_feature (8)..(8): Xaa can be any naturally occurring amino acid
  misc_feature (39)..(39): Xaa can be any naturally occurring amino acid
  Homolog annotation: Hit_ID=CAE57854.1; Match level="QueryCoverage =99%, HitCoverage=70%, E-value=6e-35, Identity=63%"; Hit description =Hypothetical protein CBG00891 [Caenorhabditis briggsae]
  Essential gene: C elegans homolog=R05H5.3; Phenotype=Emb
  Coding regions on vcDNA: vcDNA=SeqID_48216; Strand=+; Position=3-323
PKLKKFYXELKKAGKNFEVLFVSRDRAAKDLVEYYRDHXGAWAYLEFGNPKIQELLEKYEVKTIPTCKVIKPDGTIVVNDARTEVQEKGVENALGLWEEWLGFYEA

SEQ ID NO: 121794 - protein, 71 aa, Heterodera glycines
  Homolog annotation: Hit_ID=AAQ89579.1; Match level="QueryCoverage =100%, HitCoverage=10%, E-value=9e-33, Identity=100%"; Hit description=heat shock protein 70-C [Heterodera glycines] gb|AAM93256.1| heat shock protein 70-C [Heterodera glycine
  Gene Ontology: Mol. function=non-chaperonin molecular chaperone ATPase activity; Cellular component=intracellular; Biological process=protein folding
  Essential gene: C elegans homolog=C15H9.6; Phenotype=Dpy,Lva
  Coding regions on vcDNA: vcDNA=SeqID_48217; Strand=+; Position=1-213
KMKEIAESYLGHEVKNAVVTVPAYFNDAQRQATKDAGTIAGLNVVRIINEPTAAAIAYGLDKKEGERNILV

SEQ ID NO: 121795 - protein, 255 aa, Heterodera glycines
  Homolog annotation: Hit_ID=NP_505220.2; Match level="QueryCoverage =98%, HitCoverage=23%, E-value=2e-36, Identity=34%"; Hit description =putative protein, with a coiled coil-4 domain, of eukaryotic origin (5J95) [Caenorhabditis elegans]
  Essential gene: C elegans homolog=F41E6.4a; Phenotype =Emb,Gro,Pvl,Stp,Unc
  Coding regions on vcDNA: vcDNA=SeqID_48218; Strand=+; Position=2-769
MRTCTTQKNLLHSVLMNLQSKHHFLALCALRLIRRIIGLKDDTYIRHICDKGTLDQIVQCFVANGQRYNLLNSSLIELFEFIKRERIYPLIEYLINNHWENTFSKVDYVQTFVKMHDIWEAHLANKSDEGEKVKENGQTTPLAMTPPNAQWRKEREHDDEELFFSKDDDDEMPTAQCRKSGVDPLFPSLLRKRKANDEDGIASVFGGNITPPAGGAVSVSRISKIVIRMSSKEPSSAAVPLVTAGGGQSKRSTYK

SEQ ID NO: 121796 - protein, 238 aa, Heterodera glycines
  Homolog annotation: Hit_ID=NP_501299.1; Match level="QueryCoverage =78%, HitCoverage=50%, E-value=4e-22, Identity=37%"; Hit description =putative protein, with a transmembrane domain,2 coiled coil domains, Resistance to Inhibitors of Cholines
  Gene Ontology: Biological process=growth
  Essential gene: C elegans homolog=T14A8.1; Phenotype=Unclassified
  Coding regions on vcDNA: vcDNA=SeqID_48219; Strand=+; Position=50-766
WPNQQQQQQRERAHRPPPHHPGASMRMPDMHNQQQQQQQGGFWSGKSGGSMAWMLPFYTVGVVCFLLYTLFKIMFKSKTKRQKRRRDRPLDLLYGDDDDDEGTEDGLEYGVRGAKLRSVQHRLRKTEQAMADILSQLEQISAHSKDINDDDTKAAEKNVNDPNIANAQNEEENAETLQEKDGTLREAQSAKVEQSLRELKMLSDLCKSDRRLRRLRAAQRQQNLHSSSSANSDNEFLG

SEQ ID NO: 121797 - protein, 168 aa, Heterodera glycines
  Homolog annotation: Hit_ID=CAE58579.1; Match level="QueryCoverage =99%, HitCoverage=92%, E-value=8e-67, Identity=70%"; Hit description =Hypothetical protein CBG01745 [Caenorhabditis briggsae]
  Gene Ontology: Mol. function=structural constituent of ribosome; Cellular component=cytosolic large ribosomal subunit (sensu Eukarya); Biological process=reproduction
  Essential gene: C elegans homolog=E04A4.8; Phenotype=Emb,Gro
  Coding regions on vcDNA: vcDNA=SeqID_48220; Strand=+; Position=1-507
IVVGRKLPTANDPNPTLHEMVIFASNHVVAKSRFWYFTSMLRRVKKTHGEIISCQEVFEKKPGSVKNFGIWLRYDSRTGHHNMYREYRDVCEAGAVTQCYRDMGARHRAQADRIQIIKVQTISVADCKRAGVKQFQNSKIKFPLPHRVNSKRRNMTPFTTQRPRTHFV

SEQ ID NO: 121798 - protein, 111 aa, Heterodera glycines
  Homolog annotation: Hit_ID=CAE62104.1; Match level="QueryCoverage =37%, HitCoverage=4%, E-value=4e-11, Identity=76%"; Hit description =Hypothetical protein CBG06138 [Caenorhabditis briggsae]
  Gene Ontology: Biological process=regulation of protein activity, epigenetic
  Essential gene: C elegans homolog=M04B2.1; Phenotype=Lvl,Ste
  Coding regions on vcDNA: vcDNA=SeqID_48221; Strand=-; Position=0-332
LQLYIIYTLLGLERHLVMVHGLVTADLLAKAQRKADSGRCKLCSKQYAVAPPTKSWNGIWRRNIRTPGPTSNSSNINNSSSSSNAFQLICYGTEMGRGAKWRTNSKHVNNS

SEQ ID NO: 121799 - protein, 160 aa, Heterodera glycines
  Homolog annotation: Hit_ID=NP_504557.1; Match level="QueryCoverage =62%, HitCoverage=29%, E-value=4e-13, Identity=36%"; Hit description =basic-leucine zipper  transcription factor (36.9 kD) (5G495) [Caenorhabditis elegans] gb|AAB65905.2| Hypo
  Gene Ontology: Mol. function=RNA polymerase II transcription factor activity; Cellular component=cytoplasm; Biological process=JNK cascade
  Essential gene: C elegans homolog=F29G9.4; Phenotype=Pvl,Stp
  Coding regions on vcDNA: vcDNA=SeqID_48222; Strand=+; Position=229-708
MPRGTTKTVAQRRGGRRPREAEDHQLTDEDKDRRAKRRERNKQAAARCRRRREEKMQSLQEQVDELRKQNERRENEIRKMREKEQRLLEMLRLRNGGIVQQQLHHHLQAVHVQQQHQSVADHPTVSRPTSLLQPFLVGLNNKKRFCEAPAVPSSSSSAAS

SEQ ID NO: 121800 - protein, 172 aa, Heterodera glycines
  misc_feature (44)..(44): Xaa can be any naturally occurring amino acid
  Homolog annotation: Hit_ID=NP_495707.1; Match level="QueryCoverage =100%, HitCoverage=80%, E-value=1e-69, Identity=73%"; Hit description= ribosomal Protein, Large subunit (24.7 kD) (rpl-10) [Caenorhabditis elegans] emb|CAA88308.1| Hypothetica
  Gene Ontology: Mol. function=structural constituent of ribosome; Cellular component=cytosolic ribosome (sensu Eukarya); Biological process=protein biosynthesis
  Essential gene: C elegans homolog=F10B5.1; Phenotype=Lva,Ste
  Coding regions on vcDNA: vcDNA=SeqID_48223; Strand=+; Position=2-519
SVDSFLLCAMISNEREHLSSEALEAARICANKYMVKNCGKDGFXMRVRIHPFHVIRINKMLSCAGADRLQTGMRGAFGKPQELVARVGIGDMLMSVRVRDQHQAHALEAFRRAKFKFPGRQYIVISRKWGFTPFDREVYEKHRKEGRVIPDGVNCRFLKQHGPLTEWLKNPI

SEQ ID NO: 121801 - protein, 195 aa, Heterodera glycines
  Homolog annotation: Hit_ID=CAE65929.1; Match level="QueryCoverage =43%, HitCoverage=26%, E-value=2e-11, Identity=41%"; Hit description =Hypothetical protein CBG11102 [Caenorhabditis briggsae]
  Gene Ontology: Mol. function=receptor binding; Cellular component =cell junction; Biological process=EGF receptor signaling pathway
  Essential gene: C elegans homolog=Y54G11A.10; Phenotype=Gro
  Coding regions on vcDNA: vcDNA=SeqID_48224; Strand=+; Position=8-595
LSHRWHQKLFHCRFALFNFLRRPLPSLVFRRSLFKSPLDAPFCGIYRTNGGICRTDDILVCQRKMDYHLGANVRHQRGRNQHLLKANCDGTVVITRGKTFEEFKQEYERESVSRRAAFTRGTIFTVLFYPGIFVGILAVISVMSHRWHTYHGTGRELRPVSNAFVRFVAAFFGCYSYFPYNTDPDPEPIAVVEKE

SEQ ID NO: 121802 - protein, 173 aa, Heterodera glycines
  Homolog annotation: Hit_ID=CAE74645.1; Match level="QueryCoverage =98%, HitCoverage=21%, E-value=6e-44, Identity=50%"; Hit description =Hypothetical protein CBG22442 [Caenorhabditis briggsae]
  Gene Ontology: Cellular component=cytosol; Biological process =embryogenesis and morphogenesis
  Essential gene: C elegans homolog=F19F10.9; Phenotype=Emb
  Coding regions on vcDNA: vcDNA=SeqID_48225; Strand=+; Position=3-521
EDEGEEESTTYTNILGEEKDVTKGVGAMLKLAGQKGYLESGERRLEEGKLKHLESKRFSKVEQGRYDIEDKTMRKLERMGTAGTGPTRPFPEKAEYEPKIEINYADQKGRILDPKEAFRVLSWKFHGKGPGKKQAEKHAAQVVKREKLKKMNSMDTPLGTLNKQSKKQEQLQA

SEQ ID NO: 121803 - protein, 217 aa, Heterodera glycines
  misc_feature (50)..(50): Xaa can be any naturally occurring amino acid
  Homolog annotation: Hit_ID=AAL78213.1; Match level="QueryCoverage =98%, HitCoverage=85%, E-value=3e-73, Identity=67%"; Hit description =probable protein kinase Hgg-20 [Heterodera glycines]
  Gene Ontology: Mol. function=casein kinase I activity; Biological process=signal transduction
  Essential gene: C elegans homolog=B0218.5; Phenotype=Unclassified
  Coding regions on vcDNA: vcDNA=SeqID_48226; Strand=+; Position=30-679
MPEELVALSPGTRVSGRWTIIKKLGAGAFGAVYLCQDRDGRTMAALKTDXFYAQRPLLYMEAHVLLTLNELRSNSGRHFCRCLDLGRDEQPDADSGQTMEFNYVVMSLVGRPVDKLLHESGDRFSPGTAIGTSIQLLKALKALHSVGYLHRDIKPANSAIGTPETNEQRLLYLLDFGMARKYVREDGTHRRQRDTDRFRWTPIYAPISAHIKRDYSR

SEQ ID NO: 121804 - protein, 240 aa, Heterodera glycines
  misc_feature (90)..(90): Xaa can be any naturally occurring amino acid
  Homolog annotation: Hit_ID=XP_342398.1; Match level="QueryCoverage =100%, HitCoverage=58%, E-value=1e-105, Identity=52%"; Hit description=similar to hypothetical protein [Rattus norvegicus]
  Gene Ontology: Mol. function=histone-lysine N-methyltransferase activity; Cellular component=nucleosome; Biological process =establishment and/or maintenance of chromatin architecture
  Essential gene: C elegans homolog=C14B1.4; Phenotype=Stp
  Coding regions on vcDNA: vcDNA=SeqID_48227; Strand=+; Position=3-722
CQFSADGQWLASACADKTVKIWSTVDGKLENTIQGHKLGISDVCWSYDNRMIVSCSDDKTLKLFDVQQGKTLKTFRGHHNYVFCCNFNPXSTLLVSGSFDETVRIWDIRNGNCVRTLPARSDPVSAVAFNRDGSLIATSSYDGLVRIWETSSGQCMTTLFDNENPPVSFVKFSPNGKYILAATMDSQLKLWDFNKGKPLKSYQGHVNKKYCIFANFSVTGGKCIVSGSEDNRIYIWNLQT

SEQ ID NO: 121805 - protein, 203 aa, Heterodera glycines
  misc_feature (187)..(187): Xaa can be any naturally occurring amino acid
  Homolog annotation: Hit_ID=NP_509323.1; Match level="QueryCoverage =99%, HitCoverage=43%, E-value=9e-94, Identity=82%"; Hit description =translation Elongation FacTor (50.7 kD) (eft-4) [Caenorhabditis elegans] ref|NP_498520.1| translation Elo
  Gene Ontology: Mol. function=translation factor activity, nucleic acid binding
  Essential gene: C elegans homolog=R03G5.1a; Phenotype=Emb,Lva,Unc
  Coding regions on vcDNA: vcDNA=SeqID_48228; Strand=+; Position=3-611
GACGTREFEAGISKNGQTREHALLAQTLGVKQLIVACNKMDTTEPPFAEARYTEVMTEVSNLMQLFIGYNPATVPFVPISGFNGDNMLEPSDRMPWFKGWAIERKHGIASGKTLLEALDSILPPQRPTDKPLRLPLQDVYKIGGIGTVPVGRVETDVLKPGMVVTFAPQGISTEVKSEEMHHESLPXALSGHNVGFNVKNISV

SEQ ID NO: 121806 - protein, 171 aa, Heterodera glycines
  misc_feature (57)..(57): Xaa can be any naturally occurring amino acid
  Homolog annotation: Hit_ID=AAL40718.1; Match level="QueryCoverage =99%, HitCoverage=98%, E-value=8e-78, Identity=86%"; Hit description =myosin regulatory light chain [Meloidogyne incognita]
  Gene Ontology: Mol. function=structural constituent of muscle; Cellular component=muscle myosin; Biological process=regulation of muscle contraction
  Essential gene: C elegans homolog=C36E6.3; Phenotype=Gro,Unc
  Coding regions on vcDNA: vcDNA=SeqID_48229; Strand=+; Position=3-518
TEKKVKKVKKKSRTGSEASSFDQKTIQEFKEAFGIMDQDKDGVISKQDLKDLYATFXVVASDSHMDNMLKEAPGPINFTVFLTLFGERLTGTDPEATIIGAFQMFDKTDCGEITEETLMKILKNKRGEPLTEDEVQGMYKGNPPISGGKVDYKAFAHLITTGAAEELAKVG

SEQ ID NO: 121807 - protein, 98 aa, Heterodera glycines
  misc_feature (98)..(98): Xaa can be any naturally occurring amino acid
  Homolog annotation: Hit_ID=CAE62104.1; Match level="QueryCoverage =42%, HitCoverage=4%, E-value=4e-11, Identity=76%"; Hit description =Hypothetical protein CBG06138 [Caenorhabditis briggsae]
  Gene Ontology: Biological process=regulation of protein activity, epigenetic
  Essential gene: C elegans homolog=M04B2.1; Phenotype=Lvl,Ste
  Coding regions on vcDNA: vcDNA=SeqID_48230; Strand=-; Position=1-294
QLYIIYTLLGLERHLVMVHGLVTADLLAKAQRKADSGRCKLCSKQYAVAPPTKSWNGIWRRNIRTPGPTSNSSNINNSSSSSNAFQLICYGTEMGRGX

SEQ ID NO: 121808 - protein, 233 aa, Heterodera glycines
  misc_feature (18)..(18): Xaa can be any naturally occurring amino acid
  Homolog annotation: Hit_ID=NP_493252.2; Match level="QueryCoverage =99%, HitCoverage=9%, E-value=5e-76, Identity=59%"; Hit description =PAtterning Defective PAD-1, dopey, N-terminal (266.8 kD) (pad-1) [Caenorhabditis elegans]
  Gene Ontology: Biological process=development
  Essential gene: C elegans homolog=Y18D10A.13; Phenotype=Emb
  Coding regions on vcDNA: vcDNA=SeqID_48231; Strand=+; Position=3-758
PYLKAKSAKNVRFFLASXQFLASMSSYNYMRSVWKKNAMDLLWDNSFFKMDIRALRQWLYLIDNLMTNDKTSFKELLTRITTSTSTTLSTLITSKEQEYEMRAQYLKRLAFVILSSELDQYAGQLNEIQERLTENLRLCQVPVIHTQVFTCYRVLLVRMSPSSFVSIWPSMVTELVHAASSPVDEQKSARDEQCMQLFLAACKLLETLCALPSGYMSQFQMCRWTFISPMNAV

SEQ ID NO: 121809 - protein, 143 aa, Heterodera glycines
  misc_feature (45)..(45): Xaa can be any naturally occurring amino acid
  Homolog annotation: Hit_ID=AAH46078.1; Match level="QueryCoverage =88%, HitCoverage=88%, E-value=2e-20, Identity=40%"; Hit description =Similar to H2A histone family, member X [Danio rerio] ref|NP _957367.1| similar to H2A histone family, memb
  Gene Ontology: Mol. function=DNA binding; Cellular component =nucleosome; Biological process=nucleosome assembly
  Essential gene: C elegans homolog=T23D8.6; Phenotype=Emb
  Coding regions on vcDNA: vcDNA=SeqID_48232; Strand=+; Position=77-507
MPRHRAKPRSFHAGLKFPVGRVHRKMKKGPYAKRLANGVPVYMTXLVLEHITGELLKKIGEITQAEGMKRLSAFHIRTAARDDDELRKLFSGVSLAEVCVLPELESDVEQSSEGSGESDSDEESTEGSASGSHEGGGAAAAQQ

SEQ ID NO: 121810 - protein, 182 aa, Heterodera glycines
  Homolog annotation: Hit_ID=CAA70694.1; Match level="QueryCoverage =100%, HitCoverage=50%, E-value=3e-88, Identity=92%"; Hit description= cathepsin S-like cysteine proteinase [Heterodera glycines]
  Gene Ontology: Mol. function=cathepsin K activity; Cellular component= lysosome; Biological process=proteolysis and peptidolysis
  Essential gene: C elegans homolog=T03E6.7; Phenotype=Emb,Gro,Unc
  Coding regions on vcDNA: vcDNA=SeqID_48233; Strand=+; Position=19-564
MAFLSRLSILPNSPISLLAVSLAVLAFVALASANPPTARETAPNAQQNNANTVATREIAKNIAEKMERTNEFINYFRAKKFIDAHNLAFEKGEVSLKVAPNHLMHFTPAQYNRIRGLQMRSNRQRHNMATLAGNSSTSPEKPDWREKGAVTEAKDQGDCGSRWAFSATGAIEGALAQKKAPK

SEQ ID NO: 121811 - protein, 235 aa, Heterodera glycines
  misc_feature (61)..(61): Xaa can be any naturally occurring amino acid
  Homolog annotation: Hit_ID=NP_491560.1; Match level="QueryCoverage =97%, HitCoverage=42%, E-value=1e-40, Identity=38%"; Hit description =ezrin, Radixin and Moesin family, Ezrin/Radixin/Moesin (66.0 kD) (erm-1) [Caenorhabditis elegans] gb|AAB3
  Gene Ontology: Mol. function=structural constituent of cytoskeleton; Cellular component=plasma membrane; Biological process=establishment and/or maintenance of epithelial cell polarity
  Essential gene: C elegans homolog=C01G8.5a; Phenotype=Emb,Gro,Stp,Unc
  Coding regions on vcDNA: vcDNA=SeqID_48234; Strand=+; Position=1-708
HVGIPTHRSAQLKEQAKEERAQRQLKISMKEEIESAQRELEVAQGRIRRLEDQIYELIDAXRLLEEKEHELQTLNTELASERAMSKEERARLLTEIALQESRVSEKRFEVKNKTEEMNKLKAEVESGNGHLPTEFNDPDDLTAHIELSTFHEGDVNNVMPQRELDRTNFTDQDLSLKRKLELLTKELDNARDERAITDFDVLHMENKRHARDKYNTLRQIRSGNTKRRIDQFENL

SEQ ID NO: 121812 - protein, 237 aa, Heterodera glycines
  misc_feature (86)..(86): Xaa can be any naturally occurring amino acid
  Homolog annotation: Hit_ID=NP_492766.1; Match level="QueryCoverage =99%, HitCoverage=75%, E-value=7e-99, Identity=75%"; Hit description =ribosomal Protein, Acidic (33.8 kD) (rpa-0) [Caenorhabditis elegans] emb|CAB02098.1| Hypothetical protein
  Gene Ontology: Mol. function=DNA-(apurinic or apyrimidinic site) lyase activity; Cellular component=cytosolic ribosome (sensu Eukarya); Biological process=protein biosynthesis
  Essential gene: C elegans homolog=F25H2.10; Phenotype=Emb,Lva,Ste
  Coding regions on vcDNA: vcDNA=SeqID_48235; Strand=+; Position=1-710
SLFEEYPKCLLVGVDNVGSKQMQEIRGAMRGHGEILMGKNTMIRKAIRGNLQKFPLLDNLLPYIVGNVGFVFTNEDLGDVRKKLLXDKRGAPAKAGAIAPCDVRLPPQNSGMGPEKTSFFQALQIPTKISRGTIEILNEVHLIKTGEKVGASESALLNMLGIQPFSYGLVVEQVFDNGAVYSPDVLDVTTADLLARFQQGVLNVAALSLGIGYPTKASAPHLIANAFKNLLAVAAET

SEQ ID NO: 121813 - protein, 196 aa, Heterodera glycines
  Homolog annotation: Hit_ID=NP_499704.1; Match level="QueryCoverage =89%, HitCoverage=34%, E-value=6e-33, Identity=40%"; Hit description =cytochrome P450 precursor family member (3O111) [Caenorhabditis elegans] emb|CAB04112.1| Hypothetical pro
  Gene Ontology: Mol. function=oxidoreductase activity; Biological process=epoxygenase P450 pathway
  Essential gene: C elegans homolog=T10B9.4; Phenotype=Clr,Emb,Slu
  Coding regions on vcDNA: vcDNA=SeqID_48236; Strand=+; Position=90-677
MMRKHRKYWSNRGIPSPTPQLISGNFGSLYGDYPSMFQLRDWTRQYGKQYGIQYGWRNALVISDPAMVHELLVTKFEYFHARNLSPIFGNLDTNKWISMFLARGGRWKRLRTIANPAFSVANLKKCMWLIDDSVKNAINFLEKARNEGKSFNIQRHFVEMSFDVIARVALGQRESRQFETEMAHLAIESMKYKYSI

SEQ ID NO: 121814 - protein, 239 aa, Heterodera glycines
  Homolog annotation: Hit_ID=NP_499704.1; Match level="QueryCoverage =73%, HitCoverage=34%, E-value=9e-33, Identity=40%"; Hit description =cytochrome P450 precursor family member (3O111) [Caenorhabditis elegans] emb|CAB04112.1| Hypothetical pro
  Gene Ontology: Mol. function=oxidoreductase activity; Biological process=epoxygenase P450 pathway
  Essential gene: C elegans homolog=T10B9.4; Phenotype=Clr,Emb,Slu
  Coding regions on vcDNA: vcDNA=SeqID_48237; Strand=+; Position=90-809
MMRKHRKYWSNRGIPSPTPQLISGNFGSLYGDYPSMFQLRDWTRQYGKQYGIQYGWRNALVISDPAMVHELLVTKFEYFHARNLSPIFGNLDTNKWISMFLARGGRWKRLRTIANPAFSVANLKKCMWLIDDSVKNAINFLEKARNEGKSFNIQRHFVEMSFDVIARVALGQRESRQFETEMAHLAIESMQKYKYSIAQTADTEKEVAFSGQSVITPKSVTVGLKLRDEDGTAHLNNLC

SEQ ID NO: 121815 - protein, 172 aa, Heterodera glycines
  Homolog annotation: Hit_ID=NP_499704.1; Match level="QueryCoverage =95%, HitCoverage=31%, E-value=6e-27, Identity=38%"; Hit description =cytochrome P450 precursor family member (3O111) [Caenorhabditis elegans] emb|CAB04112.1| Hypothetical pro
  Gene Ontology: Mol. function=oxidoreductase activity; Biological process=epoxygenase P450 pathway
  Essential gene: C elegans homolog=T10B9.4; Phenotype=Clr,Emb,Slu
  Coding regions on vcDNA: vcDNA=SeqID_48238; Strand=+; Position=103-618
MMRKHRKYWSNRGIPSPTPQLISGNFGSLYCYYPSMFQLRDWTRQYGKQYGIQYGWRNALVISDPAMVHELLVTKFEYFHARNLSPIFGNLDTNKWISMFLARGGRWKRLRTIANPAFSVANLKKCMWLIDDPLKNAINFLEKARNEGKSFNIQRHSVQMSFDVIPPCGVGA

SEQ ID NO: 121816 - protein, 237 aa, Heterodera glycines
  misc_feature (180)..(180): Xaa can be any naturally occurring amino acid
  misc_feature (211)..(211): Xaa can be any naturally occurring amino acid
  misc_feature (224)..(224): Xaa can be any naturally occurring amino acid
  Homolog annotation: Hit_ID=CAA50685.1; Match level="QueryCoverage =96%, HitCoverage=56%, E-value=1e-101, Identity=74%"; Hit description= IEF SSP 9306 [Homo sapiens]
  Gene Ontology: Mol. function=H3/H4 histone acetyltransferase activity; Cellular component=nucleus; Biological process=cell proliferation
  Essential gene: C elegans homolog=K07A1.12; Phenotype=Emb
  Coding regions on vcDNA: vcDNA=SeqID_48239; Strand=+; Position=24-735
PPQQGEDAEERLINEEYKIWKKNCPFLYDMVMTHALEWPSLTVQWLPDVQRQEGADYTIHRLILGTHTSDEQNHLVIAKLLLPNDDAQFDASRYDTDRGEFGGFGTVTGKIEVEIKMNHEGEVNRARYMPQNPVLIGTKSPSSEVYVFDYTKHPSTPADVECKPQLRLRGHTKEGYGLSXNNNLPGHLLSASDDMTVCLWDIQAATANANXLDAKSICTAHTAXVEDVAWHVLHDTV

SEQ ID NO: 121817 - protein, 184 aa, Heterodera glycines
  Homolog annotation: Hit_ID=AAR85527.1; Match level="QueryCoverage =97%, HitCoverage=70%, E-value=5e-47, Identity=52%"; Hit description =14-3-3b protein [Meloidogyne incognita]
  Gene Ontology: Mol. function=protein kinase C inhibitor activity; Cellular component=cytoplasm; Biological process=regulation of mitosis
  Essential gene: C elegans homolog=M117.2; Phenotype=Emb
  Coding regions on vcDNA: vcDNA=SeqID_48240; Strand=+; Position=1-552
YLVEVSEKARRYDDMVEAMKKLIKLDPNLTLEERISLSTAYKGAMASRRTSWRALVSIEERTGASLSDAQQQVLENYREKVQNELVNTCQELLTCINEVLFPKASDVEQKVFYLKMKADYYRYISEVATDEDRSGVVELAKVAYQEAIDMAGDKIPATNPTRLGLALNFAVFNYEILNSVTEAR

SEQ ID NO: 121818 - protein, 120 aa, Heterodera glycines
  Homolog annotation: Hit_ID=NP_503446.1; Match level="QueryCoverage =95%, HitCoverage=23%, E-value=5e-21, Identity=42%"; Hit description =cell Division Cycle related (55.7 kD) (cdc-25.2) [Caenorhabditis elegans] gb|AAB94237.2| Cell division cy
  Gene Ontology: Mol. function=protein tyrosine phosphatase activity; Cellular component=mitotic chromosome; Biological process=meiotic spindle assembly
  Essential gene: C elegans homolog=F16B4.8; Phenotype=Bmd,Emb,Lvl
  Coding regions on vcDNA: vcDNA=SeqID_48241; Strand=+; Position=3-365
LNLWETTSIEKLFYPEEDERFGEIIVRTPIFYCEYSQKRGPKMALALREFDRVRNESRYPYVDYKEIYLLDRGYRYFFKERKFGKYCTPQAYVQMWDSAYTEQRKRFDSHRRGKKRRRNN

SEQ ID NO: 121819 - protein, 123 aa, Heterodera glycines
  misc_feature (17)..(17): Xaa can be any naturally occurring amino acid
  Homolog annotation: Hit_ID=P30757; Match level="QueryCoverage=100%, HitCoverage=100%, E-value=3e-51, Identity=82%"; Hit description =Histone H2B pir||S16084 histone H2B - sipunculid (Sipunculus nudus)
  Gene Ontology: Mol. function=DNA binding; Cellular component =nucleosome; Biological process=nucleosome assembly
  Essential gene: C elegans homolog=H02I12.6; Phenotype=Gro,Pvl,Ste
  Coding regions on vcDNA: vcDNA=SeqID_48242; Strand=+; Position=33-403
MPPKPSGKGAKKAVKSXKTVRTADKKRKKSRKESYSVYIYRVLKQVFSDTGISSKAMSIMNSFRNDVFERIAAEASRLAHYNKRSTISSREIQTAARLILPGELAKHAASEGTKAATKYTSSK

SEQ ID NO: 121820 - protein, 230 aa, Heterodera glycines
  Homolog annotation: Hit_ID=NP_497663.1; Match level="QueryCoverage =99%, HitCoverage=51%, E-value=1e-122, Identity=90%"; Hit description= MEChanosensory abnormality MEC-12, TuBulin, Alpha, specific of 15 protofilament microtubules found in me
  Gene Ontology: Mol. function=GTP binding; Cellular component =microtubule; Biological process=spindle assembly
  Essential gene: C elegans homolog=F26E4.8; Phenotype=Emb
  Coding regions on vcDNA: vcDNA=SeqID_48243; Strand=+; Position=58-747
MREVISIHVGQAGVQIGNACWELYCLEHGIQPDGKMPSDQNNQDDSFSTFFSETGNGRHVPRAVMVDLEPTVIDEIRTGTYKHLFHPEQLITGKGDAANNYARGHYTVGKEIIDPVLDRIRRIADNCTGLQGFLIFHSFGGGTGSGFTSLLMERLSVDYGKKSKLEFSIYPAPQVSTAVVEPYNSVLTTHTTLEHSDCAFMVDNEAIYDICRRNLDVERPSYTNLNRLIS

SEQ ID NO: 121821 - protein, 130 aa, Heterodera glycines
  misc_feature (75)..(75): Xaa can be any naturally occurring amino acid
  misc_feature (112)..(112): Xaa can be any naturally occurring amino acid
  Homolog annotation: Hit_ID=CAE70384.1; Match level="QueryCoverage =98%, HitCoverage=15%, E-value=8e-50, Identity=75%"; Hit description =Hypothetical protein CBG16945 [Caenorhabditis briggsae]
  Gene Ontology: Mol. function=translation elongation factor activity; Cellular component=nucleolus; Biological process=protein biosynthesis
  Essential gene: C elegans homolog=F25H5.4; Phenotype=Emb,Lva
  Coding regions on vcDNA: vcDNA=SeqID_48244; Strand=+; Position=1-392
PVLLMSKMDRALLELHLGQEELFQTFQRIVENINVIIATYGDDDGPMGPIHVDPSVGYVGYGSGLHGWAFASKQXAEMSADKFGVQQATLMRTLWGDRFLTGRPRKWTNNQXPGTMRGFSQSVLDPIFSG

SEQ ID NO: 121822 - protein, 168 aa, Heterodera glycines
  Homolog annotation: Hit_ID=CAE68356.1; Match level="QueryCoverage =53%, HitCoverage=22%, E-value=7e-22, Identity=56%"; Hit description =Hypothetical protein CBG14093 [Caenorhabditis briggsae]
  Essential gene: C elegans homolog=F49H12.1; Phenotype=Gro,Pvl,Stp,Unc
  Coding regions on vcDNA: vcDNA=SeqID_48245; Strand=+; Position=203-706
MSTGNVMMMMSPKRMDKGNGGEKGQRQKAPGKERPKDGKERVHKCDQCQKAFRFKSNLFEHKSLHLGSSSRNPFVCPFCSKTCRLKGNLKKHLQVHVTSAEDLECLWERSFSRSSGRPSKNAPPAPLPKPGDDLGMVPVLVSQQDASSSSPFGSPPTIKWTLPQNRSA

SEQ ID NO: 121823 - protein, 111 aa, Heterodera glycines
  misc_feature (49)..(49): Xaa can be any naturally occurring amino acid
  misc_feature (76)..(76): Xaa can be any naturally occurring amino acid
  misc_feature (102)..(102): Xaa can be any naturally occurring amino acid
  Homolog annotation: Hit_ID=P30757; Match level="QueryCoverage=100%, HitCoverage=90%, E-value=5e-39, Identity=74%"; Hit description =Histone H2B pir||S16084 histone H2B - sipunculid (Sipunculus nudus)
  Gene Ontology: Mol. function=DNA binding; Cellular component =nucleosome; Biological process=nucleosome assembly
  Essential gene: C elegans homolog=T10C6.11; Phenotype=Emb,Lva,Unc
  Coding regions on vcDNA: vcDNA=SeqID_48246; Strand=+; Position=3-339
AVNSTNAVRTENKKRKKALKESYSVYIYRVLKQVHPDTGISSKAMFIMXSVVNDVFQRIAAEASQLAHYNKRSTIXSPEIQTAVRLILPCELADHAVYEGTXAVTKYTSLK

SEQ ID NO: 121824 - protein, 266 aa, Heterodera glycines
  misc_feature (8)..(8): Xaa can be any naturally occurring amino acid
  misc_feature (209)..(209): Xaa can be any naturally occurring amino acid
  misc_feature (226)..(226): Xaa can be any naturally occurring amino acid
  misc_feature (252)..(252): Xaa can be any naturally occurring amino acid
  Homolog annotation: Hit_ID=AAD03339.1; Match level="QueryCoverage =99%, HitCoverage=30%, E-value=1e-130, Identity=85%"; Hit description= elongation factor [Caenorhabditis elegans] pir||A40411 translation elongation factor eEF-2 - Caenorhabdit
  Gene Ontology: Mol. function=translation elongation factor activity; Biological process=protein biosynthesis
  Essential gene: C elegans homolog=F25H5.4; Phenotype=Emb,Lva
  Coding regions on vcDNA: vcDNA=SeqID_48247; Strand=+; Position=2-795
PETVLRQXIAERIKPVLLMSKMDRALLELQLGQEELFQTFQRIVENINVIIATYGDDDGPMGPIQVDPSIGNVGFGSGLHGWAFTLKQFAEMYADKFGVQIDKLMKNLWGDRFFNMKTKKWTNNQEPETKRGFCQFVLDPIFKVFDAVMNIKKDEVAKLVEKLNIKLTLEEKEQEGKPLLKTMMRKWLPAGDTMLQMIVMHLPSPVTAXRYRMEMLYEGPHDDEAXAVAMKNCDPNGPLMMYISKMVPTSDXGRFYAFGRVFAGRV

SEQ ID NO: 121825 - protein, 210 aa, Heterodera glycines
  Homolog annotation: Hit_ID=A45618; Match level="QueryCoverage=100%, HitCoverage=45%, E-value=1e-103, Identity=87%"; Hit description =translation elongation factor eEF-1 alpha chain - nematode (Onchocerca volvulus) sp|P27592|EF1A_ONCVO ELONGA
  Gene Ontology: Mol. function=translation factor activity, nucleic acid binding; Biological process=protein biosynthesis
  Essential gene: C elegans homolog=R03G5.1a; Phenotype=Emb,Lva,Unc
  Coding regions on vcDNA: vcDNA=SeqID_48248; Strand=+; Position=6-638
IGGIGTVPVGRVETGVLKPGMVVTFAPQGISTEVKSVEMHHESLPEALPGDNVGFNVKNISVKDIRRGSVASDSKNDPAKETKSFTAQVIIMNHPGQIAAGYTPVLDCHTAHIACKFAELKEKVDRRSGKKVEDNPKALKTGDAGIVDLIPTKPMCVEAFTDYAPLGRFAVRDMRQTVAVGVIKAVEKTEGGGKVTKSAQKAAAPGGKKK

SEQ ID NO: 121826 - protein, 204 aa, Heterodera glycines
  Homolog annotation: Hit_ID=CAB59358.1; Match level="QueryCoverage =100%, HitCoverage=43%, E-value=1e-101, Identity=89%"; Hit description=translation elongation factor eEF-1 alpha chain [Anisakis simplex]
  Gene Ontology: Mol. function=translation factor activity, nucleic acid binding; Biological process=protein biosynthesis
  Essential gene: C elegans homolog=R03G5.1a; Phenotype=Emb,Lva,Unc
  Coding regions on vcDNA: vcDNA=SeqID_48249; Strand=+; Position=3-617
VPVGRVETGVLKPGMVVTFAPQGISTEVKSVEMHHESLPEALPGDNVGFNVKNISVKDIRRGSVASDSKNDPAKETKSFTAQVIIMNHPGQIAAGYTPVLDCHTAHIACKFAELKEKVDRRSGKKVEDNPKALKTGDAGIVDLIPTKPMCVEAFTDYAPLGRFAVRDMRQTVAVGVIKAVEKTEGGGKVTKSAQKAAAPGGKKK

SEQ ID NO: 121827 - protein, 100 aa, Heterodera glycines
  misc_feature (8)..(8): Xaa can be any naturally occurring amino acid
  misc_feature (22)..(22): Xaa can be any naturally occurring amino acid
  Homolog annotation: Hit_ID=CAE57827.1; Match level="QueryCoverage =99%, HitCoverage=82%, E-value=1e-34, Identity=73%"; Hit description =Hypothetical protein CBG00852 [Caenorhabditis briggsae]
  Gene Ontology: Mol. function=hydrogen-transporting ATPase activity, rotational mechanism; Cellular component=vacuolar membrane (sensu Fungi); Biological process=hydrogen transport
  Essential gene: C elegans homolog=ZK970.4; Phenotype=Emb
  Coding regions on vcDNA: vcDNA=SeqID_48250; Strand=+; Position=3-303
FLLGGVGXLNKRGSPFCIVDKXTSVAEIEDAFRTFCTRDDIAIILINQHVAEMIRYQVDQHVAGIPAVLEIPSKEMPYDASKDSILNRARGLVNTDDLKS

SEQ ID NO: 121828 - protein, 91 aa, Heterodera glycines
  Homolog annotation: Hit_ID=AAH47137.1; Match level="QueryCoverage =100%, HitCoverage=72%, E-value=8e-16, Identity=45%"; Hit description= Histone 2, H2bb [Mus musculus] ref|NP_783597.1| histone 2, H2bb [Mus musculus] gb|AAO06250.1| histone pro
  Gene Ontology: Mol. function=DNA binding; Cellular component =nucleosome; Biological process=nucleosome assembly
  Essential gene: C elegans homolog=H02I12.6; Phenotype=Gro,Pvl,Ste
  Coding regions on vcDNA: vcDNA=SeqID_48251; Strand=+; Position=127-402
KVSSNLNLRRALKEIYPGKEISLRALNIMNSFVMDALDRIATEATRMAHYDRCKTVTLRDMEFSCRLCLPDTMAKHANQKAQKTVTKFYAA

SEQ ID NO: 121829 - protein, 232 aa, Heterodera glycines
  misc_feature (6)..(6): Xaa can be any naturally occurring amino acid
  misc_feature (15)..(15): Xaa can be any naturally occurring amino acid
  Homolog annotation: Hit_ID=AAO14563.2; Match level="QueryCoverage =100%, HitCoverage=32%, E-value=1e-125, Identity=97%"; Hit description=Hsp90 [Heterodera glycines]
  Gene Ontology: Biological process=reproduction
  Essential gene: C elegans homolog=C47E8.5; Phenotype=Emb,Ste
  Coding regions on vcDNA: vcDNA=SeqID_48252; Strand=+; Position=2-694
DFLRYXTSASGEEPXQLQDYVSRMKENQTCIYYITGESKDVVQNSSFVERVKKRGFEVIYMVDPIDEYCVQQLKEYDGKKLVSVTKEGLELPESEEEKKKFEEDKVKFEKLCKVIKDILDKKVQKVSVSNRLVSSPCCIVTGEYGWSANMERIMKAQALRDSSTMGYMASKKNLEINPDHSIIKSLRDRVEKEQDDKTAKDLVVLLYETSLLTSGFSLEDPQQHASRIYRMV

SEQ ID NO: 121830 - protein, 238 aa, Heterodera glycines
  misc_feature (227)..(227): Xaa can be any naturally occurring amino acid
  Homolog annotation: Hit_ID=NP_491995.1; Match level="QueryCoverage =99%, HitCoverage=48%, E-value=1e-101, Identity=72%"; Hit description= protein disulfide isomerase (54.9 kD) (pdi-3) [Caenorhabditis elegans] emb|CAB07480.1| Hypothetical prot
  Gene Ontology: Mol. function=phospholipase C activity; Cellular component=mitochondrion; Biological process=protein-nucleus import
  Essential gene: C elegans homolog=H06O01.1; Phenotype=Sma
  Coding regions on vcDNA: vcDNA=SeqID_48253; Strand=+; Position=3-716
RIVKYMRGQAGPSSKELKSISDFDKFVDGDDVSVIGLFEGESKLKDSFHKVADTERDRFFFAHSSNPDLLKKTGYTDDIVVFVSKKLHNKFEPNEFHYDGNYDTDKIKNFLLYETNGLAGIRTQGNLFQFTHRPLVVVYYTVDYLKDPKGSNYWRNRVLKVAQDYKRKVHFAVSDKEEFAQEVEQNGLADRKESDKPLVAAITVDGKYPMNKEFSIENLKQFVEDLXAGKLEPYFKSE

SEQ ID NO: 121831 - protein, 168 aa, Heterodera glycines
  Homolog annotation: Hit_ID=XP_393534.1; Match level="QueryCoverage =100%, HitCoverage=36%, E-value=4e-59, Identity=64%"; Hit description= similar to ENSANGP00000003194 [Apis mellifera]
  Gene Ontology: Mol. function=1-phosphatidylinositol 4-kinase activity; Cellular component=plasma membrane; Biological process =actin filament organization
  Essential gene: C elegans homolog=C56A3.8; Phenotype=Let,Ste
  Coding regions on vcDNA: vcDNA=SeqID_48254; Strand=+; Position=3-506
RKPSGEDFAACLVEAIRAINRGTNPERIPQGSSGSYFVKNLQGEVIGVFKPKNEEPYGSLNPKWVKWAHKLLCPCCFGRSCLVPNQGYLSEAGASLVDQKLGLDIVPRTAIVALAAPTFYYGRIDRTVTNTKEQIARNYPDLGRHFKRIGLPPKRGSFQLFVRGFKDA

SEQ ID NO: 121832 - protein, 228 aa, Heterodera glycines
  Homolog annotation: Hit_ID=NP_505722.1; Match level="QueryCoverage =87%, HitCoverage=43%, E-value=6e-71, Identity=64%"; Hit description =PRO1512 (51.4 kD) (5L81) [Caenorhabditis elegans] emb|CAA97339.1| Hypothetical protein T21C9.12 [Caenorha
  Gene Ontology: Cellular component=mitochondrial inner membrane pre -sequence translocase complex; Biological process=mitochondrial matrix protein import
  Essential gene: C elegans homolog=B0379.4a; Phenotype=Egl
  Coding regions on vcDNA: vcDNA=SeqID_48255; Strand=+; Position=2-685
VSLFLSTDPNPSTGTNTRTKRQLPPLFAACATHFFSWRTFMREPIREKLLPDPVKPPWHQPKITVVMEMRNVLVCPKWEYKKGHYFVKRPALDYFLDMVGYPNFELVIHTSETMMQAAPVVQQLDPKGSRISNALFRECTKTRFIDGTAMKDLSRLNRDLSKVIYIDWDPQAFQLNPENVLRVPKWEGNMDDTTLIDLAELLKTIHLSDIDDVRPTLQFYSQFDNPMQ

SEQ ID NO: 121833 - protein, 138 aa, Heterodera glycines
  Homolog annotation: Hit_ID=CAE58420.1; Match level="QueryCoverage =92%, HitCoverage=46%, E-value=2e-31, Identity=48%"; Hit description =Hypothetical protein CBG01551 [Caenorhabditis briggsae]
  Gene Ontology: Mol. function=ubiquinol-cytochrome c reductase activity; Cellular component=mitochondrion; Biological process =reproduction
  Essential gene: C elegans homolog=F42G8.12; Phenotype=Emb,Ste
  Coding regions on vcDNA: vcDNA=SeqID_48256; Strand=+; Position=77-490
TRFRLVVNQTHNDVQLPNFDAYRNELTKDPPQPSHVTEDRRKGVSSFIFYGVGGAITLMTAKLVVRKAVTYKWMPRDQAAMASTEIDLSLVPLGKTKTFDWSGKPVFVKHRTDKEIERERAVEVGKLLHPERDEDRVL

SEQ ID NO: 121834 - protein, 163 aa, Heterodera glycines
  misc_feature (126)..(126): Xaa can be any naturally occurring amino acid
  misc_feature (130)..(130): Xaa can be any naturally occurring amino acid
  Homolog annotation: Hit_ID=XP_311177.1; Match level="QueryCoverage =99%, HitCoverage=39%, E-value=2e-85, Identity=95%"; Hit description =ENSANGP00000019055 [Anopheles gambiae]
  Gene Ontology: Biological process=reproduction
  Essential gene: C elegans homolog=T04C12.6; Phenotype=Ste
  Coding regions on vcDNA: vcDNA=SeqID_48257; Strand=+; Position=76-564
KHQSQPEKMCDEEVAALVVDNGSGMCKAGFAGDDAPRAVFPSIVGRPRHQGVMVGMGQKDSYVGDEAQSKRGILTLKYPIEHGIVTNWDDMEKIWHHTFYNKLRVAPEEHPVLLTEAPLNPKANRXKMTXIMFETFNTPAMYVAIQAVLSLYASGRTTGLVLD

SEQ ID NO: 121835 - protein, 214 aa, Heterodera glycines
  Homolog annotation: Hit_ID=NP_501751.1; Match level="QueryCoverage =96%, HitCoverage=46%, E-value=8e-75, Identity=63%"; Hit description =fatty acid desaturase (52.3 kD) (fat-4) [Caenorhabditis elegans] emb|CAB61031.1| Hypothetical protein T13
  Gene Ontology: Cellular component=integral to plasma membrane; Biological process=fatty acid desaturation
  Essential gene: C elegans homolog=W08D2.4; Phenotype=Unc
  Coding regions on vcDNA: vcDNA=SeqID_48258; Strand=+; Position=2-643
HVCGIVCGNLMQGFSLGGWKEQHNVHHAAPNVDGRDGDLDLLPLWATIGTQLKRIDGASPLAHLLPFQHLYWSFALPLLRFSWLLQSVQFVCQMRHSFYDIHRQRALVEQCSLALHWSLVLVQLYFLPDNLARLQYFLVSNLFAGFLIAHVVTYNHYSTDKFAYDDPILENFACLQLYTTRNMRPGPFIDWLWGGLNCQIEHHLFPTMPRHNLK

SEQ ID NO: 121836 - protein, 151 aa, Heterodera glycines
  Homolog annotation: Hit_ID=CAE71783.1; Match level="QueryCoverage =97%, HitCoverage=25%, E-value=8e-24, Identity=40%"; Hit description =Hypothetical protein CBG18786 [Caenorhabditis briggsae]
  Gene Ontology: Mol. function=nuclear localization sequence binding; Cellular component=nucleoplasm; Biological process=protein-nucleus import
  Essential gene: C elegans homolog=F26B1.3; Phenotype=Emb
  Coding regions on vcDNA: vcDNA=SeqID_48259; Strand=+; Position=5-457
MCADDSATSAEELVTDGEIGEPTGRLSPEMLSLEDAVEVLQKEQNAERFRLAFESVRRVLSRSKCPPIDKVITLGFPCALVQALHYDDDKVKFEAAWCITNIVSGTSEQTMTMVNAGAVGPLLTLCSSSSLKLSEQARWCIAHMAGDGVQL

SEQ ID NO: 121837 - protein, 250 aa, Heterodera glycines
  Homolog annotation: Hit_ID=AAA92672.1; Match level="QueryCoverage =90%, HitCoverage=48%, E-value=3e-73, Identity=57%"; Hit description =HMG CoA synthase
  Gene Ontology: Mol. function=hydroxymethylglutaryl-CoA synthase activity; Cellular component=endoplasmic reticulum; Biological process=ergosterol biosynthesis
  Essential gene: C elegans homolog=F25B4.6; Phenotype=Emb,Lva,Lvl,Unc
  Coding regions on vcDNA: vcDNA=SeqID_48260; Strand=+; Position=1-750
PTVNGNGFGLTNGTHFADDFSESIKDVGIIGIELYFPKSYANQEDLEKFDNVTSNKYVLGLGQQEMCFCHENEDVCSLSLTVTAALMDNYKVNPKDIGFLAVGTETLVDKSKSVKSVLMDLFADSGNMDLEGADEKNACFGGTQALFHAVDWMYANYATEKRLAIVVCADVAVYSAGPARCTGGAGAVAFLIGPNAPIALERGLRACHSQNVYDFYKPIVGVSTQFPRVDGPNSVETYLNAVDMCYGRFC

SEQ ID NO: 121838 - protein, 207 aa, Heterodera glycines
  Homolog annotation: Hit_ID=AAF81283.1; Match level="QueryCoverage =100%, HitCoverage=99%, E-value=2e-38, Identity=42%"; Hit description= glutathione S-transferase [Haemonchus contortus]
  Gene Ontology: Mol. function=glutathione transferase activity; Biological process=glutathione conjugation reaction
  Essential gene: C elegans homolog=R05F9.5a; Phenotype=Unclassified
  Coding regions on vcDNA: vcDNA=SeqID_48261; Strand=+; Position=17-640
MVQYKLYYFDGRGLGESIRLLLHYVGQPFEDIRIKDMEEWEKTYKPKFFYGKVPVLEVDGKPLGQSATILRYLAEKFGLAGKDECEKAKANEIIDFQKDANTDLAPYLYVKMGSRQGDLDKLRAEVFEPGVKHILPLFEKLLKESGSGYMLKSGLSMVDFQVANFLYTFTKLEPETINAFPELIKYVDRVHALPQLQQYLKQRPQDR

SEQ ID NO: 121839 - protein, 112 aa, Heterodera glycines
  Homolog annotation: Hit_ID=NP_501322.1; Match level="QueryCoverage =90%, HitCoverage=37%, E-value=2e-46, Identity=85%"; Hit description =ribosomal Protein, Small subunit (29.0 kD) (rps-2) [Caenorhabditis elegans] gb|AAF99899.1| Ribosomal prot
  Gene Ontology: Mol. function=structural constituent of ribosome; Cellular component=cytosolic small ribosomal subunit (sensu Eukarya); Biological process=protein biosynthesis
  Essential gene: C elegans homolog=C49H3.11; Phenotype=Emb,Lva,Ste
  Coding regions on vcDNA: vcDNA=SeqID_48262; Strand=+; Position=2-340
SVRRGYWGNKIGKPHTVPCKVTGKCASVLVRLIPAPRGTGIVGAPVPKKLLQMAGIDDCYTSAVGQTATLGNFAKATYYAIQRTYSYLTPDLWKENELPRNPLDHIGGGGAQ

SEQ ID NO: 121840 - protein, 237 aa, Heterodera glycines
  misc_feature (42)..(42): Xaa can be any naturally occurring amino acid
  misc_feature (190)..(190): Xaa can be any naturally occurring amino acid
  misc_feature (202)..(202): Xaa can be any naturally occurring amino acid
  Homolog annotation: Hit_ID=CAE71286.1; Match level="QueryCoverage =97%, HitCoverage=63%, E-value=7e-97, Identity=69%"; Hit description =Hypothetical protein CBG18174 [Caenorhabditis briggsae]
  Gene Ontology: Mol. function=actin binding; Cellular component=Arp2/3 protein complex; Biological process=embryogenesis and morphogenesis
  Essential gene: C elegans homolog=Y79H2A.6; Phenotype=Emb
  Coding regions on vcDNA: vcDNA=SeqID_48263; Strand=+; Position=14-724
MVSAQSDSPVPNWLLNIGPISCHAWNKDKTQLAVSPSNNEIXIFARSETVWNPLHVLREHDLLITGLDWAPNTNRIVSCSHDKNAFVWTWEAEKNSWKPEMVVVRINRAATCVKWSPNENKFAVGTGARLVAICYYERENDWWVAKQIKKLIRSTVTSLNWHPNNILLAVGACDFKTRVFSAYVKEIDEXPTPNPWGTKMPXGELLKEYQSTGWVHDLAFSPSGCKLAWVSHDSSIA

SEQ ID NO: 121841 - protein, 189 aa, Heterodera glycines
  misc_feature (169)..(169): Xaa can be any naturally occurring amino acid
  misc_feature (176)..(176): Xaa can be any naturally occurring amino acid
  Homolog annotation: Hit_ID=NP_499433.1; Match level="QueryCoverage =85%, HitCoverage=46%, E-value=1e-10, Identity=29%"; Hit description =putative protein of bilaterial origin (3M213) [Caenorhabditis elegans] emb|CAA21654.1| Hypothetical prote
  Essential gene: C elegans homolog=Y48A6C.4; Phenotype=Lva
  Coding regions on vcDNA: vcDNA=SeqID_48264; Strand=+; Position=275-841
SARGSDQFPFRPFCGFVLTGISDVRSSVRSLCFDILSLLLRKYVQLCRKNREIFDAFLQLMEGQRKPENRTKLLDSLSQFVTVFGDEANSNNKLWPERTLDISFENGEATIRSPSLSLLPSPAYFHFPVLCPSNDGTTSDGTSPLMTRDGLLNCCKVLCPLLEAVIRAXEDADGTXFSSTWAELTMSSL

SEQ ID NO: 121842 - protein, 169 aa, Heterodera glycines
  misc_feature (50)..(50): Xaa can be any naturally occurring amino acid
  misc_feature (58)..(58): Xaa can be any naturally occurring amino acid
  misc_feature (105)..(105): Xaa can be any naturally occurring amino acid
  Homolog annotation: Hit_ID=NP_509323.1; Match level="QueryCoverage =80%, HitCoverage=28%, E-value=4e-19, Identity=37%"; Hit description =translation Elongation FacTor (50.7 kD) (eft-4) [Caenorhabditis elegans] ref|NP_498520.1| translation Elo
  Gene Ontology: Mol. function=translation factor activity, nucleic acid binding
  Essential gene: C elegans homolog=R03G5.1a; Phenotype=Emb,Lva,Unc
  Coding regions on vcDNA: vcDNA=SeqID_48265; Strand=+; Position=64-574
TGHNHHRPLLGILWGEHSSFPSCSTMDTTEPAFFEDLYTDRDELNCDNFXRNMGYNPXTVSFFPVSGFNGHYMLLPADRMPGLSGWAIHHQHRTAYATTLVQCSXPSLIPQMHQLHNPLRQPVQDAYEIGGTVTAPIWPFPTLVYLDIYQWPATSRSSHVFARPHTLRH

SEQ ID NO: 121843 - protein, 88 aa, Heterodera glycines
  Homolog annotation: Hit_ID=NP_495815.1; Match level="QueryCoverage =98%, HitCoverage=12%, E-value=1e-09, Identity=37%"; Hit description =krr1 (87.1 kD) (2I871) [Caenorhabditis elegans] emb|CAA90257.1| Hypothetical protein F54C9.9 [Caenorhabdi
  Essential gene: C elegans homolog=F54C9.9; Phenotype=Unclassified
  Coding regions on vcDNA: vcDNA=SeqID_48266; Strand=+; Position=29-292
MNTDDRRLNAWAPIKKLNQYQSEEEEHKQLMFFQRKSQHIEKKRKLLEEIDFALPKKAQKSKAKTEEQKAKREEATESKDKKKKKKKE

SEQ ID NO: 121844 - protein, 216 aa, Heterodera glycines
  Homolog annotation: Hit_ID=XP_342398.1; Match level="QueryCoverage =98%, HitCoverage=58%, E-value=5e-94, Identity=51%"; Hit description =similar to hypothetical protein [Rattus norvegicus]
  Gene Ontology: Mol. function=histone-lysine N-methyltransferase activity; Cellular component=nuclear chromatin; Biological process =establishment and/or maintenance of chromatin architecture
  Essential gene: C elegans homolog=C14B1.4; Phenotype=Stp
  Coding regions on vcDNA: vcDNA=SeqID_48267; Strand=+; Position=2-649
RDCLCKFSADGQWLASASADKTVKIWSTVDGKLEKTIQGHKLGISDVCWSYDNRMIVSCSDDKTLKLFDVQQGKTLKTFRGHQNYVFCCNFNPQSTLLVSGSFDETVRIWDIRNGNCVRTLPAHSDPVSAVAFNRDGSLIATSSYDGLVRIWETSSGQCMTTLVDNENPPVSFVKFSPNGKYILAATMDSQLKLWDFNKGKPLKSYQGHVNKKYCI

SEQ ID NO: 121845 - protein, 208 aa, Heterodera glycines
  misc_feature (190)..(190): Xaa can be any naturally occurring amino acid
  misc_feature (202)..(202): Xaa can be any naturally occurring amino acid
  Homolog annotation: Hit_ID=AAL78224.1; Match level="QueryCoverage =87%, HitCoverage=83%, E-value=7e-99, Identity=99%"; Hit description =hypothetical protein Hgg-30 [Heterodera glycines]
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_48268; Strand=+; Position=56-678
MTAEVQGFGFVAYKDHESAARAVEKMNEVSVPGSEKVEQKFTVCRAQKKSERQAELKRRYEQYKAERIQRYQGVNLYVKNLHDTINDETLRSNFESYGNITSAKVMCDEHGRSKGFGFVCFEKADEATKAVVEMNNKIIENKPLYVALAQRKEDRKAQLASQYMQRLAAMRMQNPAGLMGTMYAPASGGXFLPQAIQNQRAXAVHANT

SEQ ID NO: 121846 - protein, 264 aa, Heterodera glycines
  misc_feature (119)..(119): Xaa can be any naturally occurring amino acid
  misc_feature (233)..(233): Xaa can be any naturally occurring amino acid
  misc_feature (240)..(240): Xaa can be any naturally occurring amino acid
  misc_feature (254)..(254): Xaa can be any naturally occurring amino acid
  Homolog annotation: Hit_ID=CAE61909.1; Match level="QueryCoverage =98%, HitCoverage=29%, E-value=2e-33, Identity=32%"; Hit description =Hypothetical protein CBG05905 [Caenorhabditis briggsae]
  Gene Ontology: Mol. function=aminopeptidase activity; Cellular component=cytosol
  Essential gene: C elegans homolog=F49E8.3; Phenotype=Emb
  Coding regions on vcDNA: vcDNA=SeqID_48269; Strand=+; Position=1-793
CLPEEEDYFVWSAIDPGIGSIAHSLKHLDDERKLLDRFERFVCKMIEPVAAKLGWEPKEGETIHVGRLRALLLSRLSHFRHQPTIQMALSKFNALIEKGVDVVPDLRKLIFRAVGSTNXKKIIAALKNLMETSGYAQVELSCVLGLGQCSDLKMLEDIFNYGVIQGKIRDQDLYLLFAATEMAPMACCGHFAWDFFKNNFALLIEKYGSVNSNVFLHCFDCVTSGFCSNAMAXTFMEFFXKELDEHSLKTLERXLRQAVESIKV

SEQ ID NO: 121847 - protein, 88 aa, Heterodera glycines; identical to SEQ ID NO: 121843
  Homolog annotation: Hit_ID=NP_495815.1; Match level="QueryCoverage =98%, HitCoverage=12%, E-value=1e-09, Identity=37%"; Hit description =krr1 (87.1 kD) (2I871) [Caenorhabditis elegans] emb|CAA90257.1| Hypothetical protein F54C9.9 [Caenorhabdi
  Essential gene: C elegans homolog=F54C9.9; Phenotype=Unclassified
  Coding regions on vcDNA: vcDNA=SeqID_48270; Strand=+; Position=29-292

SEQ ID NO: 121848 - protein, 277 aa, Heterodera glycines
  misc_feature (242)..(242): Xaa can be any naturally occurring amino acid
  Homolog annotation: Hit_ID=NP_506514.1; Match level="QueryCoverage =75%, HitCoverage=19%, E-value=1e-12, Identity=24%"; Hit description =putative protein of bilaterial origin (131.1 kD) (5O671) [Caenorhabditis elegans] emb|CAB00882.1| Hypothe
  Gene Ontology: Biological process=embryogenesis and morphogenesis
  Essential gene: C elegans homolog=ZC376.6; Phenotype=Emb
  Coding regions on vcDNA: vcDNA=SeqID_48271; Strand=+; Position=1-831
PFALCCVEHAPSFAGTDHFDAFRSAHQKGAFASSPRRPLLISIDECSVALEEASISHNFSRLSKSLDILLGRATVEQQFCYYELILKAMSLSLDGKWPRALVDKLQLAWERFDSVIPRRLHEDSVRLWLSSANAAKISGLDQRDNSFLIAHTPLVLFRVDSRIFRSPPHLRCLCRSLSFYLAASRDMNTLQLVRSSLNSSKSEIEEKEALLRSFGGTQRLAVVQTYIELCDDEDGTEIDDIXEIRQNLCSQIHQLFIADTHLPSSSISICIPSGLSL

SEQ ID NO: 121849 - protein, 242 aa, Heterodera glycines
  Homolog annotation: Hit_ID=NP_497728.1; Match level="QueryCoverage =100%, HitCoverage=53%, E-value=1e-135, Identity=97%"; Hit description=BENzimidazole resistant BEN-1, beta-tubulin, Tubulin, Beta (ben-1) [Caenorhabditis elegans] pir||T20194
  Gene Ontology: Mol. function=MHC class I protein binding; Cellular component=tubulin; Biological process=embryogenesis and morphogenesis
  Essential gene: C elegans homolog=K01G5.7; Phenotype=Emb
  Coding regions on vcDNA: vcDNA=SeqID_48272; Strand=+; Position=1-726
FRPDNFLFGQSGAGNNWAKGHYTEGAELVDNVLDVVRKEAEGCDCLQGFQLTHSLGGGTGSGMGTLLISKIREEYPDRIMSSFSVVPSPKVSDTVVEPYNATLSVHQLVENTDETFCIDNEALYDICFRTLKLQNPTYGDLNHLVSVTMSGVTTCLRFPGQLNADLRKLAVNMVPFPRLHFFMPGFAPLSAKGAAAYQALSVSELTKQMFDAKNMMAACDPRHGRYLTVAAMFRGRMSMREV

SEQ ID NO: 121850 - protein, 102 aa, Heterodera glycines
  Homolog annotation: Hit_ID=P53021; Match level="QueryCoverage=99%, HitCoverage=80%, E-value=1e-47, Identity=86%"; Hit description=Major sperm protein 1 gb|AAA29146.1| major sperm protein
  Essential gene: C elegans homolog=C04G2.4; Phenotype=Unclassified
  Coding regions on vcDNA: vcDNA=SeqID_48273; Strand=+; Position=54-359
MAQLPPEDVATMPTHNVVFNAPFYNKATYYMRVINPGTKRIGYAFKTTKPKRINMNPPNGVLGPKESVNVAVSCDAFDPGSDDTNGDRVTVEWTNTPDPFAT

SEQ ID NO: 121851 - protein, 167 aa, Heterodera glycines
  misc_feature (40)..(40): Xaa can be any naturally occurring amino acid
  misc_feature (128)..(128): Xaa can be any naturally occurring amino acid
  Homolog annotation: Hit_ID=NP_495707.1; Match level="QueryCoverage =99%, HitCoverage=77%, E-value=1e-70, Identity=75%"; Hit description =ribosomal Protein, Large subunit (24.7 kD) (rpl-10) [Caenorhabditis elegans] emb|CAA88308.1| Hypothetical
  Gene Ontology: Mol. function=structural constituent of ribosome; Cellular component=cytosolic large ribosomal subunit (sensu Eukarya); Biological process=protein biosynthesis
  Essential gene: C elegans homolog=F10B5.1; Phenotype=Lva,Ste
  Coding regions on vcDNA: vcDNA=SeqID_48274; Strand=+; Position=3-506
CCVHMISNEREHLSSEALEAARICANKYMVKNCGKDGFTXRVRIHPFHVVRINKMLFCAGADRLQTGMRGAFGKPQGLVARVGIGDMLMSVRVRDQHQAHALEAFRRAKFKFPGRQYIVISRKWGFTXFDREVYEKHRKEGRVIPDGVNCRFLKQHGPLTEWLKNPI

SEQ ID NO: 121852 - protein, 258 aa, Heterodera glycines
  misc_feature (18)..(18): Xaa can be any naturally occurring amino acid
  Homolog annotation: Hit_ID=NP_502137.1; Match level="QueryCoverage =99%, HitCoverage=23%, E-value=4e-46, Identity=39%"; Hit description =SNF2 related domain and helicase, C-terminal family member (122.5 kD) (4M98) [Caenorhabditis elegans] emb
  Gene Ontology: Mol. function=DNA dependent ATPase activity; Cellular component=transcription elongation factor complex; Biological process=transcription termination
  Essential gene: C elegans homolog=F54E12.2; Phenotype=Emb
  Coding regions on vcDNA: vcDNA=SeqID_48275; Strand=+; Position=2-774
LLRFGGRPRWCLTGTPIXNKLWDLFSLIRFLRISPFSEEKMWKEFIMTSSGTSAQRLNVIVKSILLRRTKNQICTETNRPIVDLQPKKYELVTLELQKLEQHCYSILFEASKQKVRELLRDGAFGGCGTLRRFKPGAKIKNPFIGGGARMAVDANFKAYSCILSLLLRLRQACVHLSLTRNAIDIDAFKQDEGETDSDAENLVAKALEMSMAQMGLEEEALERNKEREKGRRQQIERLFEKEHQSTKVNALMNRLDGV

SEQ ID NO: 121853 - protein, 234 aa, Heterodera glycines
  misc_feature (11)..(11): Xaa can be any naturally occurring amino acid
  Homolog annotation: Hit_ID=CAA70694.1; Match level="QueryCoverage =98%, HitCoverage=66%, E-value=1e-129, Identity=97%"; Hit description= cathepsin S-like cysteine proteinase [Heterodera glycines]
  Gene Ontology: Mol. function=cathepsin S activity; Cellular component= extracellular space; Biological process=proteolysis and peptidolysis
  Essential gene: C elegans homolog=T03E6.7; Phenotype=Emb,Gro,Unc
  Coding regions on vcDNA: vcDNA=SeqID_48276; Strand=+; Position=1-701
YCGKAERMNEXIKAKKFIDAHNLAFEKGEVSFKVAPNHLMHFTPAQYNRIRGLQMRSNRQRHNMATLAGNSSTLPEKLDWREKGAVTEGDCGSCWAFSATGAIEGALAQKKASKIISLSEQNLVDCSSKYGNEGCDGGLMDSAFEYVRDNNGLDTEESYPYEAVTGKCQFKNETVGGTVVSFKDLKEGDEEQLKIAVATIGPISVALDASNLSFQFYKTGVYYERWCSNRYLDH

SEQ ID NO: 121854 - protein, 218 aa, Heterodera glycines
  Homolog annotation: Hit_ID=XP_392810.1; Match level="QueryCoverage =67%, HitCoverage=24%, E-value=5e-11, Identity=30%"; Hit description =similar to ENSANGP00000005617 [Apis mellifera]
  Gene Ontology: Mol. function=death receptor interacting protein activity; Biological process=induction of apoptosis
  Essential gene: C elegans homolog=F35D6.1a; Phenotype=Stp
  Coding regions on vcDNA: vcDNA=SeqID_48277; Strand=+; Position=58-711
MGNVFGSSVAAADEEDNFEERTRQFFAFVNQGNIGQLRALVDSLDADELSIWLQMNQPDVQHARPALVNAILNRRTETAVFLLEKGADPHQTMIGQLNGLNMNVTPLWAAVVFVNLELCRALIAHGANIEMGTDSGESPLLCACFNGNLEIATFLVENGANVNLADTDGMTPLIATTFLLRLTSPTILSDLNINSSNSGTLCLDVFAEEMILMGQMRR

SEQ ID NO: 121855 - protein, 214 aa, Heterodera glycines
  misc_feature (6)..(6): Xaa can be any naturally occurring amino acid
  Homolog annotation: Hit_ID=NP_741088.1; Match level="QueryCoverage =99%, HitCoverage=70%, E-value=2e-82, Identity=69%"; Hit description =actin related protein 2 3 complex 34kDa (34.5 kD) (3B481) [Caenorhabditis elegans] gb|AAL32261.1| Hypothe
  Gene Ontology: Mol. function=structural constituent of cytoskeleton; Cellular component=Arp2/3 protein complex; Biological process=cell motility
  Essential gene: C elegans homolog=Y6D11A.2; Phenotype=Emb
  Coding regions on vcDNA: vcDNA=SeqID_48278; Strand=+; Position=15-655
MIILEXNNRVIAELLEMKFTNARTNSKFDTVDVVFADFDGILYHASNPDGGDKSKLMLSISLKFYKELQEHGADELIRSIYGKFLSESPEAGYSVSLVYDVADIPENFTALVEQASYLKRNCFASVFEKYFQFQESGQEGEKRAVIHYREDETLFIEAKSDRVTVIFSTLFKDPDDVVIGKVFLQEFREGRRASQTAPQVLYSVGEPPLELRNN

SEQ ID NO: 121856 - protein, 232 aa, Heterodera glycines
  misc_feature (197)..(197): Xaa can be any naturally occurring amino acid
  misc_feature (213)..(213): Xaa can be any naturally occurring amino acid
  Homolog annotation: Hit_ID=AAR09171.1; Match level="QueryCoverage =95%, HitCoverage=60%, E-value=1e-115, Identity=94%"; Hit description= aldolase [Heterodera glycines]
  Gene Ontology: Mol. function=fructose-bisphosphate aldolase activity; Biological process=fructose metabolism
  Essential gene: C elegans homolog=F01F1.12a; Phenotype=Gro,Unc
  Coding regions on vcDNA: vcDNA=SeqID_48279; Strand=+; Position=2-698
CDFANWRSVLNIGAHKPSHLALMENANVLARYASICQQNGLVPIVEPEVLCDGDHSLERCQKVTELTLAYTYKALANHHIYLEGTLLKPNMVTPGQSHSPKATPDQIGLATVTALRRSVPIAVPGIVFLSGGQSEIEATHNFNAINSVPGPKPWTLSFSYGRALPSSVIKKWNGKDDNLGDAHKVLLDRANANGDAXNGKSTGEEAAASAAEXSLFVANHALLKQNCGICHE

SEQ ID NO: 121857 - protein, 94 aa, Heterodera glycines
  Homolog annotation: Hit_ID=AAL40720.1; Match level="QueryCoverage =89%, HitCoverage=20%, E-value=5e-32, Identity=72%"; Hit description =calreticulin [Meloidogyne incognita]
  Gene Ontology: Mol. function=calcium ion storage activity; Cellular component=endoplasmic reticulum lumen; Biological process=central nervous system development
  Essential gene: C elegans homolog=Y38A10A.5; Phenotype=Unc
  Coding regions on vcDNA: vcDNA=SeqID_48280; Strand=-; Position=1-282
DDDLYLRKDWGAIGIDIWQVKSGTIFDNILVADSVEDAKKHAADTFDQLKEAEKKQKEAHDEEERKKFEEEEKKRKKKKKKKKKKSTLVVPPLH

SEQ ID NO: 121858 - protein, 239 aa, Heterodera glycines
  misc_feature (185)..(185): Xaa can be any naturally occurring amino acid
  Homolog annotation: Hit_ID=CAE62748.1; Match level="QueryCoverage =86%, HitCoverage=68%, E-value=4e-39, Identity=46%"; Hit description =Hypothetical protein CBG06912 [Caenorhabditis briggsae]
  Gene Ontology: Mol. function=SNAP receptor activity; Cellular component=plasma membrane; Biological process=nonselective vesicle targeting
  Essential gene: C elegans homolog=K02D10.5; Phenotype=Ste
  Coding regions on vcDNA: vcDNA=SeqID_48281; Strand=+; Position=1-717
QRKRLWRTLLMTTVTNSFAKSGPAVELNRQKFTTPAASQNIEDQIAADEKAIERYLQASLDSTQRSRQQLSSSEGLAESTARELLEQREKLERAEQNLDTIHHTTQHTQRSLNSLKSWFGGLVRNKLSRAPKGLGTANANANNQQQQLEQTVQQQHQQRPLHAHLVQSSADEFAGAIGGGGGGVXPPQQHSLNSSSRAYIQGTRWEAMDDKIDNNLDLMSAHLGRLRTFGVALGDEVQD

SEQ ID NO: 121859 - protein, 111 aa, Heterodera glycines
  misc_feature (33)..(33): Xaa can be any naturally occurring amino acid
  misc_feature (82)..(82): Xaa can be any naturally occurring amino acid
  Homolog annotation: Hit_ID=CAA82999.1; Match level="QueryCoverage =94%, HitCoverage=68%, E-value=1e-18, Identity=50%"; Hit description =ribosomal protein S19S [Ascaris suum] pir||A54581 ribosomal protein S19.e - pig roundworm sp|P39698|R19S_A
  Gene Ontology: Mol. function=structural constituent of ribosome; Cellular component=eukaryotic 48S initiation complex; Biological process=hemocyte development
  Essential gene: C elegans homolog=T05F1.3; Phenotype=Emb,Lva
  Coding regions on vcDNA: vcDNA=SeqID_48282; Strand=+; Position=23-358
VNWGKNKELTPINPDRYCVARGTPSARRYVHLXSPASVGPFPNVSGGKNRHGVTPIHFTMASGAVILKALQSIDEIKWVEKXDALVDCKLTEQGQKDLDRIASHLPDRAEQ

SEQ ID NO: 121860 - protein, 182 aa, Heterodera glycines
  Essential gene: C elegans homolog=C28C12.10; Phenotype=Ste
  Coding regions on vcDNA: vcDNA=SeqID_48283; Strand=+; Position=93-638
MRGKAIFKKSFIASGIPSEFGKYRPLPSDRKCSRKGCASDPPPATHCQPGHSSENGTVQPTKTSSLISSKNGCAEAEEEQCLFVEHFGPIPQYSETDEKENLRLRKLHEVALEIYQKQRAYVMKLQLIGLNYPRHLNDCEKRMNKKLLHSKHVIRRIADHFQTILNVHLTFLHNFYDKILKW

SEQ ID NO: 121861 - protein, 52 aa, Heterodera glycines
  misc_feature (17)..(17): Xaa can be any naturally occurring amino acid
  Homolog annotation: Hit_ID=A45618; Match level="QueryCoverage=100%, HitCoverage=11%, E-value=4e-19, Identity=76%"; Hit description =translation elongation factor eEF-1 alpha chain - nematode (Onchocerca volvulus) sp|P27592|EF1A_ONCVO ELONGAT
  Gene Ontology: Mol. function=translation factor activity, nucleic acid binding
  Essential gene: C elegans homolog=R03G5.1a; Phenotype=Emb,Lva,Unc
  Coding regions on vcDNA: vcDNA=SeqID_48284; Strand=+; Position=1-157
VMTEVSNFINKIGYTPXTVPFVPISGFNGDNMLEPSDRMPWFKGWAIERKDG

SEQ ID NO: 121862 - protein, 194 aa, Heterodera glycines
  Homolog annotation: Hit_ID=NP_493258.1; Match level="QueryCoverage =68%, HitCoverage=100%, E-value=6e-41, Identity=60%"; Hit description= profilin (14.3 kD) (pfn-1) [Caenorhabditis elegans] emb|CAA22318.1| Hypothetical protein Y18D10A.20 [Cae
  Gene Ontology: Cellular component=actin filament; Biological process =cytokinesis
  Essential gene: C elegans homolog=Y18D10A.20; Phenotype=Emb,Stp,Unc
  Coding regions on vcDNA: vcDNA=SeqID_48285; Strand=+; Position=44-628
MSGWDAYIQSLTSSCAEITRVAIIGNSDASVWARTEGENEFKASEPELKKLVGQFDDLSQVPSVGADLEGIHYIVPRTDENLIFGKRDKTGFFAVKTKSAILIAIYKDEESVVGADVRGAVEKMAKYLEDAGYRAVARFPKRLLCCQTKSAENGFDLFFQMHSFSIPNDHLLFYYYTFCEVRVPISFLLFDLWM

SEQ ID NO: 121863 - protein, 158 aa, Heterodera glycines
  Homolog annotation: Hit_ID=AAR85527.1; Match level="QueryCoverage =96%, HitCoverage=60%, E-value=2e-78, Identity=94%"; Hit description =14-3-3b protein [Meloidogyne incognita]
  Gene Ontology: Mol. function=protein kinase C inhibitor activity; Cellular component=cytoplasm; Biological process=protein targeting
  Essential gene: C elegans homolog=M117.2; Phenotype=Emb
  Coding regions on vcDNA: vcDNA=SeqID_48286; Strand=+; Position=2-475
TCCRLPQKVVGARRSSWRVISSIEQKTEGSEKKQQMAKEYREKVEQELPEICHDVLDLLDKYLIPKAGNPESKVFYLKMKGDYYRYLAEVATGDDRNAVVEKSQQSYQETFDIAKDKMQPTHPIRLGLALNFSVFYYEILNSPDKACQLAKQAFDDAI

SEQ ID NO: 121864 - protein, 225 aa, Heterodera glycines
  Homolog annotation: Hit_ID=NP_493569.1; Match level="QueryCoverage =93%, HitCoverage=66%, E-value=1e-46, Identity=45%"; Hit description =metaxin 1 (1P348) [Caenorhabditis elegans] emb|CAB07391.1| Hypothetical protein F39B2.11 [Caenorhabditis
  Gene Ontology: Cellular component=integral to membrane
  Essential gene: C elegans homolog=F39B2.11; Phenotype=Ste
  Coding regions on vcDNA: vcDNA=SeqID_48287; Strand=+; Position=3-677
EFLRTVEGRRVGQHLVPSQLCEFEAYNCLLKQKLLPALNHLFWVDKCNYGTIVHPLYAQQVTFPYNIYYMERRRRRMDTTVRAIRKNQQQLTLDAIQALNLLSAKLSDNKYFCGDKPCSIDALVFGCLAPLLRTPLPNDRLQLHLSATPNLVRFVDSILSIYLPLPEKVIKEQAMARKKWQKLKMDAQQTMEEGRIERELRKAEKKERNSMHHILFFAISSITIS

SEQ ID NO: 121865 - protein, 218 aa, Heterodera glycines
  misc_feature (136)..(136): Xaa can be any naturally occurring amino acid
  Homolog annotation: Hit_ID=CAE71388.1; Match level="QueryCoverage =92%, HitCoverage=49%, E-value=2e-32, Identity=37%"; Hit description =Hypothetical protein CBG18295 [Caenorhabditis briggsae]
  Essential gene: C elegans homolog=C44B9.2; Phenotype=Gro
  Coding regions on vcDNA: vcDNA=SeqID_48288; Strand=+; Position=2-657
WWSAGTICGLSSQKCVKSGILHPFGHILQDGDKIGCHFQPQNDPITLAKMAVVGTPGVIFSMSHLKDAFLVSSRGTSALPMDRFQFPTLRYDFTMRQFYSSAQMGSEFLFACNNIVQRARYDEKEGMLFTLNINGXLIRQRLNGDVEIFCRPRQIICSPELSTVHLRTANVEMEVQTDKKAYVKYGSKRVHVSRSGMVVSNENCSASMDHIGRIVSAS

SEQ ID NO: 121866 - protein, 195 aa, Heterodera glycines
  Homolog annotation: Hit_ID=NP_497656.1; Match level="QueryCoverage =100%, HitCoverage=26%, E-value=1e-30, Identity=37%"; Hit description= FtsJ homolog 3 (3E173) [Caenorhabditis elegans] gb|AAF39869.1| Hypothetical protein H06I04.3b [Caenorhab
  Gene Ontology: Biological process=rRNA processing
  Essential gene: C elegans homolog=H06I04.3a; Phenotype=Lva
  Coding regions on vcDNA: vcDNA=SeqID_48289; Strand=+; Position=3-590
SGLGATEFVTSKNALQLLSRASELVLDSERVLNSEHTTNEIKECLKDIKVCGPAELRSILKWRKKLVDEQKKEEKASKESVKSAEEMVEGDTGEELEENTEFKELEEIDDLIRTAKAEEKATLKKRKRKLLKAKRNLEERKKLKMVHEGDEPTIGEDLELFSLKTVKRLSERAAKAVKGIKEEEEEKESNDEDDK

SEQ ID NO: 121867 - protein, 240 aa, Heterodera glycines
  misc_feature (23)..(23): Xaa can be any naturally occurring amino acid
  Homolog annotation: Hit_ID=NP_491654.1; Match level="QueryCoverage =96%, HitCoverage=36%, E-value=6e-58, Identity=50%"; Hit description =CBF1 interacting corepressor (65.8 kD) (1G222) [Caenorhabditis elegans] gb|AAB37808.1| Hypothetical prote
  Gene Ontology: Biological process=growth
  Essential gene: C elegans homolog=F55F8.4; Phenotype=Emb
  Coding regions on vcDNA: vcDNA=SeqID_48290; Strand=+; Position=17-738
MIRSRNSHNKALLGDEKARLGLXFMYDAPAGINKKKEEGPEPKFEWQRKYNAPREEWAKGNELIQDQPFGIQVRNVRCVKCRAWGHLNTDRECPLYGMSGNAEDHGYANNPSDIIRDLNVEKKTKTVSDVTTNEQIDIKPKIEVRKSHEEKKKKRRHYSSEEEEEGTEEEEKKPEPIDQEQLLVNMREEHNLKFKTGILIGLRADEHIKKMSAMVGGGRGKTEAFLKDWMRKTKKLMKKS

SEQ ID NO: 121868 - protein, 224 aa, Heterodera glycines
  Homolog annotation: Hit_ID=CAE58622.1; Match level="QueryCoverage =83%, HitCoverage=43%, E-value=2e-53, Identity=50%"; Hit description =Hypothetical protein CBG01790 [Caenorhabditis briggsae]
  Gene Ontology: Biological process=embryogenesis and morphogenesis
  Essential gene: C elegans homolog=W02A2.1; Phenotype=Emb
  Coding regions on vcDNA: vcDNA=SeqID_48291; Strand=+; Position=42-713
MSPPCSFSPSSASSSSDSPSAEGQAQQNGQVLAPRPLPTWEEIRAAVPKECFEKSLLRSLYYLAIDLLVIGFLYAVVPFVETNFGLIGLFFWYCLLGMFLSSLFCVGHDCGHGTFSDWTWVNDIFGHISHALLMVPFWPWQKSHRQHHQFTSHVDKDKGHPWVLEDDYEGGGWLRKHFAKIPLSGLISLAPKKLAQIGVKHLPVRGTEAGHIRWNPIYTVAGLP

SEQ ID NO: 121869 - protein, 196 aa, Heterodera glycines
  Homolog annotation: Hit_ID=NP_510260.1; Match level="QueryCoverage =95%, HitCoverage=22%, E-value=8e-20, Identity=39%"; Hit description =PolyA Binding protein (76.0 kD) (pab-2) [Caenorhabditis elegans] emb|CAA90444.1| Hypothetical protein F18
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_48292; Strand=+; Position=3-593
AGGGQFGGANQIARGGPRSGGGGGMRQYGGQPRQQQNRMPGMGGGHQQQGMRYQGQPRGMQQQQQAQQPQIAYSSYPQQQSRGGIAPQMGGGASGGGANAGHVITSSTHQEPLNTQLLTEANITAQKQMLGERLYAMVARCFRDGDVEKIGKITGMLLEMENAEIVLLLGDEEMLRLRVDEAATVLYQATGQKEAQ

SEQ ID NO: 121870 - protein, 108 aa, Heterodera glycines
  misc_feature (23)..(23): Xaa can be any naturally occurring amino acid
  misc_feature (62)..(62): Xaa can be any naturally occurring amino acid
  Homolog annotation: Hit_ID=NP_501727.1; Match level="QueryCoverage =100%, HitCoverage=34%, E-value=1e-35, Identity=70%"; Hit description= adenine nucleotide family member (4K472) [Caenorhabditis elegans] emb|CAA92472.1| Hypothetical protein K
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_48293; Strand=+; Position=2-327
DLPSGGSAAALSKSAVAPIERVXMLLQVQDASIHITADKRYIGIIDVLVRVPKEQGFLSLWXGYLTNVIRYFPTQALYFAFNDTYKRFFTLGVDNVNQFLMFFLMNLA

SEQ ID NO: 121871 - protein, 76 aa, Heterodera glycines
  misc_feature (29)..(29): Xaa can be any naturally occurring amino acid
  Homolog annotation: Hit_ID=AAQ89579.1; Match level="QueryCoverage =100%, HitCoverage=11%, E-value=5e-36, Identity=97%"; Hit description= heat shock protein 70-C [Heterodera glycines] gb|AAM93256.1| heat shock protein 70-C [Heterodera glycines
  Gene Ontology: Mol. function=Hsp70/Hsp90 organizing protein activity; Cellular component=endoplasmic reticulum lumen; Biological process =reproduction
  Essential gene: C elegans homolog=C15H9.6; Phenotype=Dpy,Lva
  Coding regions on vcDNA: vcDNA=SeqID_48294; Strand=+; Position=3-232
EKLGGKLRAEDKTTIEGAVDEAISWLDSXKDAPPEELKERKKDLEAKVQPIISKLYAGQSPPPGSEPPPTEEKDEL

SEQ ID NO: 121872 - protein, 252 aa, Heterodera glycines
  misc_feature (20)..(20): Xaa can be any naturally occurring amino acid
  Homolog annotation: Hit_ID=CAE75506.1; Match level="QueryCoverage =96%, HitCoverage=52%, E-value=4e-62, Identity=51%"; Hit description =Hypothetical protein CBG23516 [Caenorhabditis briggsae]
  Gene Ontology: Cellular component=extracellular space; Biological process=embryogenesis and morphogenesis
  Essential gene: C elegans homolog=T28H10.3; Phenotype=Emb
  Coding regions on vcDNA: vcDNA=SeqID_48295; Strand=+; Position=3-757
GKLFNEPGGKDVYEGVKIDXSGTEVNPENFEAVLLGDEQRSEGKPVLKSTEKDKVFVYFSDHGAVGVIGFPAADLTVKQLTQTLKEMHAKKMYGELTFYLEACESGSMFDHTLAQSLKIYAVTAANGDESSWGCFCDTKFLPGNCLGDLFSVNWMQDSDQENLRTETLRKQFGIVREETNKSHVMHYGDLQIQDEHVSEFMGKEQAQKRNERPPSPHKFPMFPSRDIPMFMMARRQNESKQIQHNLRVAWEK

SEQ ID NO: 121873 - protein, 156 aa, Heterodera glycines
  Homolog annotation: Hit_ID=CAE60115.1; Match level="QueryCoverage =83%, HitCoverage=41%, E-value=7e-47, Identity=67%"; Hit description =Hypothetical protein CBG03655 [Caenorhabditis briggsae]
  Gene Ontology: Cellular component=mitochondrial membrane; Biological process=energy pathways
  Essential gene: C elegans homolog=C01F1.2; Phenotype=Emb,Lva
  Coding regions on vcDNA: vcDNA=SeqID_48296; Strand=+; Position=3-473
DEIEKMIDVVDILHREEATIPIEPLFISVDPERDTAERIRVYCAEFSPKLRGFTGSKEQIAKVAKAFRVYHSEGPRTKRTDDYIVDHTVIMYLIDPEGNFHDYYGQNRRAREITNVIKLKAAEWDAKKRKEQFWLNKILRGSNGEGKANATAKAIS

SEQ ID NO: 121874 - protein, 169 aa, Heterodera glycines
  misc_feature (72)..(72): Xaa can be any naturally occurring amino acid
  misc_feature (96)..(96): Xaa can be any naturally occurring amino acid
  misc_feature (117)..(117): Xaa can be any naturally occurring amino acid
  Homolog annotation: Hit_ID=CAE71878.1; Match level="QueryCoverage =88%, HitCoverage=23%, E-value=1e-36, Identity=48%"; Hit description =Hypothetical protein CBG18933 [Caenorhabditis briggsae]
  Gene Ontology: Biological process=embryogenesis and morphogenesis
  Essential gene: C elegans homolog=T05H4.14; Phenotype=Emb
  Coding regions on vcDNA: vcDNA=SeqID_48297; Strand=+; Position=20-528
FFFSRRCGQKNPHCFQPRPQPTADFIYTTTHAKDKGCGERGASLFLYAESFDILYKLEYPTQGCIRAFWHPXINQILVGLSDGTSKIYYDPSIQSXGALQCVSKPMKRSLESEMVRXELVLSPLTLEMFQPRCEYGQEKEVTEWRIPTFLPMLTKQKRPQFRQPAVMPM

SEQ ID NO: 121875 - protein, 237 aa, Heterodera glycines
  misc_feature (9)..(9): Xaa can be any naturally occurring amino acid
  Homolog annotation: Hit_ID=NP_496273.1; Match level="QueryCoverage =100%, HitCoverage=65%, E-value=1e-118, Identity=64%"; Hit description=transitional endoplasmic reticulum ATPase TER94 (89.8 kD) (2K850) [Caenorhabditis elegans] emb|CAA90050
  Gene Ontology: Mol. function=protein binding; Cellular component =endoplasmic reticulum; Biological process=microtubule cytoskeleton organization and biogenesis
  Essential gene: C elegans homolog=C06A1.1; Phenotype=Emb
  Coding regions on vcDNA: vcDNA=SeqID_48298; Strand=+; Position=3-712
RSNVLVLGXTNRPNSIDPALRRFGRFDREIDIGIPDAIGRLEILRIHTKNMKLADDVDLEKIANECHGYVGADLAALCSEAAMQQIRQKMELIDLESENIDAEVLAQLAVTMDDFQFALGKNSPSALRETVVETPNVTWEDIGGLENVKRELQELVQYPVEHPEMFLKFGMQPSRGVLFYGPPGCGKTLLAKAIARECQANFISIKGPELLTMWFGESEANVRDVFDKARAAAPCVL

SEQ ID NO: 121876 - protein, 119 aa, Heterodera glycines
  misc_feature (8)..(8): Xaa can be any naturally occurring amino acid
  Homolog annotation: Hit_ID=NP_498774.1; Match level="QueryCoverage =100%, HitCoverage=73%, E-value=9e-36, Identity=59%"; Hit description= ribosomal Protein, Large subunit (18.3 kD) (rpl-21) [Caenorhabditis elegans] gb|AAA27951.1| Ribosomal pr
  Gene Ontology: Mol. function=structural constituent of ribosome; Cellular component=cytosolic large ribosomal subunit (sensu Eukarya); Biological process=protein biosynthesis
  Essential gene: C elegans homolog=C14B9.7; Phenotype=Emb
  Coding regions on vcDNA: vcDNA=SeqID_48299; Strand=+; Position=2-360
KGNGAFQXGMPFKAYHGKTGRVFNVTKHALGVVVNKRVRHRIIPKRINVRVEHVKPSGFLLEFLQRCKANDLQKKQHKEGNAPFVALKRKPKEPRGAHLVKVKSTKVERLAPVKFEIVA

SEQ ID NO: 121877 - protein, 204 aa, Heterodera glycines
  Essential gene: C elegans homolog=R06F6.1; Phenotype=Emb
  Coding regions on vcDNA: vcDNA=SeqID_48300; Strand=+; Position=74-688
MQNALRAKLAELQNSRRTKEEEKEQQKEEPPQKLDFSLFDDSEFANRSWVELIEEEEAAARKTQKTKAATAETTAASAAPPIASVAAVASSSASPSNKRRNSERAEKEENVPKAQKFDFSLFDDSDFANRSWVDIIDEEERERSKSTALSTTPSVVSSSAPNKRRHILPTPQKGWAEPNTGWCTDEATLERRDKELQKMKEKPS

SEQ ID NO: 121878 - protein, 240 aa, Heterodera glycines
  Homolog annotation: Hit_ID=NP_506628.1; Match level="QueryCoverage =97%, HitCoverage=32%, E-value=2e-83, Identity=64%"; Hit description =pleckstrin-like, UNCoordinated locomotion UNC-112 (82.4 kD) (unc -112) [Caenorhabditis elegans] emb|CAA997
  Gene Ontology: Biological process=cell growth
  Essential gene: C elegans homolog=C47E8.7; Phenotype=Emb
  Coding regions on vcDNA: vcDNA=SeqID_48301; Strand=+; Position=1-720
HESEIDPVRINQLYEQAKWSVLLEEVEHTEEESSLFAALQLQAALQRNSPDRESPERDEVDVLLDELEQTLDTTASLSRRDLTYVPELTEYLKYLKPKKLGFNNFKRAYFTFRDLYLSYYNTAQDANGPPLGHYYLKGCEVSQDLSVSQGKFNIKLQVPSSEGMSELILKCDTEQQFAKWMAACRLASRGETMADSSYNSEVESIKKVLQMQAGRAAAAQNGAQNKKKSQPVQLPTDFNS

SEQ ID NO: 121879 - protein, 247 aa, Heterodera glycines
  misc_feature (234)..(234): Xaa can be any naturally occurring amino acid
  Homolog annotation: Hit_ID=CAA70694.1; Match level="QueryCoverage =96%, HitCoverage=67%, E-value=1e-132, Identity=99%"; Hit description= cathepsin S-like cysteine proteinase [Heterodera glycines]
  Gene Ontology: Mol. function=cathepsin S activity; Cellular component= lysosome; Biological process=proteolysis and peptidolysis
  Essential gene: C elegans homolog=T03E6.7; Phenotype=Emb,Gro,Unc
  Coding regions on vcDNA: vcDNA=SeqID_48302; Strand=+; Position=2-741
RSSPVSPPSNSPISLLAVSLAVLAFVALASANPPTARETAPNAQQNNANSVATGEIAKNIAEKMERVNEFIKAKKFIDAHNLAFEKGEVSFKVAPNHLMHFTPAQYNRIRGLQMRSNRQRHNMATLAGNSSTLPEKLDWREKGAVTEVKDQGDCGSCWAFSATGAIEGALAQKKASKIISLSEQNLVDCSSKYGNEGCDGGLMDSAFEYVRDNNGLDTEESYPYEAVTGKCQFXNETVGGTVVSFKD

SEQ ID NO: 121880 - protein, 219 aa, Heterodera glycines
  Homolog annotation: Hit_ID=CAE70892.1; Match level="QueryCoverage =94%, HitCoverage=49%, E-value=1e-31, Identity=40%"; Hit description =Hypothetical protein CBG17683 [Caenorhabditis briggsae]
  Gene Ontology: Biological process=growth
  Essential gene: C elegans homolog=T14A8.1; Phenotype=Unclassified
  Coding regions on vcDNA: vcDNA=SeqID_48303; Strand=+; Position=2-658
PRRGVAQWKLCLVGAAIFLCFALLYPSVFSPMLSNLFGGGTQRQQPAAADRPMHPSMMGPNQQQQQQRERAHRPPPHHPGASMRMPDMHNQQQQQQQGGFWSGKSGGSMAWMLPFYTVGVVCFLLYTLFKSKTKRQKRRRDRPLDLLYGDDDDDGGTEDGLEYGVRGAKLRSVQHRLRKTEQAMADILSQLEQISAHSKDINDDDTKAAEKNVNDPNIA

SEQ ID NO: 121881 - protein, 122 aa, Heterodera glycines
  Homolog annotation: Hit_ID=CAE57827.1; Match level="QueryCoverage =84%, HitCoverage=85%, E-value=4e-36, Identity=70%"; Hit description =Hypothetical protein CBG00852 [Caenorhabditis briggsae]
  Gene Ontology: Mol. function=hydrogen-transporting ATPase activity, rotational mechanism; Cellular component=vacuolar membrane (sensu Fungi); Biological process=hydrogen transport
  Essential gene: C elegans homolog=ZK970.4; Phenotype=Emb
  Coding regions on vcDNA: vcDNA=SeqID_48304; Strand=+; Position=2-370
VVGFLLGGVGQLNKAREPNFVIDDQDTSVVQIEDAFHTFCTRDDIAIIVINQHLAEMIRYHVDQHVDSIPDVLEIPCKEMPYDASKDSILNRARCLANTDDLKSYKKTLHETNYPLLVNECV

SEQ ID NO: 121882 - protein, 191 aa, Heterodera glycines
  misc_feature (154)..(154): Xaa can be any naturally occurring amino acid
  Homolog annotation: Hit_ID=AAL78224.1; Match level="QueryCoverage =80%, HitCoverage=70%, E-value=5e-66, Identity=79%"; Hit description =hypothetical protein Hgg-30 [Heterodera glycines]
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_48305; Strand=+; Position=86-658
MEDADGKPRGFGFVNYLEHENAAKAVEQMHGSLVPNGKPDQKFTVCRAQKKSERQAELRRRYEQYKCERIQRYNGTNLYVKNLVDTINDETLRGYFDSYGKITSVKIMCDESGRSKGFGFVCFEHMEAASKAVVEMNNKIIAGKPLYVAPAQRXEDRKALLASQYIQRLASMRLQNPTGILGTMYAPANGG

SEQ ID NO: 121883 - protein, 140 aa, Heterodera glycines
  Homolog annotation: Hit_ID=CAE75506.1; Match level="QueryCoverage =92%, HitCoverage=28%, E-value=3e-43, Identity=61%"; Hit description =Hypothetical protein CBG23516 [Caenorhabditis briggsae]
  Gene Ontology: Mol. function=GPI-anchor transamidase activity; Cellular component=extracellular space; Biological process =embryogenesis and morphogenesis
  Essential gene: C elegans homolog=T28H10.3; Phenotype=Emb
  Coding regions on vcDNA: vcDNA=SeqID_48306; Strand=+; Position=3-422
KSWDNAGDGNIWAVLVAGSSGWFNYRHQADICHAYHTLLAHGVAKERIITMMFDDIANNKHNPYPGKLFNEPGGKDVYEGVKIDYSGTEVNPENFEAVLLGDEQRSEGKPVLKSTEKDKVFVYFSDHGAVGVIGFPAADL

SEQ ID NO: 121884 - protein, 227 aa, Heterodera glycines
  Homolog annotation: Hit_ID=S65469; Match level="QueryCoverage=99%, HitCoverage=30%, E-value=2e-90, Identity=72%"; Hit description=DNA topoisomerase (EC 5.99.1.2) - Caenorhabditis elegans
  Gene Ontology: Mol. function=DNA topoisomerase type I activity; Cellular component=chromatin; Biological process=establishment and/or maintenance of chromatin architecture
  Essential gene: C elegans homolog=M01E5.5a; Phenotype=Lva,Unc
  Coding regions on vcDNA: vcDNA=SeqID_48307; Strand=+; Position=2-682
EVVVEFDFLGKDSIRYYNRVPVEKQVFKNLKLFMEEKDPGDDLFDRLDTSSLNQYLKELMDGLTAKVFRTYNASITLQEQLDKLTNPSDSVHEKMLSYNRANRQVAILCNHQRAVPKTHEKSMENLENKIKEKKQEYKELKDQLKKSKSVDEKMAKKYERLKEQIAKLNTQRTDKDENKQIALGTSKLNYLDPRISVAWCKKNDVPVEKIFSKTQRDKFRWALDMAK

SEQ ID NO: 121885 - protein, 88 aa, Heterodera glycines
  misc_feature (48)..(48): Xaa can be any naturally occurring amino acid
  Homolog annotation: Hit_ID=NP_492799.1; Match level="QueryCoverage =87%, HitCoverage=45%, E-value=6e-21, Identity=59%"; Hit description =genes associated with retinoid-IFN-induced mortality 19 like (20.1 kD) (1L262) [Caenorhabditis elegans] g
  Gene Ontology: Biological process=positive regulation of embryonic development
  Essential gene: C elegans homolog=C34B2.8; Phenotype=Emb,Lva
  Coding regions on vcDNA: vcDNA=SeqID_48308; Strand=+; Position=1-266
TALEHFLMAERDRSVLRIMKRNRELENEVMKDVPGWKTGTWYGEPVYXTLGDKWIEPNAMEVSPHLSFRDSDFNHYYRLNTLRPQRKC

SEQ ID NO: 121886 - protein, 83 aa, Heterodera glycines
  misc_feature (23)..(23): Xaa can be any naturally occurring amino acid
  misc_feature (61)..(61): Xaa can be any naturally occurring amino acid
  misc_feature (63)..(63): Xaa can be any naturally occurring amino acid
  Homolog annotation: Hit_ID=CAE57854.1; Match level="QueryCoverage =97%, HitCoverage=54%, E-value=2e-12, Identity=43%"; Hit description =Hypothetical protein CBG00891 [Caenorhabditis briggsae]
  Essential gene: C elegans homolog=R05H5.3; Phenotype=Emb
  Coding regions on vcDNA: vcDNA=SeqID_48309; Strand=+; Position=195-446
CDHADKHLKPYYRNHHRTWAYLXFRNPITLELLEKYEVKTLSTCTTIKPHGTIVANDARTXGXENGVENALGLCDEWLPFYEA

SEQ ID NO: 121887 - protein, 151 aa, Heterodera glycines
  Homolog annotation: Hit_ID=CAE57854.1; Match level="QueryCoverage =99%, HitCoverage=100%, E-value=7e-51, Identity=60%"; Hit description= Hypothetical protein CBG00891 [Caenorhabditis briggsae]
  Gene Ontology: Mol. function=thioredoxin reductase (NADPH) activity; Cellular component=nucleus
  Essential gene: C elegans homolog=R05H5.3; Phenotype=Emb
  Coding regions on vcDNA: vcDNA=SeqID_48310; Strand=+; Position=18-473
MAQLLAGEKVVLSDGSKVEAEVFLKDKVVAVYFSAGWCPPCRAFTPKLKKFYEELKKAGKNFEVLFVSRDRAAKDLVEYYRDHHGAWAYLEFGNPKIQELLEKYEVKTIPTCKVIKPDGTIVVNDARTEVQEKGVENALGLWEEWLGFYEA

SEQ ID NO: 121888 - protein, 203 aa, Heterodera glycines
  Homolog annotation: Hit_ID=AAN15196.1; Match level="QueryCoverage =100%, HitCoverage=53%, E-value=1e-115, Identity=99%"; Hit description=actin [Globodera rostochiensis] gb|AAN78299.1| actin 1 [Heterodera glycines] gb|AAG47837.2| actin 1 [Het
  Gene Ontology: Biological process=reproduction
  Essential gene: C elegans homolog=T04C12.6; Phenotype=Ste
  Coding regions on vcDNA: vcDNA=SeqID_48311; Strand=+; Position=100-708
MCDEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQTMFETFNTPAMYVAIQAVLSLYASGRTTGLVLDSGDGVTHTVPIYEGYALPHAILRLDLAGRDLTDYLMKILTERGYSFVT

SEQ ID NO: 121889 - protein, 159 aa, Heterodera glycines
  Homolog annotation: Hit_ID=CAE67980.1; Match level="QueryCoverage =94%, HitCoverage=61%, E-value=1e-33, Identity=46%"; Hit description =Hypothetical protein CBG13586 [Caenorhabditis briggsae]
  Gene Ontology: Mol. function=endopeptidase activity; Cellular component=proteasome core complex (sensu Eukarya); Biological process=sporulation (sensu Saccharomyces)
  Essential gene: C elegans homolog=K08D12.1; Phenotype=Emb,Lva,Unc
  Coding regions on vcDNA: vcDNA=SeqID_48312; Strand=+; Position=18-494
ILPKVEYTGTTLVGMECFGGIVVATDSRSSSGTYISNRTTDKITMLNDRIVILRAGTQADTQALADIVMYYAEAHAIMDEEDEITVRNVANYARKMHYNYRGQLNSTFLVAGYDSLNMGQLYVIPGGGYTTRHPYYTSGSGSSYIPEYLQNQWKEDLDG

SEQ ID NO: 121890 - protein, 204 aa, Heterodera glycines
  Homolog annotation: Hit_ID=NP_499741.1; Match level="QueryCoverage =96%, HitCoverage=32%, E-value=3e-62, Identity=59%"; Hit description =phosphomannomutase 45A (66.6 kD) (3O391) [Caenorhabditis elegans] emb|CAA16334.1| Hypothetical protein Y4
  Gene Ontology: Biological process=growth
  Essential gene: C elegans homolog=Y43F4B.5a; Phenotype=Emb
  Coding regions on vcDNA: vcDNA=SeqID_48313; Strand=+; Position=3-614
DSIGGERGNGEWRVFSGNEMGILLTWWAWTNWRAANPTADSSRVFVLHSAVSSQMGATMAKKEGFKAAHSLTGFKYIRNLAHKLRSEGNTVIAAWGESIGFTPGTTLDKDGVSSAAVFAEMANWLRTQKGVSLREQLFRLFSIYGFHLQRNSYWGVKSTEVTKKLFADLRSDYPETIGQNFDVKFVRDLTTGYDNAQPDDRAIL

SEQ ID NO: 121891 - protein, 253 aa, Heterodera glycines
  misc_feature (194)..(195): Xaa can be any naturally occurring amino acid
  Homolog annotation: Hit_ID=CAE56261.1; Match level="QueryCoverage =96%, HitCoverage=75%, E-value=3e-72, Identity=54%"; Hit description =Hypothetical protein CBG23904 [Caenorhabditis briggsae]
  Essential gene: C elegans homolog=F56B3.8; Phenotype=Gro
  Coding regions on vcDNA: vcDNA=SeqID_48314; Strand=+; Position=3-762
AQTSARLFFDFAHLKQITGGEYTTKPLQINRLGGRCPITRKKLCIHIGGGVKFDYFMLNLHPRGPTVADQTYDERVIEVRRDPNRTPYIALVAGVKGKRWIYATQNMQAGQIIQTTCHIPERPVIGCEGNAYPLGALVEGTMVNSIELHRNNPNSHVVITEAGGCAEIIRHMDEFTVVRMPNKYEYAVRKECMXXVGKLSHVDWEKKQWGSAQMHRRFGFRMASGPSKRRRDQYQGKKHPRNPPLCTIDGVRP

SEQ ID NO: 121892 - protein, 217 aa, Heterodera glycines
  Homolog annotation: Hit_ID=AAL40718.1; Match level="QueryCoverage =76%, HitCoverage=95%, E-value=1e-78, Identity=89%"; Hit description =myosin regulatory light chain [Meloidogyne incognita]
  Gene Ontology: Mol. function=structural constituent of muscle; Cellular component=muscle myosin; Biological process=regulation of muscle contraction
  Essential gene: C elegans homolog=C36E6.3; Phenotype=Gro,Unc
  Coding regions on vcDNA: vcDNA=SeqID_48315; Strand=+; Position=76-726
MSEKKVKKVKKKSRTGSEASSFDQKTIQEFKEAFGIMDQDKDGVISKQDLKDLYATLGVVASDSQMDNMLKEAPGPINFTVFLTLFGERLTGTDPEATIIGAFQMFDKTDCGEITEETLMKILKNKRGEPLTEDEVQGMYKGNPPISGGKVDYKAFAHLITTGAAEGVGQSGLSGAMDGREGPTSDLPIRGKTDHPSRRSFHPYDRSPFSPSPIVSP

SEQ ID NO: 121893 - protein, 240 aa, Heterodera glycines
  misc_feature (222)..(222): Xaa can be any naturally occurring amino acid
  misc_feature (228)..(228): Xaa can be any naturally occurring amino acid
  Homolog annotation: Hit_ID=NP_497663.1; Match level="QueryCoverage =100%, HitCoverage=53%, E-value=1e-126, Identity=90%"; Hit description=MEChanosensory abnormality MEC-12, TuBulin, Alpha, specific of 15 protofilament microtubules found in m
  Gene Ontology: Mol. function=GTP binding; Cellular component =microtubule; Biological process=spindle assembly
  Essential gene: C elegans homolog=F26E4.8; Phenotype=Emb
  Coding regions on vcDNA: vcDNA=SeqID_48316; Strand=+; Position=63-781
MREVISIHVGQAGVQIGNACWELYCLEHGIQPDGKMPSDQNNQDDSFSTFFSETGNGRHVPRAVMVDLEPTVIDEIRTGTYKHLFHPEQLITGKEDAANNYARGHYTVGKEIIDPVLDRIRRIADNCTGLQGFLIFHSFGGGTGSGFTSLLMERLSVDYGKKSKLEFSIYPAPQVSTAVVEPYNSVLTTHTTLEHSDCAFMVDNEAIYDICRRNLDVERPSXTNLNRXISQVVSSITASL

SEQ ID NO: 121894 - protein, 121 aa, Heterodera glycines
  misc_feature (79)..(79): Xaa can be any naturally occurring amino acid
  misc_feature (81)..(82): Xaa can be any naturally occurring amino acid
  misc_feature (84)..(84): Xaa can be any naturally occurring amino acid
  Homolog annotation: Hit_ID=CAD89885.1; Match level="QueryCoverage =97%, HitCoverage=48%, E-value=2e-40, Identity=66%"; Hit description =ribosomal protein L7 [Crassostrea gigas]
  Gene Ontology: Mol. function=structural constituent of ribosome; Cellular component=cytosolic large ribosomal subunit (sensu Eukarya); Biological process=protein biosynthesis
  Essential gene: C elegans homolog=F53G12.10; Phenotype=Emb,Lva
  Coding regions on vcDNA: vcDNA=SeqID_48317; Strand=+; Position=2-367
YLVEYRQKQRQLVALKREAKKVGNYYVPDEPKLAFVVRIKGINKIHPRPRKVLQLLRLRQINNGVFVKLNKATIQMLRXLXXPXYIAWGYPSQKIIRQLVYKRGYAKESGQRIPITDNGHC

SEQ ID NO: 121895 - protein, 230 aa, Heterodera glycines
  Homolog annotation: Hit_ID=AAO14563.2; Match level="QueryCoverage =97%, HitCoverage=31%, E-value=1e-122, Identity=96%"; Hit description= Hsp90 [Heterodera glycines]
  Gene Ontology: Biological process=reproduction
  Essential gene: C elegans homolog=C47E8.5; Phenotype=Emb,Ste
  Coding regions on vcDNA: vcDNA=SeqID_48318; Strand=+; Position=1-690
WRGRGQKKKKTRRSGEITEDEELNKTKPIWTRNPDDISNEEYAEFYKSLSNDWEDHLAVKHFSVEGQLEFRALLFVPQRAPFDLFENKKSKNAIKLYVRRVFIMENCEELMPEYLNFIKGVVDSEDLPLNISRETLRQSKILKVIRKNLVKKCMDLFEEISEDKDNFKKFYEQFAKNIKLGIHEDSVNRKKLSDFLRYYTSASGEEPCSFKDYVSRMKENQTCIYYITGE

SEQ ID NO: 121896 - protein, 196 aa, Heterodera glycines
  Homolog annotation: Hit_ID=NP_490676.1; Match level="QueryCoverage =97%, HitCoverage=78%, E-value=5e-77, Identity=67%"; Hit description =ribosomal Protein, Large subunit (28.1 kD) (rpl-7) [Caenorhabditis elegans] gb|AAB54165.1| Ribosomal prot
  Gene Ontology: Mol. function=structural constituent of ribosome; Cellular component=cytosolic large ribosomal subunit (sensu Eukarya); Biological process=protein biosynthesis
  Essential gene: C elegans homolog=F53G12.10; Phenotype=Emb,Lva
  Coding regions on vcDNA: vcDNA=SeqID_48319; Strand=+; Position=1-591
WGGTFLVEYRQKQRQLVALKREAKKVGNYYVPDEPKLAFVVRIKGINKIHPRPRKVLQLLRLRQINNGVFVKLNKATIQMLRIADPYIAWGYPSQKIIRQLVYKRGYAKESGQRIPITDNAIVERNMGKSDVICVEDMIHQIWTVGPHFKQVTNFLWPFKLSNPVGGFKKKSNHFVEGGDYGNREDQINKLLEKMI

SEQ ID NO: 121897 - protein, 185 aa, Heterodera glycines
  Homolog annotation: Hit_ID=AAL78213.1; Match level="QueryCoverage =99%, HitCoverage=73%, E-value=3e-68, Identity=71%"; Hit description =probable protein kinase Hgg-20 [Heterodera glycines]
  Gene Ontology: Mol. function=casein kinase I activity; Biological process=signal transduction
  Essential gene: C elegans homolog=B0218.5; Phenotype=Unclassified
  Coding regions on vcDNA: vcDNA=SeqID_48320; Strand=+; Position=59-613
MPEELVALSPGTRVSGRWTIIKKLGAGAFGAVYLCQDRDGRTMAALKTEPIDAQRPLLYMEAHVLLSLNELRSNSGRHFCRCLDLGRDEQPDADSGQTMEFNYVVMSLVGRPMDKLLHESGDRFSPGTAIGTSIQLLKALKALHSVGYLHRDIKPANSAIGTPETNEQRLLYLLDFGMARKYVRE

SEQ ID NO: 121898 - protein, 140 aa, Heterodera glycines
  Homolog annotation: Hit_ID=NP_498516.1; Match level="QueryCoverage =40%, HitCoverage=2%, E-value=3e-14, Identity=59%"; Hit description =NOT-like, component of CCR4/NOT complex (ntl-1) [Caenorhabditis elegans] gb|AAA21168.1| Not-like (yeast cc
  Gene Ontology: Biological process=reproduction
  Essential gene: C elegans homolog=F57B9.2; Phenotype=Emb
  Coding regions on vcDNA: vcDNA=SeqID_48321; Strand=+; Position=2-421
PVRAPCGWVYAILKVLAEIHSEPDLKLNLRFEIEVLCKELNVNLRSIEVGSYLKEQRRLPRLVPPSKLGTAAASSTLAQCQLPPIQPPHIGAGISSHSTADYTPTDIANILAEMSISRKYSPASYTPGGSQQQVSSITAH

SEQ ID NO: 121899 - protein, 247 aa, Heterodera glycines
  Homolog annotation: Hit_ID=AAO85519.1; Match level="QueryCoverage =89%, HitCoverage=70%, E-value=7e-76, Identity=57%"; Hit description =putative serine/threonine phosphatase [Oesophagostomum dentatum] gb|AAO85518.1| putative serine/threonine
  Gene Ontology: Mol. function=protein serine/threonine phosphatase activity; Cellular component=cytoplasm; Biological process=protein amino acid dephosphorylation
  Essential gene: C elegans homolog=W09C3.6; Phenotype=Ste
  Coding regions on vcDNA: vcDNA=SeqID_48322; Strand=+; Position=2-742
LQPPVVLCGDIHGQFRDLLRIFKTMGFPPDKKYLFLGDYVDRGTQSLETMVLLFCYKVKYPDSVILLRGNHECSNMNRAYGFFEEVERRYGQMDAYALWNHFNQTFAWLPYVGLIGNKILCMHGGISDKFTSLEQLNDLRPTTEPPNPSLEIDLLWADPVPGIQGVRPNNRGASVQFGEDMVHKICNLLGVDLIIRAHQVVQGGVEFFADRRLITLFSAPHYENMHNTGAIIAIAGGSQLHRSYLAI

SEQ ID NO: 121900 - protein, 243 aa, Heterodera glycines
  Homolog annotation: Hit_ID=AAO85519.1; Match level="QueryCoverage =80%, HitCoverage=61%, E-value=3e-60, Identity=53%"; Hit description =putative serine/threonine phosphatase [Oesophagostomum dentatum] gb|AAO85518.1| putative serine/threonine
  Gene Ontology: Mol. function=protein serine/threonine phosphatase activity; Cellular component=cytoplasm; Biological process=protein amino acid dephosphorylation
  Essential gene: C elegans homolog=W09C3.6; Phenotype=Ste
  Coding regions on vcDNA: vcDNA=SeqID_48323; Strand=+; Position=77-805
MNEEYCFSTSTVVAQSWAQTNFRPVDEQPNSLVDTLIAKFSCTTFEQFTSEVSAQDIHKLCDVTVGVLQQQSMLIHLQPPVVLCGDVHGQFRDLLRIFKTMGFPPDKKYLFLGDYVDRGTQSLETMVLLFCYKVKYPDSVILLRGNHECSNMNRAYGFFEEVERRYGQMDAYALWNHFNQTFAWLPYVGLIGNKILCMHGGISDKFTSLEQLNDLRPTTEPPNPSLEIDLLWADPVPGIQGVR

SEQ ID NO: 121901 - protein, 251 aa, Heterodera glycines
  misc_feature (50)..(50): Xaa can be any naturally occurring amino acid
  Homolog annotation: Hit_ID=CAE60138.1; Match level="QueryCoverage =91%, HitCoverage=13%, E-value=2e-18, Identity=25%"; Hit description =Hypothetical protein CBG03684 [Caenorhabditis briggsae]
  Essential gene: C elegans homolog=ZK430.1; Phenotype=Lva
  Coding regions on vcDNA: vcDNA=SeqID_48324; Strand=+; Position=1-752
QFLRSAPPHSKFNSTAWDWLTEYQRDAAPIPMNILCRACQVGRSYGLVSXLSNFVQMAIEQLGSTYANDKMQNYFTFLVSLFGILIENSTADGTVDDQLLARLMPFLSVALKSKLEAFKCAGIMLLICLAVNVATLDNETVQNALKLLLYKLRPNTFPLVLRAVCVLCQRLSLDTLPRNATLRIVYNDDELKATTEIQKLMELFDLSHFLVPFWRILVDAYRTGENETWRDAYLTMLLKTMDLGNGQIPSR

SEQ ID NO: 121902 - protein, 88 aa, Heterodera glycines
  misc_feature (23)..(23): Xaa can be any naturally occurring amino acid
  Homolog annotation: Hit_ID=NP_610536.1; Match level="QueryCoverage =98%, HitCoverage=14%, E-value=7e-28, Identity=66%"; Hit description =CG12140-PA [Drosophila melanogaster] gb|AAF58873.1| CG12140-PA [Drosophila melanogaster] gb|AAM29591.1| R
  Gene Ontology: Mol. function=electron acceptor activity; Cellular component=mitochondrial inner membrane; Biological process=NADH catabolism
  Essential gene: C elegans homolog=C05D11.12; Phenotype=Emb
  Coding regions on vcDNA: vcDNA=SeqID_48325; Strand=+; Position=2-264
QEVLFDEAGKTVCGVATGDVGIXKDGSPKESFERGMELKAKCTIFAEGCRGHLTKSVIEKFGLSEGRDPMTFGIGLKELWEIDPSKHR

SEQ ID NO: 121903 - protein, 163 aa, Heterodera glycines
  Homolog annotation: Hit_ID=AAL78213.1; Match level="QueryCoverage =98%, HitCoverage=64%, E-value=3e-58, Identity=71%"; Hit description =probable protein kinase Hgg-20 [Heterodera glycines]
  Gene Ontology: Mol. function=casein kinase I activity; Biological process=signal transduction
  Essential gene: C elegans homolog=R90.1; Phenotype=Lva,Unc
  Coding regions on vcDNA: vcDNA=SeqID_48326; Strand=+; Position=33-521
MPEELVALSPGTRVSGRWTIIKKLGAGAFGAVYLCQDRDGRTMAALKTEPIDAQRPLLYMEAHVLLSLNELRSNSGRHFCRCLDLGRDEQPDADSGQTMEFNYVVMSLVGRPMDKLLHESGDRFSPGTAIGTSIQLLKALKALHSVGYLHRDIKPANSAIGTP

SEQ ID NO: 121904 - protein, 254 aa, Heterodera glycines
  Homolog annotation: Hit_ID=NP_740802.1; Match level="QueryCoverage =99%, HitCoverage=32%, E-value=6e-38, Identity=36%"; Hit description =zebrafish dead eye like, Nuclear Pore complex Protein NPP-13 (npp -13) [Caenorhabditis elegans] gb|AAK2786
  Gene Ontology: Biological process=embryogenesis and morphogenesis
  Essential gene: C elegans homolog=Y37E3.15a; Phenotype=Emb
  Coding regions on vcDNA: vcDNA=SeqID_48327; Strand=+; Position=1-803
VNDERRLKLRAEWNAQNCQDMHKKAIYGLFLGFDCPEINGTIEDWLWAKLFHCKFAVDPARALRQLQTTLCTQHGERYFVGEGGSHLIYFSVLLFTGQIERAVHVLFRSEYIVHAVHLAILAHQLRLLMTVPKVSDELLTTDVHEPSVCRLNLARLLLLFVKDFELSNIEYAINYCFLRATLKGRSVFVAAVSRIVFMSGHREAILGRLDSQGNRVPGLIDKIKDAMDICELIDSIAFDTHVQGHSLAACHLYA

SEQ ID NO: 121905 - protein, 166 aa, Heterodera glycines
  Homolog annotation: Hit_ID=AAH46078.1; Match level="QueryCoverage =78%, HitCoverage=91%, E-value=6e-23, Identity=41%"; Hit description =Similar to H2A histone family, member X [Danio rerio] ref|NP _957367.1| similar to H2A histone family, memb
  Gene Ontology: Mol. function=DNA binding; Cellular component =nucleosome; Biological process=nucleosome assembly
  Essential gene: C elegans homolog=T23D8.6; Phenotype=Emb
  Coding regions on vcDNA: vcDNA=SeqID_48328; Strand=+; Position=50-550
MPRHRAKPRSFHAGLKFPVGRVHRKMKKGPYAKRLANGVPVYMTAVLEHITGELLKIIGDITQSEGMKRLSAFHIRSAARENDELRKLFSGVSLAEVCVLPELESDVEQSSEGSGESDSDESTEGSASGSQEGRCCWCAAMRGGFILETAVITLTSNLKEDRYLCL

SEQ ID NO: 121906 - protein, 70 aa, Heterodera glycines
  misc_feature (70)..(70): Xaa can be any naturally occurring amino acid
  Homolog annotation: Hit_ID=NP_500569.1; Match level="QueryCoverage =92%, HitCoverage=45%, E-value=2e-25, Identity=90%"; Hit description =histone H2A.F Z (14.7 kD) (4F211) [Caenorhabditis elegans] gb|AAC48074.1| Hypothetical protein R08C7.3 [C
  Gene Ontology: Mol. function=chromatin binding; Cellular component =chromatin remodeling complex; Biological process=establishment and/or maintenance of chromatin architecture
  Essential gene: C elegans homolog=R08C7.3; Phenotype=Gro
  Coding regions on vcDNA: vcDNA=SeqID_48329; Strand=+; Position=43-252
NFQWAGGKGKAGKDSGKAKSKKIISRSARAGLQFPVGRIHRFLKKRTTSTGRVGATAAVYSAAILEYLTX

SEQ ID NO: 121907 - protein, 234 aa, Heterodera glycines
  misc_feature (221)..(221): Xaa can be any naturally occurring amino acid
  Homolog annotation: Hit_ID=CAA78915.1; Match level="QueryCoverage =85%, HitCoverage=49%, E-value=2e-76, Identity=66%"; Hit description =p46Eg265 [Xenopus laevis] gb|AAH72133.1| LOC397925 protein [Xenopus laevis] sp|Q91820|STK6_XENLA Serine/th
  Gene Ontology: Mol. function=protein serine/threonine kinase activity; Cellular component=spindle; Biological process=chromosome condensation
  Essential gene: C elegans homolog=B0207.4; Phenotype=Mei
  Coding regions on vcDNA: vcDNA=SeqID_48330; Strand=+; Position=23-724
MKQPEPIINKENLRPANQPSNKMHEGINYSEFGKEWNEKQWTLSDFDIGRPLGKGKFGNVYLARDRKYRIPVALKILFKSQLVTGNVEHQLVREIEIHAHLRHPNILRMFNYFHDDKKVYLILEYALHGELLKVLQKSRRFSESTSAQYIFQVSDALNYCHSKKVIHRDIKPENILLCADGKIRIADFGWAVHAKNRRQTMCGTLDYLPPEMVLKRQHDEXVDYWSVGVLCYEF

SEQ ID NO: 121908 - protein, 176 aa, Heterodera glycines
  Homolog annotation: Hit_ID=NP_492528.1; Match level="QueryCoverage =87%, HitCoverage=27%, E-value=3e-25, Identity=39%"; Hit description =benzodiazepine receptor (1K94) [Caenorhabditis elegans] emb|CAB02840.1| Hypothetical protein C41G7.3 [Cae
  Gene Ontology: Biological process=chromosome segregation
  Essential gene: C elegans homolog=C41G7.3; Phenotype=Him
  Coding regions on vcDNA: vcDNA=SeqID_48331; Strand=+; Position=3-533
SSVVLKLYKFPLPNLPLHWTSVDTRNALLCAAVPSIGAFVGSTMAIKDQELVQFLKNQNFPSFARCCKYNYLLANTAVTIPFGYASYLVYKIGGGFDYTDTTVALGLYGATVLSGCFLVPVLKKQDTKALTANAVVLAGLSVATSVAFYNIDKISAYWTMPFTLWAIFCAGLTVKA

SEQ ID NO: 121909 - protein, 230 aa, Heterodera glycines
  misc_feature (131)..(131): Xaa can be any naturally occurring amino acid
  Homolog annotation: Hit_ID=CAE63991.1; Match level="QueryCoverage =91%, HitCoverage=19%, E-value=6e-20, Identity=29%"; Hit description =Hypothetical protein CBG08584 [Caenorhabditis briggsae]
  Gene Ontology: Biological process=embryogenesis and morphogenesis
  Essential gene: C elegans homolog=F18E2.3; Phenotype=Emb
  Coding regions on vcDNA: vcDNA=SeqID_48332; Strand=+; Position=3-693
MPNCGRSCAKFAATIAVFLANEEDEDQQLDEEDEAALLSAFRKMVAFASTIDVPVNVEFWDMCMALFQNSHRFRSADLVEKAMLLCFLLLSWEMKRFVAAQEHGEETIETLKKKRDQFLRTTKSILRDFAXAFMCICDILILFNWKLAADNGPDHPIHSLAIKLDREMAFRLGDFVMDNVFVLEENDSVRDLNEPERIQLMAKRRNILAQYSKLFICGLLPIIESVGILR

SEQ ID NO: 121910 - protein, 111 aa, Heterodera glycines
  misc_feature (12)..(12): Xaa can be any naturally occurring amino acid
  Homolog annotation: Hit_ID=NP_491890.2; Match level="QueryCoverage =69%, HitCoverage=13%, E-value=1e-19, Identity=62%"; Hit description =trehalase (66.9 kD) (tre-1) [Caenorhabditis elegans] gb|AAB96724.2| Trehalase protein 1 [Caenorhabditis e
  Gene Ontology: Mol. function=alpha,alpha-trehalase activity; Cellular component=extrinsic to plasma membrane, GPI-anchored; Biological process=trehalose catabolism
  Essential gene: C elegans homolog=F57B10.7; Phenotype=Emb
  Coding regions on vcDNA: vcDNA=SeqID_48333; Strand=+; Position=3-338
VKAAEQMATSMXLVVNYKGYVSTYAMFEKYNVSMINEEGVGGSGGEYEVQKGFGWTNGVILDLLDKYGSKISVSGAAVPNGVRFLPLALIVLLFMTVVEIAIAQCFWCISG

SEQ ID NO: 121911 - protein, 203 aa, Heterodera glycines
  Homolog annotation: Hit_ID=AAN15196.1; Match level="QueryCoverage =100%, HitCoverage=53%, E-value=1e-115, Identity=99%"; Hit description=actin [Globodera rostochiensis] gb|AAN78299.1| actin 1 [Heterodera glycines] gb|AAG47837.2| actin 1 [Het
  Gene Ontology: Biological process=reproduction
  Essential gene: C elegans homolog=T04C12.6; Phenotype=Ste
  Coding regions on vcDNA: vcDNA=SeqID_48334; Strand=+; Position=93-701
MCDEEVAALVVDNGSGMCKAGFAGDDAPRAMFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGLVLDSGDGVTHTVPIYEGYALPHAILRLDLAGRDLTDYLMKILTERGYSFVT

SEQ ID NO: 121912 - protein, 235 aa, Heterodera glycines
  Homolog annotation: Hit_ID=CAE73991.1; Match level="QueryCoverage =97%, HitCoverage=16%, E-value=5e-77, Identity=60%"; Hit description =Hypothetical protein CBG21624 [Caenorhabditis briggsae]
  Gene Ontology: Mol. function=molybdenum ion binding; Biological process=reproduction
  Essential gene: C elegans homolog=F15E6.6; Phenotype=Ste
  Coding regions on vcDNA: vcDNA=SeqID_48335; Strand=+; Position=1-705
EACRGTFGIDVDTLREQNMYSEGDITHYGMHLHQCNIRRCWTECQKLANYDQRKLKLQECNSRNKFLKRGIYMVPTKFGIAFGFKRLNQAGALVNVYTDGSVLISHGGMEMGQGLHTKILQIASRCLGIDVSTIQIIDTATDKVPNASATAASVGSDVNGLAVKNACEILLKRLEPLRSELPKEASWKDLVMHAYSNRVQLSATGFAIIHSEPPDFVESRGSESYSYCVYGVGCA

SEQ ID NO: 121913 - protein, 195 aa, Heterodera glycines
  misc_feature (123)..(123): Xaa can be any naturally occurring amino acid
  Homolog annotation: Hit_ID=AAK94490.1; Match level="QueryCoverage =99%, HitCoverage=19%, E-value=1e-107, Identity=96%"; Hit description= PAZ/Piwi domain protein [Heterodera glycines]
  Essential gene: C elegans homolog=C16C10.3; Phenotype=Lva
  Coding regions on vcDNA: vcDNA=SeqID_48336; Strand=+; Position=36-619
LEALCNGLVGIYAEPRYGTSGRFFRISDITKPNTGNGLNAENTFITHQVFWKISVKQYFEDTYRKTLQYPKAPLLVNYRRIGDPAYYPMEVCFVLDGQRVKSSQQNPEQIREMIKETAIPPTXLRVHNERVKESLQLVNNEYLTKASVHFDTTPLHVDYRVLGPPATLYRNNHRVTPATSNCEWRPGDALVNAQI

SEQ ID NO: 121914 - protein, 126 aa, Heterodera glycines
  Homolog annotation: Hit_ID=AAO85519.1; Match level="QueryCoverage =46%, HitCoverage=18%, E-value=1e-12, Identity=52%"; Hit description =putative serine/threonine phosphatase [Oesophagostomum dentatum] gb|AAO85518.1| putative serine/threonine
  Gene Ontology: Mol. function=protein serine/threonine phosphatase activity; Cellular component=plasma membrane; Biological process =cell cycle
  Essential gene: C elegans homolog=W09C3.6; Phenotype=Ste
  Coding regions on vcDNA: vcDNA=SeqID_48337; Strand=+; Position=2-379
IVCNFNPTQRRARRNNGKRGLRLRCNGGGSGGAVSAFGNHFNAILAARLLGHRPFSIIRKVRQSPVHRFTDEITDEELQQLCMAATDVFRMQPTLVRIQPPVVVVGDIHGQFTDLQRIFDTHGYPP

SEQ ID NO: 121915 - protein, 211 aa, Heterodera glycines
  misc_feature (200)..(200): Xaa can be any naturally occurring amino acid
  Homolog annotation: Hit_ID=AAO85519.1; Match level="QueryCoverage =84%, HitCoverage=56%, E-value=2e-49, Identity=51%"; Hit description =putative serine/threonine phosphatase [Oesophagostomum dentatum] gb|AAO85518.1| putative serine/threonine
  Gene Ontology: Mol. function=protein serine/threonine phosphatase activity; Cellular component=cytoplasm; Biological process=protein amino acid dephosphorylation
  Essential gene: C elegans homolog=W09C3.6; Phenotype=Ste
  Coding regions on vcDNA: vcDNA=SeqID_48338; Strand=+; Position=61-696
MNEEYCFSTSTVVAQSWAQTNFRPVDEQPNSLVDTLIAKLSCTTFEQFTSEVSAQDIHKLCDVTVGVLQQQSMLIHLQPPVVLCGDIHGQFRDLLRIFKTMGFPPDKKYLFLGDYVDRGTQSLETMVLLFCYKVKYPDSVILLRGNHECSNMNRAYGFFEEVERRYGQMDAYALWNHFNQTFAWLPYVGLIGNKILCMHXGISDKFTSLEH

SEQ ID NO: 121916 - protein, 208 aa, Heterodera glycines
  Homolog annotation: Hit_ID=NP_500063.1; Match level="QueryCoverage =94%, HitCoverage=20%, E-value=5e-62, Identity=59%"; Hit description =RNA helicase (109.9 kD) (4C62) [Caenorhabditis elegans] gb|AAK68386.1| Hypothetical protein F53H1.1a [Cae
  Gene Ontology: Mol. function=pre-mRNA splicing factor activity; Cellular component=spliceosome complex; Biological process=mRNA splicing
  Essential gene: C elegans homolog=F53H1.1a; Phenotype=Gro,Pvl,Stp
  Coding regions on vcDNA: vcDNA=SeqID_48339; Strand=+; Position=50-673
MAENENGGNSVEMADESELDPLDAYMAEISQKNKGGDEKKARVLVIGAVSKSAPNKGDIVEPEDETVPITDELDIEQTASSLLAKGRMLAQTDHTKVYYRPFRKNFYVEVPEITAMSKKEVDEYRKELEEITVRGKNVPKPIKSWSQCGVDLKMLNILKIHNYVKPTPIQAQAIPAIMSGRDLIGIAKTGSGKTLAFLIPMFRHVMDQ

SEQ ID NO: 121917 - protein, 85 aa, Heterodera glycines
  misc_feature (56)..(56): Xaa can be any naturally occurring amino acid
  misc_feature (62)..(62): Xaa can be any naturally occurring amino acid
  misc_feature (68)..(68): Xaa can be any naturally occurring amino acid
  Homolog annotation: Hit_ID=CAG09056.1; Match level="QueryCoverage =90%, HitCoverage=15%, E-value=9e-17, Identity=55%"; Hit description =unnamed protein product [Tetraodon nigroviridis]
  Gene Ontology: Mol. function=RNA helicase activity; Cellular component=cytoplasm; Biological process=anti-apoptosis
  Essential gene: C elegans homolog=C07H6.5; Phenotype=Emb
  Coding regions on vcDNA: vcDNA=SeqID_48340; Strand=+; Position=15-269
MYAAVSSSRPMEDWKSELAMPDKDLRYKTSDVTATKGVEFEEFGLTRDPLKGIFEXGWEHPXPGQEPXFGIALPGTKIFPSPQKG

SEQ ID NO: 121918 - protein, 152 aa, Heterodera glycines
  Homolog annotation: Hit_ID=NP_491233.1; Match level="QueryCoverage =92%, HitCoverage=67%, E-value=2e-68, Identity=90%"; Hit description =RAB family member (23.6 kD) (rab-2) [Caenorhabditis elegans] gb|AAB52431.1| Uncoordinated protein 108 [Ca
  Gene Ontology: Mol. function=ATP binding; Cellular component=Golgi apparatus; Biological process=two-component signal transduction system (phosphorelay)
  Essential gene: C elegans homolog=F53F10.4; Phenotype=Unc
  Coding regions on vcDNA: vcDNA=SeqID_48341; Strand=+; Position=2-460
LGHCTPGILSLLTRSYYRGAAGALLVYDITRRDTFNHLTSWLEDARQHSNSNMVIMLIGNKSDLEARREVKKEEGEQFARENGLVFMETSAKTAANVEEAFIDTAKEIYRKIQEGVFDINNEANGIKLGPQHPPSSPSSPGGAPLGRASNCC

SEQ ID NO: 121919 - protein, 83 aa, Heterodera glycines
  Homolog annotation: Hit_ID=NP_508159.1; Match level="QueryCoverage =86%, HitCoverage=20%, E-value=1e-10, Identity=51%"; Hit description =acyl-CoA thioesterase (XB430) [Caenorhabditis elegans] pir||T29819 hypothetical protein F25E2.3 - Caenorh
  Essential gene: C elegans homolog=C17C3.1a; Phenotype=Unclassified
  Coding regions on vcDNA: vcDNA=SeqID_48342; Strand=+; Position=2-250
INGWHASNGPALSLLGYRKAVNRDVFGGQMFAQAIAAAEATVDGDEFAPNAAHSMFIRKAFIDHPIEYIVTRTRDGRSFCTRT

SEQ ID NO: 121920 - protein, 216 aa, Heterodera glycines
  misc_feature (18)..(18): Xaa can be any naturally occurring amino acid
  misc_feature (199)..(199): Xaa can be any naturally occurring amino acid
  Homolog annotation: Hit_ID=CAE65082.1; Match level="QueryCoverage =99%, HitCoverage=22%, E-value=8e-38, Identity=40%"; Hit description =Hypothetical protein CBG09940 [Caenorhabditis briggsae]
  Gene Ontology: Mol. function=protein kinase activity; Cellular component=spindle pole body; Biological process=embryonic cleavage
  Essential gene: C elegans homolog=R06C7.8; Phenotype=Emb
  Coding regions on vcDNA: vcDNA=SeqID_48343; Strand=+; Position=3-648
KTGTENPWDEEKRNQILXTAHVMVESHAFMTEKCPRFELNRTIHLGGESFSIEDLLGQGGFARVYRANSREDGCTYAIKYESPACPWEVYICSALKRRIPSQFAAYLMEVRDAYIFKNASAIVYEYFPKGTLLDLTNVYKKNGTVVGGLLATFFGIHLARALRQVHETANIIHADVKPDNVMLLTAALNAHDSLDNLLXTPVLKLIDWGRSIDMNH

SEQ ID NO: 121921 - protein, 243 aa, Heterodera glycines
  misc_feature (40)..(40): Xaa can be any naturally occurring amino acid
  Homolog annotation: Hit_ID=CAE66826.1; Match level="QueryCoverage =96%, HitCoverage=5%, E-value=3e-65, Identity=47%"; Hit description =Hypothetical protein CBG12193 [Caenorhabditis briggsae]
  Gene Ontology: Mol. function=dynein ATPase activity; Cellular component=fusome; Biological process=mitotic spindle assembly
  Essential gene: C elegans homolog=T21E12.4; Phenotype=Emb
  Coding regions on vcDNA: vcDNA=SeqID_48344; Strand=+; Position=23-750
KWHHSQIIQETHFAIEDIMMKLGDYVSQWTRYQALWDFNXEMLFERLGTDLCNWMKVLLDTKKARTMVDSPETRHNIFPFVVDFTRVQSKVSIKYDFWQREVLNKFGSALGSSMQQFFSDISKDRHELESQSIDSTNTSSTVALIMHVQSLKKRIKASQEQVDTFLSGQKLLTVHRYPFPQSWLYAENVEGEWSALLDVLNRKDVAIQSQVANLQTRILEEEQLLEKHINDLFAEWNKSKPVH

SEQ ID NO: 121922 - protein, 192 aa, Heterodera glycines
  misc_feature (30)..(30): Xaa can be any naturally occurring amino acid
  misc_feature (58)..(58): Xaa can be any naturally occurring amino acid
  misc_feature (73)..(73): Xaa can be any naturally occurring amino acid
  misc_feature (85)..(85): Xaa can be any naturally occurring amino acid
  misc_feature (169)..(169): Xaa can be any naturally occurring amino acid
  Homolog annotation: Hit_ID=AAN05602.1; Match level="QueryCoverage =93%, HitCoverage=92%, E-value=7e-50, Identity=56%"; Hit description =ribosomal protein S7 [Argopecten irradians]
  Gene Ontology: Mol. function=structural constituent of ribosome; Cellular component=cytosolic small ribosomal subunit (sensu Eukarya); Biological process=morphogenesis
  Essential gene: C elegans homolog=ZC434.2; Phenotype=Lva
  Coding regions on vcDNA: vcDNA=SeqID_48345; Strand=+; Position=1-577
FCWIVILVATFEKLVKTDGKAPDDLEKQLXSALSELAHNSEIKAELCELYFVGAQEYXFGNKKCILVWIPVAXLLDCQMIDPKLXRELEKKMSGCHVIFIAKRRILPKPQRGKNRMPLGQKRSRSRTLTAVHDSILADAVLPTEVGGKRTRVKLDGKQIMKVHLDKAQXTTVEHNVDTFWHLYKRLTGKDVG

SEQ ID NO: 121923 - protein, 246 aa, Heterodera glycines
  misc_feature (239)..(239): Xaa can be any naturally occurring amino acid
  Homolog annotation: Hit_ID=NP_491165.1; Match level="QueryCoverage =97%, HitCoverage=28%, E-value=1e-114, Identity=85%"; Hit description= human Spastic ParapleGia homolog (spg-7) [Caenorhabditis elegans]
  Gene Ontology: Mol. function=chaperone activity; Cellular component =mitochondrion; Biological process=embryonic cleavage
  Essential gene: C elegans homolog=Y47G6A.10; Phenotype=Gro
  Coding regions on vcDNA: vcDNA=SeqID_48346; Strand=+; Position=2-739
KKARPRGGGGGFPGIGNLFGVGQSTARVINREDVKTAFADVAGCEEAKIEIMEFVNFLKNPAQYKALGAKIPKGALLTGPPGTGKTLLAKATAGEANVPFITVSGSEFLEMFVGVGPSRVRDMFEMARKKAPCILFIDEIDAVGRKRGGRGAMGGHSEQENTLNQLLVEMDGFSTDESNVVVIAATNRVDILDPALMRPGRFDRQIFIPVPDIKGRASIFRVHLTPIKTTLDKIELSRXLAAHTPG

SEQ ID NO: 121924 - protein, 55 aa, Heterodera glycines
  Homolog annotation: Hit_ID=NP_741157.1; Match level="QueryCoverage =98%, HitCoverage=96%, E-value=5e-22, Identity=98%"; Hit description =ribosomal Protein, Large subunit, ubiquitin (94.0 kD) (ubq-1) [Caenorhabditis elegans] gb|AAC46525.1| Ubi
  Essential gene: C elegans homolog=F25B5.4a; Phenotype=Emb
  Coding regions on vcDNA: vcDNA=SeqID_48347; Strand=+; Position=37-201
FGYMQIFVKTLTGKTITLEVEASDTIENVKAKIQDKEGIPPDQQRLIFAGKQLED

SEQ ID NO: 121925 - protein, 85 aa, Heterodera glycines
  misc_feature (17)..(17): Xaa can be any naturally occurring amino acid
  misc_feature (35)..(35): Xaa can be any naturally occurring amino acid
  Homolog annotation: Hit_ID=CAE58579.1; Match level="QueryCoverage =89%, HitCoverage=41%, E-value=7e-22, Identity=69%"; Hit description =Hypothetical protein CBG01745 [Caenorhabditis briggsae]
  Gene Ontology: Mol. function=structural constituent of ribosome; Cellular component=cytosolic large ribosomal subunit (sensu Eukarya); Biological process=reproduction
  Essential gene: C elegans homolog=E04A4.8; Phenotype=Emb,Gro
  Coding regions on vcDNA: vcDNA=SeqID_48348; Strand=+; Position=5-261
MFCEAGAGTQCYRDMGXARQRAQADRIQIIKVQTXTVADCKRAGVKQFHNSKIKFPLPHRVNSKRRNMTPFTTHRPRTHFVYRKK

SEQ ID NO: 121926 - protein, 225 aa, Heterodera glycines
  Homolog annotation: Hit_ID=CAF97668.1; Match level="QueryCoverage =71%, HitCoverage=28%, E-value=7e-21, Identity=36%"; Hit description =unnamed protein product [Tetraodon nigroviridis]
  Gene Ontology: Mol. function=DNA replication origin binding; Cellular component=nuclear origin of replication recognition complex; Biological process=DNA replication initiation
  Essential gene: C elegans homolog=F59E10.1; Phenotype =Gro,Pvl,Slu,Stp,Unc
  Coding regions on vcDNA: vcDNA=SeqID_48349; Strand=+; Position=33-707
MIIIHSEGSDEEEEVEEERKSEKWAKCDANRSAFAAVKCCFEKLDNHLPWKFKRNLNGETFGRHFSQWFHFLESGQFSILLHGLGSKRRILEDFRDFLSLRNRRSFVGDGLNPSDTMPKMIDRMTEELKLKGMAKTKEKSVEAAAKALRNAVDAQLRFPIVFILLNIDSPQLRSREHQKALSVLAKSSKVQLIASVDHVNAALIWDQSLRDAFAWLHFPISTFHC

SEQ ID NO: 121927 - protein, 67 aa, Heterodera glycines
  misc_feature (3)..(3): Xaa can be any naturally occurring amino acid
  Homolog annotation: Hit_ID=CAE64609.1; Match level="QueryCoverage =95%, HitCoverage=25%, E-value=2e-16, Identity=60%"; Hit description =Hypothetical protein CBG09365 [Caenorhabditis briggsae]
  Gene Ontology: Mol. function=endopeptidase activity; Cellular component=proteasome core complex (sensu Eukarya); Biological process=ubiquitin-dependent protein catabolism
  Essential gene: C elegans homolog=CD4.6; Phenotype=Emb,Lva,Lvl,Unc
  Coding regions on vcDNA: vcDNA=SeqID_48350; Strand=+; Position=11-211
DRXSAAVAIRSKDYAVVVALMRAQNELSSYQQKVFKLDDHLGLSMSGLISDGRILARFMQSECAEFR

SEQ ID NO: 121928 - protein, 67 aa, Heterodera glycines
  misc_feature (13)..(13): Xaa can be any naturally occurring amino acid
  Homolog annotation: Hit_ID=S30887; Match level="QueryCoverage=100%, HitCoverage=11%, E-value=1e-22, Identity=73%"; Hit description =polyadenylate-binding protein - fruit fly (Drosophila melanogaster)
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_48351; Strand=+; Position=1-200
REIDTIGLYDTFXLFGSILSCKIATDIEGGSKGYGFIHFETEEAANSAIAKVNGMLLDGKKVFVGKF

SEQ ID NO: 121929 - protein, 150 aa, Heterodera glycines
  Homolog annotation: Hit_ID=CAE56922.1; Match level="QueryCoverage =97%, HitCoverage=26%, E-value=2e-25, Identity=35%"; Hit description =Hypothetical protein CBG24767 [Caenorhabditis briggsae]
  Essential gene: C elegans homolog=T19H12.11; Phenotype=Gro
  Coding regions on vcDNA: vcDNA=SeqID_48352; Strand=+; Position=3-452
SAVKTDVLPAPFMKNVIGAFAELPDWHFIVKIEPDDEQSRRMAENVPNIRLTSWAPQPAILSHPRLRLFITHGGYNSLLEGAQSGTPVLSIGFFADQRRNALVAQRNGWGRAFENWKLLEGMNEFRETVKEMWEEDNDHLSRAANRVKTI

SEQ ID NO: 121930 - protein, 70 aa, Heterodera glycines
  misc_feature (55)..(55): Xaa can be any naturally occurring amino acid
  Homolog annotation: Hit_ID=AAC79129.1; Match level="QueryCoverage =98%, HitCoverage=21%, E-value=4e-28, Identity=91%"; Hit description =glyceraldehyde-3-phosphate-dehydrogenase [Globodera rostochiensis] sp|O16027|G3P1_GLORO Glyceraldehyde-3-p
  Gene Ontology: Mol. function=glyceraldehyde 3-phosphate dehydrogenase (phosphorylating) activity; Cellular component=cytoplasm; Biological process=glycolysis
  Essential gene: C elegans homolog=F33H1.2; Phenotype=Emb,Lva
  Coding regions on vcDNA: vcDNA=SeqID_48353; Strand=+; Position=16-225
SGAKKVVISAPSADAPMYVMGVNEDKYDPAKDDVISNALCTTNCLAPLAKGINYXFGIIERLMTTVHAVT

SEQ ID NO: 121931 - protein, 193 aa, Heterodera glycines
  misc_feature (14)..(14): Xaa can be any naturally occurring amino acid
  Homolog annotation: Hit_ID=NP_496273.1; Match level="QueryCoverage =100%, HitCoverage=44%, E-value=1e-95, Identity=72%"; Hit description= transitional endoplasmic reticulum ATPase TER94 (89.8 kD) (2K850) [Caenorhabditis elegans] emb|CAA90050.
  Gene Ontology: Mol. function=protein binding; Cellular component =endoplasmic reticulum; Biological process=microtubule cytoskeleton organization and biogenesis
  Essential gene: C elegans homolog=C06A1.1; Phenotype=Emb
  Coding regions on vcDNA: vcDNA=SeqID_48354; Strand=+; Position=3-580
RFDREIDIGIPDAXGRLEILRIHTKNMKLADDVDLEKIANECHGYVGADLAALCSEAAMQQIRQKMELIDLESENIDAEVLAQLAVTMDDFQFALGKNSPSALRETVVETPNVTWEDIGGLENVKRELQELVQYPVEHPEMFLKFGMQPSRGVLFYGPPGCGKTLLAKAIARECQANFISIKGPELLTMWFGE

SEQ ID NO: 121932 - protein, 67 aa, Heterodera glycines
  Homolog annotation: Hit_ID=NP_741529.1; Match level="QueryCoverage =97%, HitCoverage=14%, E-value=4e-23, Identity=69%"; Hit description =adenylosuccinate synthetase, possibly N-myristoylated (50.2 kD) (5F298) [Caenorhabditis elegans] gb|AAM29
  Gene Ontology: Mol. function=protein binding; Biological process =purine nucleotide biosynthesis
  Essential gene: C elegans homolog=C37H5.6a; Phenotype =Emb,Gro,Pvl,Stp,Unc
  Coding regions on vcDNA: vcDNA=SeqID_48355; Strand=+; Position=103-303
MSPSSISILLGAQWGDEGKGKVLDFLIGHHRIDIVARCQGGNNAGHTVLANGREYHFHLLPSGLASD

SEQ ID NO: 121933 - protein, 207 aa, Heterodera glycines
  misc_feature (22)..(22): Xaa can be any naturally occurring amino acid
  misc_feature (161)..(161): Xaa can be any naturally occurring amino acid
  Homolog annotation: Hit_ID=AAL78224.1; Match level="QueryCoverage =97%, HitCoverage=92%, E-value=1e-103, Identity=93%"; Hit description= hypothetical protein Hgg-30 [Heterodera glycines]
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_48356; Strand=+; Position=1-622
TVCRAQKKSERQAELKRRYEQXKAERIQRYQGVNLYVKNLHDTINDETLRSNFESYGNITSAKVMCDEHGRSKGFGFVCFEKADEATKAVVEMNNKIIENKPLYVALAQRKEDRKAQLASQYMQRLAAVRMQNPAGLMGTMYAPASGGFFLPQAIQNQRAXAVHANTESVRGTNAWRCPSLEQYGRFQSSNARLHDGSSWWRSVRRR

SEQ ID NO: 121934 - protein, 203 aa, Heterodera glycines
  Homolog annotation: Hit_ID=AAL78223.1; Match level="QueryCoverage =81%, HitCoverage=83%, E-value=4e-76, Identity=77%"; Hit description =hypothetical protein Hgg-29 [Heterodera glycines]
  Essential gene: C elegans homolog=ZC373.5; Phenotype=Unc
  Coding regions on vcDNA: vcDNA=SeqID_48357; Strand=+; Position=38-649
MRDLFIEDNSPITPARLAELIRHFYALGWMRDNGGGMAVLCNGAVFGSPTSVQKEKVSENDLFVIDATTGTVLKRPQNAASVPSATCGLLMNTGVENRSSGLRLDNVDRLVVPTVDSELNEQMLSPVLLRTLDKYTEASAILVRGHGFFVFGSHCWQSTKMMLECYEYLFELACEMIKYKLPLVPKSPKIKIMRQFTRNTTTA

SEQ ID NO: 121935 - protein, 171 aa, Heterodera glycines
  misc_feature (27)..(28): Xaa can be any naturally occurring amino acid
  Homolog annotation: Hit_ID=NP_498534.1; Match level="QueryCoverage =100%, HitCoverage=39%, E-value=7e-63, Identity=68%"; Hit description= UBiquitin Activating enzme related, ectopic membrane RuFfLes in embryo RFL-1, CYtoKinesis defect CYK-5 (
  Gene Ontology: Mol. function=NEDD8 activating enzyme activity; Biological process=endomitotic cell cycle
  Essential gene: C elegans homolog=F11H8.1; Phenotype=Emb
  Coding regions on vcDNA: vcDNA=SeqID_48358; Strand=+; Position=3-517
IICGLDSIEARRWLNATVCSLVECDDXXPKIHTIVPLIDGGTEGFKGNSRAIIPFMTPCIQCTIDLYTSQVNFPLCTIAHTPRLAEHCVEYVKVLLWEKEKPFGQDVKLDADDPAHVQWAFRAAQQRANEYEIKDVDLRLSQGVLKRIIPAVGSTNAVIAGSCALEALKLA

SEQ ID NO: 121936 - protein, 98 aa, Heterodera glycines
  misc_feature (84)..(84): Xaa can be any naturally occurring amino acid
  Homolog annotation: Hit_ID=CAA75628.1; Match level="QueryCoverage =93%, HitCoverage=26%, E-value=2e-21, Identity=51%"; Hit description =adenosine kinase [Physcomitrella patens] sp|O49923|ADK_PHYPA Adenosine kinase (AK) (Adenosine 5'-phosphotr
  Gene Ontology: Mol. function=adenosine kinase activity; Biological process=ribonucleoside monophosphate biosynthesis
  Essential gene: C elegans homolog=R07H5.8; Phenotype=Gro
  Coding regions on vcDNA: vcDNA=SeqID_48359; Strand=+; Position=115-411
LKSEKVNGEMKRIVMITQGPLPVLVAHDRELTQFPVEPISEDKIVDTNGAGDAFCGGFLAAFSTGRSLDLCVRAGNFAARTIIXHIGCTFPNECAYLE

SEQ ID NO: 121937 - protein, 174 aa, Heterodera glycines
  Homolog annotation: Hit_ID=NP_740802.1; Match level="QueryCoverage =90%, HitCoverage=18%, E-value=4e-21, Identity=38%"; Hit description =zebrafish dead eye like, Nuclear Pore complex Protein NPP-13 (npp -13) [Caenorhabditis elegans] gb|AAK2786
  Gene Ontology: Biological process=embryogenesis and morphogenesis
  Essential gene: C elegans homolog=Y37E3.15a; Phenotype=Emb
  Coding regions on vcDNA: vcDNA=SeqID_48360; Strand=+; Position=3-524
VNRKGRALCCSGSEYIVHAVHLAILAHQLRLLMTVPKVSDELLTTDVHEPSVCRLNLARLLLLFVKDFELSNIEYAINYCFFARDFKLDTPSADNATIRQEGRSVFVAAVSRIVFMSGHREAILGRLDSQGNRVPGLIDKFKDAMDICELIASIAFDTHVQGHSFAACHLYALA

SEQ ID NO: 121938 - protein, 119 aa, Heterodera glycines; identical to SEQ ID NO: 121530
  Homolog annotation: Hit_ID=AAN32889.1; Match level="QueryCoverage =100%, HitCoverage=100%, E-value=1e-60, Identity=97%"; Hit description=ubiquitin extension protein [Heterodera glycines]
  Gene Ontology: Biological process=cell cycle
  Essential gene: C elegans homolog=F25B5.4a; Phenotype=Emb
  Coding regions on vcDNA: vcDNA=SeqID_48361; Strand=+; Position=87-446

SEQ ID NO: 121939 - protein, 114 aa, Heterodera glycines
  misc_feature (56)..(56): Xaa can be any naturally occurring amino acid
  Homolog annotation: Hit_ID=CAB59358.1; Match level="QueryCoverage =100%, HitCoverage=24%, E-value=3e-50, Identity=85%"; Hit description= translation elongation factor eEF-1 alpha chain [Anisakis simplex]
  Gene Ontology: Mol. function=protein-synthesizing GTPase activity, elongation; Cellular component=cytoplasm; Biological process=protein biosynthesis
  Essential gene: C elegans homolog=R03G5.1a; Phenotype=Emb,Lva,Unc
  Coding regions on vcDNA: vcDNA=SeqID_48362; Strand=+; Position=1-344
QIAAGYTPVLDCHTAHIACKFAELKEKVARRSGKKVEDNPKALKTGDAGIVDLIPXKPMCVEAFTDYAPLGRFAVRDMRQTVAVGVIKAVEKTEGGGKVTKSAQKAAAPGGKKK

SEQ ID NO: 121940 - protein, 212 aa, Heterodera glycines
  misc_feature (10)..(10): Xaa can be any naturally occurring amino acid
  Homolog annotation: Hit_ID=BAA22203.1; Match level="QueryCoverage =100%, HitCoverage=47%, E-value=1e-114, Identity=91%"; Hit description=alpha-3 tubulin [Caenorhabditis elegans]
  Gene Ontology: Mol. function=GTP binding; Cellular component =microtubule; Biological process=microtubule-based process
  Essential gene: C elegans homolog=C47B2.3; Phenotype=Emb
  Coding regions on vcDNA: vcDNA=SeqID_48363; Strand=+; Position=3-636
EHSDCALWLXHEAIYDICRRNLDVERPSYTNLNRLISQVVSSITASLRFDGALNVDLTEFQTNLVPYPRIHFPLATYSPVISAEKAYHESLSVSEITNMCFEPSNQMVKCDPRHGKYMAVCLLYRGDVVPKDVNAAIASIKTNRSIQFVDWCPTGFKVGINYQPPTVVPGGDVAKVPRAVCMLSNTTAIAEAWARLDHKFDLMYAKRAFVHW

SEQ ID NO: 121941 - protein, 197 aa, Heterodera glycines
  misc_feature (65)..(65): Xaa can be any naturally occurring amino acid
  Homolog annotation: Hit_ID=NP_036172.1; Match level="QueryCoverage =95%, HitCoverage=24%, E-value=1e-35, Identity=42%"; Hit description =cullin 1 [Mus musculus] gb|AAH29260.1| Cullin 1 [Mus musculus] gb|AAD16038.1| SCF complex protein cul-1 [
  Gene Ontology: Mol. function=protein binding; Cellular component=SCF ubiquitin ligase complex; Biological process=apoptosis
  Essential gene: C elegans homolog=D2045.6; Phenotype=Emb
  Coding regions on vcDNA: vcDNA=SeqID_48364; Strand=+; Position=3-594
SRVFPQFLCKRLVYDTSASEEQERCMIAKLKHMCGFEYTSKLERVLTDVALSRDRSEQYKHAAEXCNVDFSVIVVMSNVWPLGQAVQFDIPRPLLDCIDSYTQYYTNRFNGRKLTWALQMCRGELVSTSNTFKDKYSFLCNTQQIAILMQYNERNTYTLDELHVALGTDFPADQLCAVVQSLVKTNLLKLTSAHGTA

SEQ ID NO: 121942 - protein, 156 aa, Heterodera glycines
  Homolog annotation: Hit_ID=CAE68603.1; Match level="QueryCoverage =94%, HitCoverage=78%, E-value=1e-34, Identity=50%"; Hit description =Hypothetical protein CBG14479 [Caenorhabditis briggsae]
  Gene Ontology: Mol. function=Rho GDP-dissociation inhibitor activity; Cellular component=cytoplasmic vesicle; Biological process=negative regulation of cell adhesion
  Essential gene: C elegans homolog=F46H6.1; Phenotype=Unc
  Coding regions on vcDNA: vcDNA=SeqID_48365; Strand=+; Position=1-471
RKPEKIKEQLLGENASGPVLVEPDNPKNVLVRRITLVSDDQVKHSMDLPAKGDFVFCVKESCTYRIRFEFVVQREIICGLKYAHKVSRLGVGVTKELYMLGSYGPRHEPYTYETSPEEAPSGILSRGKYRVHSLITDDDKNIWLDWSWHIEIAKSW

SEQ ID NO: 121943 - protein, 43 aa, Heterodera glycines
  misc_feature (12)..(12): Xaa can be any naturally occurring amino acid
  Homolog annotation: Hit_ID=AAN15196.1; Match level="QueryCoverage =81%, HitCoverage=9%, E-value=5e-12, Identity=97%"; Hit description =actin [Globodera rostochiensis] gb|AAN78299.1| actin 1 [Heterodera glycines] gb|AAG47837.2| actin 1 [Hetero
  Gene Ontology: Mol. function=structural constituent of cytoskeleton; Cellular component=actin filament; Biological process=cytoskeleton organization and biogenesis
  Essential gene: C elegans homolog=T04C12.5; Phenotype=Ste
  Coding regions on vcDNA: vcDNA=SeqID_48366; Strand=+; Position=3-133
AVLSLYASGRTXGLVLDSGDGVTHTVPIYEGYALPSRHTTFWT

SEQ ID NO: 121944 - protein, 36 aa, Heterodera glycines
  Homolog annotation: Hit_ID=CAA25004.1; Match level="QueryCoverage =100%, HitCoverage=9%, E-value=1e-15, Identity=100%"; Hit description= beta-actin [Gallus gallus]
  Gene Ontology: Mol. function=structural constituent of cytoskeleton; Cellular component=cytoskeleton; Biological process=actin cytoskeleton organization and biogenesis
  Essential gene: C elegans homolog=T04C12.6; Phenotype=Ste
  Coding regions on vcDNA: vcDNA=SeqID_48367; Strand=+; Position=3-110
KRGILTLKYPIEHGIVTNWDDMEKIWHHTFYNELRV

SEQ ID NO: 121945 - protein, 42 aa, Heterodera glycines
  Homolog annotation: Hit_ID=RGKWB; Match level="QueryCoverage=97%, HitCoverage=12%, E-value=1e-16, Identity=97%"; Hit description=GTP -binding regulatory protein beta chain - Caenorhabditis elegans emb|CAA35532.1| G-protein [Caenorhabditis el
  Gene Ontology: Mol. function=heterotrimeric G-protein GTPase activity; Cellular component=heterotrimeric G-protein complex; Biological process=G-protein coupled receptor protein signaling pathway
  Essential gene: C elegans homolog=F13D12.7; Phenotype=Emb
  Coding regions on vcDNA: vcDNA=SeqID_48368; Strand=+; Position=3-128
DWASDSRNLVSASQDGKLIVWDSYTTNKVHAIPLLSSWVMTC

SEQ ID NO: 121946 - protein, 53 aa, Heterodera glycines
  Homolog annotation: Hit_ID=CAE62787.1; Match level="QueryCoverage =86%, HitCoverage=8%, E-value=1e-09, Identity=60%"; Hit description =Hypothetical protein CBG06960 [Caenorhabditis briggsae]
  Essential gene: C elegans homolog=F59E12.4a; Phenotype=Emb,Lva,Unc
  Coding regions on vcDNA: vcDNA=SeqID_48369; Strand=+; Position=54-212
MLPSNPDDKIDEVDKILSKLDGKIERKMDPLMCRHNQRQKCTNCLPLDPYDEK

SEQ ID NO: 121947 - protein, 89 aa, Heterodera glycines
  Homolog annotation: Hit_ID=NP_498363.1; Match level="QueryCoverage =87%, HitCoverage=17%, E-value=6e-24, Identity=66%"; Hit description =imidazolonepropionase (3H359) [Caenorhabditis elegans] gb|AAC24449.1| Hypothetical protein T12A2.1 [Caeno
  Essential gene: C elegans homolog=T12A2.1; Phenotype=Unclassified
  Coding regions on vcDNA: vcDNA=SeqID_48370; Strand=+; Position=5-271
FEEISSRFNSKELTDVTRVDCGGGSVLPGMADAHSHPVFSGDRVHEFAMKLAGATYMEVQAAGGGIHFSTEKTREATEEQLLEDFLEIA

SEQ ID NO: 121948 - protein, 101 aa, Heterodera glycines
  Homolog annotation: Hit_ID=AAM28852.1; Match level="QueryCoverage =92%, HitCoverage=76%, E-value=2e-37, Identity=79%"; Hit description =ribosomal protein S20 [Branchiostoma belcheri tsingtaunese]
  Gene Ontology: Mol. function=structural constituent of ribosome; Cellular component=eukaryotic 48S initiation complex; Biological process=protein biosynthesis
  Essential gene: C elegans homolog=Y105E8A.16; Phenotype=Lva,Sma
  Coding regions on vcDNA: vcDNA=SeqID_48371; Strand=+; Position=1-306
HYPNIQNVKSLEKVCEQLIRGAKDENLVVKGPVRMPTKILRITTRKTPCGEGSKTWDRFQMRIHKRIINLNSSSDVLKKITGISIEPGVDVEVTIAESPSN

SEQ ID NO: 121949 - protein, 130 aa, Heterodera glycines
  Homolog annotation: Hit_ID=CAE67904.1; Match level="QueryCoverage =93%, HitCoverage=39%, E-value=2e-32, Identity=51%"; Hit description =Hypothetical protein CBG13501 [Caenorhabditis briggsae]
  Gene Ontology: Mol. function=purine-nucleoside phosphorylase activity; Biological process=DNA modification
  Essential gene: C elegans homolog=K02D7.1; Phenotype=Unc
  Coding regions on vcDNA: vcDNA=SeqID_48372; Strand=+; Position=47-436
MPTAANDCNNNSIEDIQSDRRRGPIDPTNFDHLVRLSELIRSMADLGTLQPEFGTICGSGLGAIADQMEGARILPFSEVPGFPQPSVIGHKGNLVFGRIGGHFCMCLQGRFHPYEHKMDMALCTMPVRLM

SEQ ID NO: 121950 - protein, 82 aa, Heterodera glycines
  misc_feature (55)..(55): Xaa can be any naturally occurring amino acid
  Homolog annotation: Hit_ID=AAO14563.2; Match level="QueryCoverage =91%, HitCoverage=10%, E-value=1e-36, Identity=98%"; Hit description =Hsp90 [Heterodera glycines]
  Gene Ontology: Biological process=reproduction
  Essential gene: C elegans homolog=C47E8.5; Phenotype=Emb,Ste
  Coding regions on vcDNA: vcDNA=SeqID_48373; Strand=+; Position=1-245
GRKGGVLKSLSNDWEDHLAVKHFSVEGQLEFRALLFVPQRAPFDLFENKKSKNAXKLYVRRVFIMENCEELMPEYLNFIKGV

SEQ ID NO: 121951 - protein, 67 aa, Heterodera glycines
  misc_feature (60)..(60): Xaa can be any naturally occurring amino acid
  Homolog annotation: Hit_ID=XP_312337.1; Match level="QueryCoverage =77%, HitCoverage=94%, E-value=1e-18, Identity=92%"; Hit description =ENSANGP00000024710 [Anopheles gambiae]
  Essential gene: C elegans homolog=ZK1010.1; Phenotype=Emb
  Coding regions on vcDNA: vcDNA=SeqID_48374; Strand=+; Position=2-202
AAKERSNSHPFNLAIMQIFVKTLTGKTITLEVEASDTIENVKAKIQDKEGIPPDQQRLIXRWGKQLE

SEQ ID NO: 121952 - protein, 108 aa, Heterodera glycines
  misc_feature (55)..(55): Xaa can be any naturally occurring amino acid
  Homolog annotation: Hit_ID=CAE57828.1; Match level="QueryCoverage =86%, HitCoverage=45%, E-value=6e-32, Identity=74%"; Hit description =Hypothetical protein CBG00853 [Caenorhabditis briggsae]
  Gene Ontology: Mol. function=endopeptidase Clp activity; Cellular component=mitochondrion; Biological process=misfolded or incompletely synthesized protein catabolism
  Essential gene: C elegans homolog=ZK970.2; Phenotype =Emb,Gro,Pvl,Slu,Sma,Stp
  Coding regions on vcDNA: vcDNA=SeqID_48375; Strand=+; Position=2-324
AARAEFRKGIYFTPGIGQASSMGSLLLTAGAKGMRTSLPNARIMVHQPSGGAYGXAADIVIRAEEINRMRKRLNEIYAMHTGQTVETIDQALDRDRFMSALEAQEFGL

SEQ ID NO: 121953 - protein, 195 aa, Heterodera glycines
  misc_feature (46)..(46): Xaa can be any naturally occurring amino acid
  misc_feature (179)..(179): Xaa can be any naturally occurring amino acid
  Homolog annotation: Hit_ID=CAA65506.1; Match level="QueryCoverage =97%, HitCoverage=93%, E-value=3e-54, Identity=47%"; Hit description =cuticular collagen [Teladorsagia circumcincta]
  Gene Ontology: Mol. function=structural constituent of cuticle; Cellular component=extracellular; Biological process=cuticle biosynthesis (sensu Nematoda)
  Essential gene: C elegans homolog=T07H6.3a; Phenotype=Bmd,Gro,Unc
  Coding regions on vcDNA: vcDNA=SeqID_48376; Strand=+; Position=42-626
MADFDKHAAQREAESLRTLAFFGVCLSTVATVIAVLSVPFAYQHFXQIGAQMQNEVDFCKMRSGNMWREVTRTQAYSKVSHDSRHKRQAGGCCGCGVSPPGPPGPPGPSGQPGGDGQPGGSGQPGAPGQAAPRPYPPSGGCVPQCEAAQPGLPGPPGPPGPEGQNGQPGQSAPPASPGXPGPQGPPGPDGQPGNP

SEQ ID NO: 121954 - protein, 133 aa, Heterodera glycines
  misc_feature (98)..(98): Xaa can be any naturally occurring amino acid
  Homolog annotation: Hit_ID=NP_499915.1; Match level="QueryCoverage =97%, HitCoverage=39%, E-value=3e-44, Identity=63%"; Hit description =ribosomal Protein, Small subunit (rps-24) [Caenorhabditis elegans] gb|AAK39283.2| Ribosomal protein, smal
  Gene Ontology: Cellular component=eukaryotic 48S initiation complex; Biological process=protein biosynthesis
  Essential gene: C elegans homolog=T07A9.11; Phenotype=Lva
  Coding regions on vcDNA: vcDNA=SeqID_48377; Strand=-; Position=67-467
MVEGGVITLHTRKVLNNRLLFRKQMVVDILHPNRASVPKSEVRERLAKLYKTTQDVVVAYGFRCQFGGGRSTGFANVYDSLDYAKRFEAKYRLLRQGXWSEKKKGGRKQRKERKNRQKKVRGVKKVKVQAGKK

SEQ ID NO: 121955 - protein, 65 aa, Heterodera glycines
  Homolog annotation: Hit_ID=NP_497663.1; Match level="QueryCoverage =100%, HitCoverage=14%, E-value=5e-28, Identity=86%"; Hit description= MEChanosensory abnormality MEC-12, TuBulin, Alpha, specific of 15 protofilament microtubules found in me
  Gene Ontology: Mol. function=GTP binding; Cellular component =microtubule; Biological process=spindle assembly
  Essential gene: C elegans homolog=F44F4.11; Phenotype=Emb,Gro
  Coding regions on vcDNA: vcDNA=SeqID_48378; Strand=+; Position=67-261
MREVISIHVGQAGVQIGNACWELYCLEHGIQPDGKMPSDQNNQDDSFSTFFSETGNGRHVPRAVM

SEQ ID NO: 121956 - protein, 122 aa, Heterodera glycines
  Homolog annotation: Hit_ID=BAA92244.1; Match level="QueryCoverage =77%, HitCoverage=30%, E-value=2e-16, Identity=43%"; Hit description =type 1 protein phosphatase-1 [Vicia faba]
  Gene Ontology: Mol. function=protein serine/threonine phosphatase activity; Cellular component=cytoplasm; Biological process=cell cycle
  Essential gene: C elegans homolog=W09C3.6; Phenotype=Ste
  Coding regions on vcDNA: vcDNA=SeqID_48379; Strand=+; Position=60-425
MAKEEYCFDAKAAAAAGQSRRPSTTASVLVQGDGQSSRFVDAIIRKVTQPPLQRFTDEITDEELKQLCKAATDVFRMQPTLVRIRPPVVVVGDIHGQFSDLQRIFTTHGPPPEQQYMFLGDY

SEQ ID NO: 121957 - protein, 69 aa, Heterodera glycines
  Homolog annotation: Hit_ID=NP_505074.1; Match level="QueryCoverage =100%, HitCoverage=22%, E-value=2e-24, Identity=78%"; Hit description= COLlagen structural gene (29.5 kD) (col-43) [Caenorhabditis elegans] gb|AAC48270.1| Collagen protein 43
  Gene Ontology: Mol. function=structural constituent of cuticle; Cellular component=extracellular; Biological process=cuticle biosynthesis (sensu Nematoda)
  Essential gene: C elegans homolog=F23H12.4; Phenotype =Bmd,Dpy,Emb,Lva,Unc
  Coding regions on vcDNA: vcDNA=SeqID_48380; Strand=+; Position=27-233
MTESDSRIRAYKFVAYSAVTFSIVAVLSVVVTLPMVYNYVAHVRRQMQHELGFCKGSAKDIYVEVNHMK

SEQ ID NO: 121958 - protein, 169 aa, Heterodera glycines
  misc_feature (45)..(45): Xaa can be any naturally occurring amino acid
  misc_feature (71)..(71): Xaa can be any naturally occurring amino acid
  Homolog annotation: Hit_ID=CAA65506.1; Match level="QueryCoverage =99%, HitCoverage=77%, E-value=2e-49, Identity=50%"; Hit description =cuticular collagen [Teladorsagia circumcincta]
  Gene Ontology: Mol. function=structural constituent of cuticle; Cellular component=extracellular; Biological process=cuticle biosynthesis (sensu Nematoda)
  Essential gene: C elegans homolog=T07H6.3a; Phenotype=Bmd,Gro,Unc
  Coding regions on vcDNA: vcDNA=SeqID_48381; Strand=+; Position=34-543
MQNEVDFCKMRSGNMWREVTRTQAYSKVSHDSRHKRQAGGCCGCXVSPPGPPGPPGPSGQPGGDGQPGGSXQPGAPGQAAPRPYPPSGGCVPQCEAAQPGLPGPPGPPGPEGQNGQPGQSAPPASPGRPGPQGPPGPDGQPGNPGESGQPGQPGKLTQAPPSLGPPGPA

SEQ ID NO: 121959 - protein, 80 aa, Heterodera glycines
  Homolog annotation: Hit_ID=XP_393173.1; Match level="QueryCoverage =81%, HitCoverage=14%, E-value=6e-29, Identity=98%"; Hit description =similar to Hypothetical protein CBG09037 [Apis mellifera]
  Essential gene: C elegans homolog=ZK1010.1; Phenotype=Emb
  Coding regions on vcDNA: vcDNA=SeqID_48382; Strand=+; Position=3-242
PPRFERSNSHPFNLAIMQIFVKTLTGKTITLEVEASDTIENVKAKIQDKEGIPPDQQRLIFAGKQLEDGRTLADYNIQKE

SEQ ID NO: 121960 - protein, 144 aa, Heterodera glycines
  Homolog annotation: Hit_ID=NP_493271.1; Match level="QueryCoverage =95%, HitCoverage=46%, E-value=3e-31, Identity=50%"; Hit description =proteasome Beta Subunit (29.9 kD) (pbs-2) [Caenorhabditis elegans] emb|CAB16855.1| Hypothetical protein C
  Gene Ontology: Mol. function=endopeptidase activity; Cellular component=proteasome core complex (sensu Eukarya); Biological process=locomotory behavior
  Essential gene: C elegans homolog=C47B2.4; Phenotype=Emb,Lva,Unc
  Coding regions on vcDNA: vcDNA=SeqID_48383; Strand=+; Position=1-432
GRQGLAEFDFSLCERNHALKRQMDGEGFGKQFENMTKMTSSGTTVVGAIFQDGVVLGGDSRSTQGNIIANKNSMKVHYLTDRIYASGAGGAADLEKVSQIISAELRLFELNSGLQARVVMAVRRLRQYLFKYMGHVSCYYLVGG

SEQ ID NO: 121961 - protein, 88 aa, Heterodera glycines
  Homolog annotation: Hit_ID=NP_741303.1; Match level="QueryCoverage =92%, HitCoverage=18%, E-value=1e-18, Identity=55%"; Hit description =signal recognition particle receptor (4B988) [Caenorhabditis elegans] emb|CAB04354.1| Hypothetical protei
  Gene Ontology: Mol. function=signal recognition particle binding; Cellular component=integral to membrane; Biological process =cotranslational membrane targeting
  Essential gene: C elegans homolog=F38A1.8; Phenotype=Emb,Ste
  Coding regions on vcDNA: vcDNA=SeqID_48384; Strand=+; Position=1-264
GRQGDSENDHGESGAKPKGISASGGWFSAFKSLVGTKQLARGDIEPAMEKMKEMLITKNVASEPAERICESVAAKLEGKVIGTFNRVA

SEQ ID NO: 121962 - protein, 154 aa, Heterodera glycines
  Homolog annotation: Hit_ID=NP_493271.1; Match level="QueryCoverage =88%, HitCoverage=46%, E-value=3e-31, Identity=50%"; Hit description =proteasome Beta Subunit (29.9 kD) (pbs-2) [Caenorhabditis elegans] emb|CAB16855.1| Hypothetical protein C
  Gene Ontology: Mol. function=endopeptidase activity; Cellular component=26S proteasome; Biological process=locomotory behavior
  Essential gene: C elegans homolog=C47B2.4; Phenotype=Emb,Lva,Unc
  Coding regions on vcDNA: vcDNA=SeqID_48385; Strand=+; Position=1-462
GRLAPELLNKSVGGLAEFDFSLCERNHALKRQMDGEGFGKQFENMTKMTSSGTTVVGAIFQDGVVLGGDSRSTQGNIIANKNSMKVHYLTDRIYASGAGGAADLEKVSQIISAELRLFELNSGLQARVVMAVRRLRQYLFKYMGHVSCYYLVGG

SEQ ID NO: 121963 - protein, 137 aa, Heterodera glycines
  Homolog annotation: Hit_ID=AAK94490.1; Match level="QueryCoverage =73%, HitCoverage=10%, E-value=2e-15, Identity=43%"; Hit description =PAZ/Piwi domain protein [Heterodera glycines]
  Gene Ontology: Cellular component=eukaryotic 48S initiation complex; Biological process=gametogenesis
  Essential gene: C elegans homolog=F55A12.1; Phenotype=Emb
  Coding regions on vcDNA: vcDNA=SeqID_48386; Strand=+; Position=2-412
AAKFFLEEEGREGRPFNQNLTPGSVIQEKVTRADITEFFLQPHAPIQGTGKPVEYAMLEDEIGISMDELQGVIMALSYSHQIVNVAVSMPEPVYQAHELAKRGKNNFVTLKRFKPERVPKIDKQIVAKGGKRQIISI

SEQ ID NO: 121964 - protein, 170 aa, Heterodera glycines
  Homolog annotation: Hit_ID=CAA65506.1; Match level="QueryCoverage =97%, HitCoverage=94%, E-value=2e-44, Identity=52%"; Hit description =cuticular collagen [Teladorsagia circumcincta]
  Gene Ontology: Mol. function=structural constituent of cuticle; Cellular component=extracellular; Biological process=cuticle biosynthesis (sensu Nematoda)
  Essential gene: C elegans homolog=T07H6.3a; Phenotype=Bmd,Gro,Unc
  Coding regions on vcDNA: vcDNA=SeqID_48387; Strand=+; Position=34-543
MADFDKHAAQREAESLRTLAFFGVCLSTVATVIAVLSVPFAYQHFQQIGAQMQNEVDFCKMRSGNMWREVTRTQAYSKVSHDSRHKRQAGGCCGCGVSPPGPPGPPGPSGQPGGDGQPGGSGQPGAPGQAAPRPYPPSGGCVPQCEAAQPGLPGPPGPPGPEGQNGQPGQ

SEQ ID NO: 121965 - protein, 181 aa, Heterodera glycines
  Homolog annotation: Hit_ID=AAO14563.2; Match level="QueryCoverage =98%, HitCoverage=24%, E-value=7e-96, Identity=98%"; Hit description =Hsp90 [Heterodera glycines]
  Gene Ontology: Mol. function=heat shock protein activity; Cellular component=centrosome; Biological process=reproduction
  Essential gene: C elegans homolog=C47E8.5; Phenotype=Emb,Ste
  Coding regions on vcDNA: vcDNA=SeqID_48388; Strand=+; Position=3-545
PPSSSDALDKIRYQALTDPSQMESGKELFIKIVPNKADKTLTIIDTGIGMTKADLVNNLGTIAKSGTKAFMEALQAGADISMIGQFGVGFYSAFLVADRVTVTSKHNDDDCYQWESSAGGSFIIRNCVDPEVTRGTKIVLHLKEDQTDYLEERRVREVVKKHSQFIGYPIKLLVEKERDKE

SEQ ID NO: 121966 - protein, 71 aa, Heterodera glycines
  Homolog annotation: Hit_ID=XP_393173.1; Match level="QueryCoverage =91%, HitCoverage=14%, E-value=6e-29, Identity=98%"; Hit description =similar to Hypothetical protein CBG09037 [Apis mellifera]
  Essential gene: C elegans homolog=ZK1010.1; Phenotype=Emb
  Coding regions on vcDNA: vcDNA=SeqID_48389; Strand=+; Position=30-242
HPFNLAIMQIFVKTLTGKTITLEVEASDTIENVKAKIQDKEGIPPDQQRLIFAGKQLEDGRTLADYNIQKE

SEQ ID NO: 121967 - protein, 150 aa, Heterodera glycines
  Homolog annotation: Hit_ID=EAL26272.1; Match level="QueryCoverage =71%, HitCoverage=30%, E-value=3e-16, Identity=42%"; Hit description =GA10102-PA [Drosophila pseudoobscura]
  Gene Ontology: Mol. function=protein serine/threonine phosphatase activity; Cellular component=cytoplasm; Biological process=cell cycle
  Essential gene: C elegans homolog=W09C3.6; Phenotype=Ste
  Coding regions on vcDNA: vcDNA=SeqID_48390; Strand=+; Position=1-450
PSRAAAKIVIIYCSSSAHFNPTKRRARRNNGKRGLLLRCNGGGSGGAVSAFGNDFNTCSCYGLSSSFVDAIIRKVRHSPVQRFTDEITDEELKQLCMAATDIFRMQPTLVRIQPPVVVVGDIHGQFTDLQRIFHTHGNPPEQQYVFLGDY

SEQ ID NO: 121968 - protein, 208 aa, Heterodera glycines
  misc_feature (23)..(23): Xaa can be any naturally occurring amino acid
  Homolog annotation: Hit_ID=AAO14563.2; Match level="QueryCoverage =100%, HitCoverage=28%, E-value=1e-111, Identity=98%"; Hit description=Hsp90 [Heterodera glycines]
  Gene Ontology: Mol. function=heat shock protein activity; Cellular component=centrosome; Biological process=reproduction
  Essential gene: C elegans homolog=C47E8.5; Phenotype=Emb,Ste
  Coding regions on vcDNA: vcDNA=SeqID_48391; Strand=+; Position=40-662
MSEQSGETFAFQAEIAQLMSLIXNTFYSNKEIFLRELISNFFDALDKIRYQALTDPSQMESGKELFIKIVPNKADKTLTIIDTGIGMTKADLVNNLGTIAKSGTKAFMEALQAGADISMIGQFGVGFYSAFLVADRVTVTSKHNDDDCYQWESSAGGSFIIRNCADPEVTRGTKIVLHLKEDQTDYLEERRVREVVKKHSQFIGYPIK

SEQ ID NO: 121969 - protein, 134 aa, Heterodera glycines
  Homolog annotation: Hit_ID=NP_499964.1; Match level="QueryCoverage =100%, HitCoverage=65%, E-value=2e-60, Identity=79%"; Hit description= ribosomal Protein, Large subunit (24.1 kD) (rpl-15) [Caenorhabditis elegans] gb|AAC24397.1| Ribosomal pr
  Gene Ontology: Mol. function=structural constituent of ribosome; Cellular component=cytosolic large ribosomal subunit (sensu Eukarya); Biological process=protein biosynthesis
  Essential gene: C elegans homolog=K11H12.2; Phenotype=Gro,Stp
  Coding regions on vcDNA: vcDNA=SeqID_48392; Strand=+; Position=65-466
MGAYKYMQELWRKKQSEVMRYLLRIRCWQYRQMEAIHRCTRPTRPEKARRLGYKAKQGFLIYRVRIRRGGRKRQVTKGQTYGKPKTHGVNQLKNTRSLQAVAEARAGRRLGELRVLNSYWVGQDSTYKFFEVIL

SEQ ID NO: 121970 - protein, 130 aa, Heterodera glycines
  Homolog annotation: Hit_ID=NP_508413.1; Match level="QueryCoverage =100%, HitCoverage=66%, E-value=6e-64, Identity=90%"; Hit description= ribosomal Protein, Large subunit (22.8 kD) (rpl-11.2) [Caenorhabditis elegans] gb|AAA83599.1| Ribosomal
  Gene Ontology: Mol. function=structural constituent of ribosome; Cellular component=cytosolic large ribosomal subunit (sensu Eukarya); Biological process=protein biosynthesis
  Essential gene: C elegans homolog=F07D10.1; Phenotype=Lva
  Coding regions on vcDNA: vcDNA=SeqID_48393; Strand=+; Position=119-508
EIKDSKLCLNICVGESGDRLTRAAKVLEQLTGQTPVLSKARYTVRSFGIRRNEKIAVHCTVRGPKAEEIIDRGLKVKEYELYRENFSDTGNFGFGIQEHIDLGIKYDPSIGIYGMDFYVVLGRAGLRVAK

SEQ ID NO: 121971 - protein, 230 aa, Heterodera glycines
  misc_feature (228)..(228): Xaa can be any naturally occurring amino acid
  Homolog annotation: Hit_ID=NP_500784.1; Match level="QueryCoverage =97%, HitCoverage=46%, E-value=2e-74, Identity=59%"; Hit description =amino acid/polyamine transporter, family II (53.3 kD) (4G107) [Caenorhabditis elegans] gb|AAD14765.1| Hyp
  Essential gene: C elegans homolog=Y4C6B.2a; Phenotype=Unc
  Coding regions on vcDNA: vcDNA=SeqID_48394; Strand=+; Position=1-690
GRQENIENFLRAYAGVHFSFCQLLLLVAALMLPFTMLKSPKDFWWAVIGAMVTTTVAVSIILFATASDFSVCASAARYPPVTASKFFMSFGTVMFAYGGHGAFPTIQHDMRKPYRFRRSVFCAYLIIFCMYLPVSLLGYLAYGDSLIDSIIPSLQDLILQQAVNILITLHVVLALTIVFNPLNQELEELLNVPQEFGFRRILCRSGMMLAVVAVAETMPNFGVLLDLXRR

SEQ ID NO: 121972 - protein, 220 aa, Heterodera glycines
  Homolog annotation: Hit_ID=CAE69357.1; Match level="QueryCoverage =89%, HitCoverage=73%, E-value=1e-58, Identity=61%"; Hit description =Hypothetical protein CBG15446 [Caenorhabditis briggsae]
  Gene Ontology: Mol. function=actin binding; Cellular component =troponin complex; Biological process=positive regulation of growth rate
  Essential gene: C elegans homolog=F42E11.4; Phenotype=Dpy,Egl,Rup,Unc
  Coding regions on vcDNA: vcDNA=SeqID_48395; Strand=+; Position=52-711
MADIEAAPAPKSDEEAKRQALAAKKAEVRKRLEEAGKFGKKKKGFLTPERKKKLRKLLMIKAAENLKNQQKQLDSERQNVLSKRIPQCPNIDAIEDKGQLEKMYNDLFQQMLKLEEEKYDINFVVSQKDAEISEITISVNDLRGKFVKPTLKKVSKYDNKFRKAALTEGESTAPKEDFRSKLKTVEKKNVMEELESKQKNRRRSRNGRRMWKMTPRDAGR

SEQ ID NO: 121973 - protein, 203 aa, Heterodera glycines
  Homolog annotation: Hit_ID=NP_498698.1; Match level="QueryCoverage =92%, HitCoverage=17%, E-value=1e-57, Identity=56%"; Hit description =eukaryotic Initiation Factor, EGg Laying defective EGL-45 (124.4 kD) (egl-45) [Caenorhabditis elegans] gb
  Gene Ontology: Mol. function=translation factor activity, nucleic acid binding; Cellular component=eukaryotic translation initiation factor 3 complex; Biological process=regulation of translational initiation
  Essential gene: C elegans homolog=C27D11.1; Phenotype=Emb,Ste
  Coding regions on vcDNA: vcDNA=SeqID_48396; Strand=-; Position=12-623
AINMDLWQEAFKSAEDLHSFMQLGKEKHKKIIRPTSYANYYEKISLVFWKGGNILFHAASLLQRFCIFKHMRRQFGGEEAMDQATRVLLATLSIPEGAESASMLTTHLHIEEQHSANIRILSSLLRLPITPSRSGILKEIVRLHIPELASPAAYALYKCVEMELNPLRTAVNVQMHLSDIEKLGHLEYNQYADPVKDVVRHGF

SEQ ID NO: 121974 - protein, 74 aa, Heterodera glycines
  Homolog annotation: Hit_ID=BAA09860.1; Match level="QueryCoverage =79%, HitCoverage=96%, E-value=1e-22, Identity=86%"; Hit description =polyubiquitin [Homo sapiens]
  Essential gene: C elegans homolog=ZK1010.1; Phenotype=Emb
  Coding regions on vcDNA: vcDNA=SeqID_48397; Strand=+; Position=2-223
AAKTLSIWLSCGGWGRTLTGKTITLEGEGSDTIENVKAKIQDKEGVPPDQQRLIFAGKQLEDGGAWGDYNIQKE

SEQ ID NO: 121975 - protein, 65 aa, Heterodera glycines
  misc_feature (18)..(18): Xaa can be any naturally occurring amino acid
  misc_feature (62)..(62): Xaa can be any naturally occurring amino acid
  Homolog annotation: Hit_ID=CAE60897.1; Match level="QueryCoverage =95%, HitCoverage=12%, E-value=2e-12, Identity=59%"; Hit description =Hypothetical protein CBG04612 [Caenorhabditis briggsae]
  Gene Ontology: Cellular component=mitochondrion
  Essential gene: C elegans homolog=F23B12.5; Phenotype=Emb,Gro
  Coding regions on vcDNA: vcDNA=SeqID_48398; Strand=+; Position=1-195
GRQEKGVDLSSFSGSGPXGRILAADLSKAEGEFTSRGTQSSASSFIDIPLSNMRKTIAKRLXEAK

SEQ ID NO: 121976 - protein, 169 aa, Heterodera glycines
  Homolog annotation: Hit_ID=AAO14563.2; Match level="QueryCoverage =98%, HitCoverage=23%, E-value=2e-82, Identity=93%"; Hit description =Hsp90 [Heterodera glycines]
  Gene Ontology: Mol. function=heat shock protein activity; Cellular component=centrosome; Biological process=reproduction
  Essential gene: C elegans homolog=C47E8.5; Phenotype=Emb,Ste
  Coding regions on vcDNA: vcDNA=SeqID_48399; Strand=+; Position=22-528
QCLKRAGETFAFQAEIAQLMSLIINTFYSNKEIFLRELSSNSSDALDKIRYQALTDPCEMESGKELFIKIVPNKADKTLTIIDTGIGMTKADLVNNLGAIAKSGTKACMEALQAGADISMIGQFGVGFYSAFLVGDRVTVTSKHNDDDCDQWESSGGGSFIIRNCADPE

SEQ ID NO: 121977 - protein, 142 aa, Heterodera glycines
  misc_feature (124)..(124): Xaa can be any naturally occurring amino acid
  Homolog annotation: Hit_ID=NP_492761.1; Match level="QueryCoverage =96%, HitCoverage=89%, E-value=2e-57, Identity=76%"; Hit description =nucleoside diphosphate kinase (1L130) [Caenorhabditis elegans] emb|CAB02101.1| Hypothetical protein F25H2
  Gene Ontology: Mol. function=ATP binding; Cellular component=nucleus; Biological process=negative regulation of cell proliferation
  Essential gene: C elegans homolog=F25H2.5; Phenotype=Pvl,Stp
  Coding regions on vcDNA: vcDNA=SeqID_48400; Strand=+; Position=105-530
MSSDKNKERTFIAIKPDGVQRGLGAKIIKQFEQRGYKLVAMKLAKATVPHLEVHYQDLKDKPFFAGLVKYMASGPIVAMVWEGLDVVKQGRVLLGATNPLASAPGTIRGNFCIEMGRNICHGSXSVPSADREIAHWFKPEEL

SEQ ID NO: 121978 - protein, 95 aa, Heterodera glycines
  Homolog annotation: Hit_ID=AAC79129.1; Match level="QueryCoverage =100%, HitCoverage=29%, E-value=1e-46, Identity=95%"; Hit description= glyceraldehyde-3-phosphate-dehydrogenase [Globodera rostochiensis] sp|O16027|G3P1_GLORO Glyceraldehyde-3-
  Gene Ontology: Mol. function=glyceraldehyde 3-phosphate dehydrogenase (phosphorylating) activity; Cellular component=cytoplasm; Biological process=glycolysis
  Essential gene: C elegans homolog=T09F3.3; Phenotype=Emb,Gon,Sma
  Coding regions on vcDNA: vcDNA=SeqID_48401; Strand=+; Position=3-287
SNASCTTNCLAPLGEVINDEFGIIEGLMTTVHAVTATQKTVDGPSGKQWRDGRGAAQNIIPASAGAAKAVGKVIPELNGKLTGMAFRVPTPNVSV

SEQ ID NO: 121979 - protein, 48 aa, Heterodera glycines
  misc_feature (48)..(48): Xaa can be any naturally occurring amino acid
  Homolog annotation: Hit_ID=NP_492322.1; Match level="QueryCoverage =93%, HitCoverage=33%, E-value=1e-10, Identity=60%"; Hit description =RAN (nuclear import/export) related (15.1 kD) (ran-4) [Caenorhabditis elegans] emb|CAA99890.1| Hypothetic
  Essential gene: C elegans homolog=R05D11.3; Phenotype=Emb,Lva
  Coding regions on vcDNA: vcDNA=SeqID_48402; Strand=+; Position=23-166
MATYNPNYESIGQAFVQHFYTKFDVPDGATRTVGLHDLYDAEHSFMTX

SEQ ID NO: 121980 - protein, 157 aa, Heterodera glycines
  misc_feature (147)..(147): Xaa can be any naturally occurring amino acid
  Homolog annotation: Hit_ID=CAE67039.1; Match level="QueryCoverage =95%, HitCoverage=76%, E-value=6e-52, Identity=66%"; Hit description =Hypothetical protein CBG12445 [Caenorhabditis briggsae]
  Essential gene: C elegans homolog=W10D5.2; Phenotype=Emb,Lva
  Coding regions on vcDNA: vcDNA=SeqID_48403; Strand=+; Position=97-567
MAKSDVPALSTTNQPYPYKEQTPKGVFEKMGLRKTPDGASIGEFAVMRMDDMMNLIGRGSLWPLTFGLACCAVEMMHFAAPRYDMMRFGVVFRATPRQCDLSIGSGTVTNKMAPALRRSYDQMPHPKWVISMGSCANGGGDYHYSYXVLRGCDRVIP

SEQ ID NO: 121981 - protein, 99 aa, Heterodera glycines
  misc_feature (10)..(10): Xaa can be any naturally occurring amino acid
  misc_feature (16)..(16): Xaa can be any naturally occurring amino acid
  misc_feature (45)..(45): Xaa can be any naturally occurring amino acid
  Homolog annotation: Hit_ID=AAO14563.2; Match level="QueryCoverage =97%, HitCoverage=13%, E-value=7e-49, Identity=93%"; Hit description =Hsp90 [Heterodera glycines]
  Gene Ontology: Biological process=reproduction
  Essential gene: C elegans homolog=C47E8.5; Phenotype=Emb,Ste
  Coding regions on vcDNA: vcDNA=SeqID_48404; Strand=+; Position=2-298
AAKTKPIWTXNPDDVXNEEYAEFYKSLSNDWEDHLAVKHFSVEGXLEFRALLFVPQRAPFDLFESRKSKNAIKLYVRRVFIMENCEELMPEYLNFIKGV

SEQ ID NO: 121982 - protein, 207 aa, Heterodera glycines
  Homolog annotation: Hit_ID=NP_524808.2; Match level="QueryCoverage =96%, HitCoverage=75%, E-value=2e-48, Identity=49%"; Hit description =CG6341-PA [Drosophila melanogaster] gb|AAF57941.2| CG6341-PA [Drosophila melanogaster]
  Gene Ontology: Mol. function=translation factor activity, nucleic acid binding; Cellular component=eukaryotic translation elongation factor 1 complex; Biological process=translational elongation
  Essential gene: C elegans homolog=F54H12.6; Phenotype=Lva
  Coding regions on vcDNA: vcDNA=SeqID_48405; Strand=+; Position=20-640
SFHFYCYSFKMTQNGMTTASNEFNELNDFLSTRAYLHGFLPSHEDQYVFKCIAAAPSASEYPHIARWYKHIKSYEDAERATWPKKAGQPPQKVVSKDSAPPAKKADAEEDFDLFGDEDSDDEEKKRITEERLKAYAEKKAKKPGPVAKSNVIYDVKPWDDTIDIKDIEANVRSIECDGLVWGTSRILPVAFGVQKLQIGCCVVDEKV

SEQ ID NO: 121983 - protein, 118 aa, Heterodera glycines
  misc_feature (9)..(9): Xaa can be any naturally occurring amino acid
  misc_feature (45)..(45): Xaa can be any naturally occurring amino acid
  misc_feature (87)..(87): Xaa can be any naturally occurring amino acid
  Homolog annotation: Hit_ID=AAS52855.1; Match level="QueryCoverage =91%, HitCoverage=72%, E-value=1e-28, Identity=56%"; Hit description =AER173Cp [Ashbya gossypii ATCC 10895] ref|NP_985031.1| AER173Cp [Eremothecium gossypii]
  Gene Ontology: Mol. function=ubiquitin conjugating enzyme activity; Cellular component=proteasome complex (sensu Eukarya); Biological process=sporulation (sensu Saccharomyces)
  Essential gene: C elegans homolog=M7.1; Phenotype=Emb
  Coding regions on vcDNA: vcDNA=SeqID_48406; Strand=-; Position=1-355
RITQELAEXKQEPITGCTATPMDDGKDLHHWRASIKGPPESPYEXGTFHLDIVLRRDYPCTPPIVKFINDIHHPNVGERGDICLDIXKQMWAPALTISKVLLSISSLLCTRIRTVRSA

SEQ ID NO: 121984 - protein, 135 aa, Heterodera glycines
  Homolog annotation: Hit_ID=CAE69076.1; Match level="QueryCoverage =82%, HitCoverage=37%, E-value=2e-39, Identity=66%"; Hit description =Hypothetical protein CBG15094 [Caenorhabditis briggsae]
  Gene Ontology: Biological process=positive regulation of embryonic development
  Essential gene: C elegans homolog=Y92H12BR.8; Phenotype=Lva
  Coding regions on vcDNA: vcDNA=SeqID_48407; Strand=+; Position=3-407
PQGLSRATFCPHQLRQKAVKTPLQKAVTSAAERALDIVGNASRVRLQDLRDNPGARTVGRQVRAKGHNQAGHTIGELQHASKPPLGWVWGDYYKPWQRSFDGDRRFNGDINLRREYIPISLVELQRLIDLGWLDT

SEQ ID NO: 121985 - protein, 97 aa, Heterodera glycines
  misc_feature (15)..(15): Xaa can be any naturally occurring amino acid
  Homolog annotation: Hit_ID=CAE66665.1; Match level="QueryCoverage =100%, HitCoverage=46%, E-value=3e-32, Identity=67%"; Hit description= Hypothetical protein CBG12003 [Caenorhabditis briggsae]
  Gene Ontology: Mol. function=structural constituent of ribosome; Cellular component=cytosolic large ribosomal subunit (sensu Eukarya); Biological process=protein biosynthesis
  Essential gene: C elegans homolog=C32E8.2a; Phenotype=Emb,Lva,Ste
  Coding regions on vcDNA: vcDNA=SeqID_48408; Strand=+; Position=53-342
MAPRGNNMLPNAHFXKHWQRRIKTWVNQPARKERRRAARSAKAARLAPRAAGGLLRPVVRCPSVRYNKKCRVGRGFTLEELKRSGMGKYEARSLGIA

SEQ ID NO: 121986 - protein, 188 aa, Heterodera glycines
  misc_feature (37)..(37): Xaa can be any naturally occurring amino acid
  Homolog annotation: Hit_ID=AAC79129.1; Match level="QueryCoverage =100%, HitCoverage=58%, E-value=4e-98, Identity=94%"; Hit description= glyceraldehyde-3-phosphate-dehydrogenase [Globodera rostochiensis] sp|O16027|G3P1_GLORO Glyceraldehyde-3-
  Gene Ontology: Mol. function=glyceraldehyde 3-phosphate dehydrogenase (phosphorylating) activity; Cellular component=cytoplasm; Biological process=glycolysis
  Essential gene: C elegans homolog=K10B3.7; Phenotype=Unclassified
  Coding regions on vcDNA: vcDNA=SeqID_48409; Strand=+; Position=89-653
MVKPKVGINGFGRIGRLALRAAIEKDTVQVVAVNDPXIKLDYMVYMFNYDSTHGRFKGKISTNAGNLVVEKEGKSAHTIKVFNLKDPAEIKWGEAGAEYVIESTGVFTTIEKASAHLKGGAKKVVISAPSADAPMYVMGVNEDKYDPAKDDVISNASCTTNCLAPLAKVINDEFGIIEGLMTTVHAVT

SEQ ID NO: 121987 - protein, 65 aa, Heterodera glycines
  Homolog annotation: Hit_ID=BAA09860.1; Match level="QueryCoverage =96%, HitCoverage=97%, E-value=5e-26, Identity=90%"; Hit description =polyubiquitin [Homo sapiens]
  Essential gene: C elegans homolog=ZK1010.1; Phenotype=Emb
  Coding regions on vcDNA: vcDNA=SeqID_48410; Strand=+; Position=42-236
MRRIFVKTLTGKTITLEGEASDTIENVKAKIQDKESIPPDQQRLIFAGKQVEDGRTLADYNIQKE

SEQ ID NO: 121988 - protein, 125 aa, Heterodera glycines
  misc_feature (105)..(105): Xaa can be any naturally occurring amino acid
  Homolog annotation: Hit_ID=CAA65506.1; Match level="QueryCoverage =87%, HitCoverage=37%, E-value=7e-33, Identity=60%"; Hit description =cuticular collagen [Teladorsagia circumcincta]
  Gene Ontology: Mol. function=structural constituent of cuticle; Cellular component=extracellular; Biological process=cuticle biosynthesis (sensu Nematoda)
  Essential gene: C elegans homolog=T07H6.3a; Phenotype=Bmd,Gro,Unc
  Coding regions on vcDNA: vcDNA=SeqID_48411; Strand=+; Position=16-390
TNSSRSKSGGVRQHAAQREAESLRTLAFFGVCLSTVATVIAVLSVPFAYHHFQQIGAQMRSEVDFCKMRSGNMWREVTRTQAYSKVWHDSRHNRHAGGCCGCGVXPPGPPGPPGPSGQPGGDGVP

SEQ ID NO: 121989 - protein, 99 aa, Heterodera glycines
  Homolog annotation: Hit_ID=AAK95139.1; Match level="QueryCoverage =87%, HitCoverage=41%, E-value=2e-28, Identity=64%"; Hit description =ribosomal protein L13 [Ictalurus punctatus] sp|Q90YV5|RL13_ICTPU 60S ribosomal protein L13
  Gene Ontology: Mol. function=structural constituent of ribosome; Cellular component=cytosolic ribosome (sensu Eukarya); Biological process=protein biosynthesis
  Essential gene: C elegans homolog=C32E8.2a; Phenotype=Emb,Lva,Ste
  Coding regions on vcDNA: vcDNA=SeqID_48412; Strand=+; Position=3-299
KTKWVPRKQHASNAHFHKHWERRIKTWVNQPGRKERRRAARSAKGGRLGPRPAGGLLRPVVRCPSVRYNKKCRVGRGFTLEELKRSGMGKYEARSLGIA

SEQ ID NO: 121990 - protein, 69 aa, Heterodera glycines
  Homolog annotation: Hit_ID=NP_505074.1; Match level="QueryCoverage =91%, HitCoverage=20%, E-value=1e-19, Identity=74%"; Hit description =COLlagen structural gene (29.5 kD) (col-43) [Caenorhabditis elegans] gb|AAC48270.1| Collagen protein 43 [
  Gene Ontology: Mol. function=structural constituent of cuticle; Cellular component=extracellular; Biological process=cuticle biosynthesis (sensu Nematoda)
  Essential gene: C elegans homolog=F23H12.4; Phenotype =Bmd,Dpy,Emb,Lva,Unc
  Coding regions on vcDNA: vcDNA=SeqID_48413; Strand=+; Position=33-239
MTEWGSRIRAYKFVAYSGVTFSIVGVLSVVGTLPMGYNYVAHVRGQMQHELGFCEGSAKDIYVEVNHMK

SEQ ID NO: 121991 - protein, 178 aa, Heterodera glycines
  Homolog annotation: Hit_ID=CAG09543.1; Match level="QueryCoverage =71%, HitCoverage=85%, E-value=2e-24, Identity=42%"; Hit description =unnamed protein product [Tetraodon nigroviridis]
  Gene Ontology: Mol. function=protein translocase activity; Cellular component=mitochondrial outer membrane translocase complex; Biological process=mitochondrial translocation
  Essential gene: C elegans homolog=F23H12.2; Phenotype=Lva
  Coding regions on vcDNA: vcDNA=SeqID_48414; Strand=+; Position=1-534
GRQGYYSYNVYLLLGNVSSNWVKYLSLGTALVVGYAVYIDRKRRLDPEYKQKIRQNRKQKQANFLYAKMSGGVDFPDPSDPQANEIFFFSQITLGEEKMQTGHIEEGITHLSNAIVTCSKPDELLRIFQQTIPPECVSLLVQAIPGAKMRRNASSSYRHGREPIDLDCAKIDDIGDNA

SEQ ID NO: 121992 - protein, 71 aa, Heterodera glycines
  Homolog annotation: Hit_ID=NP_505074.1; Match level="QueryCoverage =92%, HitCoverage=21%, E-value=2e-22, Identity=77%"; Hit description =COLlagen structural gene (29.5 kD) (col-43) [Caenorhabditis elegans] gb|AAC48270.1| Collagen protein 43 [
  Gene Ontology: Mol. function=structural constituent of cuticle; Cellular component=extracellular; Biological process=cuticle biosynthesis (sensu Nematoda)
  Essential gene: C elegans homolog=F23H12.4; Phenotype =Bmd,Dpy,Emb,Lva,Unc
  Coding regions on vcDNA: vcDNA=SeqID_48415; Strand=+; Position=1-213
GRQAESDGRIRAYKFVAYSAVTFSMVGVLSVVGTLPMGYNYVAHVRRQMQHELGFCKGSAKDIYVEVNHMK

SEQ ID NO: 121993 - protein, 175 aa, Heterodera glycines
  misc_feature (90)..(90): Xaa can be any naturally occurring amino acid
  Homolog annotation: Hit_ID=CAE57844.1; Match level="QueryCoverage =76%, HitCoverage=38%, E-value=8e-12, Identity=27%"; Hit description =Hypothetical protein CBG00873 [Caenorhabditis briggsae]
  Essential gene: C elegans homolog=F42A8.1; Phenotype=Gro
  Coding regions on vcDNA: vcDNA=SeqID_48416; Strand=+; Position=42-566
MCPLFLLLSAFALTAFCLFPPSFAAKDAQQLVEDGKIGQMPPKCLMSLGEQKSKWHDEGEKIEAGSIVYECRGAKMVPIGCLDEFGQQIXLNETTVAKGLLMRCSLSRWATDLQLKIIGCVPKGKANETILVGEKWTEKESQTWWECAAEGTTVRARLGGCVDEPSRSRLRIGES

SEQ ID NO: 121994 - protein, 103 aa, Heterodera glycines
  Homolog annotation: Hit_ID=NP_506471.1; Match level="QueryCoverage =78%, HitCoverage=32%, E-value=2e-12, Identity=43%"; Hit description =glutamine rich protein like (27.5 kD) (5O445Co) [Caenorhabditis elegans] emb|CAB03249.1| Hypothetical pro
  Essential gene: C elegans homolog=R10D12.14; Phenotype=Emb
  Coding regions on vcDNA: vcDNA=SeqID_48417; Strand=+; Position=2-310
AAKLRSHCKKWLYVGGQDDHEYGPYTSTEMLHWLNNSYFDGSLRLRTTNDNRFYTLSEWIQACGNEIPFALDVHSMESLRATANSRNYRGIQPTIDSVHNHQQ

SEQ ID NO: 121995 - protein, 110 aa, Heterodera glycines
  Homolog annotation: Hit_ID=AAV91469.1; Match level="QueryCoverage =91%, HitCoverage=54%, E-value=3e-39, Identity=76%"; Hit description =ribosomal protein 31 [Lonomia obliqua]
  Gene Ontology: Mol. function=structural constituent of ribosome; Cellular component=cytosolic large ribosomal subunit (sensu Eukarya); Biological process=protein biosynthesis
  Essential gene: C elegans homolog=Y48G8AL.8a; Phenotype=Emb,Lva
  Coding regions on vcDNA: vcDNA=SeqID_48418; Strand=+; Position=24-353
MGGIHGVGRPDNSTKSCKARGSDLRVHFKNTHETARAIKHMPWKRAIRFLENVREKKEIVPFRHFNGGVGRKAQAQAWGTTQGRWPKKSAEFLLQLLRNAESNAEVKGLD

SEQ ID NO: 121996 - protein, 135 aa, Heterodera glycines
  misc_feature (56)..(56): Xaa can be any naturally occurring amino acid
  Homolog annotation: Hit_ID=CAB88204.1; Match level="QueryCoverage =91%, HitCoverage=42%, E-value=1e-41, Identity=65%"; Hit description =putative cuticular collagen [Globodera pallida]
  Essential gene: C elegans homolog=F54C9.4; Phenotype=Dpy
  Coding regions on vcDNA: vcDNA=SeqID_48419; Strand=+; Position=43-447
MVGIASLCSLAAILATLVGIPQLYTQINEMNNRVMDGVQAFRVNTDSAWTELMEVXISVTPPTRPRENPFNSIFLRQKRQGLPPQCVCQLQQPSCAPGAPGPPGPPGTPGEPGGAGHPGSPGQRRTTSTAMPSAR

SEQ ID NO: 121997 - protein, 31 aa, Heterodera glycines
  Essential gene: C elegans homolog=T28D9.10; Phenotype=Emb,Lva
  Coding regions on vcDNA: vcDNA=SeqID_48420; Strand=+; Position=31-123
MKLVRFLMKLSHESVTIELKNGTQVSGAIQG

SEQ ID NO: 121998 - protein, 94 aa, Heterodera glycines
  Homolog annotation: Hit_ID=NP_741476.1; Match level="QueryCoverage =98%, HitCoverage=45%, E-value=2e-09, Identity=41%"; Hit description =ICLn ion channel homolog, nucleotide-sensitive chloride conductance regulator (22.9 kD) (icl-1) [Caenorha
  Essential gene: C elegans homolog=C01F6.8a; Phenotype=Emb,Lva,Unc
  Coding regions on vcDNA: vcDNA=SeqID_48421; Strand=+; Position=87-368
MLILQELDPPTEAVIETEGQVVAHWENHCLGQGTLYWIESALVWISHGTKNGFRLPIPSIVVHAASGANEDFSEPCLFLMVDYSKTDIEYVPAE

SEQ ID NO: 121999 - protein, 88 aa, Heterodera glycines
  misc_feature (44)..(44): Xaa can be any naturally occurring amino acid
  Homolog annotation: Hit_ID=CAB62552.1; Match level="QueryCoverage =96%, HitCoverage=37%, E-value=1e-39, Identity=95%"; Hit description =vacuolar ATPase subunit E [Heterodera schachtii] sp|Q9U1G5|VATE _HETSC Vacuolar ATP synthase subunit E (V-A
  Gene Ontology: Cellular component=proton-transporting two-sector ATPase complex; Biological process=proton transport
  Essential gene: C elegans homolog=C17H12.14; Phenotype=Emb,Lva
  Coding regions on vcDNA: vcDNA=SeqID_48422; Strand=+; Position=3-269
PPREMVARILPECVEEFQRTWGNRSEVKIDNEYFLSPESAGGVXLLAKDGKIRVSSTLEARLDLIADKITPQVRTALFGPNQNRRFFD

SEQ ID NO: 122000 - protein, 86 aa, Heterodera glycines
  misc_feature (15)..(15): Xaa can be any naturally occurring amino acid
  Homolog annotation: Hit_ID=CAE65730.1; Match level="QueryCoverage =100%, HitCoverage=34%, E-value=9e-30, Identity=72%"; Hit description= Hypothetical protein CBG10813 [Caenorhabditis briggsae]
  Gene Ontology: Mol. function=endopeptidase activity; Cellular component=proteasome core complex (sensu Eukarya); Biological process=ubiquitin-dependent protein catabolism
  Essential gene: C elegans homolog=Y110A7A.14; Phenotype=Emb
  Coding regions on vcDNA: vcDNA=SeqID_48423; Strand=+; Position=18-274
MARRYDTRATIFSPXGRLYQVEYAMEAIGQAGTCLGIRAPDGIFIAAQKLTANKLLDDRIMSEKIYKVSANIFCTVAGITSDANVL

SEQ ID NO: 122001 - protein, 86 aa, Heterodera glycines
  Homolog annotation: Hit_ID=NP_492119.1; Match level="QueryCoverage =100%, HitCoverage=69%, E-value=5e-24, Identity=56%"; Hit description= NADH dehydrogenase 1 beta subcomplex 7, possibly N-myristoylated (14.4 kD) (1I156) [Caenorhabditis elega
  Essential gene: C elegans homolog=D2030.4; Phenotype=Age,Gro,Lva
  Coding regions on vcDNA: vcDNA=SeqID_48424; Strand=+; Position=26-283
MGQKLAGGLDDYFHPETAPRIDRPPTFDPLYGFPKGRKPREMQASWEELEKMKMPISERDYCAHKMVALRKCVWDRAPFASHYCHG

SEQ ID NO: 122002 - protein, 86 aa, Heterodera glycines
  misc_feature (15)..(15): Xaa can be any naturally occurring amino acid
  Homolog annotation: Hit_ID=CAE65730.1; Match level="QueryCoverage =100%, HitCoverage=34%, E-value=3e-30, Identity=72%"; Hit description= Hypothetical protein CBG10813 [Caenorhabditis briggsae]
  Gene Ontology: Mol. function=endopeptidase activity; Cellular component=26S proteasome; Biological process=ubiquitin-dependent protein catabolism
  Essential gene: C elegans homolog=Y110A7A.14; Phenotype=Emb
  Coding regions on vcDNA: vcDNA=SeqID_48425; Strand=+; Position=18-274
MARRYDTRTTVFSPXGRLYQVEYAMEAIGQAGTCLGIRAPDGIFIAAQKLTANKLLDDRIMSEKIYKVSANIFCTVAGITSDANVL

SEQ ID NO: 122003 - protein, 145 aa, Heterodera glycines
  Homolog annotation: Hit_ID=CAI24226.1; Match level="QueryCoverage =100%, HitCoverage=68%, E-value=6e-59, Identity=75%"; Hit description= OTTMUSP00000000573 [Mus musculus]
  Gene Ontology: Cellular component=eukaryotic 48S initiation complex; Biological process=protein biosynthesis
  Essential gene: C elegans homolog=F42C5.8; Phenotype=Lva,Ste
  Coding regions on vcDNA: vcDNA=SeqID_48426; Strand=+; Position=65-499
MGISQDRWHKRRKTGGKRNPIHKKRKFEMGRPAANTKIGPKRIHLVRCRGGNIKHRGLRLDTGNFAWASEGCTRKTRIIDTMYNASNNELVRTKTLVKGMIVSIDAIPFRQWYEAHYALPLARKKGQKLTEDEEARIGGAQKRSK

SEQ ID NO: 122004 - protein, 95 aa, Heterodera glycines
  Homolog annotation: Hit_ID=NP_493761.1; Match level="QueryCoverage =96%, HitCoverage=24%, E-value=7e-20, Identity=48%"; Hit description =cdc37 (42.7 kD) (2A868) [Caenorhabditis elegans] gb|AAC71172.1| Hypothetical protein W08F4.8 [Caenorhabdi
  Gene Ontology: Mol. function=protein tyrosine kinase activator activity; Cellular component=cytoplasm; Biological process=protein targeting
  Essential gene: C elegans homolog=W08F4.8; Phenotype =Emb,Gro,Pvl,Rup,Stp,Unc
  Coding regions on vcDNA: vcDNA=SeqID_48427; Strand=+; Position=3-290
PPRLSETEVEEKKKRVAQSPGGLDPQEVFDSLPAEMQEAFETQSMAKIFEVAKSMDSEVFKYHLDRCTASGLWIPNAKEAEGHGQEEEEKETEEK

SEQ ID NO: 122005 - protein, 78 aa, Heterodera glycines
  Homolog annotation: Hit_ID=NP_941008.1; Match level="QueryCoverage =93%, HitCoverage=16%, E-value=3e-21, Identity=61%"; Hit description =gene model 83 [Mus musculus] gb|AAH60375.1| Gene model 83 [Mus musculus]
  Gene Ontology: Mol. function=snoRNA binding; Cellular component=small nuclear ribonucleoprotein complex; Biological process=rRNA processing
  Essential gene: C elegans homolog=ZK430.7; Phenotype=Lva
  Coding regions on vcDNA: vcDNA=SeqID_48428; Strand=+; Position=2-235
AAKAGCAADRSIFLFDTRQKVPLSRVVLKLRTNSIAWHPLEPFTFVAANEDYNLYTFDMRRLDSARHVHQGHTSAVMD

SEQ ID NO: 122006 - protein, 105 aa, Heterodera glycines
  misc_feature (46)..(46): Xaa can be any naturally occurring amino acid
  Homolog annotation: Hit_ID=AAV34861.1; Match level="QueryCoverage =98%, HitCoverage=47%, E-value=6e-21, Identity=51%"; Hit description =ribosomal protein S5 [Bombyx mori]
  Gene Ontology: Mol. function=structural constituent of ribosome; Cellular component=cytosolic small ribosomal subunit (sensu Eukarya); Biological process=protein biosynthesis
  Essential gene: C elegans homolog=T05E11.1; Phenotype=Ste
  Coding regions on vcDNA: vcDNA=SeqID_48429; Strand=+; Position=105-423
AVDESMHQLVTLNLSEIKLFREWYLNDVDFSVLSLFDYVAVNRKCXKYLPPKCGCYLHNRFRQVTCSVVERLDSSLMMYWRNNRDRLMVVRIVKHVSEIIDLITA

SEQ ID NO: 122007 - protein, 88 aa, Heterodera glycines
  Homolog annotation: Hit_ID=NP_496838.1; Match level="QueryCoverage =71%, HitCoverage=71%, E-value=8e-10, Identity=48%"; Hit description =ubiquinone-binding protein like (10.6 kD) (2N782) [Caenorhabditis elegans] emb|CAB04384.1| Hypothetical p
  Essential gene: C elegans homolog=F45H10.2; Phenotype=Clr,Gro,Stp
  Coding regions on vcDNA: vcDNA=SeqID_48430; Strand=+; Position=23-289
MRLSFLRASEKHFGNLSKAYGWYYVRIAPVEQKVWKGFFFDAFVKPVKEQLPHWWMFFFPVVTYFLVTDWAKKEYRRLGRIKEFTDEE

SEQ ID NO: 122008 - protein, 108 aa, Heterodera glycines
  Homolog annotation: Hit_ID=CAE71300.1; Match level="QueryCoverage =95%, HitCoverage=68%, E-value=2e-34, Identity=61%"; Hit description =Hypothetical protein CBG18189 [Caenorhabditis briggsae]
  Essential gene: C elegans homolog=F26F4.11; Phenotype=Emb
  Coding regions on vcDNA: vcDNA=SeqID_48431; Strand=+; Position=20-343
MNSLYFEDLFTVKNIDPDGKKFDRVSRLFCDSESFKMDLILDVNTQLYAMGINDKFRLMLCTSIRDDGLTEEGEYDKSIENIPRVRMFEYVMYGKIYRIENDEGTAET

SEQ ID NO: 122009 - protein, 85 aa, Heterodera glycines
  Homolog annotation: Hit_ID=NP_492119.1; Match level="QueryCoverage =97%, HitCoverage=67%, E-value=8e-24, Identity=57%"; Hit description =NADH dehydrogenase 1 beta subcomplex 7, possibly N-myristoylated (14.4 kD) (1I156) [Caenorhabditis elegan
  Essential gene: C elegans homolog=D2030.4; Phenotype=Age,Gro,Lva
  Coding regions on vcDNA: vcDNA=SeqID_48432; Strand=+; Position=3-257
PPRLAVSLDDYFHPETAPRIDRPPTFDPLYGFPKGRKPREMQASWEELEKMKMPISERDYCAHKMVALRKCVWDRAPFASHYCHG

SEQ ID NO: 122010 - protein, 52 aa, Heterodera glycines
  misc_feature (22)..(22): Xaa can be any naturally occurring amino acid
  Homolog annotation: Hit_ID=CAI24226.1; Match level="QueryCoverage =100%, HitCoverage=24%, E-value=4e-17, Identity=78%"; Hit description= OTTMUSP00000000573 [Mus musculus]
  Gene Ontology: Cellular component=eukaryotic 48S initiation complex; Biological process=protein biosynthesis
  Essential gene: C elegans homolog=F42C5.8; Phenotype=Lva,Ste
  Coding regions on vcDNA: vcDNA=SeqID_48433; Strand=-; Position=2-156
MGISQDRWHKRRKTGGKRNPIXQKKRKFEMGRPAANTKIGPKRIHLVRCRGG

SEQ ID NO: 122011 - protein, 173 aa, Heterodera glycines
  Homolog annotation: Hit_ID=NP_767340.1; Match level="QueryCoverage =100%, HitCoverage=21%, E-value=7e-77, Identity=87%"; Hit description= heavy-metal transporting P-type ATPase [Bradyrhizobium japonicum USDA 110] dbj|BAC45965.1| heavy-metal t
  Gene Ontology: Cellular component=integral to membrane
  Essential gene: C elegans homolog=Y76A2A.2; Phenotype=Gro,Lvl,Prz,Unc
  Coding regions on vcDNA: vcDNA=SeqID_48434; Strand=-; Position=1-519
GQLAGLIAIADPVKPTTPAALRALEAEGVHVIMLTGDNRTTAAAVARRLGIAEVEAEVLPEQKSAVVAKLKAQGKVVAMAGDGVNDAPALAAAEVGIAMGTGTDVAMESAGVTLLKGDLTGIVRARRLSQATMANIRQNLFFAFIYNAAGIPIAAGVLYPVFGLLLSPIIAAA

SEQ ID NO: 122012 - protein, 47 aa, Heterodera glycines
  Homolog annotation: Hit_ID=AAR85527.1; Match level="QueryCoverage =100%, HitCoverage=18%, E-value=2e-17, Identity=95%"; Hit description= 14-3-3b protein [Meloidogyne incognita]
  Gene Ontology: Mol. function=protein domain specific binding; Biological process=protein targeting
  Essential gene: C elegans homolog=M117.2; Phenotype=Emb
  Coding regions on vcDNA: vcDNA=SeqID_48435; Strand=+; Position=74-214
MSDNKEELVQRAKLAEQAERYDDMAQSMKKVTELGAELSNEERNLLS

SEQ ID NO: 122013 - protein, 150 aa, Heterodera glycines
  Homolog annotation: Hit_ID=CAB88203.1; Match level="QueryCoverage =88%, HitCoverage=92%, E-value=2e-48, Identity=65%"; Hit description =putative cuticular collagen [Globodera pallida]
  Gene Ontology: Mol. function=structural constituent of cuticle; Cellular component=extracellular; Biological process=cuticle biosynthesis (sensu Nematoda)
  Essential gene: C elegans homolog=F54C9.4; Phenotype=Dpy
  Coding regions on vcDNA: vcDNA=SeqID_48436; Strand=+; Position=1-450
GRQASLRKENARSENIVGIASLCSLAAILATLVVIPQLYTQINEMNNRVMDGVQAFRVNTDSAWTELMEVQISVTPPTRPRENPFNSIFLRQKRQGLPPQCVCQLQQPSCPPGPPGPPGPPGTPGEPGGAGQPGSPGQPGQQAPPCPPPV

SEQ ID NO: 122014 - protein, 70 aa, Heterodera glycines
  Homolog annotation: Hit_ID=AAR85527.1; Match level="QueryCoverage =100%, HitCoverage=27%, E-value=1e-16, Identity=58%"; Hit description= 14-3-3b protein [Meloidogyne incognita]
  Gene Ontology: Mol. function=protein domain specific binding; Biological process=regulation of mitosis
  Essential gene: C elegans homolog=M117.2; Phenotype=Emb
  Coding regions on vcDNA: vcDNA=SeqID_48437; Strand=+; Position=74-283
MAEQREDHIQRAKLAEQCERYDEMAKEMKQVAEMSVELTEEERTLLSAAYRRAISTRRSAWRVIESHVKK

SEQ ID NO: 122015 - protein, 95 aa, Heterodera glycines
  Homolog annotation: Hit_ID=CAE69463.1; Match level="QueryCoverage =95%, HitCoverage=48%, E-value=2e-15, Identity=41%"; Hit description =Hypothetical protein CBG15659 [Caenorhabditis briggsae]
  Essential gene: C elegans homolog=W04B5.4; Phenotype=Lva
  Coding regions on vcDNA: vcDNA=SeqID_48438; Strand=+; Position=2-286
AAKKQIRTCWVWRKNNRWWRYLPRRNDSHNLIDMDELGEQCATFSDPMPADPPKLWVAWLYTDSYGSGRKIRDQVTKLFGKDAKTGEMQVFKNTL

SEQ ID NO: 122016 - protein, 71 aa, Heterodera glycines
  Homolog annotation: Hit_ID=NP_499741.1; Match level="QueryCoverage =95%, HitCoverage=11%, E-value=8e-15, Identity=60%"; Hit description =phosphomannomutase 45A (66.6 kD) (3O391) [Caenorhabditis elegans] emb|CAA16334.1| Hypothetical protein Y4
  Gene Ontology: Biological process=growth
  Essential gene: C elegans homolog=Y43F4B.5a; Phenotype=Emb
  Coding regions on vcDNA: vcDNA=SeqID_48439; Strand=+; Position=2-214
AAKRNSYWGVKSTEVTKKLFADLRSDYPETIGQNFDVKFVRDLTTGYDNAQPDDRAILPLSTSSEMVTFTL

SEQ ID NO: 122017 - protein, 77 aa, Heterodera glycines
  Homolog annotation: Hit_ID=XP_393173.1; Match level="QueryCoverage =84%, HitCoverage=14%, E-value=6e-29, Identity=98%"; Hit description =similar to Hypothetical protein CBG09037 [Apis mellifera]
  Essential gene: C elegans homolog=ZK1010.1; Phenotype=Emb
  Coding regions on vcDNA: vcDNA=SeqID_48440; Strand=+; Position=3-233
PPRSNSHPFNLAIMQIFVKTLTGKTITLEVEASDTIENVKAKIQDKEGIPPDQQRLIFAGKQLEDGRTLADYNIQKE

SEQ ID NO: 122018 - protein, 78 aa, Heterodera glycines
  Homolog annotation: Hit_ID=XP_393173.1; Match level="QueryCoverage =83%, HitCoverage=14%, E-value=6e-29, Identity=98%"; Hit description =similar to Hypothetical protein CBG09037 [Apis mellifera]
  Essential gene: C elegans homolog=ZK1010.1; Phenotype=Emb
  Coding regions on vcDNA: vcDNA=SeqID_48441; Strand=+; Position=2-235
AAKRSNSHPFNLAIMQIFVKTLTGKTITLEVEASDTIENVKAKIQDKEGIPPDQQRLIFAGKQLEDGRTLADYNIQKE

SEQ ID NO: 122019 - protein, 140 aa, Heterodera glycines
  Homolog annotation: Hit_ID=CAB88203.1; Match level="QueryCoverage =95%, HitCoverage=92%, E-value=2e-48, Identity=65%"; Hit description =putative cuticular collagen [Globodera pallida]
  Gene Ontology: Mol. function=structural constituent of cuticle; Cellular component=extracellular; Biological process=cuticle biosynthesis (sensu Nematoda)
  Essential gene: C elegans homolog=F54C9.4; Phenotype=Dpy
  Coding regions on vcDNA: vcDNA=SeqID_48442; Strand=+; Position=3-422
PPSENIVGIASLCSLAAILATLVVIPQLYTQINEMNNRVMDGVQAFRVNTDSAWTELMEVQISVTPPTRPRENPFNSIFLRQKRQGLPPQCVCQLQQPSCPPGPPGPPGPPGTPGEPGGAGQPGSPGQPGQQAPPCPPPV

SEQ ID NO: 122020 - protein, 71 aa, Heterodera glycines; identical to SEQ ID NO: 121966
  Homolog annotation: Hit_ID=XP_393173.1; Match level="QueryCoverage =91%, HitCoverage=14%, E-value=6e-29, Identity=98%"; Hit description =similar to Hypothetical protein CBG09037 [Apis mellifera]
  Essential gene: C elegans homolog=ZK1010.1; Phenotype=Emb
  Coding regions on vcDNA: vcDNA=SeqID_48443; Strand=+; Position=33-245

SEQ ID NO: 122021 - protein, 77 aa, Heterodera glycines; identical to SEQ ID NO: 122017
  Homolog annotation: Hit_ID=XP_393173.1; Match level="QueryCoverage =84%, HitCoverage=14%, E-value=6e-29, Identity=98%"; Hit description =similar to Hypothetical protein CBG09037 [Apis mellifera]
  Essential gene: C elegans homolog=ZK1010.1; Phenotype=Emb
  Coding regions on vcDNA: vcDNA=SeqID_48444; Strand=+; Position=3-233

SEQ ID NO: 122022 - protein, 132 aa, Heterodera glycines
  Homolog annotation: Hit_ID=CAE72579.1; Match level="QueryCoverage =95%, HitCoverage=39%, E-value=6e-35, Identity=57%"; Hit description =Hypothetical protein CBG19767 [Caenorhabditis briggsae]
  Gene Ontology: Cellular component=integral to membrane
  Essential gene: C elegans homolog=F39B2.11; Phenotype=Ste
  Coding regions on vcDNA: vcDNA=SeqID_48445; Strand=-; Position=1-396
KCNYGTIVHPLYAQQVTFPYNIYYMERRRRRMDTTVRAIRKNQQQLTLDAIQALNLLSAKLSDNKYFCGDKPCSIDALVFGCLAPLLRTPLPNDRLQLHLSATPNLVRFVDSILSIYLPLPEKVIKEQAMAA

SEQ ID NO: 122023 - protein, 79 aa, Heterodera glycines
  Homolog annotation: Hit_ID=XP_393173.1; Match level="QueryCoverage =82%, HitCoverage=14%, E-value=6e-29, Identity=98%"; Hit description =similar to Hypothetical protein CBG09037 [Apis mellifera]
  Essential gene: C elegans homolog=ZK1010.1; Phenotype=Emb
  Coding regions on vcDNA: vcDNA=SeqID_48446; Strand=+; Position=1-237
GRQERSNSHPFNLAIMQIFVKTLTGKTITLEVEASDTIENVKAKIQDKEGIPPDQQRLIFAGKQLEDGRTLADYNIQKE

SEQ ID NO: 122024 - protein, 190 aa, Heterodera glycines
  Homolog annotation: Hit_ID=EAL30237.1; Match level="QueryCoverage =76%, HitCoverage=17%, E-value=2e-20, Identity=36%"; Hit description =GA11383-PA [Drosophila pseudoobscura]
  Gene Ontology: Mol. function=ubiquitin-specific protease activity
  Essential gene: C elegans homolog=T27A3.2; Phenotype=Gro,Pvl,Slu,Stp
  Coding regions on vcDNA: vcDNA=SeqID_48447; Strand=+; Position=2-571
AATFEEEIIDDYFSPVLKMKGRAKQQQRMGSFPDFLLLQLGRFAFDWILGTQHKLDVDVHVSDELDINAFFSTGELQPNEKSLPVDDTSAVIKERLWQEPNHEIVAKLLSMGFTENAAKKAALFTKNESAESAINWILQHSDDTDVNDPHPMLTKQSTPPLTSNQGQNASQKVRHGKGHYRLRAFISHIG

SEQ ID NO: 122025 - protein, 109 aa, Heterodera glycines
  Homolog annotation: Hit_ID=NP_491282.1; Match level="QueryCoverage =100%, HitCoverage=76%, E-value=6e-39, Identity=69%"; Hit description= CalPoNin (cpn-3) [Caenorhabditis elegans] gb|AAB52338.1| Calponin protein 3 [Caenorhabditis elegans] pir
  Gene Ontology: Mol. function=troponin C binding; Biological process =growth
  Essential gene: C elegans homolog=F28H1.2; Phenotype=Emb,Lva
  Coding regions on vcDNA: vcDNA=SeqID_48448; Strand=+; Position=36-362
MSSRATPGGIGFQVVAKQASKFNDQEGKLILDWVKKLSGENFSTDGSRENFYKLLKDGTLLCKLANGIQPGSVKKIQQPTGNFACMENINAFVSFAKAQGVPTEETFQS

SEQ ID NO: 122026 - protein, 67 aa, Heterodera glycines
  Homolog annotation: Hit_ID=CAA33466.1; Match level="QueryCoverage =95%, HitCoverage=50%, E-value=5e-28, Identity=96%"; Hit description =unnamed protein product [Chlamydomonas reinhardtii] emb|CAA43216.1| ubiquitin extension protein (UbCEP52)
  Essential gene: C elegans homolog=ZK1010.1; Phenotype=Emb
  Coding regions on vcDNA: vcDNA=SeqID_48449; Strand=+; Position=1-201
GRQVQIFVKTLTGKTITLEVEASDTIENVKAKIQDKEGIPPDQQRLIFAGKQLEDGRTLADYNIQKE

SEQ ID NO: 122027 - protein, 144 aa, Heterodera glycines
  Homolog annotation: Hit_ID=CAB88203.1; Match level="QueryCoverage =92%, HitCoverage=92%, E-value=2e-48, Identity=65%"; Hit description =putative cuticular collagen [Globodera pallida]
  Gene Ontology: Mol. function=structural constituent of cuticle; Cellular component=extracellular; Biological process=cuticle biosynthesis (sensu Nematoda)
  Essential gene: C elegans homolog=F54C9.4; Phenotype=Dpy
  Coding regions on vcDNA: vcDNA=SeqID_48450; Strand=+; Position=2-433
AAKNARSENIVGIASLCSLAAILATLVVIPQLYTQINEMNNRVMDGVQAFRVNTDSAWTELMEVQISVTPPTRPRENPFNSIFLRQKRQGLPPQCVCQLQQPSCPPGPPGPPGPPGTPGEPGGAGQPGSPGQPGQQAPPCPPPV

SEQ ID NO: 122028 - protein, 721 aa, Heterodera glycines
  Homolog annotation: Hit_ID=AAO14563.2; Match level="QueryCoverage =100%, HitCoverage=100%, E-value=0.0, Identity=100%"; Hit description= Hsp90 [Heterodera glycines]
  Gene Ontology: Mol. function=protein binding; Cellular component =centrosome; Biological process=reproduction
  Essential gene: C elegans homolog=C47E8.5; Phenotype=Emb,Ste
  Coding regions on vcDNA: vcDNA=SeqID_48451; Strand=+; Position=1-2166
MSEQSGETFAFQAEIAQLMSLIINTFYSNKEIFLRELISNSSDALDKIRYQALTDPSQMESGKELFIKIVPNKADKTLTIIDTGIGMTKADLVNNLGTIAKSGTKAFMEALQAGADISMIGQFGVGFYSAFLVADRVTVTSKHNDDDCYQWESSAGGSFIIRNCADPEVTRGTKIVLHLKEDQTDYLEERRVREVVKKHPQFIGYPIKLLVEKERDKEISDDEAEEEKKEDEAKEEEKKPEDDVSDDEAEKKKEEGDKKKKKTKKIKEKYTEDEELNKTKPIWTRNPDDISNEEYAEFYKSLSNDWEDHLAVKHFSVEGQLEFRALLFVPQRAPFDLFENKKSKNAIKLYVRRVFIMENCEELMPEYLNFIKGVVDSEDLPLNISRETLQQSKILKVIRKNLVKKCMDLFEEISEDKDNFKKFYEQFAKNIKLGIHEDSVNRKKLSDFLRYYTSASGEEPCSFKDYVSRMKENQTCIYYITGESKDVVQNSSFVERVKKRGFEVIYMVDPIDEYCVQQLKEYDGKKLVSVTKEGLELPESEEEKKKFEEDKVKFEKLCKVIKDILDKKVQKVSVSNRLVSSPCCIVTGEYGWSANMERIMRAQALRDSSTMGYMASKKNLEINPDHSIIKSLRDRVEKEQDDKTAKDLVVLLYETSLLTSGFSLEDPQQHASRIYRMVKLGLDIPDEEEPAEQQPSTSGEPTIAEKIAGAEEEASRMEEVD

SEQ ID NO: 122029 - protein, 374 aa, Heterodera glycines
  Homolog annotation: Hit_ID=AAS84611.1; Match level="QueryCoverage =100%, HitCoverage=100%, E-value=0.0, Identity=100%"; Hit description= cathepsin L-like cysteine proteinase I variant form precursor [Heterodera glycines]
  Gene Ontology: Mol. function=cathepsin S activity; Cellular component= lysosome; Biological process=proteolysis and peptidolysis
  Essential gene: C elegans homolog=T03E6.7; Phenotype=Emb,Gro,Unc
  Coding regions on vcDNA: vcDNA=SeqID_48452; Strand=+; Position=60-1184
MFLLFLLSMLLLQTNGWRARERAIELADSDESIELQNIGQRKTDIRTPTERMSALRQMIERGFSDWNAYKQKHGKAYADQEVENERMLTYLSAKQFIDKHNEAYKEGKVSFRVGETHIADLPFSEYQKLNGFRRLMGDSLRRNASTFLAPMNVGDLPESVDWRDKGWVTEVKNQGMCGSCWAFSATGALEGQHVRDKGHLVSLSEQNLIDCSKKYGNMGCNGGIMDNAFQYIKDNKGIDKETAYPYKAKTGKKCLFKRNDVGATDSGYNDIAEGDEEDLRMAVATQGPVSVAIDAGHRSFQLYTNGVYFEKECDPQNLDHGVLVEGYGTDPTQGDYWIVKNSWGTRWGEQGYIRMARNRNNNCGIASHASFPLV

SEQ ID NO: 122030 - protein, 570 aa, Heterodera glycines
  Homolog annotation: Hit_ID=AAD43464.1; Match level="QueryCoverage =100%, HitCoverage=100%, E-value=0.0, Identity=100%"; Hit description= pre-mRNA splicing factor [Heterodera glycines]
  Gene Ontology: Mol. function=pre-mRNA splicing factor activity; Cellular component=nuclear pore; Biological process=locomotory behavior
  Essential gene: C elegans homolog=F49D11.1; Phenotype=Bmd,Emb,Lva
  Coding regions on vcDNA: vcDNA=SeqID_48453; Strand=+; Position=11-1723
MDLLKSYDGSSSSDNEQELADIPSSSNHNKLLALKIPSINLTPNVIEQRAIQQVAVVDPKTKELYHNPRFDELFRPESGPQNPFKSEHQRAEKNTLTGYVEPAHFNAFHFERSLRSYDTLGYADNPTADTTSAKFVGDVGQAQEKAGESLFESVKTGGQKRKRVINYDASNVDGYTGPWARFEDEKTFARPDPELQKEMDEIVRKRKLKSRAGRRAAIAELHLAEESTKLHIKDDTDYLGRSFMEPPKYTGTNLREDFVPDRCFPPTKQAHTYSSHTKPVTAIRWFPRSAHMFISCSMDGKVKLWEVYGNRKLIRTYTGHKVPVKDIYFNNTGTEFLSAAYDNYIKLWDTETGQVKNRYTIGGHRAYVVKFNPDDDKQNIFMAGMSNKKIIQWDTRTGEIEQEYDRHLGPVNSITFFDKNRRFVSTSDDKSLRIWEFGIPVDTKLIQHAGLHSIPSMTRAPNEKWIVGQSMDNRIVLFQIVDDKLRFARKKAFRGHNTAGYACSTDFSPEMSFLASGDADGKITMWDWRTHKIVSTWKAHDNVCISTLWHPHEKSRMISCGWDNVIKMWV

SEQ ID NO: 122031 - protein, 121 aa, Heterodera glycines
  Homolog annotation: Hit_ID=NP_491501.1; Match level="QueryCoverage =98%, HitCoverage=73%, E-value=2e-57, Identity=92%"; Hit description =troponin C, Paralysed Arrest at Two-fold PAT-10 (18.5 kD) (pat-10) [Caenorhabditis elegans] gb|AAK21395.1
  Gene Ontology: Mol. function=calcium ion binding; Cellular component =spindle pole body; Biological process=cell organization and biogenesis
  Essential gene: C elegans homolog=F54C1.7; Phenotype=Emb,Lvl
  Coding regions on vcDNA: vcDNA=SeqID_48454; Strand=+; Position=6-368
MAENIEEILAEIDGSQIEEYQRFFDMFDRGKNGYIMATQIGQIMNAMEQDFDEKTLRKLIRKFDADGSGKLEFDEFCALVYTVANTVDKDTLRKELREAFRLFDKEGNGYISRPTLKELNA

SEQ ID NO: 122032 - protein, 150 aa, Heterodera glycines
  Homolog annotation: Hit_ID=CAA12260.1; Match level="QueryCoverage =77%, HitCoverage=86%, E-value=2e-18, Identity=47%"; Hit description =troponin [Brugia pahangi]
  Essential gene: C elegans homolog=T22E5.5; Phenotype=Stp,Unc
  Coding regions on vcDNA: vcDNA=SeqID_48455; Strand=+; Position=56-505
MSEEESQYSDEEVEEESIAADEVSVQEPAPPKEEEPAPEAEAEAPPAEEKEEEEEEEPGSPGGAGDAPKEEFRRTSVTESVAPMAQLRRAPPPQPKPAEESMTEAEAAMLAVKKRHEEEEEAKMRDNDERRRQELAAVEDELRVLKELNA

SEQ ID NO: 122033 - protein, 128 aa, Heterodera glycines
  Homolog annotation: Hit_ID=CAE69561.1; Match level="QueryCoverage =100%, HitCoverage=100%, E-value=1e-66, Identity=96%"; Hit description=Hypothetical protein CBG15773 [Caenorhabditis briggsae]
  Essential gene: C elegans homolog=ZK1010.1; Phenotype=Emb
  Coding regions on vcDNA: vcDNA=SeqID_48456; Strand=+; Position=62-448
MQIFVKTLTGKTITLEVEASDTIENVKAKIQDKEGIPPDQQRLIFAGKQLEDGRTLADYNIQKESTLHLVLRLRGGIIEPSLRMLAQKYNCDKQICRKCYARLPPRATNCRKKKCGHSNDLRIKKKLK

SEQ ID NO: 122034 - protein, 209 aa, Heterodera glycines
  Homolog annotation: Hit_ID=NP_497777.1; Match level="QueryCoverage =98%, HitCoverage=41%, E-value=2e-29, Identity=39%"; Hit description =UDP-N-acteylglucosamine pyrophosphorylase 1 (53.5 kD) (3E932) [Caenorhabditis elegans] emb|CAA91270.2| Hy
  Gene Ontology: Mol. function=UDP-N-acetylglucosamine pyrophosphorylase activity; Biological process=UDP-N -acetylglucosamine biosynthesis
  Essential gene: C elegans homolog=C36A4.4; Phenotype=Emb
  Coding regions on vcDNA: vcDNA=SeqID_48457; Strand=+; Position=4-630
MDQFDFSYLNKAFKRALEPKLPSTDIRPIPDERCVNTAHLGEAEKERLEQIGLKAIAEGRVAAVVLAGGQASRLGSAQPKGVLRLGTGLGQDDVDSLLFIQAAQIVRLQRMAAEQFPAEAAKSGGRITWLVMTSNTTNAAVHDHLNAVLAETGLSSDQVLIFTQKEIPAFDFDGNALMKSSTELVTAPDGNGGFYDVVRPLLAELEKRG

SEQ ID NO: 122035 - protein, 288 aa, Heterodera glycines
  Homolog annotation: Hit_ID=CAE73541.1; Match level="QueryCoverage =87%, HitCoverage=65%, E-value=7e-74, Identity=52%"; Hit description =Hypothetical protein CBG21009 [Caenorhabditis briggsae]
  Gene Ontology: Biological process=protein modification
  Essential gene: C elegans homolog=Y17G7B.18a; Phenotype=Gro,Stp,Unc
  Coding regions on vcDNA: vcDNA=SeqID_48458; Strand=+; Position=138 -1083
MEQHENAGRKRHTKDRFRYGNYNRYYGVRNQGFDHDPRVDLFPVQWFHGRRVLDIGCNVGHLTLEIAKKLGPAHIVGIDIDDHLVGVARKNIRHYCGSAQKLIGKFPASLRKMGKEEGPSSTTAKPAVLPYGQFPKNVWFLRENYVLDCDEFLEMVREEYDVILALSITKWVHLNWGDDGLKRFLRRTFLNLRPGGRLLLEAQPFPSYYKKAKMTSDMFETYKAIQFKPYQFKDFLLSDTVGFSECEELGTPTAISKGFERPILVFKKASSSTTPTTTKRKRERCLRP

SEQ ID NO: 122036 - protein, 113 aa, Heterodera glycines
  Homolog annotation: Hit_ID=BAA11131.1; Match level="QueryCoverage =100%, HitCoverage=77%, E-value=5e-48, Identity=80%"; Hit description= type-1 cytochrome c [Ascaris suum]
  Gene Ontology: Mol. function=electron transporter activity; Cellular component=mitochondrion; Biological process=electron transport
  Essential gene: C elegans homolog=E04A4.7; Phenotype=Emb,Lva
  Coding regions on vcDNA: vcDNA=SeqID_48459; Strand=+; Position=39-380
MPEAIPEGDYERGKKIFKQRCLQCHVIDSTATKTGPTLNGLWNRKSGSVPTFDYSAANKSKGVIWNKETLFEYLLNPKKYIPGTKMVFAGLKKAEERADLIKFIEVESQKPPS

SEQ ID NO: 122037 - protein, 180 aa, Heterodera glycines
  misc_feature (36)..(36): Xaa can be any naturally occurring amino acid
  Homolog annotation: Hit_ID=NP_493759.1; Match level="QueryCoverage =97%, HitCoverage=63%, E-value=5e-82, Identity=75%"; Hit description =putative secreted or extracellular protein precursor (2A860) [Caenorhabditis elegans] pir||T34048 hypothe
  Essential gene: C elegans homolog=W08F4.6; Phenotype=Bmd,Lva,Unc
  Coding regions on vcDNA: vcDNA=SeqID_48460; Strand=+; Position=2-545
EVRHAVTGKHNSKGWQVIPCQGWNLLDGCDGVGSWXREGAKHEITLQNSRYCDVLDKCKETVKGAHKYVNDRKAEEFLRQNKLCPPPKAHRTMTCSKIFTIEDLPKSFFGPLQSNEYWLTFSFTDGKDKKLGCARLWVDVCKYHLQDKQQKCLRDPNAFKNFINEISSQAEQIRQRTNSG

SEQ ID NO: 122038 - protein, 150 aa, Heterodera glycines
  Homolog annotation: Hit_ID=AAA03341.1; Match level="QueryCoverage =100%, HitCoverage=100%, E-value=4e-52, Identity=67%"; Hit description=ribosomal protein L23a
  Gene Ontology: Mol. function=structural constituent of ribosome; Cellular component=cytosolic large ribosomal subunit (sensu Eukarya); Biological process=ribosomal large subunit assembly and maintenance
  Essential gene: C elegans homolog=F55D10.2; Phenotype=Gro
  Coding regions on vcDNA: vcDNA=SeqID_48461; Strand=+; Position=52-504
MPPTSKKTGKAVAKAVEAKKKLAKGQHIVRKKKMRTSVHFYRPRTLKLARSPKFPRKAVPKRNKLDSFSIIKHPLTTESAMKKIEDTNTLVFIVDVKANKHQIKSAVNKLYNIEAQKVNTLVTPDHTKKAYVRLAADYDALDVANKIGII

SEQ ID NO: 122039 - protein, 150 aa, Heterodera glycines
  Homolog annotation: Hit_ID=NP_500569.1; Match level="QueryCoverage =82%, HitCoverage=87%, E-value=1e-55, Identity=88%"; Hit description =histone H2A.F Z (14.7 kD) (4F211) [Caenorhabditis elegans] gb|AAC48074.1| Hypothetical protein R08C7.3 [C
  Gene Ontology: Mol. function=chromatin binding; Cellular component =polytene chromosome; Biological process=establishment and/or maintenance of chromatin architecture
  Essential gene: C elegans homolog=R08C7.3; Phenotype=Gro
  Coding regions on vcDNA: vcDNA=SeqID_48462; Strand=+; Position=44-496
MAGGKRKAGKDSGKAKSKKIISRSARAGLQFPVGRIHRFLKKRTTSTGRVGATAAVYSAAILEYLTAEVLELAGNASKDLKVKRVTPRHLHLAIRGDEELDSMVTATIAGGGVIPHIHRSLMRKPPSQLNHSHQQNHSQQQMTNVGNGDN

SEQ ID NO: 122040 - protein, 70 aa, Heterodera glycines
  Homolog annotation: Hit_ID=BAD26684.1; Match level="QueryCoverage =100%, HitCoverage=100%, E-value=3e-27, Identity=85%"; Hit description=Ribosomal protein L38 [Plutella xylostella]
  Essential gene: C elegans homolog=C06B8.8; Phenotype=Gro,Stp
  Coding regions on vcDNA: vcDNA=SeqID_48463; Strand=+; Position=64-276
MPRQITDIKQFLLTARRKDAKSVKIKKNKENTKFKVRCTRFLYTLVVDDKEKAEKLKQSLPPGLQVKELK

SEQ ID NO: 122041 - protein, 264 aa, Heterodera glycines
  Homolog annotation: Hit_ID=NP_492315.3; Match level="QueryCoverage =96%, HitCoverage=12%, E-value=3e-93, Identity=66%"; Hit description =abnormal GONad development GON-2, putative TRP homologous cation channel ltrpc1 family member (gon-2) [Ca
  Gene Ontology: Mol. function=calcium channel activity; Cellular component=integral to plasma membrane; Biological process =gametogenesis
  Essential gene: C elegans homolog=T01H8.5; Phenotype=Pvl,Stp
  Coding regions on vcDNA: vcDNA=SeqID_48464; Strand=+; Position=3-794
SLRFANLSVLTKRHEMALCMWQHGEEALAKALVACRIYKSLANEAAEDYLEVEVCEELKTYAEEFRQLSLELLDHCYKEDDAQTLQLLTYELSYWGHQTCLSLAVIVNNKQFLAHPCCQILLADLWHGGLRIRSNSNIKVLMGILFPPSIFLLEFKSREELLLQPQTAAEHQKDINESSSSSSDSSSSTSSSDSESDGDESDAGERGGATAEERRRTSHSHGSMQSLNFTSIFKSKRKRRRPSHSRSSTTAKEDIEMGKQRNRV

SEQ ID NO: 122042 - protein, 87 aa, Heterodera glycines
  Homolog annotation: Hit_ID=XP_393173.1; Match level="QueryCoverage =96%, HitCoverage=14%, E-value=5e-36, Identity=97%"; Hit description =similar to Hypothetical protein CBG09037 [Apis mellifera]
  Essential gene: C elegans homolog=ZK1010.1; Phenotype=Emb
  Coding regions on vcDNA: vcDNA=SeqID_48465; Strand=+; Position=16-279
IQYPFNLAIMQIFVKTLTGKTITLEVEASDTIENVKAKIQDKEGIPPDQQRLIFAGKQLEDGRTLADYNIQKESTLHLVLRLRGGKN

SEQ ID NO: 122043 - protein, 232 aa, Heterodera glycines
  Homolog annotation: Hit_ID=CAE73453.1; Match level="QueryCoverage =87%, HitCoverage=29%, E-value=3e-65, Identity=59%"; Hit description =Hypothetical protein CBG20902 [Caenorhabditis briggsae]
  Gene Ontology: Biological process=physiological processes
  Essential gene: C elegans homolog=Y48B6A.1; Phenotype=Lva
  Coding regions on vcDNA: vcDNA=SeqID_48466; Strand=+; Position=19-714
MKRPIMQKDCTSKGENVSQLDKSTSKMEGSKPLQIEEYDTSDEEDLRNTIGNIPVQWYNDYDHVGYTLSGDKIKKDAIKTDEIDAFLQKEEDSDYWRKVFDRQSGQQMALTDQQVEKLNAIADNRFPEIGYNPYPPFLDIFSSVREIHPISNRPPDKRSFVPSADERRIVGRMVHAIKMGWLKRKEPPKGSEEEEEPRLYDLWDDEGDEQRKSKSQMARVRMHLPAPKVKPP

SEQ ID NO: 122044 - protein, 220 aa, Heterodera glycines
  Homolog annotation: Hit_ID=NP_495447.1; Match level="QueryCoverage =95%, HitCoverage=62%, E-value=8e-27, Identity=34%"; Hit description =BRCA2 protein BCCIPbeta like (39.5 kD) (2H343) [Caenorhabditis elegans] gb|AAB93435.1| Hypothetical prote
  Essential gene: C elegans homolog=ZK1127.4; Phenotype=Emb,Gro
  Coding regions on vcDNA: vcDNA=SeqID_48467; Strand=+; Position=1-663
EESEDDESEAITYGVLSIVPLNGTQNFQSQVAALVLQRSKKHATDEIFKKFENVLGVGRVSSKVGFLINERMLNFPAQIAGPAFHSLAEDYNGLAEERRFEHILAILKVRICTEQCASSSTSPNIGKKRKLGKAARKRLAVERTIESDIIFDNLEEQMLFQHSSDFPFFQYPVESEIEKSSKFHSLRRDGRIFRPFRRVCLLSVDQFLQFASSVVRSFSV

SEQ ID NO: 122045 - protein, 206 aa, Heterodera glycines
  Homolog annotation: Hit_ID=NP_494913.1; Match level="QueryCoverage =99%, HitCoverage=99%, E-value=5e-47, Identity=42%"; Hit description =proteasome Beta Subunit (22.7 kD) (pbs-3) [Caenorhabditis elegans] gb|AAA98018.1| Proteasome beta subunit
  Gene Ontology: Mol. function=endopeptidase activity; Cellular component=proteasome core complex (sensu Eukarya); Biological process=protein catabolism
  Essential gene: C elegans homolog=Y38A8.2; Phenotype=Emb
  Coding regions on vcDNA: vcDNA=SeqID_48468; Strand=+; Position=38-658
MPNIMGLHGGSMIAMRSKDSVVIACDLRLGEQAMKNIATNATKIHPISDNVFIGLTGFNADATTVLNKLRTHQAIYEMREQRPMSPKALTSYLAWMLYKRRFGPFLIEPIIVGLNQQNEPFISHMDVVGSVSEPEDYTVGGTGGDLAMSLCEALWRPDMTSEEMTVAVGQAMLAVVERDASTGWGVVIHTITAEGVTTKMIKSRMD

SEQ ID NO: 122046 - protein, 198 aa, Heterodera glycines
  Homolog annotation: Hit_ID=CAH91387.1; Match level="QueryCoverage =97%, HitCoverage=54%, E-value=2e-30, Identity=43%"; Hit description =hypothetical protein [Pongo pygmaeus]
  Gene Ontology: Mol. function=transcriptional activator activity; Cellular component=CCAAT-binding factor complex; Biological process =cell organization and biogenesis
  Essential gene: C elegans homolog=F23F1.1; Phenotype=Lva
  Coding regions on vcDNA: vcDNA=SeqID_48469; Strand=+; Position=34-627
MASSSSDHSAYSKQVLEEFWPGQNVKIGHMTMNSFREVNRHSELPIARIKKIMKIEEGVKTQMISAEAPVLLAKAAELFIEELTLRAWLNTNDNRRKTIQKSDIAAGAAKSEMFDFLIDILPRDELQKEQSVDYDGTEIQVVDDGAEEGPTMADGQQNVQYILQYADSGEMENSMVQLEDGRIIHATQIGQPIPLSSA

SEQ ID NO: 122047 - protein, 313 aa, Heterodera glycines
  Homolog annotation: Hit_ID=NP_501727.1; Match level="QueryCoverage =96%, HitCoverage=96%, E-value=1e-144, Identity=83%"; Hit description= adenine nucleotide family member (4K472) [Caenorhabditis elegans] emb|CAA92472.1| Hypothetical protein K
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_48470; Strand=+; Position=42-983
MSENKSEGGAEKKKSGGFNTKKFLLDLASGGTAAAVSKTAVAPIERVKLLLQVQDASIHITADKRYKGIIDVLVRVPKEQGFLSLWRGNLANVIRYFPTQALNFAFKDTYKRVFTQGVDKEKQFLKFFAMNLASGGAAGATSLCFVYPLDFARTRLAADVGKADAREFKGLADCIMKILKSDGPIGLYRGFFVSVQGIIIYRAAYFGCFDTAKMLFSPEGKQMNFFVNWAIAQVVTVSSGVLSYPWDTVRRRMMMQSGRKDIMYKNTLDCAIKIIKNEGLLKGMFKGALSNVFRGTGGALVLAFYDEIQKYIH

SEQ ID NO: 122048 - protein, 96 aa, Heterodera glycines; identical to SEQ ID NO: 121114
  Homolog annotation: Hit_ID=NP_493465.1; Match level="QueryCoverage =94%, HitCoverage=77%, E-value=4e-23, Identity=54%"; Hit description =nadh dehydrogenase (1O705) [Caenorhabditis elegans] emb|CAA21708.1| Hypothetical protein Y63D3A.7 [Caenor
  Gene Ontology: Biological process=growth
  Essential gene: C elegans homolog=Y63D3A.7; Phenotype=Lva
  Coding regions on vcDNA: vcDNA=SeqID_48471; Strand=+; Position=46-336

SEQ ID NO: 122049 - protein, 188 aa, Heterodera glycines
  Homolog annotation: Hit_ID=CAE71475.1; Match level="QueryCoverage =90%, HitCoverage=31%, E-value=2e-19, Identity=35%"; Hit description =Hypothetical protein CBG18393 [Caenorhabditis briggsae]
  Essential gene: C elegans homolog=M03C11.4; Phenotype=Emb
  Coding regions on vcDNA: vcDNA=SeqID_48472; Strand=+; Position=64-627
MHDIDEPREIFLSADDAFVSDALETIGLTFVGTEDELETAPVFAPEFAHQHFESEKIVGYKNLKVSVLYSDPTLFLTSFYQCEQKEDDSTKCDDIEYRIKDALPQTQLNAYLTIEKFRQKLSEQKNFVPFGELITKFCLKDSEIEHNFILYKFEKKQQNDAQFDQGCKFLERVQALAHWYIDAVSYTD

SEQ ID NO: 122050 - protein, 385 aa, Heterodera glycines
  Homolog annotation: Hit_ID=CAE71286.1; Match level="QueryCoverage =96%, HitCoverage=99%, E-value=1e-132, Identity=61%"; Hit description= Hypothetical protein CBG18174 [Caenorhabditis briggsae]
  Gene Ontology: Mol. function=actin binding; Cellular component=Arp2/3 protein complex; Biological process=embryogenesis and morphogenesis
  Essential gene: C elegans homolog=Y79H2A.6; Phenotype=Emb
  Coding regions on vcDNA: vcDNA=SeqID_48473; Strand=+; Position=1-1158
SDSPVPNWLLNIGPISCHAWNKDKTQLAVSPSNNEIHIFARSETVWNPLHVLREHDLLITGLDWAPNTNRIVSCSHDKNAFVWTWEAEKNSWKPEMVVVRINRAATCVKWSPNENKFAVGTGARLVAICYYERENDWWVAKQIKKLIRSTVTSLNWHPNNILLAVGACDFKTRVFSAYVKEIDEKPTPNPWGTKMPLGELLKEYQSTGWVHDLAFSPSGCKLAWVSHDSSIAVIDKSNSQPQERPIQHKTAFLPFTSVRWVNETHIVTAGHDCSPMLFTFDGTALNFKCKLDVPPENKNGSNVSSAFAMFRSIDKKALSADSPLGSTALKTLHQNSIMQIQPHTVSSQSGTISKFTTCGLDGVVALWDVQKPLGMPLANGAAQMS

SEQ ID NO: 122051 - protein, 200 aa, Heterodera glycines
  Homolog annotation: Hit_ID=NP_496447.1; Match level="QueryCoverage =95%, HitCoverage=60%, E-value=3e-79, Identity=70%"; Hit description =mitochondrial solute carrier (34.1 kD) (2L760) [Caenorhabditis elegans] emb|CAA91399.1| Hypothetical prot
  Gene Ontology: Mol. function=carrier activity; Cellular component =mitochondrion; Biological process=embryogenesis and morphogenesis
  Essential gene: C elegans homolog=W02B12.9; Phenotype=Emb
  Coding regions on vcDNA: vcDNA=SeqID_48474; Strand=+; Position=31-630
MPEQSSGADEYESLAPTYSLWVHLAAGAAAGMAEHCVMFPLDSVKTRLQSLCPCPESTCPTPIHGVASMVRREGFWRTFRGVNAVAVGSVPAHALYFTVYEKFKSSLTGNTHGHSNSFSYALAGMAATVVHDLVMNPAEVVKQRMQMLYSPYGGSLECVRCIFRNEGMAAFYRSYSTQLFMNVPFQAVHFVCYEFWQEQF

SEQ ID NO: 122052 - protein, 184 aa, Heterodera glycines
  Homolog annotation: Hit_ID=NP_493348.1; Match level="QueryCoverage =86%, HitCoverage=99%, E-value=1e-50, Identity=64%"; Hit description =small nuclear ribonucleoprotein, small nuclear ribonucleoprotein SNR- 2 (16.7 kD) (snr-2) [Caenorhabditis
  Gene Ontology: Mol. function=pre-mRNA splicing factor activity; Cellular component=small nucleolar ribonucleoprotein complex; Biological process=morphogenesis of an epithelium
  Essential gene: C elegans homolog=W08E3.1; Phenotype=Emb,Lva
  Coding regions on vcDNA: vcDNA=SeqID_48475; Strand=+; Position=8-562
VISSTLFLESLFDLSINSCKMTISKNNKMMAHLNYKMKVIVQDSRVFIGYFKAFDKHMNIILADCEEMRRIKPKQGAKKSNVEEEKRILGLVLLRGDKIISISVEGPPQKEDSGVQLPKAGGLGGPGQGRGAGRGMPMGVVPPMGAVPPGLQGAVRGIGGPGMGGPMQPGYMQGMPQGMPPRPF

SEQ ID NO: 122053 - protein, 190 aa, Heterodera glycines
  Homolog annotation: Hit_ID=AAQ76040.1; Match level="QueryCoverage =80%, HitCoverage=98%, E-value=9e-71, Identity=85%"; Hit description =ubiquitin extension protein [Cucumis sativus]
  Gene Ontology: Biological process=cell cycle
  Essential gene: C elegans homolog=H06I04.4a; Phenotype=Ste
  Coding regions on vcDNA: vcDNA=SeqID_48476; Strand=+; Position=64-636
MQIFVKTLTGKTITLEVESSDTIDAVKAKIQDKEGIPPDQQRLIFAGKQLEDGRTLADYNIQKESTLHLVLRLRGGGKKKKKKTYTTPKKIKHVHKKVKLAILKFYKVDDNGKITRLRRECPAKTCGAGVFMAWHVDRQYCGKCGLTYKLDPATIKKNMAAAAKASKPAAAAKPAAEAAAAAGKGKGKKK

SEQ ID NO: 122054 - protein, 309 aa, Heterodera glycines
  Homolog annotation: Hit_ID=NP_502137.1; Match level="QueryCoverage =93%, HitCoverage=26%, E-value=4e-68, Identity=45%"; Hit description =SNF2 related domain and helicase, C-terminal family member (122.5 kD) (4M98) [Caenorhabditis elegans] emb
  Gene Ontology: Mol. function=DNA dependent ATPase activity; Cellular component=nucleotide excision repair complex; Biological process =transcription termination
  Essential gene: C elegans homolog=F54E12.2; Phenotype=Emb
  Coding regions on vcDNA: vcDNA=SeqID_48477; Strand=+; Position=1-930
LRRFKPGAKIKNPFIGGGARMAVDANFKAYSCILSLLLRLRQACVHLSLTRNAIDIDAFKQDEGETDSDAENLVAKALEMSMAQMSLEEEALERNEEREKDEGQQIERLFEKEHQSTKVNALMNRLDGVVQNGDKCVIVSQWTSMLALIEFHLRQKAISFTSITGEVRTEERQSRVDAFNRTNTGPKVMLLSLTAGGVGLNLIGGNHLFMIDLHWNPALELQASDRIHRLGQKKNVFIHKFVCASTIEQRVLQLQEKKNAMATSVLEGAAKKLGNLSKDDVMYLFELEKRPNNQQKAGQSQKPTTSSQM

SEQ ID NO: 122055 - protein, 216 aa, Heterodera glycines
  Homolog annotation: Hit_ID=NP_506571.1; Match level="QueryCoverage =98%, HitCoverage=86%, E-value=4e-70, Identity=60%"; Hit description =proteasome Alpha Subunit (27.0 kD) (pas-1) [Caenorhabditis elegans] emb|CAB02738.1| Hypothetical protein
  Gene Ontology: Mol. function=endopeptidase activity; Cellular component=26S proteasome; Biological process=proteolysis and peptidolysis
  Essential gene: C elegans homolog=C15H11.7; Phenotype=Emb
  Coding regions on vcDNA: vcDNA=SeqID_48478; Strand=+; Position=18-665
MTRGSSAGYDRHITIFSPEGRIYQVEYAFKAANTATLSAVGIALDETAVIAVQRRVPDKLVDPSSVKSIYKLSSTVSCGVIGIVPDAMFQVRRAQSEAARWKYENGYEMPISELARKMAEINQYYTQVAELRSLGTLMLMISYDDEKGASVFSIDPAGHYISVRGYGIGVKQQQINGFLEKKLKSKDRKFGDTEVIQLALEALQTGLGIDLNADQV

SEQ ID NO: 122056 - protein, 148 aa, Heterodera glycines
  Homolog annotation: Hit_ID=NP_001001819.1; Match level="QueryCoverage= 97%, HitCoverage=99%, E-value=7e-57, Identity=73%"; Hit description =ribosomal protein S15 [Danio rerio] gb|AAH81516.1| Ribosomal protein S15 [Danio rerio] gb|AAS66964.1|
  Gene Ontology: Mol. function=structural constituent of ribosome; Cellular component=eukaryotic 48S initiation complex; Biological process=positive regulation of growth rate
  Essential gene: C elegans homolog=F36A2.6; Phenotype=Lva
  Coding regions on vcDNA: vcDNA=SeqID_48479; Strand=+; Position=34-480
MADAAAQEQKKKRTFRKFVYRGVDLEQLLEMNEKQFNQMIPARQRRKMNRGLNRKHKSLLVRLRKAKLNCPELMKPECVKTHLRDMIVLPEMVGCVVGIHSGKAYNQVEIRAEMIGYYLGEFSITYKPVKHGRPGIGATHSSRFIPLK

SEQ ID NO: 122057 - protein, 425 aa, Heterodera glycines
  Homolog annotation: Hit_ID=CAE75137.1; Match level="QueryCoverage =100%, HitCoverage=100%, E-value=1e-132, Identity=56%"; Hit description=Hypothetical protein CBG23066 [Caenorhabditis briggsae]
  Gene Ontology: Mol. function=translation elongation factor activity; Cellular component=ribosome; Biological process=translational elongation
  Essential gene: C elegans homolog=F17C11.9a; Phenotype=Gro
  Coding regions on vcDNA: vcDNA=SeqID_48480; Strand=+; Position=11-1288
MTAKLYGNQDNFRVKKVLIAAKLSGKDIKAIPQLPPTNLFPLGQAPAFDDGKVCLFGAEAISKYLLGTGSIYLPQNPELDQWIGWTASSLQPNVLSYVLPCVSAAKIDQNALETAKNELLAQLSLFDQILLPKTFLVGERLSLADISVAIDLLPAYQYVLGEEARKGLVNVNRWFQTVVSQPGIREVLGEFSFIKDPLTFDEKEYNKLLNAAGQPAKKEQKPEKQKGAKEEKPKSAKEEKPKKKAKEEADEEMDAADEAIAAQPKFSDPLAALPPGSFVMDSFKRVYSNEDTATKAIPYFWENFDPTNYSIWFSEYKYPEELKLVYMSCNLIGGMFQRLEKMKKHAFASVCLFGTDNNSTISGIWIWRGQQLAFELCQDWQVDYESYEWKKLEPENEADKKMVNEYFMWEGDFGGKKFNQGKIFK

SEQ ID NO: 122058 - protein, 190 aa, Heterodera glycines
  Homolog annotation: Hit_ID=NP_497550.1; Match level="QueryCoverage =99%, HitCoverage=98%, E-value=2e-33, Identity=40%"; Hit description =mitochondrial ribosomal protein L30 like (23.3 kD) (3D496) [Caenorhabditis elegans] gb|AAC68918.1| Hypoth
  Essential gene: C elegans homolog=W04B5.4; Phenotype=Lva
  Coding regions on vcDNA: vcDNA=SeqID_48481; Strand=+; Position=61-633
MSKQIRTCWVWRKNNRWWRYLPRRNDSHNIIDMDELGEQCATFSDPMPADPPKLWVAWLYTDSYGSGRKIRDQVTKLFGKDAKPGEMQVFKNTLSTNKQLWKIKHLLEIRPVTFPNGEPGQEDATHLEIMADGRCVINRQSLPNVDDFQLIDHSKQFSPRYLASRLMSKDVTKQDVYEDTVYNPENISIG

SEQ ID NO: 122059 - protein, 521 aa, Heterodera glycines
  Homolog annotation: Hit_ID=CAE63795.1; Match level="QueryCoverage =87%, HitCoverage=95%, E-value=1e-147, Identity=57%"; Hit description= Hypothetical protein CBG08337 [Caenorhabditis briggsae]
  Gene Ontology: Mol. function=carboxypeptidase activity; Cellular component=plasma membrane; Biological process=neuropeptide signaling pathway
  Essential gene: C elegans homolog=F59A3.1; Phenotype=Rup,Unc
  Coding regions on vcDNA: vcDNA=SeqID_48482; Strand=+; Position=17-1582
MKFMASMVTSFPVSFFLFFSTALIHGTMGGLFWSKKPADSADDSLWSRYHDQNAMEELLEKVHSKCPNVTRLYSVGRSVQGRDLAVIEFSLHPGRHQILKPEMKYIGNMHGNEAIGRELLLRLAQFLCDGWRQGQRSVVEMLNSTNIHIMPSMNPDGFELTLKTKPEQRGWVTGRTNAHGVDLNRNFPDLDAIFYKANAQRLPFFDHLLEVFHDSDNGQQFEPEVTAVANWVLSWPFVISANLHEGDLVANYPFDESLNPNELRAYSKSPDDVTFRYIAETYARAHAHMAKNDHAPCDGTAGDNFARQGGITNGAKWYSVAGGMQDFNYLSTNAFEITLELSCEKMPAPERLPQFWVDNKLALLEFIRLAHIGIKGMVSDARNGEPIANAVVWVRNVTDGDGQTAIKHPVTTWITGDYFRPLVSGCYQIAVEADGYEIGIKTLNISQKDVKERRPHIVNFQLRPIEVEVPEARIGREMGEEERGEEENGPLTPEQAAEFLQLIRMQQPVGVRTANAPSFSQ

SEQ ID NO: 122060 - protein, 143 aa, Heterodera glycines
  Homolog annotation: Hit_ID=NP_502365.1; Match level="QueryCoverage =100%, HitCoverage=100%, E-value=5e-71, Identity=89%"; Hit description=ribosomal Protein, Small subunit (15.9 kD) (rps-23) [Caenorhabditis elegans] emb|CAA94601.1| Hypothetic
  Gene Ontology: Cellular component=eukaryotic 48S initiation complex; Biological process=protein biosynthesis
  Essential gene: C elegans homolog=F28D1.7; Phenotype=Ste
  Coding regions on vcDNA: vcDNA=SeqID_48483; Strand=+; Position=28-459
MGKPKGIRTARKLKKHRQEQRWNDKRYKKTNLGTRWKADPFGGACMAKGIVLEKIGVEAKQPNSAIRKCVRVQLIKNSKKITAFVPNDGCLNFIEENDEVLVSGFGRSGHAVGDIPGVRFKVVKVANTSLLALFRGKKERPRS

SEQ ID NO: 122061 - protein, 127 aa, Heterodera glycines
  Homolog annotation: Hit_ID=CAE71410.1; Match level="QueryCoverage =72%, HitCoverage=96%, E-value=7e-22, Identity=53%"; Hit description =Hypothetical protein CBG18320 [Caenorhabditis briggsae]
  Essential gene: C elegans homolog=K01G5.8a; Phenotype=Unclassified
  Coding regions on vcDNA: vcDNA=SeqID_48484; Strand=+; Position=53-436
MDKGRSKSPNHNNEAEETQSAKEDKTDHKTNEQMLLVRTGLKLKRGTLFKKKRNVDPKTIDLTIKKEQEGPRKTKAELAFLKRQEETAFDRLSKRAQISHREKVEKFNKQMEELTEFNDIPKVSWTK

SEQ ID NO: 122062 - protein, 257 aa, Heterodera glycines
  Homolog annotation: Hit_ID=CAE67843.1; Match level="QueryCoverage =100%, HitCoverage=97%, E-value=4e-88, Identity=60%"; Hit description= Hypothetical protein CBG13430 [Caenorhabditis briggsae]
  Gene Ontology: Mol. function=DNA binding; Cellular component=delta -DNA polymerase cofactor complex; Biological process=DNA replication
  Essential gene: C elegans homolog=W03D2.4; Phenotype=Emb,Ste
  Coding regions on vcDNA: vcDNA=SeqID_48485; Strand=+; Position=18-788
MFEAKFTNAALLKKIVEAIKELVSEAPFDCTENSMCLQAMDGSHVALISLKLDIGLFEVFRCDRTIALGLSMGELSKVLKCSKSEDTLMIRFEDSEQDMVTFTFEDTKGRKQDITLKLMDIDNEHLGIPDQKYAAVVEMPSTEFQKVCRDIASFSDSMNITATKSGVVFSGSGDSVTNTIRYSKDKTADDDDDKDRVDITVKEKVNLNFSIKYLTNFTKATSLADRVRLSMGDKVPLVGEYDVEGNGFLRFCLAPKL

SEQ ID NO: 122063 - protein, 178 aa, Heterodera glycines
  Homolog annotation: Hit_ID=CAE67651.1; Match level="QueryCoverage =100%, HitCoverage=23%, E-value=2e-41, Identity=45%"; Hit description= Hypothetical protein CBG13212 [Caenorhabditis briggsae]
  Gene Ontology: Mol. function=oxysterol binding; Cellular component =bud neck; Biological process=steroid biosynthesis
  Essential gene: C elegans homolog=Y47D3A.17a; Phenotype=Emb
  Coding regions on vcDNA: vcDNA=SeqID_48486; Strand=+; Position=2-538
KVEGVIFDGMGVPHFCLEGYWNEHVNIASVVGRRKDEKGNLVIQMGEKRRIWTANAPFGDSSQYNFTKLAIEMNQPDDSVAPTDSRRRPDQRLMEDGDWDEANKRKNQLEERQRKARRQAEAEAERAMDNNQMTAEYQARWFKKVQDSHTGSVIHVVRDEEYWRCKINRDWSRCPEIF

SEQ ID NO: 122064 - protein, 56 aa, Heterodera glycines; identical to SEQ ID NO: 121107
  Homolog annotation: Hit_ID=AAQ63317.1; Match level="QueryCoverage =100%, HitCoverage=100%, E-value=7e-20, Identity=73%"; Hit description=40S ribosomal protein S29 [Hippocampus comes] gb|AAK95214.1| 40S ribosomal protein S29 [Ictalurus puncta
  Essential gene: C elegans homolog=B0412.4; Phenotype=Dpy,Emb,Ste
  Coding regions on vcDNA: vcDNA=SeqID_48487; Strand=+; Position=31-201

SEQ ID NO: 122065 - protein, 235 aa, Heterodera glycines
  misc_feature (50)..(50): Xaa can be any naturally occurring amino acid
  misc_feature (83)..(83): Xaa can be any naturally occurring amino acid
  Homolog annotation: Hit_ID=CAE73907.1; Match level="QueryCoverage =97%, HitCoverage=93%, E-value=1e-40, Identity=38%"; Hit description =Hypothetical protein CBG21513 [Caenorhabditis briggsae]
  Gene Ontology: Mol. function=methyltransferase activity; Cellular component=mitochondrial inner membrane; Biological process=larval development (sensu Nematoda)
  Essential gene: C elegans homolog=Y57G11C.11; Phenotype =Age,Unclassified
  Coding regions on vcDNA: vcDNA=SeqID_48488; Strand=+; Position=68-775
MSSLIRGEIQQFASFANVFHWFDELHGCFRPLHSFNQLRIPWLSAHLATXVGCGAGILSTSLCRRGALVTGLDADKSVLEIAXVIRKQWRRPLRKKIEFIPGTIERLAQEKDRIGTFDAVVSSEVVEHVSDLPLFIRSCCKLARPNSPIFFTTINRTIWSQLLAKTIAEDLLRILPQGLHQFEQFVAPRDLRKLLLDEQCSVGPVLGMAYNPFFNIWNWTRFTGVNYALVAHTKN

SEQ ID NO: 122066 - protein, 219 aa, Heterodera glycines
  Homolog annotation: Hit_ID=NP_509586.1; Match level="QueryCoverage =97%, HitCoverage=100%, E-value=6e-51, Identity=43%"; Hit description= golgi snap receptor complex member 2 (XK58) [Caenorhabditis elegans] emb|CAA86311.1| Hypothetical protei
  Gene Ontology: Mol. function=v-SNARE activity; Biological process=ER to Golgi transport
  Essential gene: C elegans homolog=M03E7.5; Phenotype=Emb
  Coding regions on vcDNA: vcDNA=SeqID_48489; Strand=+; Position=3-662
PFKACAMEQLFQQANMDLHQIHLEMRHLELCKNESEAQPLFQKLHQQIRQSAAQLDGLERLVNKEPSGKRHTSKYRFEQLRHDYNALEMAINSLQNRLTTKWRTAAEREELLTMRFKPNETHLDFEGTELLVNDRLKQSHNAVDDLIAHGNSVLTSLRHQHLGLKDVKRKMLDIGQVLGLSTTTLQMIEKRLEDDWLLFLVLCVLCVVFMYCFYRFWKG

SEQ ID NO: 122067 - protein, 174 aa, Heterodera glycines
  Homolog annotation: Hit_ID=NP_491093.1; Match level="QueryCoverage =100%, HitCoverage=88%, E-value=4e-84, Identity=82%"; Hit description= polymerase II (1D600) [Caenorhabditis elegans] gb|AAF59550.1| Hypothetical protein Y54E10BR.6 [Caenorhab
  Gene Ontology: Mol. function=DNA-directed RNA polymerase activity; Cellular component=DNA-directed RNA polymerase II, holoenzyme; Biological process=histogenesis and organogenesis
  Essential gene: C elegans homolog=Y54E10BR.6; Phenotype=Emb,Lva
  Coding regions on vcDNA: vcDNA=SeqID_48490; Strand=+; Position=6-530
MFYHLSLEHEIQLHPKYFGQNLMETVKQKLFSEVEGTCTGKYGFVIAVTTIDTIGHGMIQPGRGFVTYPVKYKAIVFRPFKGQVIDAVVSQVNKVGIFCEIGPLSCFISRHCIPPDMEFEPNNIPPCYKTADESIVIKQDDEIRLKLIGIRVDANDIFAIGTLMDDYLGLCSTE

SEQ ID NO: 122068 - protein, 175 aa, Heterodera glycines
  Homolog annotation: Hit_ID=NP_499554.1; Match level="QueryCoverage =84%, HitCoverage=89%, E-value=1e-35, Identity=48%"; Hit description =signal sequence receptor delta (17.4 kD) (3N11) [Caenorhabditis elegans] emb|CAB60502.1| Hypothetical pro
  Gene Ontology: Mol. function=calcium ion binding; Cellular component =translocon; Biological process=intracellular protein transport
  Essential gene: C elegans homolog=Y56A3A.21; Phenotype=Unc
  Coding regions on vcDNA: vcDNA=SeqID_48491; Strand=+; Position=9-536
MFFSNFVALTFCIFSIFILIPNVSAAACESPKYSANGYSTQDGFFHYKTSYIVEFAIQCSNNYKDAPFYALVGEKTLQLAVSEETNKYQVSWQLEHADSGAQTFDIRVYDEDKFAEHKKADESGSSSVQPLFTVQHYHGGTSHKTWISSESVFLLLGVVALYFTMNLRQLLAKRD

SEQ ID NO: 122069 - protein, 169 aa, Heterodera glycines
  Homolog annotation: Hit_ID=NP_493695.1; Match level="QueryCoverage =98%, HitCoverage=92%, E-value=8e-43, Identity=51%"; Hit description =mitochondrial ribosomal protein L41 like (20.9 kD) (2A579) [Caenorhabditis elegans] gb|AAB37899.1| Hypoth
  Essential gene: C elegans homolog=B0432.3; Phenotype=Lva
  Coding regions on vcDNA: vcDNA=SeqID_48492; Strand=+; Position=17-526
MVRHVTASCFRAPWPFEKKGSTGWRKNGPVVIESHKWPGQQKEFPELSPKFLGANFKQLWRYTGVAPTGFNDPKTDDFVHVPEMVPELVVPDLANFELKPYVSYKTDAKIEERLRNFDKKLTKFGGNEKAAIANSKETELWPPPPIDAKILFDFFYAEKIRQAFEKGKK

SEQ ID NO: 122070 - protein, 335 aa, Heterodera glycines
  Homolog annotation: Hit_ID=CAE71252.1; Match level="QueryCoverage =92%, HitCoverage=60%, E-value=3e-57, Identity=44%"; Hit description =Hypothetical protein CBG18132 [Caenorhabditis briggsae]
  Gene Ontology: Mol. function=proteasome endopeptidase activity; Cellular component=proteasome regulatory particle (sensu Eukarya); Biological process=proteolysis and peptidolysis
  Essential gene: C elegans homolog=C30C11.2; Phenotype=Emb
  Coding regions on vcDNA: vcDNA=SeqID_48493; Strand=+; Position=22-1029
MINNHVNGANDVDMERTENESFGELNQRLIALKAEKNNKESATLAVKVLAFFVNCDNLSAAQDFVEALKNLPESASNSDWARWFYYLGRIEALKGTDAETYKAAEKHFEVALRKAPQNGAVGFKQEVNKWVVLVKLLIGEIPERSLFRTAELRHVLAPYLLLTQTVRLGDVAGFDQTKREHGPIFVKDRTAALVERIHQSVIRTAIRKISTTYSRIYVSDVATKLNSTEQEAHRELVKAIKEGIVRAQLVAGDPLAGGRHYVKFGTTDDQYRGIEPRREFDARVNELLELYHQAVKALRYPDMRNPEVETIDEQRRREQLALEMAAAEEEDDDDF

SEQ ID NO: 122071 - protein, 198 aa, Heterodera glycines
  Homolog annotation: Hit_ID=CAE64961.1; Match level="QueryCoverage =71%, HitCoverage=59%, E-value=1e-33, Identity=47%"; Hit description =Hypothetical protein CBG09795 [Caenorhabditis briggsae]
  Gene Ontology: Mol. function=chaperone activity; Cellular component =mitochondrial matrix; Biological process=mitochondrial translocation
  Essential gene: C elegans homolog=C34C12.8; Phenotype=Lva
  Coding regions on vcDNA: vcDNA=SeqID_48494; Strand=+; Position=66-659
MTSRILSCNLRRYFSKMNQHIEFGTTKSASSDKQSPPSPTNNQTQHEGMSQECREQIEQMEKLKSDNEMLTDKYKRTLADMENLRKRTQRQIEEAKLFAIQPFCKDLLEVADVLDLALNSLEKMKTEDGAASLDSGVNKGIKMTKEVLLKTFKKHGLVPVQPEGQKFDPNLHEAVYEIPKDQSDRPAGHIAHVLNIGY

SEQ ID NO: 122072 - protein, 246 aa, Heterodera glycines
  Homolog annotation: Hit_ID=CAE59685.1; Match level="QueryCoverage =97%, HitCoverage=45%, E-value=3e-53, Identity=38%"; Hit description =Hypothetical protein CBG03108 [Caenorhabditis briggsae]
  Gene Ontology: Mol. function=translation initiation factor activity; Cellular component=cytosolic small ribosomal subunit (sensu Eukarya); Biological process=translational initiation
  Essential gene: C elegans homolog=E04D5.1a; Phenotype=Emb
  Coding regions on vcDNA: vcDNA=SeqID_48495; Strand=+; Position=3-743
KVSIFNTRGDTVWELSEGHRNEVYFNPQSTILVTCGFGNIASGKMEFWNLETRSEICAFCAPHTTHFEWAPDGQHICTSTTAPRLRTDNGFKLWTYRGDFVYEQKYDREELWEIKWRPCAAYNKFKIEEPNREQSTSNSSRINDGNAKTPFDNLPKGSLTQTARYVPPHLRGKPQKKEEKGKNETNSEETDVGKKIRTLQKKLDDISKLKTKRAAGHQLELNQMDKIRNEDRLLEEMERLTATANC

SEQ ID NO: 122073 - protein, 113 aa, Heterodera glycines
  Homolog annotation: Hit_ID=NP_499552.1; Match level="QueryCoverage =96%, HitCoverage=84%, E-value=3e-27, Identity=53%"; Hit description =putative nuclear protein of eukaryotic origin (14.6 kD) (3N8) [Caenorhabditis elegans] emb|CAB60500.1| Hy
  Gene Ontology: Mol. function=transcription co-repressor activity; Cellular component=nucleus; Biological process=embryogenesis and morphogenesis
  Essential gene: C elegans homolog=Y56A3A.18; Phenotype=Emb
  Coding regions on vcDNA: vcDNA=SeqID_48496; Strand=+; Position=16-357
MPKKHTQSNKTRKRSGRDLDEIHADLIRPDKMQRIQERPFDDDLPGGGWHYCVACDRHFVDEQTKAGHEKTKGHKRRLRALREKPYTQREAELAGGLGVEEQIKLESLADLTF

SEQ ID NO: 122074 - protein, 294 aa, Heterodera glycines
  Homolog annotation: Hit_ID=CAE67162.1; Match level="QueryCoverage =96%, HitCoverage=82%, E-value=2e-62, Identity=44%"; Hit description =Hypothetical protein CBG12588 [Caenorhabditis briggsae]
  Gene Ontology: Mol. function=single-stranded DNA binding; Cellular component=cytoplasm; Biological process=mRNA metabolism
  Essential gene: C elegans homolog=F26B1.2a; Phenotype=Emb
  Coding regions on vcDNA: vcDNA=SeqID_48497; Strand=+; Position=48-932
KAILDSIQFFVPDDMKRQFEPMEQHQGRMSSGTKRYRADGYNDALAEGKFELRLLIPTKSAGAVIGKGGESIKSLRAKYDAIVTVPDRSTPERVLTIVCAQEKLADCFAEILEKLTEDQGRDDVDVRVIVHQSHAGAIIGKQGSKIKELRELMQAHIKVFQECAPQSTDRVVLITTQQSKMPDAIKHLMEFMREVPIKGPTKPYDPSSHDPRIVQCYGGFSGPMPPPPMGGPPMGMHGGGGGYAGFGPRGGPPMPGGMGMPGGFMQEQVTTTQVTIPNELGGTIIGKGGDRINR

SEQ ID NO: 122075 - protein, 149 aa, Heterodera glycines
  Homolog annotation: Hit_ID=AAL05950.1; Match level="QueryCoverage =76%, HitCoverage=83%, E-value=3e-32, Identity=56%"; Hit description =frataxin [Caenorhabditis elegans] ref|NP_495183.1| FRataxin Homolog (15.7 kD) (frh-1) [Caenorhabditis eleg
  Gene Ontology: Mol. function=iron-sulfur electron transfer carrier; Cellular component=extracellular space; Biological process=synaptic transmission
  Essential gene: C elegans homolog=F59G1.7; Phenotype=Emb,Gro
  Coding regions on vcDNA: vcDNA=SeqID_48498; Strand=+; Position=20-469
MAFVNSLSSNTKTIHFLKKYLLLAHNYCTFSREWSEMEYERRAEDTLVALTEYLDTLPDRVDCESAFDVSYSMGVLTAHISPRIGTYVINKQTPNKQIWLSSPVSGPKRYDLSDKGRWVYKHDGVTLHELLEKEFRHIFKNDQISLHQS

SEQ ID NO: 122076 - protein, 206 aa, Heterodera glycines
  Homolog annotation: Hit_ID=NP_010376.1; Match level="QueryCoverage =93%, HitCoverage=31%, E-value=2e-78, Identity=73%"; Hit description =Protein with strong similarity to human RNase L Inhibitor (RLI), required for vegetative growth and early
  Gene Ontology: Mol. function=ATP-binding cassette (ABC) transporter activity
  Essential gene: C elegans homolog=Y39E4B.1; Phenotype=Emb
  Coding regions on vcDNA: vcDNA=SeqID_48499; Strand=+; Position=397 -1014
MKKSAKPEIQTAQTRIAIVNPDRCKPKNCGQPCKKNCPVVRTGKQCIVVEPTSKIAEISEILCIGCGICVKKCPYGAIQIINLPSNLERETTHRYSANSFKLHRLPTPRLGSVLGLVGTNGIGKSTALNILSNRLKPNLGSFKSPPDWPSILQYFRGSELQNYFTKLLENKFKAITKPQYVDQIPKFLEKQPLKKVGELLEKRAQK

SEQ ID NO: 122077 - protein, 114 aa, Heterodera glycines
  Homolog annotation: Hit_ID=CAE62880.1; Match level="QueryCoverage =79%, HitCoverage=83%, E-value=7e-20, Identity=49%"; Hit description =Hypothetical protein CBG07066 [Caenorhabditis briggsae]
  Gene Ontology: Mol. function=receptor activity; Cellular component =integral to membrane; Biological process=mitochondrial translocation
  Essential gene: C elegans homolog=W10D9.5; Phenotype=Emb,Lva
  Coding regions on vcDNA: vcDNA=SeqID_48500; Strand=+; Position=30-374
MAHIQFGPQQPEVEEDLVNWDEVPDDELEETAFERFEGLKEMFPTPVRSALSTTVQLTWVVAQNSFSFARSAAWVLSTSALLMVMPYIVDKELQDVEKAQLKQQQQLLLGGRPS

SEQ ID NO: 122078 - protein, 154 aa, Heterodera glycines
  Homolog annotation: Hit_ID=NP_775391.1; Match level="QueryCoverage =92%, HitCoverage=77%, E-value=6e-09, Identity=26%"; Hit description =hypothetical protein DT1P1A10 (human) - like [Danio rerio] gb|AAM28202.1| DT1P1A10-like protein [Danio re
  Essential gene: C elegans homolog=Y51H4A.15; Phenotype=Unclassified
  Coding regions on vcDNA: vcDNA=SeqID_48501; Strand=+; Position=18-482
MAQNTAQIEEFVRLVLSSWPSYQFAIKNQLAGSLTSAKDAWFVEELSAHLLKHKDICPFALSDWMEDILDTEFSLISDDGTLEPTAKLLVELADLTVGRGAHKGAEAAAKLEEHLQRLRTLSAKSCTNSTTPRLDSSSSESEENNGSDEENDWQ

SEQ ID NO: 122079 - protein, 308 aa, Heterodera glycines
  Homolog annotation: Hit_ID=CAE70786.1; Match level="QueryCoverage =96%, HitCoverage=49%, E-value=8e-23, Identity=30%"; Hit description =Hypothetical protein CBG17542 [Caenorhabditis briggsae]
  Gene Ontology: Biological process=embryogenesis and morphogenesis
  Essential gene: C elegans homolog=C37H5.9a; Phenotype=Emb
  Coding regions on vcDNA: vcDNA=SeqID_48502; Strand=+; Position=32-955
MLPIRLLFLLAVPSSAMGQFDLGGLLGNVNQFTSQAGVNLGGIFGQMGQQQPNTAQSNDQPPRHFHRGGPPPHHHRDGGGGGGLGNIGGAVEGILSRVGVNPQLANQFGKIQIPPIPSLAVHNVLDGVPGILRQFLPAQTVGQITAIARQAIESICSSDNCLQQRPEWLHQRATVAQFETLIRKTFSPGQSDSQIGRDVEIRLSRTFQVKKALIRKAGLEGRVEPANNGVFQQDLLLTEQQANVLITEINQNEVGVGAVPPSDNRRFSRRHNFNRRRFTRAGNSLFFEASPTQKWPVGQPILYMFDQS

SEQ ID NO: 122080 - protein, 428 aa, Heterodera glycines
  misc_feature (419)..(419): Xaa can be any naturally occurring amino acid
  Homolog annotation: Hit_ID=CAE57680.1; Match level="QueryCoverage =100%, HitCoverage=79%, E-value=1e-180, Identity=75%"; Hit description=Hypothetical protein CBG00674 [Caenorhabditis briggsae]
  Gene Ontology: Mol. function=chaperone activity; Cellular component =actin filament; Biological process=cell organization and biogenesis
  Essential gene: C elegans homolog=K01C8.10; Phenotype=Emb,Lva,Ste
  Coding regions on vcDNA: vcDNA=SeqID_48503; Strand=+; Position=26-1308
MSPSLSVANSNVSRPLGQPKVAGFKDKDKPESVRTSNIVAAKAVADAVRTSLGPRGMDKMIQSGNGEVTITNDGATILNQMSVVHPTAKMLVELSKAQDIEAGDGTTTVVVLAGSLLDAAEKLLAKGIHPTTISDSFQRAATFSEKVLEEMATPIDINDDDELVKLAMTSLNSKVVSQYSHLLAPMAVQAVKKLMSSPEDSSVNLKLIKVVKKLGETVEESQLIEGALIDQKSMGHGGPARVEKAKIGLIQFQISPPKPNMENQVVISDYAQMDRALKEERNYILELCKQIKKAGCNVLLIQKSILRDAINEMALHFFAKMKIMVIKDIERDDIEFYAKILGCRPVASVDHFVPESLGTADLVEEIETADGKVLKVTGLKHTGCAVSILVPGSSKLVLDEAERSLHDTLCVIRCLVKNXALLTGRGAP

SEQ ID NO: 122081 - protein, 261 aa, Heterodera glycines
  Homolog annotation: Hit_ID=NP_496281.1; Match level="QueryCoverage =86%, HitCoverage=53%, E-value=2e-65, Identity=54%"; Hit description =mitochondrial ribosomal protein S22 (48.3 kD) (2K875) [Caenorhabditis elegans] emb|CAB60995.1| Hypothetic
  Gene Ontology: Mol. function=structural constituent of ribosome; Cellular component=mitochondrial ribosome
  Essential gene: C elegans homolog=C14A4.14; Phenotype=Emb,Lva
  Coding regions on vcDNA: vcDNA=SeqID_48504; Strand=+; Position=102-887
SSRVPISHLNGEQLESLFVDERVQRLLLSLTGHDTDKILRHRRINQTERKHYALMTDGMVKEFMSRLDQRAGKFLRIVPFKEPRSNRTEVLARDAEIDGFDTAKFVFTDISFDATDMDRTVVVREQDGTLRTALPEEHDRMNRLFFVQPNRPVNEPPLFAMTDEWLQKTLDRDEHEFVLDWACHFYEPDAPKFVELCKYIFDHTLENDKLDVLYSTRHFGTLAFYLVINGKMDKLLEFYEQKNRNDGVDQTRQLWQILSCY

SEQ ID NO: 122082 - protein, 210 aa, Heterodera glycines
  Homolog annotation: Hit_ID=AAK95139.1; Match level="QueryCoverage =100%, HitCoverage=99%, E-value=2e-62, Identity=57%"; Hit description= ribosomal protein L13 [Ictalurus punctatus] sp|Q90YV5|RL13_ICTPU 60S ribosomal protein L13
  Gene Ontology: Mol. function=structural constituent of ribosome; Cellular component=cytosolic ribosome (sensu Eukarya); Biological process=protein biosynthesis
  Essential gene: C elegans homolog=C32E8.2a; Phenotype=Emb,Lva,Ste
  Coding regions on vcDNA: vcDNA=SeqID_48505; Strand=+; Position=38-667
MAPRGNNMLPNAHFHKHWQRRIKTWFNQPARKERRRAARSAKAARLAPRPAGGLLRPVVRCPSVRYNKKCRVGRGFTLEELKRSGMGKYEARSLGIAVDTRRVNRSVESTERNVARLKEYRSRLIIFPKKMNKPKKGDSSPEELKLAAQMPGSVVMPPVVKQRRLKAEPITEAMNKFSAYCHQRRVRADKRLKGKREKKARNGGRRAGQK

SEQ ID NO: 122083 - protein, 91 aa, Heterodera glycines
  Homolog annotation: Hit_ID=NP_499930.2; Match level="QueryCoverage =95%, HitCoverage=69%, E-value=3e-16, Identity=47%"; Hit description =mitochondrial ribosomal protein L55 (4B197) [Caenorhabditis elegans] gb|AAD12855.2| Hypothetical protein
  Essential gene: C elegans homolog=Y66H1A.3; Phenotype=Gro,Unclassified
  Coding regions on vcDNA: vcDNA=SeqID_48506; Strand=+; Position=13-288
MTSWRLCLGKIRRKEMVRLYKVKIMRSDGSVIFGRCDEPREIIQLPVDLRTLSDDERRMRIAERKPIAKKVVEDTLDDSFDFHKYVSQWKR

SEQ ID NO: 122084 - protein, 196 aa, Heterodera glycines
  Homolog annotation: Hit_ID=CAE57494.1; Match level="QueryCoverage =82%, HitCoverage=83%, E-value=3e-31, Identity=44%"; Hit description =Hypothetical protein CBG00465 [Caenorhabditis briggsae]
  Gene Ontology: Cellular component=mitochondrial ribosome
  Essential gene: C elegans homolog=F54C4.1; Phenotype=Lva
  Coding regions on vcDNA: vcDNA=SeqID_48507; Strand=+; Position=82-669
MISGHRSVGRCLLSLPQFASRLIPIYGHVQAQCFHFMKKQVTVDPEIAKLREGRKRRKLTKAIKKLAEYSKKPVPVEEIEVDLRHQATKGQRERTDNGVQGRDEKKEAYGRKKLLKQYAQSRARLARTDIMWIKRSIDAQENALEVLKQLSPTLYEAAVQLDERLFYTQIQGPPISPPIDNYNCPDGEYQDVTKKW

SEQ ID NO: 122085 - protein, 288 aa, Heterodera glycines
  Homolog annotation: Hit_ID=CAE64694.1; Match level="QueryCoverage =75%, HitCoverage=44%, E-value=3e-09, Identity=25%"; Hit description =Hypothetical protein CBG09476 [Caenorhabditis briggsae]
  Essential gene: C elegans homolog=F15B9.5; Phenotype=Unclassified
  Coding regions on vcDNA: vcDNA=SeqID_48508; Strand=+; Position=3-869
SCRIRHEAFFAIFSFSLLFILCHHCSFAAFLITNYPNPLNNASLWKCGISSPGPLCDPDSLLNETARHEALELLKQFQDQTDIDDNGDGSCKGKGVIVGLALTKQPIIARNARINVTDDLMKNIWQLDNRCNKALMLTLSVQPTPVVRFTRYMTTPVFDDELHHLIWTEMHWLRDRNYIMWVRLVLDGLRALIVDRHNTLGIGPAQQLAAANKKCASHGFVIFSAFIAVLCSIVGTMCAPLLWHKCCERFGPIVGKPSLPFPMVRFNNERDIGPYTTTNNGHQQQQQQ

SEQ ID NO: 122086 - protein, 329 aa, Heterodera glycines
  Homolog annotation: Hit_ID=Q8BK63; Match level="QueryCoverage=93%, HitCoverage=91%, E-value=1e-158, Identity=87%"; Hit description =Casein kinase I, alpha isoform (CKI-alpha) (CK1) sp|P48729|KC1A _HUMAN Casein kinase I, alpha isoform (CKI-alp
  Gene Ontology: Mol. function=casein kinase I activity; Cellular component=nucleus; Biological process=signal transduction
  Essential gene: C elegans homolog=C03C10.1; Phenotype=Emb
  Coding regions on vcDNA: vcDNA=SeqID_48509; Strand=+; Position=84-1073
MAAVVTNNSKEFIVGVKYKLKRKIGSGSFGDIYLAINIQNGEEVAVKLESVKARHPQLLYESKVYKILQGGVGIPHIRYYGIERDYHCLVMDLLGPSLEDLFNFCCRRFTMKTVLMLADQMIGRIEYMHVKNFIHRDIKPDNFLMGIGRHCNKLFIIDFGLAKKYRDSRTRIHIPYRDNKNLTGTARYASINAHMGIEQSRRDDMESLGYVLMYFNRGNLPWQGLKAANKKQKYEKISEKRMSTPVEMLCKGFPSEFSMYLNYCRGLRFDEAPDYMYLRQLFRILFRTLNHQYDYTFDWTLLKQKATMNNANSTATYPTEAAAGTSAQQ

SEQ ID NO: 122087 - protein, 317 aa, Heterodera glycines
  Homolog annotation: Hit_ID=NP_498386.2; Match level="QueryCoverage =97%, HitCoverage=97%, E-value=2e-78, Identity=48%"; Hit description =DeHydrogenase, Short chain, complex, LEThal LET-767 (34.3 kD) (let -767Co) [Caenorhabditis elegans] gb|AAA
  Gene Ontology: Mol. function=ketoreductase activity; Cellular component=endoplasmic reticulum; Biological process=fatty acid biosynthesis
  Essential gene: C elegans homolog=C56G2.6; Phenotype=Lva
  Coding regions on vcDNA: vcDNA=SeqID_48510; Strand=+; Position=34-987
MSFLVTLAGYLTIAIFLQKLFRSLYNVVFPYLFAVPQNIKVLAGAEWAVVTGSTDGIGKAYALELAKKNFNVVLISRSMDKLNAVAEEIKQKYPNVEVKCISFDFTNANLKDYEQTIFSQLSTIEVGMLVNNVGMSYEYPERLDRIEGGLQRVSDITVINTLPTTVLSAFVLKQMRERGRGVVVNLASSAAYFNWFYLAAYSASKKYVCWLSSILRMEYADTDIVIQTVCPMMVATKMAKIRKASFFTPSPEEFAAQALRSIGLVDETTGCLSHQIQAELMFGYVPAPLLNKFVRDNSLQTRKRALKKKEATVAKSE

SEQ ID NO: 122088 - protein, 122 aa, Heterodera glycines; identical to SEQ ID NO: 121348
  Homolog annotation: Hit_ID=CAE57827.1; Match level="QueryCoverage =99%, HitCoverage=100%, E-value=2e-49, Identity=78%"; Hit description= Hypothetical protein CBG00852 [Caenorhabditis briggsae]
  Gene Ontology: Mol. function=hydrogen-transporting ATPase activity, rotational mechanism; Cellular component=vacuolar membrane (sensu Fungi); Biological process=hydrogen transport
  Essential gene: C elegans homolog=ZK970.4; Phenotype=Emb
  Coding regions on vcDNA: vcDNA=SeqID_48511; Strand=+; Position=55-423

SEQ ID NO: 122089 - protein, 181 aa, Heterodera glycines
  Homolog annotation: Hit_ID=NP_493024.1; Match level="QueryCoverage =98%, HitCoverage=100%, E-value=2e-62, Identity=62%"; Hit description= ubiquitin conjugating enzyme (ubc-12) [Caenorhabditis elegans] emb|CAB03238.1| Hypothetical protein R09B
  Gene Ontology: Mol. function=ubiquitin-protein ligase activity; Cellular component=proteasome complex (sensu Eukarya); Biological process=pronuclear fusion
  Essential gene: C elegans homolog=R09B3.4; Phenotype =Adl,Emb,Pvl,Stp,Unc
  Coding regions on vcDNA: vcDNA=SeqID_48512; Strand=+; Position=69-614
MFNLQDRCKGVDQDRDYHATRISIRDKLLSQETKELEQNLRDLPTCKLIFPSTSALHEMELTVKPNVGLYKGGAFKFSITVPPEYNNVPPIVKCLTRVWHPNINEDGSICLSLLRQNSLDGYGWMPTRRIRDVILGLDQLFTDLIDFDDPLNAQAAQQWQTNKDGFAQKVKEYMTKYCPRN

SEQ ID NO: 122090 - protein, 125 aa, Heterodera glycines
  Homolog annotation: Hit_ID=NP_492007.1; Match level="QueryCoverage =88%, HitCoverage=80%, E-value=1e-35, Identity=58%"; Hit description =nadh dehydrogenase Fe-S protein 6 (15.7 kD) (1H669) [Caenorhabditis elegans] emb|CAA95810.1| Hypothetical
  Essential gene: C elegans homolog=F22D6.4; Phenotype=Gro
  Coding regions on vcDNA: vcDNA=SeqID_48513; Strand=+; Position=1-378
WKGGDEQKNVPVPSPKEMAQRPAEFDELTHTGQAWDIADWRRSRFEYMPKQVNPNIAAHLIAELAPVPSEERVVRCDGGHRELGHPRVYINLDKPGTHACGYCGQRFYNVHMTKAEGLDIHHIQV

SEQ ID NO: 122091 - protein, 241 aa, Heterodera glycines
  Homolog annotation: Hit_ID=NP_594138.1; Match level="QueryCoverage =97%, HitCoverage=98%, E-value=2e-81, Identity=64%"; Hit description =40S ribosomal protein S6 [Schizosaccharomyces pombe] emb|CAC36929.1| SPAPB1E7.12 [Schizosaccharomyces pom
  Gene Ontology: Cellular component=eukaryotic 48S initiation complex; Biological process=protein biosynthesis
  Essential gene: C elegans homolog=Y71A12B.1; Phenotype=Ste
  Coding regions on vcDNA: vcDNA=SeqID_48514; Strand=+; Position=25-750
MKLNIADPSTGSQKTFEIDDEKRYHVLIDKRISQEIPGDQLGDEFKGYIFKITGGNDKQGFPMKQGVLVNHRVRLLLSEGHSCYRPRRTGERKRKSIRGCIINHDISVVSLVVVKKGEADIAGVTDVTVPKRLGPKRASKIRKMFNLTKEDDVRKYVIRREVPKKSGKPESKAPKIQRLVTPLTLQRKRAHHAEKRNRAVAAREAAASYKKLLADRAHELYAKKHAKRVQRRSSTHASSTA

SEQ ID NO: 122092 - protein, 196 aa, Heterodera glycines
  Homolog annotation: Hit_ID=CAE57690.1; Match level="QueryCoverage =97%, HitCoverage=34%, E-value=9e-53, Identity=52%"; Hit description =Hypothetical protein CBG00692 [Caenorhabditis briggsae]
  Gene Ontology: Mol. function=Ran guanyl-nucleotide exchange factor activity; Cellular component=nucleus; Biological process=DNA packaging
  Essential gene: C elegans homolog=C26D10.1; Phenotype=Emb,Gro
  Coding regions on vcDNA: vcDNA=SeqID_48515; Strand=+; Position=58-645
MGTPSRRGRKRKSEVVPDKRTSTSSARSKPLMPRKSFVPLSIEQFRPTAVGTRVLSCGEGEQLGHPNRNTTKKPRAVGTFPTDMTFVQVAAGGVHSLVLTTDGRVFSCGINEKGTVPVQGLEAEGTTDTFSEIVFTTDIQRLGKIVQITAGASFSAALTEKGSVIAWGNLRDTQGEVNVHETLTDIQKKPMVVMRH

SEQ ID NO: 122093 - protein, 266 aa, Heterodera glycines
  Homolog annotation: Hit_ID=CAE57843.1; Match level="QueryCoverage =94%, HitCoverage=83%, E-value=1e-117, Identity=76%"; Hit description= Hypothetical protein CBG00872 [Caenorhabditis briggsae]
  Gene Ontology: Mol. function=succinate dehydrogenase (ubiquinone) activity; Cellular component=respiratory chain complex II (sensu Eukarya); Biological process=electron transport
  Essential gene: C elegans homolog=F42A8.2; Phenotype=Emb
  Coding regions on vcDNA: vcDNA=SeqID_48516; Strand=+; Position=40-837
MLLSKIPPPFCIALRAASTNPPARGPSVKTFEIYRYNPEKPEQKPFLQKYDVDLNQCGPMVLDALIKIKNEMDPTLTFRRSCREGICGSCAMNIGGENTLACICNIEKKTKYSTKIYPLPHMYVVKDLVPDMTLFYEQYASVQPWLQKNKPTKLGEAENFQSQAERTKLDGLYECILCACCSTSCPSYWWNSDKYMGPAALLQSYRWIIDSRDDKANERLERLTDPFSVFKCHTILNCTKTCPKHLNPAKAIGEIKKLLTGMETKP

SEQ ID NO: 122094 - protein, 162 aa, Heterodera glycines
  misc_feature (28)..(34): Xaa can be any naturally occurring amino acid
  misc_feature (39)..(39): Xaa can be any naturally occurring amino acid
  Homolog annotation: Hit_ID=CAE60034.1; Match level="QueryCoverage =75%, HitCoverage=18%, E-value=4e-37, Identity=63%"; Hit description =Hypothetical protein CBG03543 [Caenorhabditis briggsae]
  Gene Ontology: Mol. function=oxidoreductase activity; Cellular component=integral to membrane; Biological process=embryogenesis and morphogenesis
  Essential gene: C elegans homolog=K10D2.6; Phenotype=Emb
  Coding regions on vcDNA: vcDNA=SeqID_48517; Strand=+; Position=137-622
SRLVRCFGQRIQPLPYCWRRSTAEEEEXXXXXXXLFYLXYESTKKHPFACLCTFRTGLRHYVDICSPVKSHVLKALVEVSADEETKAKLTLLSTASEEGLREYPQFIVEERRSIVDVLQHFPACKPPLDLLLELLPSLQARYYSISSSPRVDASLVAGTAVV

SEQ ID NO: 122095 - protein, 190 aa, Heterodera glycines
  Homolog annotation: Hit_ID=XP_317628.1; Match level="QueryCoverage =95%, HitCoverage=64%, E-value=7e-71, Identity=68%"; Hit description =ENSANGP00000019124 [Anopheles gambiae] gb|EAA12157.2| ENSANGP00000019124 [Anopheles gambiae str. PEST]
  Gene Ontology: Mol. function=F-actin capping activity; Cellular component=actin filament; Biological process=cell organization and biogenesis
  Essential gene: C elegans homolog=M106.5; Phenotype =Bmd,Dpy,Emb,Gro,Lvl
  Coding regions on vcDNA: vcDNA=SeqID_48518; Strand=+; Position=342-911
MSGELRLDSSLDLMRRLPPQNCEKHLTDLVALAPDLCESLLTAVDQPLKVAKDKTTGREYLLCDYNRDGDSYRSPWTNAYDPPLEDGVSPSDTIRKLEIEVNAAFEAYRDMYFEGGVSSVYLWDIDNGFAGVVLLKKETDNSLSGRQGVKGCWDSIHVLEVNEKTKAAKFAKYKLTSTVMLWLQTQNPTT

SEQ ID NO: 122096 - protein, 136 aa, Heterodera glycines
  Homolog annotation: Hit_ID=AAH87725.1; Match level="QueryCoverage =100%, HitCoverage=100%, E-value=3e-70, Identity=100%"; Hit description=H3f3b protein [Rattus norvegicus] ref|NP_446437.1| H3 histone, family 3B [Rattus norvegicus] ref|NP_788
  Gene Ontology: Mol. function=DNA binding; Cellular component =nucleosome; Biological process=embryogenesis and morphogenesis
  Essential gene: C elegans homolog=F45E1.6; Phenotype=Emb,Gro
  Coding regions on vcDNA: vcDNA=SeqID_48519; Strand=+; Position=63-473
MARTKQTARKSTGGKAPRKQLATKAARKSAPSTGGVKKPHRYRPGTVALREIRRYQKSTELLIRKLPFQRLVREIAQDFKTDLRFQSAAIGALQEASEAYLVGLFEDTNLCAIHAKRVTIMPKDIQLARRIRGERA

SEQ ID NO: 122097 - protein, 148 aa, Heterodera glycines
  Homolog annotation: Hit_ID=NP_500627.1; Match level="QueryCoverage =100%, HitCoverage=81%, E-value=2e-42, Identity=59%"; Hit description= inner mitochondrial membrane (4F508) [Caenorhabditis elegans] gb|AAB92039.1| Hypothetical protein E04A4.
  Gene Ontology: Mol. function=protein transporter activity; Cellular component=integral to plasma membrane; Biological process =mitochondrial translocation
  Essential gene: C elegans homolog=E04A4.5; Phenotype=Emb,Lva
  Coding regions on vcDNA: vcDNA=SeqID_48520; Strand=+; Position=20-466
MDEYSREPCPHRIYADAGSAFAMGLIGGSIFHGIKGFSSAPRGQGLLNIAREVRMRSPVTGSQFAAWGGMFSVIDCGLVYMRRKEDPLNSIAAGGLTGGLLCARMGWKTALVSAGFGAVILTMIEGVGILMNRVMVAQSDAALAPSPA

SEQ ID NO: 122098 - protein, 114 aa, Heterodera glycines
  Homolog annotation: Hit_ID=AAC79129.1; Match level="QueryCoverage =95%, HitCoverage=33%, E-value=2e-53, Identity=92%"; Hit description =glyceraldehyde-3-phosphate-dehydrogenase [Globodera rostochiensis] sp|O16027|G3P1_GLORO Glyceraldehyde-3-p
  Gene Ontology: Mol. function=glyceraldehyde 3-phosphate dehydrogenase (phosphorylating) activity; Cellular component=cytoplasm; Biological process=glycolysis
  Essential gene: C elegans homolog=K10B3.7; Phenotype=Unclassified
  Coding regions on vcDNA: vcDNA=SeqID_48521; Strand=+; Position=109-643
EHSSHFQVYMFNYDSTHGRFKGKISTNAGNLVVEKEGKSAHTIKVFNLKDPAEIKWGEAGAEYVIESTGVFTTIEKASAHLKGGAKKVVISAPSADAPMYVMGVNEDKYDPAKD

SEQ ID NO: 122099 - protein, 204 aa, Heterodera glycines
  Homolog annotation: Hit_ID=CAE62798.1; Match level="QueryCoverage =86%, HitCoverage=31%, E-value=1e-61, Identity=53%"; Hit description =Hypothetical protein CBG06972 [Caenorhabditis briggsae]
  Gene Ontology: Mol. function=RNA binding; Biological process =regulation of protein activity, epigenetic
  Essential gene: C elegans homolog=T01D1.2a; Phenotype=Emb
  Coding regions on vcDNA: vcDNA=SeqID_48522; Strand=+; Position=21-632
MSSESDEQSADVNGLCSQSLRSDEKVCPDPDTIKMFIGQIPKAWDELQLKEYFEEFGPIYQLSVLRDKETASSRGCCFVTYYHRKDAISAQNELHNVRTFPGLSHPIQMKPADVENKNERKLFIGMLPKSMDEESVRALFKEFGQVEDCSILREDGKSKGCAFLTLVSRSCAQQAIRKMHHSQIFEGCSKPVVVKFPDSCREKT

SEQ ID NO: 122100 - protein, 177 aa, Heterodera glycines
  Homolog annotation: Hit_ID=AAP36083.1; Match level="QueryCoverage =96%, HitCoverage=36%, E-value=4e-42, Identity=53%"; Hit description =splicing factor, arginine/serine-rich 4 [Homo sapiens] ref|NP _005617.2| splicing factor, arginine/serine-r
  Gene Ontology: Mol. function=pre-mRNA splicing factor activity; Cellular component=nuclear speck; Biological process=mRNA splice site selection
  Essential gene: C elegans homolog=Y111B2A.18; Phenotype=Emb
  Coding regions on vcDNA: vcDNA=SeqID_48523; Strand=+; Position=2-535
GGGGGFGGYRGGGAGGMGMNRTQSSRYGPPIQTRYRMLVTNLSTRCSWQDLKDLMRNAGEVTYADAHKKVRNEAVVCFATHEDLRRAVERYQGKDINGRRIKLVDDSEGYAGRKSRSRSPRSRSRSPRSRTRSPPSRSRSPRSRSASPAENGRSRSRSRSRSPTPSRSRSRSPNDEK

SEQ ID NO: 122101 - protein, 136 aa, Heterodera glycines
  Homolog annotation: Hit_ID=NP_491928.1; Match level="QueryCoverage =97%, HitCoverage=97%, E-value=4e-27, Identity=45%"; Hit description =lipid Binding Protein LBP-5, adipocyte P2 family member (15.5 kD) (lbp-5) [Caenorhabditis elegans] gb|AAK
  Gene Ontology: Mol. function=lipid binding; Cellular component =cytoplasm; Biological process=lipid binding
  Essential gene: C elegans homolog=W02D3.7; Phenotype=Unc
  Coding regions on vcDNA: vcDNA=SeqID_48524; Strand=+; Position=39-449
MGEKFVGKWNLESSENFDDFLKEIGVSYLTRKAGACIKPVLEFEVNGNKWKMTSTSTFITISWEFELGQEKEVKTADGRIVKTTFTFVDGKLIENQKKTKAEEKDSYYERYVDADGKLMITMDCDGVKAKRVYIKA

SEQ ID NO: 122102 - protein, 181 aa, Heterodera glycines; identical to SEQ ID NO: 120385
  Homolog annotation: Hit_ID=NP_496338.1; Match level="QueryCoverage =100%, HitCoverage=100%, E-value=2e-60, Identity=61%"; Hit description=i-120 protein (20.8 kD) (2L163) [Caenorhabditis elegans] emb|CAA85416.1| Hypothetical protein F59E10.3
  Gene Ontology: Cellular component=COPI-coated vesicle; Biological process=intracellular protein transport
  Essential gene: C elegans homolog=F59E10.3; Phenotype=Emb,Ste
  Coding regions on vcDNA: vcDNA=SeqID_48525; Strand=+; Position=22-567

SEQ ID NO: 122103 - protein, 89 aa, Heterodera glycines
  Homolog annotation: Hit_ID=NP_501726.1; Match level="QueryCoverage =76%, HitCoverage=85%, E-value=3e-27, Identity=79%"; Hit description =putative protein of eukaryotic origin (4K471) [Caenorhabditis elegans] emb|CAA92471.1| Hypothetical prote
  Essential gene: C elegans homolog=K01H12.1; Phenotype=Emb
  Coding regions on vcDNA: vcDNA=SeqID_48526; Strand=+; Position=11-280
MEKRVTESLVFHDEVEIEDFEFDDEFQLYHFPCPCGDRFEITREQLESGEDVATCPSCSLMLRVIYDMEQFVKLETLRLEPTNAVEAVK

SEQ ID NO: 122104 - protein, 163 aa, Heterodera glycines
  Homolog annotation: Hit_ID=NP_497291.1; Match level="QueryCoverage =52%, HitCoverage=89%, E-value=4e-15, Identity=48%"; Hit description =putative mitochondrial protein (11.0 kD) (3B528) [Caenorhabditis elegans] gb|AAC71133.1| Bmp receptor ass
  Essential gene: C elegans homolog=F23H11.5; Phenotype=Emb,Lva
  Coding regions on vcDNA: vcDNA=SeqID_48527; Strand=+; Position=6-497
MLCNFRNFNCSSSRHFSLASVLLQQQKFAAVSSPPNKNWNAVLIEAMRLKSTSIVQDDAITEHGHDDHGHGHHAVNYGPPITYDYTPIPSQPYKKVYKELKQKFITYLAMSFVFFMFCCYVGYSTDVLGHSAWKLPGSYRNRKAINARLDAEEAKAKAGEGEQ

SEQ ID NO: 122105 - protein, 239 aa, Heterodera glycines
  Homolog annotation: Hit_ID=CAE65023.1; Match level="QueryCoverage =66%, HitCoverage=66%, E-value=5e-40, Identity=55%"; Hit description =Hypothetical protein CBG09861 [Caenorhabditis briggsae]
  Essential gene: C elegans homolog=F59A2.3; Phenotype=Rup
  Coding regions on vcDNA: vcDNA=SeqID_48528; Strand=+; Position=4-720
MLYNFRNLNSLSSRHFSLASALLQQQKVTAGTSMANKRVLIDAVRCKSTGSSQQYILAAHGQDSHGYGHRAFSTSGAAQELSSALDEEIKAEKELVQDKLGGTSAPSVPGFKITTKGAEVRLSKTHGNEKIEVILNVNHSVDIEEDEEYEDEPQAEMEPESVPVSLPHFTISITKNNQSMFFALEMVKTEDGGFDFTVEEFFIAPSVNGEPVNEVGDDVYSSSGKYIDPKLHDLLFVRY

SEQ ID NO: 122106 - protein, 215 aa, Heterodera glycines
  Homolog annotation: Hit_ID=NP_496403.1; Match level="QueryCoverage =96%, HitCoverage=72%, E-value=3e-76, Identity=65%"; Hit description =holocytochrome c synthase, possibly N-myristoylated (31.3 kD) (2L524) [Caenorhabditis elegans] emb|CAA889
  Gene Ontology: Mol. function=holocytochrome c synthase activity; Cellular component=mitochondrial intermembrane space; Biological process=electron transport
  Essential gene: C elegans homolog=T06D8.6; Phenotype=Age,Gro,Lva
  Coding regions on vcDNA: vcDNA=SeqID_48529; Strand=+; Position=34-678
MSGGCPLAGGASVNGCPMSNGGDQIDPSNAMPPPNQKPAPDQPFVLSTNRQKSTIPKAKVMVDGQLETWEYPSAQMFWNAMLKKGWRWRDDQLDQRDMDNIIRIHNANNELAWQEVLKWEHSLHPECDMPKLKSFHGDAKNLSPRARFRSWLGYQLPFDRHNWLVDRCGREVPYIIDYYDVGHVNPETKLFAHLDGRPAIRDASTMWDRMVVGYW

SEQ ID NO: 122107 - protein, 56 aa, Heterodera glycines; identical to SEQ ID NO: 120012
  Homolog annotation: Hit_ID=AAQ63317.1; Match level="QueryCoverage =100%, HitCoverage=100%, E-value=3e-19, Identity=71%"; Hit description=40S ribosomal protein S29 [Hippocampus comes] gb|AAK95214.1| 40S ribosomal protein S29 [Ictalurus puncta
  Essential gene: C elegans homolog=B0412.4; Phenotype=Dpy,Emb,Ste
  Coding regions on vcDNA: vcDNA=SeqID_48530; Strand=+; Position=53-223

SEQ ID NO: 122108 - protein, 238 aa, Heterodera glycines
  Homolog annotation: Hit_ID=AAV34862.1; Match level="QueryCoverage =97%, HitCoverage=94%, E-value=9e-94, Identity=71%"; Hit description =ribosomal protein S6 [Bombyx mori]
  Gene Ontology: Cellular component=eukaryotic 48S initiation complex; Biological process=reproduction
  Essential gene: C elegans homolog=Y71A12B.1; Phenotype=Ste
  Coding regions on vcDNA: vcDNA=SeqID_48531; Strand=+; Position=19-735
MKLNIAYPATGAQKLFEIEDEKKLRIFFDKRMAQEVEADSLGDEWKGYVLRISGGNDKQGFPMKQGVITNSRVRLLLSKGHSCYRQRKKGERKRKSVRGCIVDSNMSVLALVVVKKGEQEIEGLTDRVVPRRLGPKRATKIRRLFNLNKEDDVRKYVIRRTLPAKEGKKPRTKTPKIQRLVTPVTLQRKRRRIALKNKRRVKRREEAALYHQTLAKYAKEKQAEKVARRHSSASHSQG

SEQ ID NO: 122109 - protein, 132 aa, Heterodera glycines
  Homolog annotation: Hit_ID=NP_493571.1; Match level="QueryCoverage =86%, HitCoverage=97%, E-value=4e-52, Identity=85%"; Hit description =ribosomal Protein, Small subunit (13.2 kD) (rps-26) [Caenorhabditis elegans] emb|CAB07387.1| Hypothetical
  Gene Ontology: Mol. function=structural constituent of ribosome; Cellular component=cytosolic small ribosomal subunit (sensu Eukarya); Biological process=locomotory behavior
  Essential gene: C elegans homolog=F39B2.6; Phenotype=Lva,Ste
  Coding regions on vcDNA: vcDNA=SeqID_48532; Strand=+; Position=38-436
MTKKRRNNGRNKKGRGHVQPIRCTNCGRSCPKDKAIKKFVVRNIVEAAAVRDITDASVYDQYALPKLYHKLHYCVSCAIHSKVVRNRSREARKDRNPPPRFGQRSAVDRPQRPGGAAPGGPGGVGMMQAIRT

SEQ ID NO: 122110 - protein, 252 aa, Heterodera glycines
  misc_feature (237)..(237): Xaa can be any naturally occurring amino acid
  Homolog annotation: Hit_ID=CAE68535.1; Match level="QueryCoverage =98%, HitCoverage=49%, E-value=1e-111, Identity=81%"; Hit description= Hypothetical protein CBG14362 [Caenorhabditis briggsae]
  Gene Ontology: Mol. function=hydrogen-transporting ATPase activity, rotational mechanism; Cellular component=plasma membrane; Biological process=proton transport
  Essential gene: C elegans homolog=F20B6.2; Phenotype=Emb,Lva
  Coding regions on vcDNA: vcDNA=SeqID_48533; Strand=+; Position=66-823
MAKSAIDVNRGITEDQTATIRNYFTQPHLIYKTVTGVRGPLVILGDVKFPQYAEIVKLTLPNGEKRMGQVLEVTKDKAVVQVFEGTSGIDAKNTICEFTGDIMRTPVSEDMLGRIFNGSGTPIDKGPNVLAEDYLDIDGQPINPWSRIYPEEMIQTGISAIDVMNSIARGQKIPIFSAAGLPHNEIAAQIVRQGGLVKQPNRKKENEVEGDDDFAIVFAAMGVNMETARFFKQDFEXNGSMENVCLFLNLAK

SEQ ID NO: 122111 - protein, 199 aa, Heterodera glycines
  Homolog annotation: Hit_ID=NP_502337.1; Match level="QueryCoverage =90%, HitCoverage=90%, E-value=2e-54, Identity=43%"; Hit description =carrier family (34.6 kD) (4N47) [Caenorhabditis elegans] gb|AAL02464.1| Hypothetical protein C42C1.10 [Ca
  Gene Ontology: Mol. function=transporter activity; Cellular component= mitochondrion; Biological process=transport
  Essential gene: C elegans homolog=C42C1.10; Phenotype=Emb
  Coding regions on vcDNA: vcDNA=SeqID_48534; Strand=+; Position=1-597
VGLNRKDSSESQEPGLHPFQYVQAGFFTGVATRAIIQPFDVLKIRLQLQEEPLRGKSRGKYSGIFQSAKLIYHEEGIAAFWRGHIPAQGLSIVYGLVQFCTFELLTKQAGDFGFHNFSKSVDFVCGASAGCLATTCAMPFDVVRTRMVAQGAHRTYRNMAHAFIKTWRYEGPAGYFRGLVPSLVQIAPFTGLQFTFYNL

SEQ ID NO: 122112 - protein, 85 aa, Heterodera glycines
  Homolog annotation: Hit_ID=CAE63804.1; Match level="QueryCoverage =94%, HitCoverage=76%, E-value=3e-28, Identity=75%"; Hit description =Hypothetical protein CBG08350 [Caenorhabditis briggsae]
  Gene Ontology: Mol. function=structural constituent of ribosome; Cellular component=ribosome; Biological process=protein biosynthesis
  Essential gene: C elegans homolog=F37C12.4; Phenotype=Emb
  Coding regions on vcDNA: vcDNA=SeqID_48535; Strand=+; Position=41-298
MKEGQKPRQSRHKGRLSKKTRIVRELVREVVGFAPYERRVQELLKISKDKKALKFLKKRIGQHTRAKRKRDEMQQVLVAQRKAHK

SEQ ID NO: 122113 - protein, 206 aa, Heterodera glycines
  Homolog annotation: Hit_ID=NP_505181.1; Match level="QueryCoverage =92%, HitCoverage=64%, E-value=5e-65, Identity=61%"; Hit description =mitochondrial ribosomal protein L4 (34.3 kD) (5I949) [Caenorhabditis elegans] gb|AAB69933.1| Hypothetical
  Gene Ontology: Cellular component=mitochondrion
  Essential gene: C elegans homolog=T23B12.2; Phenotype=Emb,Lva
  Coding regions on vcDNA: vcDNA=SeqID_48536; Strand=+; Position=21-638
MMSAKFFTHLINSASVRPISTSCCRKELRELWKLDKRNPFQEIPEAWVTSLDDIEQKNCGLIQLHPDIFRVKPRLDLLHRNITWQSNYRNLTLLKMLSRAEMPGGGRKPWPQKKMGRHHAGSIRSPHFIRGGFAHGVRGPCTQFYMLPNTVRIHGLRTALTLKHAQDDLVIVDSYDTLNSAEPQFLNDLADARNWGYSVLFVDLTV

SEQ ID NO: 122114 - protein, 130 aa, Heterodera glycines
  Homolog annotation: Hit_ID=CAE67541.1; Match level="QueryCoverage =89%, HitCoverage=95%, E-value=3e-39, Identity=67%"; Hit description =Hypothetical protein CBG13066 [Caenorhabditis briggsae]
  Gene Ontology: Mol. function=structural constituent of ribosome; Cellular component=cytosolic ribosome (sensu Eukarya); Biological process=protein biosynthesis
  Essential gene: C elegans homolog=F10E7.7; Phenotype =Clr,Emb,Gro,Sck,Slu,Stp
  Coding regions on vcDNA: vcDNA=SeqID_48537; Strand=+; Position=23-415
MVEAAEQSQQQPIRRRAGPKSARRLYVKAVFTGYKRGHRSQHENTSLLKLDGVNDKSDASFYLGKRAVYMYKGHKTIARGGGPKTRVRAIWGRITRVHGNSGVVRAKFRHNLPPTAMGKRIRVMLYPSNI

SEQ ID NO: 122115 - protein, 151 aa, Heterodera glycines; identical to SEQ ID NO: 121887
  Homolog annotation: Hit_ID=CAE57854.1; Match level="QueryCoverage =99%, HitCoverage=100%, E-value=7e-51, Identity=60%"; Hit description= Hypothetical protein CBG00891 [Caenorhabditis briggsae]
  Gene Ontology: Mol. function=thioredoxin reductase (NADPH) activity; Cellular component=nucleus
  Essential gene: C elegans homolog=R05H5.3; Phenotype=Emb
  Coding regions on vcDNA: vcDNA=SeqID_48538; Strand=+; Position=41-496

SEQ ID NO: 122116 - protein, 223 aa, Heterodera glycines
  Homolog annotation: Hit_ID=NP_507024.1; Match level="QueryCoverage =100%, HitCoverage=100%, E-value=1e-68, Identity=58%"; Hit description=adrenal gland protein AD-002 like (26.1 kD) (5Q503) [Caenorhabditis elegans] emb|CAB07655.1| Hypothetic
  Gene Ontology: Biological process=mRNA splicing
  Essential gene: C elegans homolog=T10C6.5; Phenotype=Emb
  Coding regions on vcDNA: vcDNA=SeqID_48539; Strand=+; Position=26-697
MTTAHRPTFDPAKGGTGRNEGDLAKLSQQYSSRDMPSHMTLKYRQKGQAHPEEVVAKNLRRDIEEREQHSRERRSRDSLDSFGTGPTNKKQRVEDTSSARNLDADEPFDELNEDDTDLDEDSDNEAELMAELERIRKERAAERASKEAKEREEQERIREENILHGNPLLNPASSEFKVKRRWDDDVVFKNCARGIDERKKTPSFINDAIRSEFHRKFMEKYIK

SEQ ID NO: 122117 - protein, 247 aa, Heterodera glycines
  misc_feature (174)..(174): Xaa can be any naturally occurring amino acid
  misc_feature (176)..(176): Xaa can be any naturally occurring amino acid
  Homolog annotation: Hit_ID=BAB69973.1; Match level="QueryCoverage =87%, HitCoverage=39%, E-value=2e-42, Identity=42%"; Hit description =Myt1 [Asterina pectinifera]
  Gene Ontology: Mol. function=protein serine/threonine kinase activity; Cellular component=cytoplasm; Biological process=signal transduction
  Essential gene: C elegans homolog=Y53C12A.1; Phenotype=Unclassified
  Coding regions on vcDNA: vcDNA=SeqID_48540; Strand=+; Position=66-806
MEMQASPGPDCGFTTPSRTSTNSKFIVDVPLSTKREKLLRGTPTRFRLPPVRRLMKSAPNIHHRFYLARDHIEPFAQIVSFKRSEDRPSLSNRYRPELEETYLQQCFVLQGRLGQGDFGEVVSVRSKDDGKLYAVKSSLDIYRNSADRREKLQEVQKHEMLPPHPNLIHCVKAXRXRGRLYIQTELCSRSLDDMARERHEIPEPETRYYLIDSLKALEHMHSHDIIHVDIKPSNILVSTDGICKHGD

SEQ ID NO: 122118 - protein, 248 aa, Heterodera glycines
  Homolog annotation: Hit_ID=NP_492751.1; Match level="QueryCoverage =88%, HitCoverage=95%, E-value=3e-47, Identity=44%"; Hit description =predicted CDS, exosome complex exonuclease rrp40 (1L95) [Caenorhabditis elegans] emb|CAB01875.1| Hypothet
  Gene Ontology: Mol. function=3'-5' exoribonuclease activity; Cellular component=exosome (RNase complex); Biological process=rRNA processing
  Essential gene: C elegans homolog=F59C6.4; Phenotype=Lva
  Coding regions on vcDNA: vcDNA=SeqID_48541; Strand=+; Position=3-749
RIVLPSDFITGSTISVATQVPKLIGHGLEKRPDGVYALMAGVLHENEQKMWLNTSTKRYVPHSGDRVLGTVTSKAGDYFKVDIGSIDLALLNFTSFEGATKRNRPNVKVSDLIYGLVILTSKQLEPELSCVDSEGRARGMGLISAPGLVLSVSLGYARRLLSADCKILAELSKQLKFETTIGMNGTIWIGGDEDVVLAVRNALIAGETMFDSNIALLVQNAVQNVHFQKPPADDNADGGAEQMPMETT

SEQ ID NO: 122119 - protein, 123 aa, Heterodera glycines; identical to SEQ ID NO: 121314
  Homolog annotation: Hit_ID=P30757; Match level="QueryCoverage=100%, HitCoverage=100%, E-value=5e-57, Identity=89%"; Hit description =Histone H2B pir||S16084 histone H2B - sipunculid (Sipunculus nudus)
  Gene Ontology: Mol. function=DNA binding; Cellular component =nucleosome; Biological process=nucleosome assembly
  Essential gene: C elegans homolog=H02I12.6; Phenotype=Gro,Pvl,Ste
  Coding regions on vcDNA: vcDNA=SeqID_48542; Strand=+; Position=54-425

SEQ ID NO: 122120 - protein, 234 aa, Heterodera glycines
  Homolog annotation: Hit_ID=NP_495988.1; Match level="QueryCoverage =100%, HitCoverage=76%, E-value=5e-57, Identity=45%"; Hit description= eukaryotic Initiation Factor (32.9 kD) (eif-3.F) [Caenorhabditis elegans] emb|CAA87773.1| Hypothetical p
  Gene Ontology: Mol. function=translation initiation factor activity; Cellular component=eukaryotic translation initiation factor 3 complex; Biological process=regulation of translational initiation
  Essential gene: C elegans homolog=D2013.7; Phenotype=Emb,Lva
  Coding regions on vcDNA: vcDNA=SeqID_48543; Strand=+; Position=7-708
MASNLTVKVHPIVYMSIVDAYERKSSSNINSRVGTVRSVETTENRALGTLLGFYEKNVVQVTSCYAVPFRETSDDIPEINDALNRQMWHMSKRTSPSEQIVGWFFTVPDLSEMCPHYHGYYTGLVNETPRKEPPPIILITMDFTFSGESADRLPIKAYAAREAGVPGKGATQATIFYPLKVEMDVFPGESVALSFIMRGLDSERREIKIANSQEQFLENGKQMVHWLEKMLGYL

SEQ ID NO: 122121 - protein, 77 aa, Heterodera glycines
  Homolog annotation: Hit_ID=CAE60496.1; Match level="QueryCoverage =98%, HitCoverage=98%, E-value=3e-27, Identity=71%"; Hit description =Hypothetical protein CBG04114 [Caenorhabditis briggsae]
  Gene Ontology: Mol. function=U6 snRNA binding; Cellular component =nucleus; Biological process=mRNA splicing
  Essential gene: C elegans homolog=Y71F9B.4; Phenotype=Emb,Gro
  Coding regions on vcDNA: vcDNA=SeqID_48544; Strand=+; Position=74-307
MSKTHPPELKKYMDKQVNIKLNGNRNVSGILRGFDPFMNIVVEDCIEHLKTGESQSIGMVVVRGNSVVIMEPMERIG

SEQ ID NO: 122122 - protein, 191 aa, Heterodera glycines
  Homolog annotation: Hit_ID=CAB60993.2; Match level="QueryCoverage =97%, HitCoverage=48%, E-value=7e-90, Identity=85%"; Hit description =Hypothetical protein C08B11.5 [Caenorhabditis elegans] sp|Q09442|YP85_CAEEL Hypothetical RNA-binding prote
  Gene Ontology: Mol. function=pre-mRNA splicing factor activity; Cellular component=spliceosome complex; Biological process=mRNA splicing
  Essential gene: C elegans homolog=C08B11.5; Phenotype=Emb
  Coding regions on vcDNA: vcDNA=SeqID_48545; Strand=+; Position=48-620
MSVLITERNQDATIYVGGLDEKVTEAILWELFVNAGPVTNVNMPKDRITGTHQGFGFVEFMSEEDADYAIKIMNMIKLFGKPIKVNKASANEKNMDVGANLFVGNLDPEVDEKLLFDTFSAFGVILQPPKIMRDVETGSSKGYAFINFASFEASDAALEAMNGQFLCNRPITCSYAFKKDTKGERHGTTAE

SEQ ID NO: 122123 - protein, 198 aa, Heterodera glycines
  Homolog annotation: Hit_ID=NP_495919.1; Match level="QueryCoverage =58%, HitCoverage=68%, E-value=8e-15, Identity=39%"; Hit description =NADH ubiquinone oxidoreductase, AGGG subunit (18.5 kD) (2J287) [Caenorhabditis elegans] emb|CAA90118.1| H
  Essential gene: C elegans homolog=F44G4.2; Phenotype=Emb,Lva
  Coding regions on vcDNA: vcDNA=SeqID_48546; Strand=+; Position=14-610
MTISIFPRICPSFPPFLRHFPSSSANSLAFRRHFSLTGPRHSFFFDYFTKHPKDMPPLRDYLPRPTWVKHGNEFPLRQLLPGHYDDPEWHPKDRGYAGSPRFGDKIPEDIMIYRRSPTEEEVPFLHKAMHKLMSMVFWYWVFYTIYWHHQEQFTGEWYFPYHYEWTDEELGVPPDDAPDPEERQFWGHPGELIGTYRA

SEQ ID NO: 122124 - protein, 348 aa, Heterodera glycines
  Homolog annotation: Hit_ID=CAE67177.1; Match level="QueryCoverage =79%, HitCoverage=32%, E-value=1e-104, Identity=67%"; Hit description= Hypothetical protein CBG12609 [Caenorhabditis briggsae]
  Gene Ontology: Cellular component=nucleoplasm; Biological process =chromosome segregation
  Essential gene: C elegans homolog=ZC308.1a; Phenotype=Emb
  Coding regions on vcDNA: vcDNA=SeqID_48547; Strand=+; Position=71-1114
MAPPPATVDEYTLSQSRFPSVASLAPPTVLMMSTAGQTPVHRRRHCSAGSNNAQPNNSHEAISRMDVLSERIRDFHYNEDQTHAQLNRKLQLRDQLYYAISPIFPMCGLYIVGSSLNGFGTKRSDLDLCLMITNRDIDQRTDAVVVLSSVMRTLESNQIVAEQNLILAKVPILRIKFIGTFHDITVDLNVNNSVAIRNTHLMCYYSSFDWRVRPLVMVVKEWAKRHGINDSACSSFTSYSLVLMVIHYLQCGAQPPVLPNLQQMYPKRFSVRADVRTLNVSLPFEPIPTAMGWQFKDDATLSELLLGFLRYYAFQFDFDADAISIRMGKKVNRAQVAQNQSPFNTLSQ

SEQ ID NO: 122125 - protein, 292 aa, Heterodera glycines
  misc_feature (145)..(145): Xaa can be any naturally occurring amino acid
  misc_feature (189)..(189): Xaa can be any naturally occurring amino acid
  misc_feature (271)..(271): Xaa can be any naturally occurring amino acid
  Homolog annotation: Hit_ID=NP_501751.1; Match level="QueryCoverage =98%, HitCoverage=67%, E-value=1e-48, Identity=34%"; Hit description =fatty acid desaturase (52.3 kD) (fat-4) [Caenorhabditis elegans] emb|CAB61031.1| Hypothetical protein T13
  Essential gene: C elegans homolog=W08D2.4; Phenotype=Unc
  Coding regions on vcDNA: vcDNA=SeqID_48548; Strand=+; Position=59-934
MVLTDSAHADPKNAVPFRLRIDGHWVRVDERLLRAHPGSGAMLAYRDREASTVFHSFHAGSKRAYRWMTEHRENGGATAETEATTEANGTAAKTKKSNGTGAGAALWPDKIDAINMGKFGRSAEANEKICRSFDVLRSRVRSLGXLRADDALFVLKFIQCVALIAFAVFLQSRDFFLASALCMGIAWPXEYGHQQHFGSWWWNDVCGYVCGNLMQDFSLGGWKRIDSVSPLAHLLPFQHLYWSFALPLLRFSWLLQSVQFVCQIRHSFHDXHRQRALVEQCSLALHWSLVFV

SEQ ID NO: 122126 - protein, 150 aa, Heterodera glycines; identical to SEQ ID NO: 119655
  Homolog annotation: Hit_ID=AAH20086.1; Match level="QueryCoverage =90%, HitCoverage=79%, E-value=2e-38, Identity=53%"; Hit description =RNA binding motif protein 8a [Mus musculus] gb|AAH58376.1| RNA binding motif protein 8a [Mus musculus] gb|
  Gene Ontology: Mol. function=mRNA binding; Cellular component =nucleus; Biological process=microtubule cytoskeleton organization and biogenesis
  Essential gene: C elegans homolog=R07E5.14; Phenotype=Emb
  Coding regions on vcDNA: vcDNA=SeqID_48549; Strand=+; Position=29-481

SEQ ID NO: 122127 - protein, 217 aa, Heterodera glycines
  Homolog annotation: Hit_ID=CAE67073.1; Match level="QueryCoverage =98%, HitCoverage=75%, E-value=9e-45, Identity=41%"; Hit description =Hypothetical protein CBG12482 [Caenorhabditis briggsae]
  Gene Ontology: Biological process=reproduction
  Essential gene: C elegans homolog=F59A3.3; Phenotype=Lva
  Coding regions on vcDNA: vcDNA=SeqID_48550; Strand=+; Position=12-662
MVRKLHAELDYARHFPKAYLDKAQRHVPMKVYDNRFGAPPVIRWAIRPDDWAMRTKRPWEYGEVENVIRQEKMYQRQLFSTKFYRKKWNKMPIIPAENWTIFPGDTVQVMVGKHKGRKSNVSHVIKESNAVFVEGLHTKLVDKFNKDRMKEMGIGDVFFDQWEEQPLFLHKGEVQLVDPSDGEPCMAKWVLNDSKTEYQRISSRTGFLIPLPSRAFT

SEQ ID NO: 122128 - protein, 251 aa, Heterodera glycines
  Homolog annotation: Hit_ID=NP_496795.1; Match level="QueryCoverage =29%, HitCoverage=19%, E-value=1e-23, Identity=65%"; Hit description =maturing Oocyte Expressed MOE-3, C-x8-C-x5-C-x3-H type zinc finger containing protein family member (moe-
  Gene Ontology: Mol. function=single-stranded RNA binding; Cellular component=cytoplasm; Biological process=cell fate specification
  Essential gene: C elegans homolog=C09G9.6; Phenotype=Oma,Ste
  Coding regions on vcDNA: vcDNA=SeqID_48551; Strand=+; Position=34-789
MDYELSNQQLRPFSRSFTSSSFSQQRSNNPSLFQYINPNSDKALRVFQAHTRHSGKAEENYKTVMCQNWLEQAECRFGSKCRFAHGPEELRVATTPLPINNKYKTRLCEKYTKNGVCPYGERCLFIHPDQQFGLPSSTFAASLPLSLFRFQQMTTATFHHRSHQKFPSNRQIRNLLPQIEEELRREREEIKQQNHQQKCNGLRVEIPQPSVGASSSHTPEQIEWRGMVEMVDKLTLTPSANNKLCPADFPS

SEQ ID NO: 122129 - protein, 105 aa, Heterodera glycines
  Homolog annotation: Hit_ID=NP_510360.1; Match level="QueryCoverage =91%, HitCoverage=32%, E-value=6e-13, Identity=39%"; Hit description =putative endoplasmic reticulum protein, with a coiled coil domain, of bilaterial origin (34.2 kD) (XO782)
  Essential gene: C elegans homolog=R03E1.2; Phenotype=Emb,Lva,Lvl,Unc
  Coding regions on vcDNA: vcDNA=SeqID_48552; Strand=+; Position=53-370
MLLRFSLTVQLLLLFFAFEVLGAEPPEGAQNEEGQRDSKRLEMARKGLNVHMFSSPNFAPMFGIIAGLSVVLIIAIVFIVVGLLSMEPAKDSIIYRMTTTRLKKD

SEQ ID NO: 122130 - protein, 199 aa, Heterodera glycines
  Homolog annotation: Hit_ID=AAS54865.1; Match level="QueryCoverage =100%, HitCoverage=98%, E-value=8e-73, Identity=69%"; Hit description= AGR375Wp [Ashbya gossypii ATCC 10895] ref|NP_987041.1| AGR375Wp [Eremothecium gossypii]
  Gene Ontology: Cellular component=eukaryotic 48S initiation complex; Biological process=protein biosynthesis
  Essential gene: C elegans homolog=F42C5.8; Phenotype=Lva,Ste
  Coding regions on vcDNA: vcDNA=SeqID_48553; Strand=+; Position=15-611
MGISRDSRHKRAHTGAKRAHYRKKRKFELGRQAANTKLGATRVHQVRVRGGNIKFRALRLDTGNFSWGSESCTRKTRILGVVYNASNNELVRTNTIVKGGIVEIDATPFRQWYESHYVQALGRKQKDVAEVEELNKKRSSRVLRKVEARQANAKVDPHLASQFQKGRLYARIASRPGQSGRADGYILEGKELDFYLRKL

SEQ ID NO: 122131 - protein, 297 aa, Heterodera glycines
  Homolog annotation: Hit_ID=CAE64108.1; Match level="QueryCoverage =98%, HitCoverage=55%, E-value=1e-125, Identity=78%"; Hit description= Hypothetical protein CBG08717 [Caenorhabditis briggsae]
  Gene Ontology: Mol. function=hydrogen-transporting ATP synthase activity, rotational mechanism; Cellular component=extracellular space; Biological process=morphogenesis
  Essential gene: C elegans homolog=H28O16.1a; Phenotype=Emb,Lva
  Coding regions on vcDNA: vcDNA=SeqID_48554; Strand=+; Position=16-906
MLSKKLFQSILNKSPKTAFSTSARLSASSAEVSRILEEKILGQASQINLEETGRVLSIGDGIARVYGLKNIQAEEMVEFDSGMKGMALNLETDNVGVVVFGNDKVIKEGDVVKRTGSIVDVGVGEALLGRVVDALGNPIDGKGPINVSKRSRVEVKAPGIIPRVGVREPMLTGVKAVDSLVPIGRGQRELIIGDRQTGKTAIAIDTIINQKRFNSSTEEKKKLYCIYVAIGQKRSTVAQIVKRLTDTDAMKYTIIVSATASDATPLQFLAPYSGADMGEIFRDNGKHGMNIDDESLQ

SEQ ID NO: 122132 - protein, 159 aa, Heterodera glycines
  Homolog annotation: Hit_ID=CAE74519.1; Match level="QueryCoverage =100%, HitCoverage=100%, E-value=2e-45, Identity=57%"; Hit description=Hypothetical protein CBG22273 [Caenorhabditis briggsae]
  Gene Ontology: Mol. function=structural constituent of ribosome; Cellular component=cytosolic ribosome (sensu Eukarya); Biological process=reproduction
  Essential gene: C elegans homolog=D1007.12; Phenotype=Emb,Lva,Ste
  Coding regions on vcDNA: vcDNA=SeqID_48555; Strand=+; Position=43-522
MKTETCVYSGYKIHPGHGKRVVRADGKIQIYLSKKAQRGAALKRNPRDVPWTVLYRRKHKKGVHAEEGTQRKRVKRTVQIASRPIADLTVEALLAQRNQKPEFRKQQRDAAIKAAKESARVKKDETKKKQQKIDKKAAPTKTKAAKQVKAPKQFVGGKR

SEQ ID NO: 122133 - protein, 260 aa, Heterodera glycines
  Homolog annotation: Hit_ID=NP_871640.1; Match level="QueryCoverage =100%, HitCoverage=38%, E-value=1e-105, Identity=70%"; Hit description=glycyl tRNA Synthetase (76.5 kD) (grs-1) [Caenorhabditis elegans] gb|AAN65294.1| Glycyl trna synthetase
  Gene Ontology: Mol. function=glycine-tRNA ligase activity; Cellular component=mitochondrion; Biological process=tRNA modification
  Essential gene: C elegans homolog=T10F2.1a; Phenotype=Emb
  Coding regions on vcDNA: vcDNA=SeqID_48556; Strand=+; Position=3-782
CALKANMIQAWRTHFVLEEGMLEVECTSLTPEYVLKASGHVDRFIDWMVKDKQTGACFRADHLVKNQAETLIRDKKTDEKTKSELMNVLVMLDGMSCDDLHEVIKKFNFKSPLTGGDLSEPVSFNLMFPTEIGPTCDQRAFLRPETAQGIFINFKRLLEFNQGRLPFAAAQVGSGFRNEISPRQGLIRVREFTMCEIEHFVDPTDKRHPKFEKIAHLELTLFPACNQMESKNPQKISIGNAVKLGIVNNETLGYYMARTH

SEQ ID NO: 122134 - protein, 126 aa, Heterodera glycines
  Homolog annotation: Hit_ID=NP_035425.2; Match level="QueryCoverage =93%, HitCoverage=89%, E-value=2e-32, Identity=53%"; Hit description =ribosomal protein S12 [Mus musculus] gb|AAH87174.1| Unknown (protein for MGC:97945) [Xenopus laevis] gb|A
  Gene Ontology: Mol. function=structural constituent of ribosome; Cellular component=cytosolic small ribosomal subunit (sensu Eukarya); Biological process=protein biosynthesis
  Essential gene: C elegans homolog=F54E7.2; Phenotype=Emb,Ste
  Coding regions on vcDNA: vcDNA=SeqID_48557; Strand=+; Position=45-425
MIETLETSEVLKRVLKSALIVDGVARGLNEAAQTLDKREAHFCVLAKSCDEASFEKLVRSLCKEHIIPILEVEDKAELGQMVGQCKYDKDGKARKIVGCSVAVVKDYGRDEEAKNDLQEVLKKISD

SEQ ID NO: 122135 - protein, 84 aa, Heterodera glycines
  Homolog annotation: Hit_ID=CAE66872.1; Match level="QueryCoverage =92%, HitCoverage=89%, E-value=1e-28, Identity=70%"; Hit description =Hypothetical protein CBG12250 [Caenorhabditis briggsae]
  Essential gene: C elegans homolog=ZK652.1; Phenotype=Emb
  Coding regions on vcDNA: vcDNA=SeqID_48558; Strand=+; Position=39-293
MSTGVIQPLNPKPFLNNLTGKPIICKLKWGMEYRGILMSIDGYMNLHLANTEEYIDGTNTGALGEVLIRCNNVLWISAAEEGEQ

SEQ ID NO: 122136 - protein, 315 aa, Heterodera glycines
  Homolog annotation: Hit_ID=CAE66855.1; Match level="QueryCoverage =96%, HitCoverage=96%, E-value=1e-104, Identity=55%"; Hit description= Hypothetical protein CBG12227 [Caenorhabditis briggsae]
  Gene Ontology: Mol. function=oxidoreductase activity; Cellular component=membrane; Biological process=positive regulation of body size
  Essential gene: C elegans homolog=C25A1.5; Phenotype=Sck,Sma
  Coding regions on vcDNA: vcDNA=SeqID_48559; Strand=+; Position=67-1014
MNREETNKHPLIVTYAGRHYDISGFVSRHPGGERVLRMVAGANVDSFIDGTSELLGLRHEHSAAAYGILARYSLDQEFKRDPLVDSKAPMLWRVGELRERYWTWIHHPYDGVLRLFESDLLEQLTRTKWWLIPLIWLPIVSYFFFTGLSLLREDFGFSGGPLLAFGLFAFGCLAWTLLEYSLHRGLFHWHPNAHSYRQITLHFLLHGLHHKTPMDSDRLVFPPAAAVLIVGFFYTIYRSLLPFPIFCCFASGKLFGYIVYDITHYYLHHGRPETNSGWHYRKIYHHNHHFKDSDSSFGISTTFWDYVFGTVGTFN

SEQ ID NO: 122137 - protein, 268 aa, Heterodera glycines
  Homolog annotation: Hit_ID=CAE67991.1; Match level="QueryCoverage =70%, HitCoverage=57%, E-value=3e-44, Identity=51%"; Hit description =Hypothetical protein CBG13601 [Caenorhabditis briggsae]
  Gene Ontology: Mol. function=tRNA methyltransferase activity; Cellular component=nucleus; Biological process=gametogenesis
  Essential gene: C elegans homolog=W02A11.1; Phenotype=Gro,Stp
  Coding regions on vcDNA: vcDNA=SeqID_48560; Strand=+; Position=2-805
RTLQKSTQILYTPDIGTILLLLDVKPGARICETGTGSGSLSHAIATAVAPDGHLYSFDIDEKRAKTVHNDLKLHGLSQNATVLCRDVSQHGFAATDCAEKEWRCDGVFLDLPAPWLAIGHAHKVLLQNGPERRPSRLVSFSPCIEQVQRVCAELEQHGFVDIETVEVVPPKLKVVDLPCESLSEYAAKGANAQTFFQKESQHNNTDCEQQRQKGRRGAKRKADNAGEKTKMEEDADTCQNGLNGKVAAASIAQESDGPQTETDAMPFP

SEQ ID NO: 122138 - protein, 422 aa, Heterodera glycines
  Homolog annotation: Hit_ID=NP_777285.1; Match level="QueryCoverage =97%, HitCoverage=88%, E-value=1e-155, Identity=64%"; Hit description= RuvB-like protein 2 [Danio rerio] gb|AAH58871.1| RuvB-like protein 2 [Danio rerio] gb|AAL18005.1| RuvB-l
  Gene Ontology: Mol. function=ATP dependent DNA helicase activity; Cellular component=cytosol; Biological process=DNA recombination
  Essential gene: C elegans homolog=T22D1.10; Phenotype=Emb,Lva
  Coding regions on vcDNA: vcDNA=SeqID_48561; Strand=+; Position=15-1283
MSEIGNFEIRNVSKVERIGAHSHITGLGLKANFEPIFISDGMVGQCAARKAAGLIVRMIKDGQIAGRALLIVGEPGTGKTAVAMGISKSIGGDTPFISISASEVFSMDLSKPEALTQSFRKAIGVRIKEETEVLCGEVVQLEIDRPQSGAGPRVGKLTLKTTDMEAIYDIGNKMTESVIKERITAGDVIQIDKATGKISKIGRSLARSKDFDALGPQDKLVACPSGEIQSRVETVNTISLHDIDVINSRSSGYLAVFSGDTGEIKSEVREQIDKKVMAWREENKAQIIPGVLFVDEVHMFDLECFSFINRYIESDLSPILVMATNRGIVNIRGTSVESPHGVPLFLLDRSLIIRTSSYKENEIGEILKIRASDELVEMEDASIAVLVQIALETSMRYCMQLISTADILRQRRKGEKTKCLRH

SEQ ID NO: 122139 - protein, 207 aa, Heterodera glycines
  misc_feature (187)..(187): Xaa can be any naturally occurring amino acid
  Homolog annotation: Hit_ID=CAA50685.1; Match level="QueryCoverage =92%, HitCoverage=47%, E-value=3e-89, Identity=79%"; Hit description =IEF SSP 9306 [Homo sapiens]
  Gene Ontology: Mol. function=H3/H4 histone acetyltransferase activity; Cellular component=nucleus; Biological process=cell proliferation
  Essential gene: C elegans homolog=K07A1.12; Phenotype=Emb
  Coding regions on vcDNA: vcDNA=SeqID_48562; Strand=+; Position=113-733
MSVPGSQPPQQGEDAEERLINEEYKIWKKNCPFLYDMVMTHALEWPSLTVQWLPDVQRQEGADYTIHRLILGTHTSDEQNHLVIAKLLLPNDDAQFDASRYDTDRGEFGGFGTVTGKIEVEIKMNHEGEVNRARYMPQNPVLIGTKSPSSEVYVFDYTKHPSTPADVECKPQLRLRGHTKEGYGLSXNNNLPGHLLSASDDMTVCLW

SEQ ID NO: 122140 - protein, 184 aa, Heterodera glycines
  Homolog annotation: Hit_ID=NP_499643.1; Match level="QueryCoverage =96%, HitCoverage=64%, E-value=3e-13, Identity=29%"; Hit description =angio-associated migratory cell protein (23.7 kD) (3N707) [Caenorhabditis elegans] emb|CAC35841.1| Hypoth
  Gene Ontology: Biological process=gametogenesis
  Essential gene: C elegans homolog=Y111B2A.12; Phenotype =Emb,Lva,Sck,Sma,Stp
  Coding regions on vcDNA: vcDNA=SeqID_48563; Strand=+; Position=6-557
MNYDNGISDDDDLEMDENGSDGVEIVDFVEEPHKEDNSAAKIAAHSKDVFCLALSPDGHWLASGSEDETAAVWDLRHGMTSPLLHRTISSHSDSVHLLAWNVSANILASADMAGRIICTKVTGDEATQTASLTIDDCFVEPSRRDDDNGEDEEGQGSDPEQIGWLFWHSTVEGILFAGCNDGSL

SEQ ID NO: 122141 - protein, 205 aa, Heterodera glycines
  Homolog annotation: Hit_ID=NP_491740.1; Match level="QueryCoverage =100%, HitCoverage=41%, E-value=2e-78, Identity=68%"; Hit description= constitutive photomorphogenic COP9 SigNalosome subunit (56.8 kD) (csn- 2) [Caenorhabditis elegans] gb|AAB
  Gene Ontology: Mol. function=signal transducer activity; Cellular component=signalosome complex; Biological process=positive regulation of growth rate
  Essential gene: C elegans homolog=B0025.2; Phenotype=Egl,Emb
  Coding regions on vcDNA: vcDNA=SeqID_48564; Strand=+; Position=61-675
MSDFEMDDGEDYGLQYSDDSGSEPDVALENQYYAAKTLKSDGDQRGALDAFRRVLELETEKGDWGFKALKQMMKLNYAMGNFEEMLRHYRNLLTYIRSSVTKNYAEKSINSILDYVSLSKNTALLQQFYKITLEALKEAKNERLWFKTNTKLGKLYFDLKEFDRLKQVLKQLRNSCQTEHGEDDQRKGTQLLEIYALEIQMYTEQ

SEQ ID NO: 122142 - protein, 261 aa, Heterodera glycines
  Homolog annotation: Hit_ID=CAE59376.1; Match level="QueryCoverage =99%, HitCoverage=35%, E-value=3e-46, Identity=39%"; Hit description =Hypothetical protein CBG02729 [Caenorhabditis briggsae]
  Gene Ontology: Cellular component=nucleus; Biological process =ribosome nucleus export
  Essential gene: C elegans homolog=C07E3.2; Phenotype=Unclassified
  Coding regions on vcDNA: vcDNA=SeqID_48565; Strand=+; Position=3-785
LIKVLTHFWSRKTEEIRCIAFVALCKIARLDSECFPAVYKNCYTAYVANCKTIDDETLPFIHFMQCSLAELTFVHPSQAYQYAFVYIRQFAIHLRNAMIAKRKDLIQTVYNWQFVKGLQLWVLVICEGSKRFRPSSDKSASWFYELVHPLVEVINSLWRLFPSTKFFPLRIHSIQMLLDIQRESEVFVPSLAFAVELLDELAQIDAKRPTAGKGRTREPNAERMLRLSGEQLDDAGVRAHLAQRLFALITDCLNLLNSRES

SEQ ID NO: 122143 - protein, 132 aa, Heterodera glycines
  Homolog annotation: Hit_ID=NP_492322.1; Match level="QueryCoverage =98%, HitCoverage=97%, E-value=3e-42, Identity=61%"; Hit description =RAN (nuclear import/export) related (15.1 kD) (ran-4) [Caenorhabditis elegans] emb|CAA99890.1| Hypothetic
  Gene Ontology: Mol. function=RAN protein binding; Cellular component =nucleus; Biological process=protein-nucleus import
  Essential gene: C elegans homolog=R05D11.3; Phenotype=Emb,Lva
  Coding regions on vcDNA: vcDNA=SeqID_48566; Strand=+; Position=455-853
MATYNPNYESIGQAFVQHFYTKFDVPDGPTRTVGLHDLYDAEHSFMTFEGNQVKGRQAILDKYGALPFRTIQHGITKTDSQPLPDGSILVTVIGQLKTDDDPVNSFNHCFILRPNSSGGFFISNEVFRLVLH

SEQ ID NO: 122144 - protein, 161 aa, Heterodera glycines
  Homolog annotation: Hit_ID=CAE70207.1; Match level="QueryCoverage =100%, HitCoverage=100%, E-value=1e-56, Identity=65%"; Hit description=Hypothetical protein CBG16683 [Caenorhabditis briggsae]
  Gene Ontology: Mol. function=structural constituent of ribosome; Cellular component=cytosolic large ribosomal subunit (sensu Eukarya); Biological process=protein biosynthesis
  Essential gene: C elegans homolog=C14B9.7; Phenotype=Emb
  Coding regions on vcDNA: vcDNA=SeqID_48567; Strand=+; Position=122-607
MVNPKGYRRGTRYMFARPFRKHGVEPLSTFYRVYKRGDIVTVKGNGAFQKGMPFKAYHGKTGRVFNVTKHALGVVVNKRVRHRIIPKRINVRVEHVKPSGSRLEFLQRCKANDLQKKQHKEGNAPFVALKRKPKEPRVAHLVKVKSTKVERLAPVKFEIVA

SEQ ID NO: 122145 - protein, 129 aa, Heterodera glycines
  Homolog annotation: Hit_ID=NP_505714.1; Match level="QueryCoverage =87%, HitCoverage=84%, E-value=5e-10, Identity=37%"; Hit description =putative protein, LiPid Depleted LPD-9 (15.0 kD) (lpd-9) [Caenorhabditis elegans] emb|CAA97333.1| Hypothe
  Gene Ontology: Biological process=growth
  Essential gene: C elegans homolog=T21C9.5; Phenotype=Lpd
  Coding regions on vcDNA: vcDNA=SeqID_48568; Strand=+; Position=58-447
MNSPVISRGMHGFSTTISKRFASSISEGHAEYYREFNRLASAGIWDQLNMRPKVFSTKTEKAAAMKVWQKMLPEDAGWFDRRPGGVFLKMLLHISLACFAVFMIPYTYEKVVPEEYRCKIKYKKNDGHH

SEQ ID NO: 122146 - protein, 151 aa, Heterodera glycines
  Homolog annotation: Hit_ID=AAT92172.1; Match level="QueryCoverage =100%, HitCoverage=100%, E-value=4e-71, Identity=87%"; Hit description=ribosomal protein S14 [Ixodes pacificus]
  Gene Ontology: Mol. function=structural constituent of ribosome; Cellular component=cytosolic small ribosomal subunit (sensu Eukarya); Biological process=protein biosynthesis
  Essential gene: C elegans homolog=F37C12.9; Phenotype=Emb,Ste
  Coding regions on vcDNA: vcDNA=SeqID_48569; Strand=+; Position=31-486
MASRKGKVKEEQPAVSLGPQVQEGENVFGVAHIFASFNDTFVHVTDLSGRETIVKITGGMRVKADRDEASPYAAMLAAQDVAERCKQVGINALHVKLRATGGTKTKTPGPGAQAALRALARSGMKIGRIEDVTPIPSDSTRQKGGRRGRRL

SEQ ID NO: 122147 - protein, 341 aa, Heterodera glycines
  Homolog annotation: Hit_ID=AAC79129.1; Match level="QueryCoverage =95%, HitCoverage=100%, E-value=1e-175, Identity=95%"; Hit description=glyceraldehyde-3-phosphate-dehydrogenase [Globodera rostochiensis] sp|O16027|G3P1_GLORO Glyceraldehyde-3
  Gene Ontology: Mol. function=glyceraldehyde 3-phosphate dehydrogenase (phosphorylating) activity; Cellular component=cytoplasm; Biological process=glycolysis
  Essential gene: C elegans homolog=K10B3.7; Phenotype=Unclassified
  Coding regions on vcDNA: vcDNA=SeqID_48570; Strand=+; Position=106 -1131
MVKPKVGINGFGRIGRLALRAAIEKDTVQVVAVNDPFIELDYMVYMFNYDSTHGRFKGKISTNAGNLVVEKEGKSAHTIKVFNLKDPAEIKWGEAGAEYVIESTGVFTTIEKASAHLKGGAKKVVISAPSADAPMYVMGVNEDKYDPAKDDVISNASCTTNCLAPLAKVINDEFGIIEGLMTTVHAVTATQKTVDGPSGKQWRDGRGAAQNIIPASTGAAKAVGKVIPELNGKLTGMAFRVPTPNVSVVDLTARLEKPAPLDAIKEAVKKAANGKLKGILAYTEDQVVSTDFLGDSHSSIFDAGACISLNPHFVKLVSWYDNEFGYSCRLVDLITHCASKA

SEQ ID NO: 122148 - protein, 205 aa, Heterodera glycines
  Homolog annotation: Hit_ID=AAB62321.1; Match level="QueryCoverage =98%, HitCoverage=35%, E-value=1e-56, Identity=55%"; Hit description =RanGTPase activating protein [Xenopus laevis] sp|O13066|RGP1_XENLA Ran GTPase-activating protein 1
  Gene Ontology: Mol. function=Ran GTPase activator activity; Cellular component=cytosol; Biological process=signal transduction
  Essential gene: C elegans homolog=C29E4.3a; Phenotype=Emb
  Coding regions on vcDNA: vcDNA=SeqID_48571; Strand=+; Position=32-646
MRVLSFAGLQLKLDTIGDGEKIAAKIRECAGLEVLEMRGNTLGVGATAPIAEALECQSNLKRALWSDMFTGRLKEEIPRTLKTLCDAMILSGARLTELDLSDNAIGPMAVPGIKEFLAGEAAFALKTLKLNNCGLGIAGKTIAHCLIECHRRSVSHGTPLCLKIFVARRNRLEYTSTAALAEAFQIIGTLEEISMPQNGISAEGI

SEQ ID NO: 122149 - protein, 296 aa, Heterodera glycines
  Homolog annotation: Hit_ID=NP_508153.1; Match level="QueryCoverage =98%, HitCoverage=98%, E-value=9e-96, Identity=57%"; Hit description =HAH-P like (34.3 kD) (XB393) [Caenorhabditis elegans] gb|AAA82460.1| Hypothetical protein T04G9.4 [Caenor
  Essential gene: C elegans homolog=T04G9.4; Phenotype=Gro,Prz,Unc
  Coding regions on vcDNA: vcDNA=SeqID_48572; Strand=+; Position=3-890
AVTEQCFCKRWAFSLKKSMESENFERHFRLAIQSVTAEDYEKMRQYRHREDSLATLAGRLFLRKAVQCLCGVRWADIEISRTERGKPFIVRPENISIGLNVSHQGDYTVFASSCTNQVGVDVMRLDMCRGNKTADEYINSMAKSASAGELRTMRGQPTEQKKMTVFYRYWCLKETIMKATGHGLVNDLSRFDFIIDPNERYKQGSFITSTTFTEDAIKQPQWVFEESFVDANHVAAVCREKALPAVCTFRKEQCAKIFFSKIDFEFLLDDASILNPLADGGASEYNNFMQKPRKKF

SEQ ID NO: 122150 - protein, 91 aa, Heterodera glycines
  Homolog annotation: Hit_ID=XP_393173.1; Match level="QueryCoverage =84%, HitCoverage=14%, E-value=9e-36, Identity=98%"; Hit description =similar to Hypothetical protein CBG09037 [Apis mellifera]
  Essential gene: C elegans homolog=ZK1010.1; Phenotype=Emb
  Coding regions on vcDNA: vcDNA=SeqID_48573; Strand=+; Position=3-278
LSDRIQHPFNLAIMQIFVKTLTGKTITLEVEASDTIENVKAKIQDKEGIPPDQQRLIFAGKQLEDGRTLADYNIQKESTLHLVLRLRGGKN

SEQ ID NO: 122151 - protein, 204 aa, Heterodera glycines
  Homolog annotation: Hit_ID=NP_501789.1; Match level="QueryCoverage =82%, HitCoverage=56%, E-value=2e-25, Identity=37%"; Hit description =RNaseIII (4K696) [Caenorhabditis elegans] emb|CAA93284.1| Hypothetical protein F25H8.1 [Caenorhabditis el
  Gene Ontology: Mol. function=tRNA (guanine) methyltransferase activity; Biological process=tRNA modification
  Essential gene: C elegans homolog=F25H8.1; Phenotype=Unclassified
  Coding regions on vcDNA: vcDNA=SeqID_48574; Strand=+; Position=39-650
MSSSNTILLDCSDDSAVVVGFEQCATSEGGGAVEPQQKLTKNQQKKRARMERFNAGKAEWRRKQRERHKERKRARKADGQTATVVHNDRPNKLNTMNESKCRVRVAVDMAYDDLMDERSVCKTVSQLRHCYASNRRAADPLQFYVVNLDEKAKKVLDGITGWQQWDVHLLAQPLAKLWDDREIVYLTADSENVLSALDEQKVYV

SEQ ID NO: 122152 - protein, 224 aa, Heterodera glycines
  Homolog annotation: Hit_ID=NP_524808.2; Match level="QueryCoverage =98%, HitCoverage=83%, E-value=6e-58, Identity=51%"; Hit description =CG6341-PA [Drosophila melanogaster] gb|AAF57941.2| CG6341-PA [Drosophila melanogaster]
  Gene Ontology: Mol. function=translation elongation factor activity; Cellular component=eukaryotic translation elongation factor 1 complex; Biological process=translational elongation
  Essential gene: C elegans homolog=F54H12.6; Phenotype=Lva
  Coding regions on vcDNA: vcDNA=SeqID_48575; Strand=+; Position=54-728
MTQNGMTTASNEFNELNDFLSTRAYLHGFLPSQEDQYVFKCIAAAPSASEYPHIARWYKHIKSYEDAERATWPKKAGQPPQKVVSKDSAPPAKKADAEEDFDLFGDEDSDDEEKKRITEERLKAYAEKKAKKPGPVAKSNVIYDVKPWDDTIDIKDIEANVRSIECDGLVWGTSRILPVAFGVQKLQIGCCVVDEKVSTDWLEEQITGFEDLVQSVDVVAFNKV

SEQ ID NO: 122153 - protein, 159 aa, Heterodera glycines
  Homolog annotation: Hit_ID=AAA68776.1; Match level="QueryCoverage =96%, HitCoverage=96%, E-value=5e-64, Identity=78%"; Hit description =Inhibitor of cell death protein 1 [Caenorhabditis elegans] ref|NP _495336.1| transcription factor btf3 (17.
  Gene Ontology: Mol. function=transcription factor activity; Cellular component=nucleus; Biological process=regulation of transcription, DNA-dependent
  Essential gene: C elegans homolog=C56C10.8; Phenotype=Emb,Gro,Stp,Unc
  Coding regions on vcDNA: vcDNA=SeqID_48576; Strand=+; Position=31-510
MNAEKIKKLQQNAEHVRTGGKGTARRKKKVVHKTTAMDDKKLQTNLKKLSVTNIPGIEEVNMIKDDGTVIHFNNPKVQASVPANTFSITGTAENKQITDMLPGILNQLGAESLTHLKKLANNVTTQFKPSAEDDDVPDLIGDFEEASKNESKTTEELVH

SEQ ID NO: 122154 - protein, 194 aa, Heterodera glycines
  Homolog annotation: Hit_ID=CAE67039.1; Match level="QueryCoverage =96%, HitCoverage=94%, E-value=1e-75, Identity=73%"; Hit description =Hypothetical protein CBG12445 [Caenorhabditis briggsae]
  Essential gene: C elegans homolog=W10D5.2; Phenotype=Emb,Lva
  Coding regions on vcDNA: vcDNA=SeqID_48577; Strand=+; Position=69-650
MAKSDVPALSTTNQPYPYKEQTPKGIFEKMGLQKTPDGTSIGEFAVMRMDDMMNLIGRGSLWPLTFGLACCAVEMMHFAAPRYDMMRFGVVFRATPRQCDLIIVSGTVTNKMAPALRRIYDQMPHPKWVISMGSCANGGGYYHYSYSVLRGCDRVIPVDIYVPGCPPSAEALLYGVLQLQKKIKRLKKVQMWYR

SEQ ID NO: 122155 - protein, 206 aa, Heterodera glycines
  Homolog annotation: Hit_ID=CAE70374.1; Match level="QueryCoverage =75%, HitCoverage=11%, E-value=1e-25, Identity=38%"; Hit description =Hypothetical protein CBG16933 [Caenorhabditis briggsae]
  Gene Ontology: Biological process=locomotory behavior
  Essential gene: C elegans homolog=VF36H2L.1; Phenotype=Unc
  Coding regions on vcDNA: vcDNA=SeqID_48578; Strand=+; Position=12-629
TSQTDKRRQMGVAFVLCCFSVAFTPSLFIFRRFVAPDPLRIILFVLGAFFWLCSLLLSAVVFAVFGQHLLLVAIFFSILFQEVARALFYLLLYKTQSNLARLMAADANRTGTVSSMRLLYSSRHILAIVCGLGMGTAAALFHLANVLAAYWDDGVVGLPGAVQANRTMAEPTDASATAQPNAVPLPHHSDPAILLSAAADGGVTAV

SEQ ID NO: 122156 - protein, 362 aa, Heterodera glycines
  Homolog annotation: Hit_ID=NP_495900.1; Match level="QueryCoverage =98%, HitCoverage=82%, E-value=1e-156, Identity=75%"; Hit description= enolase (46.6 kD) (2J223) [Caenorhabditis elegans] emb|CAA92692.1| Hypothetical protein T21B10.2a [Caeno
  Gene Ontology: Mol. function=phosphopyruvate hydratase activity; Cellular component=soluble fraction; Biological process =gluconeogenesis
  Essential gene: C elegans homolog=T21B10.2a; Phenotype=Emb
  Coding regions on vcDNA: vcDNA=SeqID_48579; Strand=+; Position=36-1121
MSDSIKRIFARYIYDSRGNPTVEVDLETEKGLFQAAVPSGASTGVYEALELRDNDKTVHHGKGVLKAVDNINSKIGPALVGQNFAVMQQNQIDKFLIDLDGTDNKGKLGANAILGVSLAVCKAGAVHKGLPLYKHIAELAGTRKVILPVPAFNMINGGSHAGNKLAMQEFMVLPTGAKTFKEAMQIGSEIYHHLKKVIKERYGLDATSVGDEGGFAPNIQNNREGLDLLKEAFAASGHQDKVIIGMDVAASEFYKEGKYDLDFKNPNTDKAQWLTGEQLADMYKSFINDYPVVSIEDAFDQDDWENWSKLQAAIDIQLVVDDLTVTNPKRIQKAVQKKACNCLLLKVNQIGTVTESIEASKL

SEQ ID NO: 122157 - protein, 156 aa, Heterodera glycines
  Homolog annotation: Hit_ID=NP_498868.1; Match level="QueryCoverage =98%, HitCoverage=19%, E-value=3e-34, Identity=46%"; Hit description =heat shock 105kD (86.9 kD) (3J534) [Caenorhabditis elegans] gb|AAA27967.1| Hypothetical protein C30C11.4
  Gene Ontology: Mol. function=ATP binding; Cellular component=nucleus; Biological process=protein folding
  Essential gene: C elegans homolog=C30C11.4; Phenotype=Bmd,Gro
  Coding regions on vcDNA: vcDNA=SeqID_48580; Strand=+; Position=155-622
MAGIDFGNLTCYMAVARNKGIEIVENDYSLHATPSCVSFGQFARMMGFGAKQQLNVNYGNSVVNFKHILGRTFNDKVVQTFRQHIPCGLMGKFTDDQIEIKVTHLGTTRVLSPEQVVACLLTHLRVQLSRSLGTDATECVINGPIFYQENQPRALL

SEQ ID NO: 122158 - protein, 237 aa, Heterodera glycines
  Homolog annotation: Hit_ID=AAH45216.1; Match level="QueryCoverage =64%, HitCoverage=36%, E-value=5e-18, Identity=33%"; Hit description =RNPC7 protein [Xenopus laevis]
  Essential gene: C elegans homolog=W04D2.6a; Phenotype=Gro
  Coding regions on vcDNA: vcDNA=SeqID_48581; Strand=+; Position=12-725
MAFPPPFPNPLLPRLPNQSVQFPGQKFGFFSPQRQSILPGIPLLRPRFRPNFIPRELRPPNPLARPTGPPTTTTVFIGNISDKCPDRIIQEVLKKCGSVCNWKRLQDSRGKFKAFGFCDFMYPDGAKKALSVLKDFPIGDKRLNVKVSLVLKVSEIVAIFRRTNKRRNCWMNSPRISSSPPTRRATTPSELRSESFWRTRRPTWWTCRRTKVFGEGRRIVTKQFRRIQRKKPGRRKH

SEQ ID NO: 122159 - protein, 250 aa, Heterodera glycines
  Homolog annotation: Hit_ID=NP_507507.1; Match level="QueryCoverage =65%, HitCoverage=27%, E-value=6e-27, Identity=41%"; Hit description =constitutive photomorphogenic COP9 SigNalosome subunit (68.4 kD) (csn-1) [Caenorhabditis elegans] emb|CAC
  Gene Ontology: Mol. function=GTPase inhibitor activity; Cellular component=signalosome complex; Biological process=gametogenesis
  Essential gene: C elegans homolog=Y59A8A.1; Phenotype=Emb,Sck,Stp
  Coding regions on vcDNA: vcDNA=SeqID_48582; Strand=+; Position=62-811
MASSIIFAPLALKIPLKFAKMDNFGKQKICPILLMDDHEFMEGMEQEDEDEFIEEPMSADFDLGNINDPIGVDEPINHEVQPKPPTVNSAGIDLDSLSNDYTDYALMNRLLFIADVCPPLKVEALKMLITYVIKKTQNWSMLSAAYQRVESAKASGIQGVESIPELDRTWVEVTTVKGNSRLEALLAEFKRQKDEAVKESIRRALEDLFQQYVQMGNLQEALKLYGRGMREYCTAPNQIVQMLINWISVT

SEQ ID NO: 122160 - protein, 356 aa, Heterodera glycines
  Homolog annotation: Hit_ID=CAE60849.1; Match level="QueryCoverage =90%, HitCoverage=44%, E-value=1e-107, Identity=60%"; Hit description= Hypothetical protein CBG04558 [Caenorhabditis briggsae]
  Gene Ontology: Biological process=cell growth
  Essential gene: C elegans homolog=C47E8.7; Phenotype=Emb
  Coding regions on vcDNA: vcDNA=SeqID_48583; Strand=+; Position=1-1068
MAHLIQDGFVVNDATWKLGIFITDMNISRELFVRGDMTIGSLMMQLVGQIGETQDWSDHYMWWPDRRKWLKHTRSTLDQIGITAATYLEFTPMHKHAKVQLPDLQIIDARLDFSVPILKVTQKICQELAIRHPEELSLKRDIPPDILRKGASVESEAQIQPYMKPGEESIGPGTLRTAKPIRASTVNLTSGRGSPALSQASAMGPGHLFNASEIGTLPKMGTIPRGMSPGPAAYREVLGRTPEPGYSEGGGLECDQFDENLINSPKITPGRETFRPQNYLEKAALNRGWLDSSRSLMEQGICEGDVVLLRFKFMQFFDMNPLRKCCRCKQEGQRQRKTVHKTRRNRNRCSCPRISI

SEQ ID NO: 122161 - protein, 232 aa, Heterodera glycines
  Homolog annotation: Hit_ID=NP_510571.1; Match level="QueryCoverage =78%, HitCoverage=43%, E-value=3e-37, Identity=38%"; Hit description =delayed-early response protein/equilibrative nucleoside transporter family member (50.5 kD) (XQ221) [Caen
  Gene Ontology: Mol. function=nucleoside transporter activity; Biological process=physiological processes
  Essential gene: C elegans homolog=ZK809.4; Phenotype=Sck
  Coding regions on vcDNA: vcDNA=SeqID_48584; Strand=+; Position=789 -1484
MTTGSDRTQLQLQLHFNANNSSEASQSQNSSEQMQNCSTNERVSGEDSVPFIDRETFGDAESDRGRGPPPDRFRLVYLIVLLHGMGMLLPWNTFITIAGDYYLQFKFANVSNEDNYKVYFFNYLTVCAQIPNLLLSFLNLFVVIRGGFYRRIYFTLAVIFGICLVTIAMVYVPTDNWTFGFFLFTMLSVVLLNSASGVYQNSIWGLVADFPGEFAGAIILGNNLCGILMAVL

SEQ ID NO: 122162 - protein, 247 aa, Heterodera glycines
  Homolog annotation: Hit_ID=NP_508269.1; Match level="QueryCoverage =99%, HitCoverage=36%, E-value=8e-16, Identity=25%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
  Coding regions on vcDNA: vcDNA=SeqID_48585; Strand=+; Position=2-742
PYIFRLFSDNQFCDLNKTFLYLSTSIERKDKSNWIPITKDSEADQHVGVIQNFGHSFVKTLKVSISGVESYDSGIYYAFRAYMMNELGFSEDVKKGLCEASCYYVDDVDQDDYTNSGFKNRASRFADGAKCETMVKLNFDLARQPNFLLNNSDVIFSIHRNTDVFLIMAPPYVSGNAVIVNPHTYRINIHDIRIYVKTVDVTQSLNNIISNQLQTTPAKYPMRKIEIRSLFIPRGTSDLSHNVFTSI

SEQ ID NO: 122163 - protein, 291 aa, Heterodera glycines
  Homolog annotation: Hit_ID=CAE67047.1; Match level="QueryCoverage =98%, HitCoverage=70%, E-value=4e-48, Identity=36%"; Hit description =Hypothetical protein CBG12454 [Caenorhabditis briggsae]
  Essential gene: C elegans homolog=ZK858.7; Phenotype=Dpy,Gro,Stp
  Coding regions on vcDNA: vcDNA=SeqID_48586; Strand=+; Position=3-875
PSKIHEGVFAIVRKVGGEHIRLCRLISGQRVLIERLSFNPKDAIGHFYGIFEVSNGGDMLCPIEFASKLFFTEFSNGNSAGDRGHGNESTQQLTSNQIMSLKEDGITTNELVSKLVSGNCHFQSRTKFSKEKYMRKKVQKHSDRVVILQPNIRLLADCYYRKDPERLGHLRIDQLGLMLQLSGLHSGKCNAFVFDQVLGLLGAAVLERINPFGHCIFLHRGDWPQSIPCLDSFTTDAQKSRGFLTLRITTLLQRNNGRDEEKTNNLKNTEEREPGKREDVAEERREQQIQK

SEQ ID NO: 122164 - protein, 214 aa, Heterodera glycines
  misc_feature (174)..(174): Xaa can be any naturally occurring amino acid
  Homolog annotation: Hit_ID=NP_500107.1; Match level="QueryCoverage =99%, HitCoverage=56%, E-value=6e-17, Identity=29%"; Hit description =putative nuclear protein, with 4 coiled coil domains (40.0 kD) (4C373) [Caenorhabditis elegans] gb|AAK684
  Essential gene: C elegans homolog=Y41D4B.11; Phenotype=Gro,Pvl,Stp
  Coding regions on vcDNA: vcDNA=SeqID_48587; Strand=+; Position=91-733
MGRHRRYPMKKTAKNTNQAQKIERLSFDTDQTPLQTPKDSRKNKNMNKKPSNSMLEEQPTTWKEQMLKKLTDEVAQQKNKIQKRNKKPKNRLLEETQKLGYHHMPWESAKTLIYRIQQDQNKAINEELLKARFAKAGRDVKEIAEEYKIMDEKNKMKKERRKALHEKQSKLRAXKKTLTKESERIRKKKWTKTKWKKGREKTEEAEKRKRKEQV

SEQ ID NO: 122165 - protein, 337 aa, Heterodera glycines
  Homolog annotation: Hit_ID=AAC47348.1; Match level="QueryCoverage =81%, HitCoverage=88%, E-value=1e-124, Identity=69%"; Hit description= cysteine protease precursor [Onchocerca volvulus]
  Gene Ontology: Mol. function=cysteine-type peptidase activity; Cellular component=extracellular space; Biological process =embryogenesis and morphogenesis
  Essential gene: C elegans homolog=F32B5.8; Phenotype=Emb
  Coding regions on vcDNA: vcDNA=SeqID_48588; Strand=+; Position=13-1026
MRCSHSLPLFLCFVLFAGLASLISARLAHESFAKHRHHSRGGAATRPEAAAGDQPQKRKSIYNSNKCYRQPSDAERVQKRTSMRLYEFDDYLFDELPETWDWRNVNGVNYASTDRNQHIPQYCGSCWAMGATSSLADRINIKRKNAWPPAYLSVQEVIDCSEAGSCEGGTPDKVFEYAHKNGIPHETCNNYQARDGKCDPYNRCGSCWPDKCFTVQNYTLYKVGDFGSANGIQKMKAEIYHHGPIACGVAATPRFDNYSGGIYKERTNEDINHVISVVGWGKDAASGVPYWIGRNSWGTAWGEQGWFRVVTSEYRDAGNKYNLKIEEDCTWGEPIII

SEQ ID NO: 122166 - protein, 204 aa, Heterodera glycines
  Homolog annotation: Hit_ID=AAR85527.1; Match level="QueryCoverage =100%, HitCoverage=81%, E-value=1e-105, Identity=94%"; Hit description=14-3-3b protein [Meloidogyne incognita]
  Gene Ontology: Mol. function=protein domain specific binding; Cellular component=cytoplasm; Biological process=protein targeting
  Essential gene: C elegans homolog=M117.2; Phenotype=Emb
  Coding regions on vcDNA: vcDNA=SeqID_48589; Strand=+; Position=56-667
MSDNKEELVQRAKLAEQAERYDDMAQSMKKVTELGAELSNEERNLLSVAYKNVVGARRSSWRVISSIEQKTEGSEKKQQMAKEYREKVEQELREICHDVLDLLDKYLIPKAGNPESKVFYLKMKGDYYRYLAEVATGDDRNAVVEKSQQSYQESVDIAKDKMQATHPIRLGLALNFSVFYYEILNSPDKACQLAKKAFDDANGE

SEQ ID NO: 122167 - protein, 106 aa, Heterodera glycines
  Homolog annotation: Hit_ID=CAE69896.1; Match level="QueryCoverage =68%, HitCoverage=91%, E-value=2e-15, Identity=50%"; Hit description =Hypothetical protein CBG16246 [Caenorhabditis briggsae]
  Essential gene: C elegans homolog=R10H10.4; Phenotype=Emb
  Coding regions on vcDNA: vcDNA=SeqID_48590; Strand=+; Position=83-403
MPKVDFDYLDMFSPILVAFIFAVILFFISFTCINWYCITHKDDLTVFEKFGTRLNLRLGPHSMAVIKRGGYASTYAREEAKRSECTGPQQQQLNTLGDGKCQISHA

SEQ ID NO: 122168 - protein, 342 aa, Heterodera glycines
  Homolog annotation: Hit_ID=XP_320451.1; Match level="QueryCoverage =72%, HitCoverage=57%, E-value=9e-23, Identity=32%"; Hit description =ENSANGP00000016785 [Anopheles gambiae]
  Gene Ontology: Mol. function=protein binding; Cellular component =dynactin complex; Biological process=microtubule-based movement
  Essential gene: C elegans homolog=C49H3.8; Phenotype=Emb,Gro
  Coding regions on vcDNA: vcDNA=SeqID_48591; Strand=+; Position=65-1090
MNTSTPRDAPTAQDARTLRQMASLRRSMRSTLSPIVAEEGEREVGTSAAAATQRRSTDLAQSLLQRRSVLSQFGSAQSSVSSSVGSYTPSMMASKIDNRPAIVIEIGTRLTRIGFAGDFLPQEIFRSEFVDPLDGPSPSSPIALFDRSRTEQQQYEVLVKFFKNIVFGKLLTTMSSRRVVVVESLLVSNWQRNAIARALFQCPSLSAHSILFAPSHLCCTFPFNTKTCLVIDMGADEAVLFPVAEGVLMLNSLETSVAPSATALEQNVRRLMAQFGRLRTGAEDDAEGRPLTETELEQADRMRLWEDVAVRFCFATTAARGKRIQTYLANSAASSSADCSAA

SEQ ID NO: 122169 - protein, 217 aa, Heterodera glycines
  Homolog annotation: Hit_ID=CAE59948.1; Match level="QueryCoverage =100%, HitCoverage=44%, E-value=1e-65, Identity=58%"; Hit description= Hypothetical protein CBG03435 [Caenorhabditis briggsae]
  Gene Ontology: Mol. function=serine-tRNA ligase activity; Cellular component=cytoplasm; Biological process=tRNA processing
  Essential gene: C elegans homolog=C47E12.1; Phenotype=Emb,Lva,Ste,Unc
  Coding regions on vcDNA: vcDNA=SeqID_48592; Strand=+; Position=1-651
EKGGDPEQIRKSQVGRFADVSLVDKVISADSEWRKERFFLDGLNRAIKVCSTAIGDKMKKKESAGDSDAIPEGQIKSLAELKMDDIKEMKISQIKTVKGMVDEEVRRTKLRMETLEGDRNEHLAKIGNLLHNSVPISDNEDENRVERTFGDCASRKSYSHVDLVVMCDGFDRERGTNVAGGRGYFLKGPVGVLEQALIALALQMLNKKGFTPLYTPF

SEQ ID NO: 122170 - protein, 216 aa, Heterodera glycines
  Homolog annotation: Hit_ID=NP_507993.1; Match level="QueryCoverage =76%, HitCoverage=7%, E-value=8e-35, Identity=40%"; Hit description =papilin (5V147) [Caenorhabditis elegans] emb|CAB07294.1| Hypothetical protein W01F3.3 [Caenorhabditis eleg
  Essential gene: C elegans homolog=W01F3.3; Phenotype=Emb,Lva,Unc
  Coding regions on vcDNA: vcDNA=SeqID_48593; Strand=+; Position=3-650
GYKSQLQHHHLQNSFLRRRLHHQHRRVRRSGQQSATAAFSLDNGATAPAASPLRFDDKAPPARINQAVFRQQSLLNAASAELSPCVQPLRRGNCQEASLRYFYDLALDQCRLFYFSGCDGNENNFATLAECEVRCKIGFTPNSVPAQQQQQQQQKGSIGPCPSGELPLGGKNPVLCGDRSDSIGCPSGFFCADGPPSVCCPGHKSAASVGDVRRKP

SEQ ID NO: 122171 - protein, 154 aa, Heterodera glycines
  Homolog annotation: Hit_ID=EAA05425.2; Match level="QueryCoverage =97%, HitCoverage=98%, E-value=6e-80, Identity=99%"; Hit description =ENSANGP00000012700 [Anopheles gambiae str. PEST]
  Gene Ontology: Mol. function=calcium ion binding
  Essential gene: C elegans homolog=T21H3.3; Phenotype=Emb,Ste
  Coding regions on vcDNA: vcDNA=SeqID_48594; Strand=+; Position=347-811
RNYNKMADQLTEEQIAEFKEAFSLFDKDGDGTITTKELGTVMRSLGQNPTEAELQDMINEVDADGNGTIDFPEFLTMMARKMKDTDSEEEIREAFRVFDKDGNGFISAAELRHVMTNLGEKLTDEEVDEMIREADIDGDGQVNYEEFVTMMTTK

SEQ ID NO: 122172 - protein, 139 aa, Heterodera glycines; identical to SEQ ID NO: 119931
  Homolog annotation: Hit_ID=NP_491926.1; Match level="QueryCoverage =98%, HitCoverage=99%, E-value=1e-28, Identity=46%"; Hit description =lipid Binding Protein LBP-6, adipocyte P2 family member (15.6 kD) (lbp-6) [Caenorhabditis elegans] gb|AAK
  Gene Ontology: Mol. function=lipid binding; Cellular component =cytoplasm; Biological process=lipid binding
  Essential gene: C elegans homolog=W02D3.7; Phenotype=Unc
  Coding regions on vcDNA: vcDNA=SeqID_48595; Strand=+; Position=75-494

SEQ ID NO: 122173 - protein, 215 aa, Heterodera glycines
  Essential gene: C elegans homolog=Y39A1A.13; Phenotype=Unc
  Coding regions on vcDNA: vcDNA=SeqID_48596; Strand=+; Position=6-650
MVLQKKKKSFSGFKIQNFVYGLDSQISSLDKYLLNFKAKKNGGSCLLSGRTNTGKTLVLESLIQKHFSDDDCDINIRRVDGLSKMTKLFEKLDLEGPVLIVVDHFELFAYKQQQNFLYSILNGSQTLPWFVVLIGTTENSVNLLEKRVKSRFSALRVNFNVTFSLEQFDEGFGQLLDCSSLSKKMIKKTKEDDNGKKLLCAFDCPDHWFGYLKKN

SEQ ID NO: 122174 - protein, 212 aa, Heterodera glycines
  misc_feature (187)..(187): Xaa can be any naturally occurring amino acid
  Homolog annotation: Hit_ID=NP_502097.1; Match level="QueryCoverage =89%, HitCoverage=72%, E-value=5e-29, Identity=37%"; Hit description =peroxisomal membrane anchor protein like (28.2 kD) (4L949) [Caenorhabditis elegans] emb|CAB03225.1| Hypot
  Gene Ontology: Cellular component=integral to membrane
  Essential gene: C elegans homolog=R07H5.1; Phenotype=Lva
  Coding regions on vcDNA: vcDNA=SeqID_48597; Strand=+; Position=145-780
MASSSAASDDSSAVSSPPPPLLSSPIRSEMVAAAKQFLANPRVRNTPISEQTEFLRGKGLTETEIQKAMKLTTDGGGEVPSTSLSSLPPASAPSPSARAVVDLARSALLFGTAGYMVYRFVRSWLLPQLLNVPDPAEERMQRLEQQVERLSDSTRCIAESVTQTLVAVTEQNEQLSRTMMMVQGGTXGTVCTADIDRVHTEIGIVKSLLLNQ

SEQ ID NO: 122175 - protein, 173 aa, Heterodera glycines; identical to SEQ ID NO: 119685
  Homolog annotation: Hit_ID=CAE57948.1; Match level="QueryCoverage =90%, HitCoverage=98%, E-value=2e-33, Identity=42%"; Hit description =Hypothetical protein CBG01005 [Caenorhabditis briggsae]
  Essential gene: C elegans homolog=R53.4; Phenotype=Emb,Lva
  Coding regions on vcDNA: vcDNA=SeqID_48598; Strand=+; Position=31-552

SEQ ID NO: 122176 - protein, 135 aa, Heterodera glycines
  Homolog annotation: Hit_ID=CAE65324.1; Match level="QueryCoverage =91%, HitCoverage=27%, E-value=1e-49, Identity=70%"; Hit description =Hypothetical protein CBG10258 [Caenorhabditis briggsae]
  Gene Ontology: Cellular component=integral to plasma membrane; Biological process=fatty acid desaturation
  Essential gene: C elegans homolog=W08D2.4; Phenotype=Unc
  Coding regions on vcDNA: vcDNA=SeqID_48599; Strand=+; Position=3-410
RLQYFLVSNLFAGFLIAHVVTYNHYSTDKFAYDDPILENFACLQLYTTRNMRPGPFIDWLWGGLNYQIEHHLFPTMPRHNLKKVMPLVKEFCAENDIPYMVDDYFTGFRLVIEHLRRVAEAATETLVSHHSQKVP

SEQ ID NO: 122177 - protein, 161 aa, Heterodera glycines
  Homolog annotation: Hit_ID=NP_492348.1; Match level="QueryCoverage =78%, HitCoverage=13%, E-value=2e-19, Identity=42%"; Hit description =insulin-like growth factor binding protein acid labile (1J254) [Caenorhabditis elegans] emb|CAB03182.1| H
  Gene Ontology: Biological process=embryogenesis and morphogenesis
  Essential gene: C elegans homolog=K07A12.2; Phenotype=Emb
  Coding regions on vcDNA: vcDNA=SeqID_48600; Strand=+; Position=1-486
SKLPPELTQQVMRGEMPDLTKLPLDLQQWIKDNFDRLVASLENNPDLSIDEIMKKLPTFEHPLMSTFSPYDINKVDADLVVQQRNEEEANHRFWRIFAASALALAGAVTLGVLSAFFWYLKRSRRLADPPMAPPIGIDGGPELPSVIREQYFRPSASSTLK

SEQ ID NO: 122178 - protein, 231 aa, Heterodera glycines
  Homolog annotation: Hit_ID=CAE67168.1; Match level="QueryCoverage =92%, HitCoverage=32%, E-value=4e-51, Identity=44%"; Hit description =Hypothetical protein CBG12598 [Caenorhabditis briggsae]
  Gene Ontology: Mol. function=protein binding; Cellular component =anaphase-promoting complex; Biological process=mitosis
  Essential gene: C elegans homolog=F10C5.1; Phenotype=Mei,Ste
  Coding regions on vcDNA: vcDNA=SeqID_48601; Strand=+; Position=16-708
MHEQAQEFLKRAIKLCPTNASIWVLLGHEYLETKNHQLASTAYKKATEIDSVCYRGWYGLGQLYEILKQSETALYYYQKAHKCRPADSRILIALGVIFSKIDRKSDAEKCFKKAFQIGDVEGNALTHLAKLYEEQENQQNAAKAYEAYLTLYTEELVGDLSLIAEACRFLARHNLDLGDLDTSYAYAQRCLNYDLAKEEGQRILRLIMSKRKEEQERKLALPVGTPQQQNI

SEQ ID NO: 122179 - protein, 216 aa, Heterodera glycines
  Homolog annotation: Hit_ID=CAE68356.1; Match level="QueryCoverage =41%, HitCoverage=22%, E-value=1e-21, Identity=56%"; Hit description =Hypothetical protein CBG14093 [Caenorhabditis briggsae]
  Essential gene: C elegans homolog=F49H12.1; Phenotype=Gro,Pvl,Stp,Unc
  Coding regions on vcDNA: vcDNA=SeqID_48602; Strand=+; Position=36-683
MLFFQNGPVEQCPHQQQQNAAPLSHRPTAFSLPATSPFSTISSVGSLPSEPTTPTERMSTGNVMMMMSPKRMDKGNGGEKGQRQKAPGKERPKDGKERVHKCDQCQKAFRFKSNLFEHKSLHLGSSSRNPFVCPFCSKTCRLKGNLKKHLQVHVTSAEDLECLWKRSFSRSSGRPSKNAPPAPLPKPGDDLGMVPVLVSQQDASSSSPFGSSPTIK

SEQ ID NO: 122180 - protein, 130 aa, Heterodera glycines
  Homolog annotation: Hit_ID=CAE59628.1; Match level="QueryCoverage =96%, HitCoverage=97%, E-value=5e-57, Identity=89%"; Hit description =Hypothetical protein CBG03041 [Caenorhabditis briggsae]
  Gene Ontology: Mol. function=pre-mRNA splicing factor activity; Cellular component=small nuclear ribonucleoprotein complex; Biological process=neurogenesis
  Essential gene: C elegans homolog=M28.5; Phenotype=Emb,Lva
  Coding regions on vcDNA: vcDNA=SeqID_48603; Strand=+; Position=31-423
MTEGGEEVNPKAYPLADIQLSQKLLDLVQQATNYHQLKKGANEATKTLNRGIAEVIILAADAEPLEIILHLPLLCEDKNVPYVFVKSKAALGRACGVTRPVIATSIIQNEGSQLKSQIQKIKEDVEKLLI

SEQ ID NO: 122181 - protein, 217 aa, Heterodera glycines
  misc_feature (125)..(125): Xaa can be any naturally occurring amino acid
  Homolog annotation: Hit_ID=NP_497890.1; Match level="QueryCoverage =99%, HitCoverage=55%, E-value=3e-66, Identity=55%"; Hit description =swi Snf related matrix associated actin dependent regulator of chromatin subfamily b member 1 (42.8 kD) (
  Gene Ontology: Biological process=embryogenesis and morphogenesis
  Essential gene: C elegans homolog=R07E5.3; Phenotype=Emb
  Coding regions on vcDNA: vcDNA=SeqID_48604; Strand=+; Position=20-669
MFKTYGPRPESFTLDDGERYYVGADVGQYLKYHRGTLYKRYPQLWKRMASVEEKKKIQELGCATSYINSNIMLVKANEVEDIFDGQEEKYRASVSGGSAYGRAEGAQTLRSRGSAPWLNQQVAKXTNVTSGSHHLESVPCSTPSAHGRGHFKNRDYAYVADDLESYRRVMENAQAGECLVPIRLDMELDNIKLRDCFCYNKNDKLITPEMVAEVLCE

SEQ ID NO: 122182 - protein, 227 aa, Heterodera glycines
  misc_feature (197)..(197): Xaa can be any naturally occurring amino acid
  Homolog annotation: Hit_ID=CAE61253.1; Match level="QueryCoverage =100%, HitCoverage=45%, E-value=8e-44, Identity=48%"; Hit description= Hypothetical protein CBG05057 [Caenorhabditis briggsae]
  Gene Ontology: Mol. function=ATP binding; Biological process=protein kinase cascade
  Essential gene: C elegans homolog=T22E5.5; Phenotype=Stp,Unc
  Coding regions on vcDNA: vcDNA=SeqID_48605; Strand=+; Position=186-867
MSEEESQYSDEEVEEESIAADEVSVQEPAPPKEEEPAPEAEAEAPPAEEKEEEEEEEPGSPGGAGDAPKEEFRRTSVTESVAPTAQLRRAPPPQPKPAEESMTEAEAAMLAVKKRHEEEEEAKMRDNDERRRQELAAVEDELRVLKERQAERRAEREKEEAEFAERRRQDEDRRRKDEEERKARLEAEKAKRDEEKXKRHLMMAGGIGGFVAADAEGAGKNFGVPQK

SEQ ID NO: 122183 - protein, 431 aa, Heterodera glycines
  Homolog annotation: Hit_ID=CAE67815.1; Match level="QueryCoverage =81%, HitCoverage=68%, E-value=5e-53, Identity=35%"; Hit description =Hypothetical protein CBG13395 [Caenorhabditis briggsae]
  Gene Ontology: Mol. function=glutathione synthase activity; Cellular component=intracellular; Biological process=neurogenesis
  Essential gene: C elegans homolog=M176.2; Phenotype=Emb,Lva
  Coding regions on vcDNA: vcDNA=SeqID_48606; Strand=+; Position=36-1328
MAAFLNGNAHSSIECNGVVHDKNGIDQNGTKLADRLQHSVQIGTKKAPVSKGSINVNKYVLEVISDTDQLHTLEQYAIDYAHSIGLVAPLSDPPEGKFTNIYAVPPPIALLPSPFPRELYDHAVNVQQAMNELYFRVASDHDFLMDAFKDVVKGDPFMARLVQIAQVVHDEGIHQPLAVQLQRSDYMAHWDPSDGSMALKQVEVNIGPIGGPGFAFGVSKLHQKMLDKLAIAHDGKPAILANSEAPLNRSRQNIAYTLYQSWKLFGDPKAVLLFLDTPNITHFEQLQFIQFEVEKLGKQQGNFVKVLVLSLTEASKRISLDESGDFSLYLDGTKRVALVHIADGNVPHEYPTEHEWTARTTIERSNAILSPNIRFHLSSTKKIQQVLAKPGMVERFFPNDPKRVALIRSTFTGLWGLEVEDEATREVIEDA

SEQ ID NO: 122184 - protein, 204 aa, Heterodera glycines
  Homolog annotation: Hit_ID=CAE71397.1; Match level="QueryCoverage =100%, HitCoverage=19%, E-value=1e-96, Identity=88%"; Hit description= Hypothetical protein CBG18305 [Caenorhabditis briggsae]
  Gene Ontology: Mol. function=calcium-transporting ATPase activity; Cellular component=nuclear envelope-endoplasmic reticulum network; Biological process=calcium ion homeostasis
  Essential gene: C elegans homolog=K11D9.2a; Phenotype=Ste
  Coding regions on vcDNA: vcDNA=SeqID_48607; Strand=+; Position=25-636
MENAHTKSEDELFRFFGTGPDGLTEEQADELRDKYGYNEMPAEEGKKLWELILEQFDDLLVKILLLAAIISFVLALFEEHDDQTSAVTAFVEPFVILLILIANATVGVWQERNAESAIEALKEYEPEMAKVIRAGKHGIQMIRAKELVPGDLVEVSVGDKIPADLRLVKIYSTTIRIDQSILTGESVSVIKNLDGVPDPRAVNQ

SEQ ID NO: 122185 - protein, 221 aa, Heterodera glycines
  Homolog annotation: Hit_ID=CAE71840.1; Match level="QueryCoverage =96%, HitCoverage=99%, E-value=9e-32, Identity=41%"; Hit description =Hypothetical protein CBG18881 [Caenorhabditis briggsae]
  Gene Ontology: Mol. function=calcium ion binding; Cellular component =actin filament; Biological process=signal transduction
  Essential gene: C elegans homolog=F11E6.3; Phenotype=Gro
  Coding regions on vcDNA: vcDNA=SeqID_48608; Strand=+; Position=3-665
LSSKIPFWTKLCPFSKQQPEQQQSSPVAEDTIPPQQQKEGAAMSAEGNDAPPAAEQPPPAEAAPAEAVPVQEAAAPPVEAAAETAPAEAAQPVEEAAPPAEAPVEAAPAEAAPPIEEAAPPAEAPVEAAPAEAAQPIEEAAPPAEAPVEPAPPVEEPKAAEPEAPVSEAVPAAEAPVKEAVAAPIEVAPAEAEPVSAPPAEAVPAEEAPAAEVAQLSLEEQ

SEQ ID NO: 122186 - protein, 216 aa, Heterodera glycines
  Homolog annotation: Hit_ID=NP_741215.1; Match level="QueryCoverage =85%, HitCoverage=42%, E-value=5e-58, Identity=57%"; Hit description =secreted NADH-ubiquinone oxireductase precursor (50.9 kD) (3I246) [Caenorhabditis elegans] gb|AAA62532.1|
  Gene Ontology: Mol. function=NADH dehydrogenase (ubiquinone) activity; Cellular component=membrane fraction; Biological process =growth
  Essential gene: C elegans homolog=K04G7.4a; Phenotype=Lva
  Coding regions on vcDNA: vcDNA=SeqID_48609; Strand=+; Position=20-667
MASKFVFSLRFSYPRLLTSSALNNKKLVPNLIQSRSIVTKFDLELPDDYPEPWPYKQWGFNQFMQHLDKTLKRWHINSKLIVFESNIGVGRSSIAKELADALGFYYMPAFKMDDILVDRYNNDMRDYYHLFPKRFRFPDINMFYKDPADDQTAVMQDLMYDCRWEQYLNAQAHLFNTGQGVVLERCVHADFVFANAMRAKDWISREYLNFYMYKRK

SEQ ID NO: 122187 - protein, 339 aa, Heterodera glycines
  Homolog annotation: Hit_ID=NP_498386.2; Match level="QueryCoverage =88%, HitCoverage=89%, E-value=4e-53, Identity=40%"; Hit description =DeHydrogenase, Short chain, complex, LEThal LET-767 (34.3 kD) (let -767Co) [Caenorhabditis elegans] gb|AAA
  Gene Ontology: Cellular component=integral to membrane; Biological process=fatty acid biosynthesis
  Essential gene: C elegans homolog=C56G2.6; Phenotype=Lva
  Coding regions on vcDNA: vcDNA=SeqID_48610; Strand=+; Position=3-1022
MTYYNDSNSPFLITLLGRICLSLLLAKVCRSLYNILYPYVIAKPRDLHELAGGDANWAVVTGATDGIGKAYAAELALRGFNLVLISRSAHKLEAVATELKQYSATSGQRGEVQLRTVQFDFTNANPADYERHIFGAISDLNIGILVNNVGMGNPNDYPERFDEMSTKLLSDMTIVNTLPVTVLSSFVLRQMVKRRRGAVINISSASAYMKWYQYAVYSSTKSFIVHLSEILRKEFASDCPGIAIQTVCPMVVATKLTQRSSRDGLSSLLAASPTEFARQAIQTVGLVPETSGCLSHQIQVELLFSLLLTFVPNSLFDFFVRLEAHLHKSVLNTASKQHD

SEQ ID NO: 122188 - protein, 209 aa, Heterodera glycines
  misc_feature (84)..(84): Xaa can be any naturally occurring amino acid
  Homolog annotation: Hit_ID=CAE67460.1; Match level="QueryCoverage =98%, HitCoverage=69%, E-value=3e-26, Identity=35%"; Hit description =Hypothetical protein CBG12961 [Caenorhabditis briggsae]
  Gene Ontology: Mol. function=methylenetetrahydrofolate reductase (NADPH) activity; Cellular component=cell; Biological process =methionine metabolism
  Essential gene: C elegans homolog=C06A8.1a; Phenotype=Gro
  Coding regions on vcDNA: vcDNA=SeqID_48611; Strand=+; Position=11-636
MLASVINDRFNRHSQYAPFFSLEFYPPLKEHPKNLADFFEMLDHLKQAQPLFVDITWSRRNDPGNLAKLNSSSAIAIATAASFXGKERTMLHICCNDHTRTESISHVKQTLSHGIANIMALRGDDMPTEQTLLTKNTKHFAIDLVKWTRELEETDGYFGNDRLTGAVAGHIYPPMKNISYRQCMEHLRAKVNAGADFVVTQFFLDANLF

SEQ ID NO: 122189 - protein, 197 aa, Heterodera glycines
  Homolog annotation: Hit_ID=NP_495863.1; Match level="QueryCoverage =100%, HitCoverage=43%, E-value=4e-85, Identity=75%"; Hit description= phenylalanine hydroxylase, Biogenic Amine Synthesis related (52.1 kD) (bas-2) [Caenorhabditis elegans] e
  Gene Ontology: Mol. function=phenylalanine 4-monooxygenase activity; Biological process=phenylalanine catabolism
  Essential gene: C elegans homolog=ZK1290.2a; Phenotype=Emb
  Coding regions on vcDNA: vcDNA=SeqID_48612; Strand=+; Position=3-593
CTGFTLRPVAGLLSSRDFLAGLAFRVFHSTQYIRHSSKPHYTPEPDICHELLGHCPLFADPDFAQFSQEFGLASLGASDEMVEKLATLYWFTVEFGICIQNGAKKAYGAGLLSSFGELEYALSGQPELAAFNPPETCQTKYPITSYQPKYFVAESFADAKNKLATWSTSIPRQFQVNYNPYTQRIEMLDNESAANKL

SEQ ID NO: 122190 - protein, 224 aa, Heterodera glycines
  misc_feature (212)..(212): Xaa can be any naturally occurring amino acid
  Homolog annotation: Hit_ID=CAE64609.1; Match level="QueryCoverage =97%, HitCoverage=86%, E-value=3e-73, Identity=59%"; Hit description =Hypothetical protein CBG09365 [Caenorhabditis briggsae]
  Gene Ontology: Mol. function=RNA binding; Cellular component=cytosol; Biological process=proteolysis and peptidolysis
  Essential gene: C elegans homolog=CD4.6; Phenotype=Emb,Lva,Lvl,Unc
  Coding regions on vcDNA: vcDNA=SeqID_48613; Strand=+; Position=35-706
MFRNQYDSDVTVFSPQGRLHQIDYAVEAMRQGSAAVAIRSKDYAVVVALMRAQNELSSYQQKVFKLDDHLGLSMSGLISDGRILARFMQSECAEFRWNYHNPISVELLNRKLGLKLQSNTQYYGRRPFGVGLLIIGYDDKGPHVVKAEPSGDVSEMFAASIGARSQSARTYLEKNLPEFETADRDALIRHAIRSLKETLQADAGSLDENNTXIAIIGLDNLLPF

SEQ ID NO: 122191 - protein, 210 aa, Heterodera glycines
  Homolog annotation: Hit_ID=NP_491237.1; Match level="QueryCoverage =74%, HitCoverage=50%, E-value=2e-48, Identity=55%"; Hit description =protein phosphatase 1A (34.6 kD) (1E406) [Caenorhabditis elegans] gb|AAB42233.1| Yeast glc seven-like pho
  Gene Ontology: Mol. function=protein serine/threonine phosphatase activity; Cellular component=cytoplasm; Biological process=protein amino acid dephosphorylation
  Essential gene: C elegans homolog=W09C3.6; Phenotype=Ste
  Coding regions on vcDNA: vcDNA=SeqID_48614; Strand=+; Position=30-659
MAKEEYCFDAKAAAAAGQSRRPSTTASVLVQGDGQSSRFVDAIIRKVTQPPLQRFTDEITDEELKQLCKAATDVFRMQPTLVRIRPPVVVVGDIHGQFSDLQRIFTTHGPPPEQQYMFLGDYVDRGAHSMETIILLFCYKIKYPSNFMLLRGNHECSNINKAYGFYEEIDRRYPRTGARRLFDLFNQVFAWMPFVGLIGEKILCMDGGIS

SEQ ID NO: 122192 - protein, 340 aa, Heterodera glycines
  Homolog annotation: Hit_ID=CAE60137.1; Match level="QueryCoverage =99%, HitCoverage=75%, E-value=1e-103, Identity=50%"; Hit description= Hypothetical protein CBG03683 [Caenorhabditis briggsae]
  Gene Ontology: Mol. function=snoRNA binding; Cellular component=small nuclear ribonucleoprotein complex; Biological process=rRNA processing
  Essential gene: C elegans homolog=ZK430.7; Phenotype=Lva
  Coding regions on vcDNA: vcDNA=SeqID_48615; Strand=+; Position=3-1022
SGPINGLSVDASDGLHFVTVGQDAQFKVWPLPIEFDGNAQPTQPVHSLSLDGVPHGCSHVAMSSDFVTCGEGISVWRLHRSSPIRHYAVGPNTVQHINCNPIEEGIMAGCAADRSIFLFDTRQKVPLSRVVLKLRTNSIAWHPLEPFTFVAANEDYNLYTFDMRRLDSARHVHQGHTSAVMDVDFAPSGHEFVSGSFDRSLRIFPVEQWRSREVYHTPRMQYVLSVLWSSDNKFVLSGSDDMNIRLWKANAAEKLGPLCPREKAAIEYSQKLRDTFQGHPEVRRIVKHRHVPKAIYSATREHRIIRESQRRKDKNRRKNTKSAATEPFTSERAKAIVSEG

SEQ ID NO: 122193 - protein, 195 aa, Heterodera glycines
  Homolog annotation: Hit_ID=CAE57828.1; Match level="QueryCoverage =92%, HitCoverage=87%, E-value=2e-74, Identity=76%"; Hit description =Hypothetical protein CBG00853 [Caenorhabditis briggsae]
  Gene Ontology: Mol. function=endopeptidase Clp activity; Cellular component=mitochondrion; Biological process=misfolded or incompletely synthesized protein catabolism
  Essential gene: C elegans homolog=ZK970.2; Phenotype =Emb,Gro,Pvl,Slu,Sma,Stp
  Coding regions on vcDNA: vcDNA=SeqID_48616; Strand=+; Position=39-623
MHAIRTISRTFSRSTTAPVGIPFVVDNDGKTERVYDIYSRLLKDRIVCVMNPIDDFFAASVIAQLLFLQSESGKTAINMYINCPGGSVTAGLGIYDTMQHISAPVATWCIGQASSMGSLLLTAGAKGMRTSLPNARIMVHQPSGGAYGTAADIVIRAEEINRMRKRLNEIYAMHTGQTVETIDQALDRDRFMSAL

SEQ ID NO: 122194 - protein, 212 aa, Heterodera glycines
  Homolog annotation: Hit_ID=NP_492715.1; Match level="QueryCoverage =99%, HitCoverage=37%, E-value=1e-87, Identity=68%"; Hit description =carboxypeptidase a2 precursor family member (1K935) [Caenorhabditis elegans] emb|CAB00065.2| Hypothetical
  Gene Ontology: Mol. function=lysine carboxypeptidase activity; Cellular component=extracellular space; Biological process =proteolysis and peptidolysis
  Essential gene: C elegans homolog=R11A5.7; Phenotype=Dpy
  Coding regions on vcDNA: vcDNA=SeqID_48617; Strand=+; Position=2-637
TNKRIVWIDGGMHAREWASIHTALWFIDQLISLYGVDPQVTAYMDTLNFYVLPLANPDGFEYSRSDVNPQTRFWRKNRGQQVCKKDRWRRERCCGGVDLNRNFDFHWGETGSSSDMCSDIYQGAYAFSEPESRAIRDKMMSSELYGKVDAFLTLHTYSQMWIHPYNHERKSFPNDIEDLQEVGRRGVRALEQLYGTRYRFGTGADILYPSAG

SEQ ID NO: 122195 - protein, 216 aa, Heterodera glycines
  Homolog annotation: Hit_ID=NP_493746.1; Match level="QueryCoverage =81%, HitCoverage=26%, E-value=1e-60, Identity=64%"; Hit description =yeast splicing factor PRP related, pre-mRNA splicing factor 3a (73.8 kD) (prp-21) [Caenorhabditis elegans
  Gene Ontology: Mol. function=pre-mRNA splicing factor activity; Cellular component=nucleus; Biological process=embryogenesis and morphogenesis
  Essential gene: C elegans homolog=W07E6.4; Phenotype=Emb
  Coding regions on vcDNA: vcDNA=SeqID_48618; Strand=+; Position=7-654
MAQEPPLQIVIPRLDDDKPLVRRPTPQAQPAAPAVPAELRVSNREEDAQNIEPSMSGKQIVGLIIPPPDIRTIVDKTALFVARNGLEFEMKIKEREASNMRFNFLNPTDPYFAYYRNKVNEFETGVASADTQSKVKLPEAVREHVQRAEFIPRLPPKPFEFCADPLTLNAFDLDLIHLTALFVARNGRQFLTQLMNREVRNFQFEFLKPQHSTFQY

SEQ ID NO: 122196 - protein, 340 aa, Heterodera glycines
  Homolog annotation: Hit_ID=AAH73714.1; Match level="QueryCoverage =97%, HitCoverage=22%, E-value=1e-60, Identity=37%"; Hit description =LOC398742 protein [Xenopus laevis]
  Essential gene: C elegans homolog=Y110A7A.1a; Phenotype=Emb
  Coding regions on vcDNA: vcDNA=SeqID_48619; Strand=+; Position=185 -1204
MRIKKRIFRGELMSREVRASGVLAIGKLCLLDEQLAKKCIPVFVRQLRENPDHFVRNNIVVVICDLCIRYTSEVDRYSTILASCLWDSSILIRRQTLLLLTNLIKEQYLKWEGTVIYRFVTTLLDPEQCIEEYANFCLTDILLPQFRERMFFHHFLECMFNFNGVRHVSWIPSAGYELSEEVQKRCSLEGRELFDSRMRLYKYMLNTFEDQQKVYILEKIGLEIFVPIVEGRLKLSDVKVRNLLFDAFKIMGTEEIKLKMQLGKMDADYEGDDDEPPELVKTAAKKFIATTFRKSIAETVMPHLFLLKSFLCEKRSPLAKNCYSVILDFCREHEEQLDAF

SEQ ID NO: 122197 - protein, 232 aa, Heterodera glycines
  Homolog annotation: Hit_ID=NP_498931.2; Match level="QueryCoverage =94%, HitCoverage=64%, E-value=9e-75, Identity=55%"; Hit description =SMAll body size SMA-2, dwarfin; affects body size and the arrangement of peripheral sense organs in the m
  Gene Ontology: Mol. function=protein binding; Cellular component =cytoplasm; Biological process=BMP receptor signaling pathway
  Essential gene: C elegans homolog=R13F6.9; Phenotype=Sma
  Coding regions on vcDNA: vcDNA=SeqID_48620; Strand=+; Position=19-767
MSLENFGNGFMRRLGWKQGDEDEGWSKKAVDSLLKKLQKQHNKEGLTLLENALRTEGKEPSECVTIPRSLDGRLQISHRKALPHVIYCRVYRWPDLQSHHELKASQCCRFCFESGQKDVCINPYHYERVDSSNLLPPVLVPRFSDSPPKRQPGGEHRVLLGHDPIPFVPCQHWATISYYELNTRVGEQAKVSAIECVVDPSSGETNDQHKISLGLFSNVNRNSTVENTRREI

SEQ ID NO: 122198 - protein, 203 aa, Heterodera glycines
  Homolog annotation: Hit_ID=NP_498595.1; Match level="QueryCoverage =88%, HitCoverage=84%, E-value=8e-84, Identity=80%"; Hit description =NADH:ubiquinone oxidoreductase complex I, 23.9 kD mitochondrial subunit, Fe3S4/Fe4S4 electron transfer ca
  Gene Ontology: Mol. function=NADH dehydrogenase (ubiquinone) activity; Cellular component=membrane fraction; Biological process =mitochondrial electron transport, NADH to ubiquinone
  Essential gene: C elegans homolog=T20H4.5; Phenotype=Emb
  Coding regions on vcDNA: vcDNA=SeqID_48621; Strand=+; Position=14-625
MQHISRTSKHFLNKFSPNTFWQPSRNAYKYVGETAASDGTLQGDTSAAMASALFHEMIKGAATIVGHTFMEPVTINYPFEKGPLSARFRGEHALRRYPSGEERCIACKLCEAICPAQAITIETETRPDGSRRTTRYDIDMTKCIYCGLCQEACPVDAIVEGPNFEYSTETHEELLYNKEKLLSNGDRWEPELAANLQSEFLYR

SEQ ID NO: 122199 - protein, 204 aa, Heterodera glycines
  Homolog annotation: Hit_ID=NP_499964.1; Match level="QueryCoverage =100%, HitCoverage=100%, E-value=7e-94, Identity=78%"; Hit description=ribosomal Protein, Large subunit (24.1 kD) (rpl-15) [Caenorhabditis elegans] gb|AAC24397.1| Ribosomal p
  Gene Ontology: Mol. function=structural constituent of ribosome; Cellular component=cytosolic large ribosomal subunit (sensu Eukarya); Biological process=protein biosynthesis
  Essential gene: C elegans homolog=K11H12.2; Phenotype=Gro,Stp
  Coding regions on vcDNA: vcDNA=SeqID_48622; Strand=+; Position=226-840
MGAYKYMQELWRKKQSEVMRYLLRIRCWQYRQMEAIHRCTRPTRPEKARRLGYKAKQGFLIYRVRIRRGGRKRQVTKGQTYGKPKTHGVNQLKNTRSLQAVAEARAGRRLGELRVLNSYWVGQDSTYKFFEVILVDPSHKTIRRNPDTQWITKPVQKHREQRGLTSAGRKSRGLGKGMKHTKTIGGSRRKCWKRQNTVEFHRKR

SEQ ID NO: 122200 - protein, 451 aa, Heterodera glycines
  Homolog annotation: Hit_ID=CAE61350.1; Match level="QueryCoverage =100%, HitCoverage=98%, E-value=1e-159, Identity=34%"; Hit description=Hypothetical protein CBG05190 [Caenorhabditis briggsae]
  Gene Ontology: Mol. function=protein phosphatase type 2A activity; Cellular component=shmoo tip; Biological process=cell organization and biogenesis
  Essential gene: C elegans homolog=F48E8.5; Phenotype=Emb
  Coding regions on vcDNA: vcDNA=SeqID_48623; Strand=+; Position=2-1354
IVTEEGEDSLYPIAVLIDELRNEDVQLRLNSIRKLSTIALALGDERTRKELIQFLTDTIYDEDEVLVALADQLGNFTPLGGGPEYVHWLLPPLENLANIEETVVRDKAVESLQKIAEKHSAAQLEEYFIPMDLRLSAGDWFTSRTSACGLFRVAYARANPAQKTELRAAFRGLCRDDTPMVRRAAAYKLGDFAKVQEEDYLKNEITQMFEDLAKDEQDSVRLLSVEAGIVIVGLLSEDSAKLAQVKPIAVSLVQDKSWRVRYMAADKIVQIQQAFRTKIGIEEIVGWYTGLLKDCEGEVRDAAAEKLQSFCAALSEEGRKKGIIEEILPVIRPLTTDANQHVKIALAQVVMGLAPLLGNQCTIEHLLPIFLSMLRDDTPEVRLNIISSLEKVSDVIGADELQYSLLPAIIDLAQDGKWRVRLAIVEYMPLLAKQLGQKFFDEKLLKLCMNW

SEQ ID NO: 122201 - protein, 194 aa, Heterodera glycines
  Homolog annotation: Hit_ID=XP_424244.1; Match level="QueryCoverage =100%, HitCoverage=24%, E-value=3e-76, Identity=69%"; Hit description= PREDICTED: similar to KIAA1709 protein, partial [Gallus gallus]
  Gene Ontology: Cellular component=nucleus
  Essential gene: C elegans homolog=F55A12.8; Phenotype=Lva
  Coding regions on vcDNA: vcDNA=SeqID_48624; Strand=+; Position=2-583
ERGVANRWRSLFIIIGDKAKDQAVTLHHILAKATTGGRPSVLWCYKKETEFSSHRKKRIKELKKRKESGLFQSKEDNLFEQFILSTQISYCYYADSHRILGNTFGMAVLQDFEALTPNLLARTVETVEGGGLVVLLIQSGTSLKHVFTMNMDVHKRYRTEAHADVVGRFNERFILSLASCANCVVMDDCLNVLP

SEQ ID NO: 122202 - protein, 194 aa, Heterodera glycines
  Homolog annotation: Hit_ID=NP_500963.1; Match level="QueryCoverage =88%, HitCoverage=54%, E-value=1e-59, Identity=64%"; Hit description =ribonucleoprotein (33.5 kD) (4H89) [Caenorhabditis elegans] gb|AAM44397.1| Homologous to drosophila sqd (
  Gene Ontology: Mol. function=RNA binding; Cellular component=nuclear speck; Biological process=RNA catabolism
  Essential gene: C elegans homolog=Y73B6BL.6; Phenotype=Stp
  Coding regions on vcDNA: vcDNA=SeqID_48625; Strand=+; Position=50-631
MSNDNDKRDASSIPTNALVNKEESPDGNEEKKIFCGGISYETSNEDLAVYFGQYGKVKEVQVKYDRVTGRSRGFAFVEFDTVAACQASLVQREQVIKGKQCEIKPAKSREVGYMNKKVFVGGLPGDFPEEELRKHFNQYGKVEEIEWPFDKLSKTRKNFAFVVFEDEESADRATALPKQNFASRECDVKKGGPQ

SEQ ID NO: 122203 - protein, 171 aa, Heterodera glycines
  Homolog annotation: Hit_ID=NP_499535.1; Match level="QueryCoverage =100%, HitCoverage=33%, E-value=7e-68, Identity=72%"; Hit description= NOT-like, component of CCR4/NOT complex, CCR4-associated Factor family (ntl-3) [Caenorhabditis elegans]
  Gene Ontology: Mol. function=3'-5' exoribonuclease activity; Cellular component=cytoplasm; Biological process=regulation of transcription, DNA-dependent
  Essential gene: C elegans homolog=Y56A3A.1; Phenotype=Emb
  Coding regions on vcDNA: vcDNA=SeqID_48626; Strand=+; Position=139-651
MAEKRKLLNEIDKCYKKIDEGFEIFDDIMEKMNEANSDNQREKFQDDLKKEIKKLQRLRDQIKGWQNSSEIKDKDSLSKFRKLIEQRMEIFKDVERENKTKPHSKQGLSAEDKLDPREKEKCETIEWLNCQIRRIQDEIDRTESKLETMSSMADSNRKRGKKDEAEKNEKE

SEQ ID NO: 122204 - protein, 301 aa, Heterodera glycines
  Homolog annotation: Hit_ID=NP_490675.1; Match level="QueryCoverage =58%, HitCoverage=81%, E-value=8e-70, Identity=78%"; Hit description =RAB family member (23.4 kD) (rab-11.1) [Caenorhabditis elegans] gb|AAB54158.1| Rab family protein 11.1 [C
  Gene Ontology: Mol. function=RAB small monomeric GTPase activity; Cellular component=Golgi apparatus; Biological process=signal transduction
  Essential gene: C elegans homolog=F53G12.1; Phenotype=Emb,Ste
  Coding regions on vcDNA: vcDNA=SeqID_48627; Strand=+; Position=27-932
KCRNEDEYDYLFKVVLIGDSGVGKSNLLSRFTRNEFNLESKSSAGVELFFEFSPSIKVDGKTMKAQIWDTAGQERHQPIVSAFYRRAVGALLVYDISVRLTYENVGRWLKELRDHSDPNIVIMLVGNKSDLGNLRAVPTDEANAYAERNQMAFIETSALDGTNVGAAFTNILTTICRSQSTTAGSTPKIDINDDLIDEDALLEPEDLQRPEQSAACGVPSDGDEQSKKRRACKNCTCGLAEQMQTAADANGDTNNKMEAKSACGNCYLGDAFRCSTCPHLGKPPFKAGEDGTIKLASVDDF

SEQ ID NO: 122205 - protein, 215 aa, Heterodera glycines
  Homolog annotation: Hit_ID=NP_505626.1; Match level="QueryCoverage =80%, HitCoverage=16%, E-value=1e-33, Identity=41%"; Hit description =general transcription factor IIIC polypeptide 3 102kDa (119.0 kD) (5K688) [Caenorhabditis elegans] emb|CA
  Gene Ontology: Mol. function=RNA polymerase III transcription factor activity; Cellular component=transcription factor TFIIIC complex; Biological process=transcription from Pol III promoter
  Essential gene: C elegans homolog=ZK856.13; Phenotype=Gro
  Coding regions on vcDNA: vcDNA=SeqID_48628; Strand=+; Position=3-647
RIHCFGQESDKRLILDLDDQQAGPSEQKVGRRGPGRKSANPTLDNLLGHANLEHARGRTKEAMTFLFEVVKLAPYHVQTYKELSDLYSELGQKEKSFEFKMLAALLNSKTTAEEWDEIAGTAKSFNRLELAVACLAKAIRCDPENWLYYEKRIQILDASGETDLAMKTRLQAAQSINCQTSKINFAWIDKLIKTAADYYCTLKDEERATEALETF

SEQ ID NO: 122206 - protein, 243 aa, Heterodera glycines
  Homolog annotation: Hit_ID=CAE66847.1; Match level="QueryCoverage =91%, HitCoverage=47%, E-value=3e-79, Identity=66%"; Hit description =Hypothetical protein CBG12219 [Caenorhabditis briggsae]
  Gene Ontology: Mol. function=transcription regulator activity; Cellular component=cytoplasm; Biological process=intracellular receptor-mediated signaling pathway
  Essential gene: C elegans homolog=C25A1.11; Phenotype=Gro,Slu
  Coding regions on vcDNA: vcDNA=SeqID_48629; Strand=+; Position=19-747
MDGLTEPMLSTRPSPSIGAEGKERFARENHSEIERRRRNKMTHYINELADMVPQCAALGRKPDKLTILRMAVSHMKVIRGANAQSNNLSGTMPSQPSFLTDQELKHLILEAANGFLFVVSCESARVVFVSDSIGPILNVSPEQWLNSPSFYDVIHPQDVEKVRGHLLGTDFSHNSRVLDLKTGTVKREHSSARVHLNCRRGFICRMRIGDVNCLPRLRNRHPIFESEGRSFIPVHCTGYVKKT

SEQ ID NO: 122207 - protein, 201 aa, Heterodera glycines
  Homolog annotation: Hit_ID=CAE70046.1; Match level="QueryCoverage =100%, HitCoverage=46%, E-value=2e-63, Identity=65%"; Hit description= Hypothetical protein CBG16478 [Caenorhabditis briggsae]
  Gene Ontology: Mol. function=helicase activity; Cellular component =eukaryotic translation initiation factor 4 complex; Biological process=nucleobase, nucleoside, nucleotide and nucleic acid metabolism
  Essential gene: C elegans homolog=F57B9.6; Phenotype=Lva
  Coding regions on vcDNA: vcDNA=SeqID_48630; Strand=+; Position=44-646
MTDAKTDQKDNVKSEVGDVPNGGTSFTAQLSDDFTIQSNTNEVVDSFDNMQLKDTLLRGIYSFGFEKPSAIQQRAIVPCCSGRDVIAQAQSGTGKTATFSISVLQRVDENAPDVQALVMAPTRELAQQILLVMRALGEYMGVKFHTCIGGTSVRDDQRKLEGSVQVIVGTPGRVNDMIPPGALKNDKIKMVVLDEADEMLS

SEQ ID NO: 122208 - protein, 343 aa, Heterodera glycines
  Homolog annotation: Hit_ID=CAE65743.1; Match level="QueryCoverage =100%, HitCoverage=67%, E-value=1e-109, Identity=57%"; Hit description=Hypothetical protein CBG10828 [Caenorhabditis briggsae]
  Gene Ontology: Mol. function=RNA binding; Cellular component =nucleolus; Biological process=histogenesis and organogenesis
  Essential gene: C elegans homolog=Y110A7A.8; Phenotype=Emb
  Coding regions on vcDNA: vcDNA=SeqID_48631; Strand=+; Position=1-1029
NVIHKFVRDKYEKRFPELESLVPMPLDYINTVKLLANDIDTNSRKEIIHQILPAATCIVVSVTASTSQGKPLEQNELDVIIEACSMAEELYDLRMKMHLFVELRMALIAPNLCRIVGAGTAAMLISQAGGLVPLAKMPACNVLILGKQKRTLAGFSSSVILPNTGFIYHHPIVQTLPPDLRRKAARLVAAKCTLASRVDSIHSSLDGRIGERLSVEIKGKLEKMQEPPPVKNAKPLPKPLDKASKKRGGKRVRKQKELLKATELRRKANRMNFGELQEDVMQDHLGFTLGQANSHSLPSGGRLRASQVDNKTRVKVSQKLQRTIEKTRQHGGITSLAAKSHGS

SEQ ID NO: 122209 - protein, 285 aa, Heterodera glycines
  misc_feature (195)..(195): Xaa can be any naturally occurring amino acid
  Homolog annotation: Hit_ID=BAC66617.1; Match level="QueryCoverage =98%, HitCoverage=77%, E-value=1e-108, Identity=63%"; Hit description= inorganic pyrophosphatase [Ascaris suum]
  Gene Ontology: Mol. function=inorganic diphosphatase activity; Cellular component=mitochondrion; Biological process=energy pathways
  Essential gene: C elegans homolog=C47E12.4a; Phenotype=Emb,Lva
  Coding regions on vcDNA: vcDNA=SeqID_48632; Strand=+; Position=54-908
MSAYQTIEKGSLHTLNYRVFFKNSDGKLISPWHDIPLYASESNKLFNMVVEIPRWTNAKMEIATKEVMSPIRQDEKKGLPRFVNNIFPHRGYIWNYGALPQTWEDPGHKDENTGENGDNDPIDVIEIGSKVQKRGAVIRVKVLGVLALLDEGETDWKLVAIDENDELAPKLNGIEDIEKHLPGLLSATHEWFRIXKIPTGKPANKFAFNGQFKDRNFAHKIIEQTHQFWKKLVTSASPHPLNTDCHKEEAVFKANLSDWESFISKQPKFGHAQQVPEHVDKWHFI

SEQ ID NO: 122210 - protein, 362 aa, Heterodera glycines
  Homolog annotation: Hit_ID=CAE72532.1; Match level="QueryCoverage =73%, HitCoverage=59%, E-value=7e-45, Identity=38%"; Hit description =Hypothetical protein CBG19712 [Caenorhabditis briggsae]
  Essential gene: C elegans homolog=K11B4.1; Phenotype=Emb,Lva
  Coding regions on vcDNA: vcDNA=SeqID_48633; Strand=+; Position=4-1089
MPAFRLILSPFPSVFARLSHSHVPLFRQCSAAASSNSPSVNFLSSNFALPAEWDGRLGHLSVEQLGGDNFEWIVAVQKKFTGVGKASAIDLDLACSVPVGSDHLADLVDLCYKFRHTDSAGDLLPSTEYTLCRLLLEFGEFGVFMNLLNDPINYGIFPNEHICCMFLDHFLGSAQLQYAAKIAIYVMLQEMFDFPLLTFLATRALLEWTQGERKLDEQIHPKMAPSLEDETNFNEENVRLFRYPFLKNPFWDGHFDENDSDRMAGKALEWLSYHLKLAKNDETNYDETLIRVIRLLGLSIQRKWTEAKSLAEEMFITVAPSDNARQMIYSSMEQMQQFLNFDEQIEAAEKQTEREKDDQNSE

SEQ ID NO: 122211 - protein, 210 aa, Heterodera glycines
  Homolog annotation: Hit_ID=NP_508980.2; Match level="QueryCoverage =100%, HitCoverage=45%, E-value=7e-76, Identity=35%"; Hit description= PUmilio and FBF family member (78.5 kD) (puf-9) [Caenorhabditis elegans] gb|AAA81077.2| Puf (pumilio/fbf
  Gene Ontology: Mol. function=RNA binding; Cellular component =cytoplasm; Biological process=regulation of protein activity, epigenetic
  Essential gene: C elegans homolog=W06B11.2; Phenotype=Gro
  Coding regions on vcDNA: vcDNA=SeqID_48634; Strand=+; Position=1-630
VRCIKDQNGNHVVQKIIERVQPHQLQFIIDTMVNGFTDSVTSLSVHPYGCRVIQRVLEHCTEGQKRPVLEQLHENVLTLVTDQYGNYVIQHVIEHGLFDDRERIVRALHGDILKYAQHKFASNVIEKCLICGTTDQKNALIDEVCADNGSSNPPLLEMMKDPFANYVVQKMLDVADSTHRKKMMFAIKGHIPALRRFNYGKHIITKLEKY

SEQ ID NO: 122212 - protein, 202 aa, Heterodera glycines
  Homolog annotation: Hit_ID=NP_493745.1; Match level="QueryCoverage =88%, HitCoverage=32%, E-value=2e-36, Identity=46%"; Hit description =protein beta-transducin family (52.4 kD) (2A772) [Caenorhabditis elegans] gb|AAC78176.1| Hypothetical pro
  Gene Ontology: Cellular component=nucleosome; Biological process=cell organization and biogenesis
  Essential gene: C elegans homolog=W07E6.2; Phenotype=Lva
  Coding regions on vcDNA: vcDNA=SeqID_48635; Strand=+; Position=3-608
IGLLLEQPVKKRKIEVGESDGNEQRSVAVRLFSEDGKEIGQAPVVLLASTTAEQLQVLYHQLLRSEKQQNGECGDDGDFDEGTAPVQFRTVADEKSGGKGTEIVDSLLDSLPSERLFLEKPLELVCLPQAVFRVRPVTRCTASLPGHGEPVLSVQFSPDGSCLASGSGDRTVRLWDLHTNLPKQTLTGHNDWVLCIGWSPDG

SEQ ID NO: 122213 - protein, 219 aa, Heterodera glycines
  misc_feature (164)..(164): Xaa can be any naturally occurring amino acid
  Homolog annotation: Hit_ID=NP_491237.1; Match level="QueryCoverage =94%, HitCoverage=64%, E-value=3e-52, Identity=48%"; Hit description =protein phosphatase 1A (34.6 kD) (1E406) [Caenorhabditis elegans] gb|AAB42233.1| Yeast glc seven-like pho
  Gene Ontology: Mol. function=protein serine/threonine phosphatase activity; Cellular component=cytoplasm; Biological process=protein amino acid dephosphorylation
  Essential gene: C elegans homolog=W09C3.6; Phenotype=Ste
  Coding regions on vcDNA: vcDNA=SeqID_48636; Strand=+; Position=3-657
KVRHSPVQRFTDEITDEELKQLCMAATDIFRMQPTLVRIQPPVVVVGDIHGQFTDLQRIFHTHGNPPEQQYVFLGDYADRGPQSLETIVLLFCYKVKYPANFMLLRGNHECANINRVYGFFDEVNRRYQRPGPRRLYDLFNQTFAWMPYVGLIGDKILCMHGGXLSDQINSLEQLSQLNPPANTTPRLRTLEKRILLWGETLPNRKYRWQAYPRTTMEK

SEQ ID NO: 122214 - protein, 218 aa, Heterodera glycines
  Homolog annotation: Hit_ID=NP_004506.2; Match level="QueryCoverage =74%, HitCoverage=41%, E-value=3e-36, Identity=47%"; Hit description =interleukin enhancer binding factor 2 [Homo sapiens] ref|NP _080650.1| interleukin enhancer binding factor
  Gene Ontology: Mol. function=RNA polymerase II transcription factor activity; Cellular component=nucleus
  Essential gene: C elegans homolog=R11H6.5; Phenotype=Unclassified
  Coding regions on vcDNA: vcDNA=SeqID_48637; Strand=+; Position=24-677
MMYSLGSFYGAPPIAYNPTPLAAATPGVGPMRPPVPMSVHGASPQQIYQFKPPTFDPYLCDQFFPRSSTEAEETAQTQFLLAKHNDILPSTVEQSAISALVGKVKQTLDKIIVAPETFNSVAIEEVREVGSYKKGTMLAKHNVADLVIVLKTLPLIEAVNALGQKIVLDLKAENHADIFGCVIREFGCEIAGTHAVVRVLITILPQLATQLDKDLHLP

SEQ ID NO: 122215 - protein, 113 aa, Heterodera glycines
  Homolog annotation: Hit_ID=NP_491944.2; Match level="QueryCoverage =100%, HitCoverage=100%, E-value=3e-32, Identity=61%"; Hit description=60s acidic ribosomal protein p2 (1H366) [Caenorhabditis elegans] gb|AAB52450.2| Hypothetical protein C3
  Gene Ontology: Mol. function=structural constituent of ribosome; Cellular component=cytosolic large ribosomal subunit (sensu Eukarya); Biological process=protein biosynthesis
  Essential gene: C elegans homolog=C37A2.7; Phenotype=Emb,Gro
  Coding regions on vcDNA: vcDNA=SeqID_48638; Strand=+; Position=32-373
MKYVAAYMLASLGGNGDPSPKDLEKILAAGGLEVDMDNVNAVINAVKGKSIDEVITAGQKKLATMPTGGGAAAPAAAAATGAAAPAGKEEKEEKKKEEVKEESDDDMGFGLFD

SEQ ID NO: 122216 - protein, 159 aa, Heterodera glycines
  misc_feature (74)..(74): Xaa can be any naturally occurring amino acid
  Homolog annotation: Hit_ID=NP_085059.1; Match level="QueryCoverage =85%, HitCoverage=45%, E-value=7e-21, Identity=36%"; Hit description =alpha 1 type XVIII collagen isoform 1 precursor [Homo sapiens] gb|AAC39658.1| type XVIII collagen [Homo s
  Gene Ontology: Mol. function=protein binding; Cellular component =collagen; Biological process=negative regulation of cell proliferation
  Essential gene: C elegans homolog=F23H12.4; Phenotype =Bmd,Dpy,Emb,Lva,Unc
  Coding regions on vcDNA: vcDNA=SeqID_48639; Strand=+; Position=6-728
MVAANLKLSLIFVAGFCLLFIADSDAGKSCKPGEKGPPGPPGKPGNKGKPGVTVANALRMPCSFGLLALSTTPXPAGPPGDAGIAGPPGPPGEPGKCYGSGSKESKEKEYKPSKRSIDNFEHGLRVARGYKQEVGPPGPAGPPGPPGPDGPPGECECKY

SEQ ID NO: 122217 - protein, 270 aa, Heterodera glycines
  Homolog annotation: Hit_ID=AAK39275.2; Match level="QueryCoverage =88%, HitCoverage=49%, E-value=2e-74, Identity=54%"; Hit description =Glutamyl(e)/glutaminyl(q) trna synthetase protein 3 [Caenorhabditis elegans]
  Gene Ontology: Mol. function=glutamate-tRNA ligase activity; Cellular component=mitochondrion; Biological process=tRNA modification
  Essential gene: C elegans homolog=T07A9.2; Phenotype=Gro
  Coding regions on vcDNA: vcDNA=SeqID_48640; Strand=+; Position=22-831
MVSFPPSLMPSFQCFCASSSRLFCSSAFVRPVRVRFAPSPTGELHLGSVRTALFNFLWARKYNGKFVLRIEDTDRERLVEGSEQRIEQTLSHFGLTPDESPLRGGQFGSYYQSERLPLYRELADQLVDIGHSYKCFCSQERLDFLRRKANSERIPFRYDGICRQLSTEETRARERNEEQFVVRFKFDGRRAGFTDIVFGDYEHYSEEGDFVILKRDGFPTYHFANVVDDRRMKISHVIRGAEWICSTTKHLQIYSAFGWSPPHFAHLPLI

SEQ ID NO: 122218 - protein, 218 aa, Heterodera glycines
  misc_feature (109)..(109): Xaa can be any naturally occurring amino acid
  Homolog annotation: Hit_ID=NP_496490.1; Match level="QueryCoverage =99%, HitCoverage=28%, E-value=1e-68, Identity=57%"; Hit description =neprilysin-like zinc metallo-peptidase (2L946) [Caenorhabditis elegans] emb|CAA93770.1| Hypothetical prot
  Gene Ontology: Mol. function=metalloendopeptidase activity; Cellular component=Golgi apparatus; Biological process=reproduction
  Essential gene: C elegans homolog=ZK20.6; Phenotype=Ste
  Coding regions on vcDNA: vcDNA=SeqID_48641; Strand=+; Position=2-656
ALEMIEDLRGAFQQMLVANDWMDSDTREFAMEKAQQMINLIGFPDFLFNDTQLDDYYKNLVLHPNDHYAEMVEKVSAWAHKKLFRRLIEEVDRSEFGTSSTVVNAFYSXSKYAITFPAAILQAPFFDQAFPKAVNYGGIGAVIGHEITHGFDDQGAQFHGIGNLKDWCDPNTQQHFVERKRSIIDQYSSFEVPDINLHVNGILTQGRKIADNGGHKQA

SEQ ID NO: 122219 - protein, 267 aa, Heterodera glycines
  Homolog annotation: Hit_ID=CAE68967.1; Match level="QueryCoverage =100%, HitCoverage=34%, E-value=1e-130, Identity=86%"; Hit description=Hypothetical protein CBG14947 [Caenorhabditis briggsae]
  Gene Ontology: Mol. function=chaperone activity; Cellular component =mitochondrion; Biological process=embryonic cleavage
  Essential gene: C elegans homolog=Y47G6A.10; Phenotype=Gro
  Coding regions on vcDNA: vcDNA=SeqID_48642; Strand=+; Position=1-801
VKTAFADVAGCEEAKIEIMEFVNFLKNPAQYKALGAKIPKGALLTGPPGTGKTLLAKATAGEANVPFITVSGSEFLEMFVGVGPSRVRDMFEMARKKAPCILFIDEIDAVGRKRGGKGAMGGHSEQENTLNQLLVEMDGFSTDESNVVVIAATNRVDILDPALMRPGRFDRQIFIPVPDIKGRASIFRVHLTPIKTTLDKIELSRKLAAHTPGFSGADIANVCNESALIAARDAHDEVTSKDFENAIERVIAGMEKKSQVLQPDEKK

SEQ ID NO: 122220 - protein, 302 aa, Heterodera glycines
  misc_feature (272)..(272): Xaa can be any naturally occurring amino acid
  Homolog annotation: Hit_ID=CAE56819.1; Match level="QueryCoverage =95%, HitCoverage=86%, E-value=1e-115, Identity=64%"; Hit description= Hypothetical protein CBG24633 [Caenorhabditis briggsae]
  Gene Ontology: Mol. function=stearoyl-CoA desaturase activity; Cellular component=endoplasmic reticulum membrane; Biological process=lipid metabolism
  Essential gene: C elegans homolog=VZK822L.1; Phenotype =Gro,Ste,Unc,Unclassified
  Coding regions on vcDNA: vcDNA=SeqID_48643; Strand=+; Position=7-912
MATITLTSQHSQIVPEVIRQQFLAADLEESVRLREEAKKGQFKTQIVWRNVLLFVLLHFGALVGLCQLISSAKWATIGWCIFLWFAGGVGITAGAHRLWSHKSYKARFPLRVLLVVLNCVAFQNDVIEWSRDHRCHHKWTDTDADPHNINRGFFFSHMGWLLVKKHPQVKAKGSTLDLSDLTSDPLLAFQRKFYLPLVLLFCFLLPTLIPVLLWNESSSVAFYTAAVFRYTFTLHATWLINSVAHIFGYRPYDVSISSAESVWTTLLAVGEXGHNYHHTFPQDYRTSEMRTLLNFTKAFIDL

SEQ ID NO: 122221 - protein, 362 aa, Heterodera glycines
  Homolog annotation: Hit_ID=AAP94888.1; Match level="QueryCoverage =90%, HitCoverage=99%, E-value=4e-75, Identity=46%"; Hit description =P34 [Ascaris suum]
  Gene Ontology: Mol. function=casein kinase I activity; Cellular component=bud neck; Biological process=signal transduction
  Essential gene: C elegans homolog=R90.1; Phenotype=Lva,Unc
  Coding regions on vcDNA: vcDNA=SeqID_48644; Strand=+; Position=1-1089
LFSALLHLISAAHRLHRQRHAMEELVALSPGIRVGRWTITKKLGAGAFGAVYLCVNDQGEQAALKTEPVNTPHPLLVMEAHVMTKLDALRDGDGKHFCRCLDLGRDEQKDQQSGQMKKFNYIVMSLVGRGLDGVVKDAGGRLSLGSAVGVSIQMLAALRGLHTVGYLHRDIKPGNSTIGRPESNEIRLLYLIDFGMARKYTRDDGSQHRPRAVTNFRGSPRYAAISAHLGREYSRKDDIESWFYCMIELLKGALPWANVGEMKAIGEAKIKRQKKQPEAVRRQAIADLLSGCPNEFGQVLKYIDDMKYTDKPDYDWIIATLRSSLSNAGVQEFPYDWETGKRNAAPGAGGGGGGGGGDSYFN

SEQ ID NO: 122222 - protein, 296 aa, Heterodera glycines
  Homolog annotation: Hit_ID=CAE73448.1; Match level="QueryCoverage =96%, HitCoverage=97%, E-value=2e-74, Identity=50%"; Hit description =Hypothetical protein CBG20897 [Caenorhabditis briggsae]
  Gene Ontology: Mol. function=transferase activity, transferring groups other than amino-acyl groups; Cellular component=integral to endoplasmic reticulum membrane; Biological process=fatty acid elongation
  Essential gene: C elegans homolog=D2024.3; Phenotype=Gro
  Coding regions on vcDNA: vcDNA=SeqID_48645; Strand=+; Position=46-936
MASGHYEVWHSQSVGFPIFYLPYEYDDKWALEKRVWNPAQAKWLHPVFIRHWHISFFLVFLYIAGIHYLKWWMRDRKPFELRNFLVFWNAGLAIFSTFGALRFSEEFLYVMKNRSFQDSVCLSISPTQPAALWAFLFSLSKVAEFGDTVLLVLRKRPLIFLHWFHHSVVLIYSWHSATELTAAGRWFIQLNYSVHAIMYTYYTFASLGIRFPKWVSMTVTTLQTTQMLIGVFISLYVARLKLFSSRPTVCQQSVENMCICFSIYTAFAFLFIRFFVNSYLLGKKPTAAKAVAKKAQ

SEQ ID NO: 122223 - protein, 213 aa, Heterodera glycines
  Homolog annotation: Hit_ID=NP_496500.1; Match level="QueryCoverage =95%, HitCoverage=50%, E-value=6e-57, Identity=56%"; Hit description =Malate/L-lactate dehydrogenase (42.8 kD) (2M3) [Caenorhabditis elegans] emb|CAA88951.1| Hypothetical prot
  Essential gene: C elegans homolog=F36A2.3; Phenotype=Egl,Unc
  Coding regions on vcDNA: vcDNA=SeqID_48646; Strand=+; Position=78-716
MLSSPPKEFVAPVGEVHAFVVKCMQSVGTSAAHAAQLADLLLDADIVGHYSHGLNRLCIYIEDVASGVKGDGEPKVLKQKGATAWVDGCDLLGAVVGNFCTELAIKLAKEHGIGWVVCKRSNHYGICQHYAKKIANAGLLGLSFTNTSPIIFPTRSSQIGLGTNPISCCANSREKGDGFILDMAASTVALGKGEIAKVNGKSAIPSAWGADSA

SEQ ID NO: 122224 - protein, 168 aa, Heterodera glycines
  Homolog annotation: Hit_ID=CAE63934.1; Match level="QueryCoverage =100%, HitCoverage=87%, E-value=5e-81, Identity=88%"; Hit description= Hypothetical protein CBG08511 [Caenorhabditis briggsae]
  Gene Ontology: Cellular component=cytoplasmic vesicle; Biological process=ommochrome biosynthesis
  Essential gene: C elegans homolog=Y48G8AL.14; Phenotype=Ste
  Coding regions on vcDNA: vcDNA=SeqID_48647; Strand=+; Position=130-633
MIKAILVFNNHGKPRLLKFYTQYSEEEQQQIVRETFQQVSKRDDNVCNFLEGGKLIGGSDCKLIYRHYATLYFVFCVDSSESELGILDLIQVFVETLDRCFENVCELDLIFHVEKVHHILNELVMGGMVLETNMNEILLRIQEQDKIERQEAGIAAAPARAVSAVKNM

SEQ ID NO: 122225 - protein, 443 aa, Heterodera glycines
  Homolog annotation: Hit_ID=NP_499068.1; Match level="QueryCoverage =99%, HitCoverage=28%, E-value=4e-69, Identity=36%"; Hit description =yeast transcriptional mediator complex RGR homolog (rgr-1) [Caenorhabditis elegans] pir||A88554 protein C
  Gene Ontology: Mol. function=transcription co-activator activity; Biological process=regulation of transcription from Pol II promoter
  Essential gene: C elegans homolog=C38C10.5a; Phenotype=Emb
  Coding regions on vcDNA: vcDNA=SeqID_48648; Strand=+; Position=1-1329
YVETADRLVEIARNELPNARLPAFQVAQAVDVLTLGSYPRLPQNIKDRFIPPLPLGAAERRLTLRQLNKLIEFHLAQQAAQLSPRIRHITVQNGMACLVVPGEFEMELTRLGDEPTTRWTLLNIRILVESAEVGEGQQMVHPLQINFLHQMVQEKLDTANEPIMAAYIVLHWFCRSLHLDILLCQALQIAKINRSGKGSEGSSQQYIRVDEYNEKECRLAISYWLRREGGTIHGRLSSHYRMLIFGDKNNSHVGLKIRHHPPSTELPTIDHEQSPSLQRLLNETVLFRCRERLLAGKQLLEAAFRTLSSQSNTKCPSSASPSSTNSEDTAQQFVHQSGHSLLTLSCPLVLIGDCHPDECLTVAVNTFSGAVIARVEVLGQREEIHKLEHQLNTCPTVLLHSSASSLSAFSVSSIGRLLARLRVLVIGERLNRALVGMQVNSLN

SEQ ID NO: 122226 - protein, 226 aa, Heterodera glycines
  Homolog annotation: Hit_ID=CAE65778.1; Match level="QueryCoverage =95%, HitCoverage=32%, E-value=4e-24, Identity=32%"; Hit description =Hypothetical protein CBG10873 [Caenorhabditis briggsae]
  Gene Ontology: Biological process=embryogenesis and morphogenesis
  Essential gene: C elegans homolog=C37H5.9a; Phenotype=Emb
  Coding regions on vcDNA: vcDNA=SeqID_48649; Strand=+; Position=66-743
MPMNEIDRAVEVRLERVQEVKKSMLKEAGLETDIEPANDGVFQGDLLLTTEQCDELINQLQNDTTAEGTAVVSLEAQSLLDSETDTEVGSNSPSLATYNATHSILPDAEIEGTASAVAALAPHLRAKRAGNALFFELIPIEKWPYDKPIAFFLDKALRNDERKQVRFALKQIQSNSCIKFKEYAAKPTHTTHLHYLKETSLGACGFSEIGMVKPFNRIMLSFRCPS

SEQ ID NO: 122227 - protein, 205 aa, Heterodera glycines
  Homolog annotation: Hit_ID=CAE59526.1; Match level="QueryCoverage =84%, HitCoverage=54%, E-value=2e-27, Identity=38%"; Hit description =Hypothetical protein CBG02921 [Caenorhabditis briggsae]
  Essential gene: C elegans homolog=B0491.5; Phenotype=Emb,Lva
  Coding regions on vcDNA: vcDNA=SeqID_48650; Strand=+; Position=25-639
MHIYKDPYAPPLAPKVPDDPPPWFPSWKEYKRRTEWWASLGYKDLDLKRGLTTGFYPFFEERDIRYVDSKVPDGTSMVGPQGKDSRYHQRKMVKWGIPGKFEDFQKQIRENCSQYKQIAEKWDLRDEHPGIAVNPSLDSIIRQKYRPIGTVFPLFPKILAWPRFWDKPMNEGCFKKGLALAKYSLPITWIAYAGALRGYDPPATN

SEQ ID NO: 122228 - protein, 299 aa, Heterodera glycines
  Homolog annotation: Hit_ID=NP_498013.1; Match level="QueryCoverage =59%, HitCoverage=92%, E-value=3e-29, Identity=35%"; Hit description =bzfb xenla basic fgf-repressed zic binding protein homolog like (3F951) [Caenorhabditis elegans] gb|AAA62
  Essential gene: C elegans homolog=C35D10.5; Phenotype=Gro
  Coding regions on vcDNA: vcDNA=SeqID_48651; Strand=+; Position=37-936
MPFCPMASQRTHCALFQQRHLATKYVRFPLVPPDNKNSVQTLQQLIASQKDPNAFVFGTNMAGRVGQWLTKRSFEKTVDTELRILLLKSANQMYLCCANKYPFIPLLNEFGLPDHYSSWYRLTLLHIWMALCRVQQSLEAMAYIYFMHQVLEVFNTDWYTRLDKAAKEMGMSVNKRKEGMALHAIYISTLHDYDEGFFGDDRVLAAAVWRSFFLQLPDVCPAQINRVGRYMRATMASLARMDDTRLLTDGIERWDVAEELARLVSAEQFGTIPAAPPSSSMDGDGRNSAQPAPKVAASN

SEQ ID NO: 122229 - protein, 288 aa, Heterodera glycines
  Homolog annotation: Hit_ID=NP_500332.1; Match level="QueryCoverage =91%, HitCoverage=56%, E-value=6e-19, Identity=27%"; Hit description =ATPase H+ transporting lysosomal (49.6 kD) (4E137) [Caenorhabditis elegans] gb|AAC69004.1| Hypothetical p
  Essential gene: C elegans homolog=Y55H10A.1; Phenotype=Ste
  Coding regions on vcDNA: vcDNA=SeqID_48652; Strand=+; Position=14-877
MILKLKVPILLYCFVQCLSAVKVDNAEQSDQPTGDSSSGQFPISYPPIKYENDLAYVEKPSGNERCLFYAEGLSVVVFATKKSQSAWADYRSDTKESPKYTASIECQGNMNVGSSFDVYLKIDGKAEGVVRADIGKKDAKSVFTVEGAEFILNFNVTQVGFWQLVGATVERIEVKGSSDFLNKNLNVDKKWTLEPSVVPSTNINGFKDYSFACGQTNPIVWALKDSNDYAVGITLNNVQFQPFNATYTAGGKEADRLKFGWKVNDCQGLVSIGTWMGLVVATLLIGVL

SEQ ID NO: 122230 - protein, 344 aa, Heterodera glycines
  Homolog annotation: Hit_ID=NP_506137.1; Match level="QueryCoverage =98%, HitCoverage=74%, E-value=1e-73, Identity=44%"; Hit description =hemoglobinase-type cysteine proteinase family C13, legumain (53.2 kD) (5M993) [Caenorhabditis elegans] em
  Gene Ontology: Mol. function=GPI-anchor transamidase activity; Cellular component=extracellular space; Biological process =embryogenesis and morphogenesis
  Essential gene: C elegans homolog=T28H10.3; Phenotype=Emb
  Coding regions on vcDNA: vcDNA=SeqID_48653; Strand=+; Position=1-1032
TTHTQKLFNEPGGKDVYEGVKIDYSGTEVNPENFEAVLLGDEQRSEGKPVLKSTEKDKVFVYFSDHGAVGVIGFPAADLTVKQLTQTLKEMHAKKMYGELTFYLEACESGSMFDHTLAQSLKIYAVTAANGDESSWGCFCDTKFLPGNCLGDLFSVNWMQDSDQENLRTETLRKQFGIVREETNKSHVMHYGDLQIQDEHVSEFMGKEQAQKRNERPPSPHKFPMFPSRDIPMFMMARRQNESKQIQRNLRVAWKKRSFLEQSIKQIVHQLVHDMNNRRQMLTTYPQQIRDLDCHHEVMHTFSNLCFRFSENPYALKYAYVLANLCERPELDAERIRMALIEHC

SEQ ID NO: 122231 - protein, 171 aa, Heterodera glycines
  Homolog annotation: Hit_ID=CAE56706.1; Match level="QueryCoverage =92%, HitCoverage=56%, E-value=3e-25, Identity=38%"; Hit description =Hypothetical protein CBG24492 [Caenorhabditis briggsae]
  Gene Ontology: Biological process=chromosome segregation
  Essential gene: C elegans homolog=C41G7.3; Phenotype=Him
  Coding regions on vcDNA: vcDNA=SeqID_48654; Strand=+; Position=84-599
ANTNSLCLTMPLHWTSVDTRNALLCAAVPSIGAFVGSTMAIKDQELVQFLKNQNFPSFARCCKYNYLLANTAVTIPFGYASYLVYKIGGGFDYTDTTVALGLYGATVLSGCFLVPMLKKQDTKALTANAVVLAGLSVATSVAFYNIDKISAYWTMPFTLWAIFCAGLTVKA

SEQ ID NO: 122232 - protein, 203 aa, Heterodera glycines
  Homolog annotation: Hit_ID=XP_308308.1; Match level="QueryCoverage =95%, HitCoverage=37%, E-value=1e-44, Identity=48%"; Hit description =ENSANGP00000010875 [Anopheles gambiae]
  Gene Ontology: Mol. function=co-chaperone activity; Cellular component=mitochondrial inner membrane; Biological process=protein folding
  Essential gene: C elegans homolog=F22B7.5a; Phenotype=Emb,Lva,Sck
  Coding regions on vcDNA: vcDNA=SeqID_48655; Strand=+; Position=82-690
MLRYVCLFPRRSFHFSTFLPKDYYKILGLSKTAKESDIKKAYYEMAKKYHPDVNKAKGASEKFQELSEAYEVLGDPKRRAEYDRFGAGGPQPGAASGSPGGPQSARDFGWEFHSGKSAEQVFRDIFRDFDPFGNAGAFGSGRRSFGETQHGFDAAQEVVVNVTFEEAARGVRKEVRINVVDSCWKCNGSGVQPGFKKVSCPYC

SEQ ID NO: 122233 - protein, 254 aa, Heterodera glycines
  Homolog annotation: Hit_ID=CAA78914.1; Match level="QueryCoverage =99%, HitCoverage=65%, E-value=7e-87, Identity=60%"; Hit description =p46XlEg22 [Xenopus laevis] pir||S52242 protein kinase (EC 2.7.1.-) p46XlEg22 - African clawed frog
  Gene Ontology: Mol. function=protein serine/threonine kinase activity; Cellular component=centrosome; Biological process =chromosome condensation
  Essential gene: C elegans homolog=B0207.4; Phenotype=Mei
  Coding regions on vcDNA: vcDNA=SeqID_48656; Strand=+; Position=1-765
LARDRKYRIPVALKILFKSQLVKGNVEHQLVREIEIHAHLRHPNILRMFNYFHDDKKVYLILEYALHGELFKVLQKSRRFSESTSAQYIFQVSDALNYCHSKKVIHRDIKPENILLCADGKIRIADFGWAVHAKNRRQTMCGTLDYLPPEMVLKRQHDEKVDYWSVGVLCYEFLVGRPPFETKTQEETYTRIMKVQYSFPSFMSPDARDLISKLLVKEPSRRLSFEHVLKHHWIIAHCNKNNDADSSTASSECW

SEQ ID NO: 122234 - protein, 164 aa, Heterodera glycines
  Homolog annotation: Hit_ID=XP_393173.1; Match level="QueryCoverage =93%, HitCoverage=14%, E-value=4e-79, Identity=95%"; Hit description =similar to Hypothetical protein CBG09037 [Apis mellifera]
  Essential gene: C elegans homolog=F25B5.4a; Phenotype=Emb
  Coding regions on vcDNA: vcDNA=SeqID_48657; Strand=+; Position=3-497
RIQHPFNLAIMQIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGKN

SEQ ID NO: 122235 - protein, 198 aa, Heterodera glycines
  Homolog annotation: Hit_ID=NP_492557.1; Match level="QueryCoverage =88%, HitCoverage=23%, E-value=1e-21, Identity=34%"; Hit description =complex locus; 3' and 5' of different mRNAs overlap; the locus encodes successively a product with simila
  Gene Ontology: Mol. function=transcriptional activator activity; Cellular component=cytoplasm; Biological process=signal transduction
  Essential gene: C elegans homolog=T05F1.6; Phenotype=Unclassified
  Coding regions on vcDNA: vcDNA=SeqID_48658; Strand=+; Position=2-598
LASDETAYLIADTYYRTHKYLSALSLSIPCVSYKWIQQCVAEKQLTDHRPFLLPAGESSLDTKQQFEWRPLKGVLMKGKRVLIWSSSAETDPGIVSFAEIWTPILQNLGATLVGIGPGEPFASKSSANLEEKMEFCSKIEPPVDVLLAETDCQAEVAKLVEERGGLAVSSEWVIQAIVTGSLPDLGEPGGEKFRYDFV

SEQ ID NO: 122236 - protein, 194 aa, Heterodera glycines
  Homolog annotation: Hit_ID=NP_499360.1; Match level="QueryCoverage =91%, HitCoverage=93%, E-value=1e-39, Identity=53%"; Hit description =mitochondrial ribosomal protein L7L12 (18.4 kD) (3L797) [Caenorhabditis elegans] emb|CAB07857.1| Hypothet
  Gene Ontology: Mol. function=structural constituent of ribosome; Cellular component=mitochondrial large ribosomal subunit; Biological process=growth
  Essential gene: C elegans homolog=W09D10.3; Phenotype=Lva
  Coding regions on vcDNA: vcDNA=SeqID_48659; Strand=+; Position=26-610
MIVNGSLKICRTALGPFVRRASASALGLPLEDGPSVSPPSVDRAKDISPRVRSLVDQIAELSLVEVSDLNFALKKRLNIPDTPAMAMSPEMFAAAGMFGAQAGGAAGAQTSQANADDDSASTKTSYAVRLAKFDDAKKIALIKEVRSVIPGMNLVQTKKLIESAPVEIKGDMGKTEADELKALLEKHGAECEVI

SEQ ID NO: 122237 - protein, 331 aa, Heterodera glycines
  Homolog annotation: Hit_ID=CAE62343.1; Match level="QueryCoverage =98%, HitCoverage=56%, E-value=2e-53, Identity=36%"; Hit description =Hypothetical protein CBG06418 [Caenorhabditis briggsae] pir||S27782 esterase precursor - Caenorhabditis br
  Gene Ontology: Mol. function=neurexin binding; Cellular component =synaptic junction; Biological process=synaptic vesicle targeting
  Essential gene: C elegans homolog=K07C11.4; Phenotype=Gro
  Coding regions on vcDNA: vcDNA=SeqID_48660; Strand=+; Position=1-993
VSIQYRLGIIGFSSTGDKQMAGNFGLWDQFAALEFVSENIAQFGGNPADITLFGESAGAASVSFLGLSPHSQGLFQKCVQLSGSPLSAWALNGRVINETAQLAAAINCAENGREGIKECLKGKTVDELFEGVEKVGKTRQEYDFTKWGPLLDGDFLPADIPQLIERAPPKPTVMGIADLETLLWTLAIGHNDSISLYAIPWDEMANFDRRRFEMFVQNFVTKRELFGQQMATELQREIVQFYTRDKAVERIENEGEYYVRKITLLLSDLQFAVPVIWEAAQKAQKGWPIYFFKNSYFNEVVFPKVVKVRQNFHANDFIYFFDRKVYRFEFN

SEQ ID NO: 122238 - protein, 240 aa, Heterodera glycines
  Homolog annotation: Hit_ID=AAT02163.1; Match level="QueryCoverage =87%, HitCoverage=96%, E-value=1e-41, Identity=45%"; Hit description =hypothetical protein L3ni56 isoform a [Dictyocaulus viviparus]
  Essential gene: C elegans homolog=C55B7.9; Phenotype=Dpy
  Coding regions on vcDNA: vcDNA=SeqID_48661; Strand=+; Position=67-786
MLLNNRSQLPLSVYGGGIGSGVSALSAGAKDHSATASSASVRRPPVSQYQSTECVLFGSIFNDQKDQLIQRLKGLCDPDGPTPFFEHNMVFKLKTGIESPVQVQMRRRFKVDTVHWHCRYVSQPEAHIKDVVVRKVIDSLIHSTDMMSFVKSLGLRMEYEYIANGFLFTKGDIRILLYQLQCSETIGNYNKLKQFGDSFLVEASVLLPGHGLEHLQQAAKSVKEFADQLHPLCKLSYVDY

SEQ ID NO: 122239 - protein, 202 aa, Heterodera glycines
  Homolog annotation: Hit_ID=NP_491066.1; Match level="QueryCoverage =98%, HitCoverage=48%, E-value=1e-94, Identity=81%"; Hit description =actin Related protein 2/3 compleX component ARX-1, actin-like protein 3 (arx-1) [Caenorhabditis elegans]
  Gene Ontology: Mol. function=actin polymerizing activity; Cellular component=cytoskeleton; Biological process=cell cycle dependent actin filament reorganization
  Essential gene: C elegans homolog=Y71F9AL.16; Phenotype=Emb
  Coding regions on vcDNA: vcDNA=SeqID_48662; Strand=+; Position=24-629
MHANLPAAVIDCGTGYTKLGYAGNSEPQFIIPSAIAVKDANILKSVGGKIPDLDFFIGDEALSPSAANYFVKYPIRHGIVDDWDLMERFWEHCIFKYLRAEPEDHYFLLTEPPLNTPENREFTAEIMFESFNVPGLYIAVQALLALAASWQTREFNHRSLTGLVVDSGDGVTHCIPVCDGYVIGSCIKHIPIAGRDITYFLQ

SEQ ID NO: 122240 - protein, 211 aa, Heterodera glycines
  Homolog annotation: Hit_ID=NP_032595.1; Match level="QueryCoverage =69%, HitCoverage=7%, E-value=9e-20, Identity=33%"; Hit description =anaphase promoting complex subunit 1 [Mus musculus] emb|CAA56450.1| tsg24 [Mus musculus] pir||A55117 tsg24
  Gene Ontology: Mol. function=ATP binding; Cellular component=anaphase- promoting complex; Biological process=cell organization and biogenesis
  Essential gene: C elegans homolog=W10C6.1; Phenotype=Mei,Ste
  Coding regions on vcDNA: vcDNA=SeqID_48663; Strand=+; Position=3-635
NSSLGRAYTPGGGGIEGVVESLNGANHNNGGTSGQSAARHADHSGIGQPCSSHVRELPTLNTHLTSPAAAVALGLIYLRTGDCWIRETLAIADTFYEIDQIRPDMLMIRTFSRCLVDFEDIKCTREWVDAQIPQIIRKYVKRFLEVKSKEDMWWSDFIDMATVAKAYFYCFAGASFAMALRFASKWEIKALQVIQSFYEILKTDTSELATS

SEQ ID NO: 122241 - protein, 208 aa, Heterodera glycines
  Homolog annotation: Hit_ID=NP_494218.2; Match level="QueryCoverage =98%, HitCoverage=37%, E-value=2e-79, Identity=71%"; Hit description =chaperonin (2C531) [Caenorhabditis elegans] gb|AAF35963.3| Hypothetical protein F54A3.3 [Caenorhabditis e
  Gene Ontology: Mol. function=chaperone activity; Cellular component =cytoskeleton; Biological process=protein folding
  Essential gene: C elegans homolog=F54A3.3; Phenotype=Emb,Lva
  Coding regions on vcDNA: vcDNA=SeqID_48664; Strand=+; Position=22-645
MIQTGGAPLIIINRSAEREQGHRVQKQNIAAAKMVADVIRTSLGPRAMLKMLMDPMGGIVLTNDGNAILREITVKHPAAKTMIEIARTQDEETGDGTTSVIILAGEFLAQAEQFLEQSIHPTVIIHGYRMALEDIIEWTEEKFSKPVDLASESELTTVVKSCLGTKMLAKYMDLAVNIALSAVRTIDVTNNDFREIDIKRYCRIEKIP

SEQ ID NO: 122242 - protein, 203 aa, Heterodera glycines
  misc_feature (108)..(108): Xaa can be any naturally occurring amino acid
  Homolog annotation: Hit_ID=NP_502204.2; Match level="QueryCoverage =96%, HitCoverage=47%, E-value=7e-38, Identity=39%"; Hit description =nucleoside transporter of the ENT family (50.0 kD) (ent-1) [Caenorhabditis elegans] gb|AAM46663.1| equili
  Gene Ontology: Mol. function=nucleoside transporter activity; Biological process=physiological processes
  Essential gene: C elegans homolog=ZK809.4; Phenotype=Sck
  Coding regions on vcDNA: vcDNA=SeqID_48665; Strand=+; Position=1-651
GRRPPPDRFRLVYLIVLLHGMGMLLPWNTFITIAGDYYLQFKFANVSNEDNYKVYFFNYLTVCAQIPNLLLTFLNLFGVIRGGFYRRIYFTLAVIFGICLVTIAMGLXGFFLFTMLSVVLLNSASGVYQNSIWGLFADFPGEFAGAIIIGNNLCGILMAVLDILIIVLVGANAALAATVYFGLALFTVVLCIFSFHFLQKLVL

SEQ ID NO: 122243 - protein, 256 aa, Heterodera glycines
  misc_feature (207)..(207): Xaa can be any naturally occurring amino acid
  Homolog annotation: Hit_ID=CAE68424.1; Match level="QueryCoverage =96%, HitCoverage=40%, E-value=3e-84, Identity=59%"; Hit description =Hypothetical protein CBG14204 [Caenorhabditis briggsae]
  Gene Ontology: Mol. function=protein binding; Cellular component =actin cytoskeleton; Biological process=hearing
  Essential gene: C elegans homolog=C04F6.4a; Phenotype=Gro,Slu
  Coding regions on vcDNA: vcDNA=SeqID_48666; Strand=+; Position=22-787
MTSSDEEFKKECTFASLPRTVRGMPLVVSSNSDGTKFLYCNGNSVFIRDEENIADCDVYTEHATLTTVAKYSPSEFYIASGDQSGKIRFWDTTQSTHILKSEFALLSGAIRDISWSEDSKRVAIVGEGHERFGHVFLFDTGTSNGNLSGQSRPMNSIDFRPTRPYRLVSGSEDNTVAIFEGPPFKFKSIFHEHSRFVQSVRYNKDGXSLFAAGGMDGKVILFEGQEGGKVGELVDETCKGTAAHSGGVFALNWHSG

SEQ ID NO: 122244 - protein, 231 aa, Heterodera glycines
  Homolog annotation: Hit_ID=AAK93843.1; Match level="QueryCoverage =70%, HitCoverage=19%, E-value=1e-31, Identity=46%"; Hit description =Dnaj domain (prokaryotic heat shock protein) protein 8 [Caenorhabditis elegans] ref|NP_495340.1| DNaJ doma
  Essential gene: C elegans homolog=C56C10.13; Phenotype=Egl,Unc
  Coding regions on vcDNA: vcDNA=SeqID_48667; Strand=+; Position=200-892
MDVNQAYKILSNPQRRKAYDTFGFTDEQFEGMRKEFFREQQQHQFQFVRWPQPPRKKQTDISQFLLPFGSVLGTLFFIFVVGYFLNHMNVSEQSKRRRQPQNRAEEANKMGGGDTKTEDNEKELAEDQKAPLTEEERQQKLQARVWRVMGPMIRELRAETQFGLIRLLKPGCRSIIVLVDKDSKDKLLQQFARHLYCLRNNKTFSFGFLMVPKNLSWFRSLLELTLPDEQQ

SEQ ID NO: 122245 - protein, 266 aa, Heterodera glycines
  Homolog annotation: Hit_ID=NP_741153.1; Match level="QueryCoverage =100%, HitCoverage=48%, E-value=1e-109, Identity=74%"; Hit description=chaperonin Containing TCP-1 (58.9 kD) (cct-6) [Caenorhabditis elegans] gb|AAC46642.1| Chaperonin contai
  Gene Ontology: Mol. function=chaperone activity; Cellular component =cytoplasm; Biological process=protein folding
  Essential gene: C elegans homolog=F01F1.8a; Phenotype=Emb
  Coding regions on vcDNA: vcDNA=SeqID_48668; Strand=+; Position=55-852
MASIACLNPKAELARHAAALEMNISGAKGLQEVMKTNLGPKGTLKMLVSGSGDLKVTKDGNVLLHEMQIQHPTASLIAKACTAQNDVTGDGTTSTVLLIGELLKQAENYVSEGVHPHLVTEGFQLAHDHLLQLLAASKKTLPIDRPLLIEVARTTLRTKLDQKLADHVTECVVDAVLAIRRDENDTEPDLHMIEIQQMEHEMETDTQLIRGLVLDHGGRHPDMPKSVRNVHILTCNVSMEFDKTEVNSGLFYETAAERERLLQAER

SEQ ID NO: 122246 - protein, 212 aa, Heterodera glycines
  Homolog annotation: Hit_ID=NP_507514.1; Match level="QueryCoverage =81%, HitCoverage=48%, E-value=7e-41, Identity=49%"; Hit description =ubiquitin specific protease 8 (5S413) [Caenorhabditis elegans] emb|CAC14405.1| Hypothetical protein Y59A8
  Gene Ontology: Mol. function=protein binding; Cellular component =intracellular; Biological process=positive regulation of body size
  Essential gene: C elegans homolog=Y59A8B.2; Phenotype=Gro,Sma
  Coding regions on vcDNA: vcDNA=SeqID_48669; Strand=+; Position=419 -1054
MPCQRKKSPAIRSGRKRWVFGGFGRKFFIFKINSFIFQPLGQTGLFNMGNTCFMNATLQPLFHTPGFSQLFQEKSAQRFVNGNNSFGTNGMISGSFSALIDLIWSGKFNALRPTTFLEFFARRVNTEMADRRQHDAQEFQLYLLDALHEDTNRVNKRQSFEQNYDDTDLGASASDFNERSKLFSSSPVNDLFNLTNISMVQCSTCNTTSVRF

SEQ ID NO: 122247 - protein, 214 aa, Heterodera glycines
  Homolog annotation: Hit_ID=NP_495707.1; Match level="QueryCoverage =100%, HitCoverage=100%, E-value=1e-100, Identity=79%"; Hit description=ribosomal Protein, Large subunit (24.7 kD) (rpl-10) [Caenorhabditis elegans] emb|CAA88308.1| Hypotheti
  Gene Ontology: Mol. function=structural constituent of ribosome; Cellular component=cytosolic ribosome (sensu Eukarya); Biological process=protein biosynthesis
  Essential gene: C elegans homolog=F10B5.1; Phenotype=Lva,Ste
  Coding regions on vcDNA: vcDNA=SeqID_48670; Strand=+; Position=28-672
MGRRPARCYRYIKNKPYPKSRFCRGVPDPKIRIFDLGRKRATVDEFPCCVHMISNEREHLSSEALEAARICANKYMVKNCGKDGFHMRVRIHPFHVIRINKMLSCAGADRLQTGMRGAFGKPQGLVARVGIGDMLMSVRVRDQHQAHALEAFRRAKFKFPGRQYIVISRKWGFTPFDREVYEKHRKEGRVIPDGVNCRFLKQHGPLTEWLKNPI

SEQ ID NO: 122248 - protein, 375 aa, Heterodera glycines
  Homolog annotation: Hit_ID=AAT70232.1; Match level="QueryCoverage =100%, HitCoverage=100%, E-value=0.0, Identity=100%"; Hit description= unc-87 [Heterodera glycines]
  Gene Ontology: Mol. function=troponin C binding; Cellular component =cytoskeleton; Biological process=muscle contraction
  Essential gene: C elegans homolog=F08B6.4a; Phenotype=Unc
  Coding regions on vcDNA: vcDNA=SeqID_48671; Strand=+; Position=131 -1258
MPESENDFDEEAPNATMETKVAGGGAAPKRVGRWTLSQLRQTDGIIPSQAGWNKGDSQKLMTNFGTPRNTTTKVKVENLAEIPEDILLKSHGEVRLQSGTNRFASQKGFVSFGTGRDVCREGVNVNILPADLEPLPEEKIRASDGIVRLQAGTNKFDSQKGMTLFGTGRRETTRMKDSKHPEYSHERDIDNTEIPLQMGTNKFASQKGMTGFGTNRRETTKMLDTSHPEYSHEQSIDQTSIPYQMGSNKYASQKGMTGFGQPRWEVLDPSISYQNRKSQGMVRLQSGTNRFASQAGMTGFGTPRNNTYEAEAGELPYEDMKKSEAIIPSQAGWNKGDSQKLMTNFGTPRDVKGKHLKRIWELEYPEEAEVSLDRL

SEQ ID NO: 122249 - protein, 257 aa, Heterodera glycines
  misc_feature (123)..(123): Xaa can be any naturally occurring amino acid
  misc_feature (163)..(163): Xaa can be any naturally occurring amino acid
  misc_feature (236)..(236): Xaa can be any naturally occurring amino acid
  Homolog annotation: Hit_ID=EAL22335.1; Match level="QueryCoverage =89%, HitCoverage=47%, E-value=4e-31, Identity=34%"; Hit description =hypothetical protein CNBB5100 [Cryptococcus neoformans var. neoformans B-3501A]
  Gene Ontology: Biological process=embryogenesis and morphogenesis
  Essential gene: C elegans homolog=C16A3.4; Phenotype=Emb
  Coding regions on vcDNA: vcDNA=SeqID_48672; Strand=+; Position=291 -1143
MTTTETPTAPRLDHTTGWTCLACKLVFSSGQLQRDHYRSEWHLYNMKRQIANLPPVTECDFLEKLQYFLQHQQKNAFDADHRRLSSLSLSSSSPSSLVCTVCRNKRFRSRNAFDNHLQSRRHXKRKNNCNSSRRRQRQLRLMSAKRRGEKMAAWKQNCQRLWXNIDGEEEAVLPIESDNDDDEEAEQKEDNSFAKKEDGIPPNECLYCELKSDTWEANLAHMSKQHGFLVPDSPFXRNVPGLLTYLVVALCFSNFFF

SEQ ID NO: 122250 - protein, 365 aa, Heterodera glycines
  Homolog annotation: Hit_ID=NP_499734.1; Match level="QueryCoverage =92%, HitCoverage=91%, E-value=3e-66, Identity=43%"; Hit description =cleavage and Polyadenylation Factor (cpf-2) [Caenorhabditis elegans] emb|CAB05746.1| Hypothetical protein
  Gene Ontology: Mol. function=RNA binding; Cellular component=nucleus; Biological process=embryogenesis and morphogenesis
  Essential gene: C elegans homolog=F56A8.6; Phenotype=Emb
  Coding regions on vcDNA: vcDNA=SeqID_48673; Strand=+; Position=36-1133
MQNQQNMDNSARSIFVGNISYDVSEDELRKLLSACGQIVSFRLVHDRETGRPKGFGFCEFADVPQAEAAILYFNGFEFRGRPLRVDSATGNDRSADEMQHFQMTLTRPQNPTDELSPYGPELEPGKAPEVIARTVASMPPEKMFELMRSMKETVNNNPQMARQLLMENPQLSYALLQAQVVMRVVDPKIAYQMLHREHAQPLVPPTSIPTHIPQQFAGKPPQLPPQFNIPPPSVPSHQFQMQPPPLVPGQFHHGFPSMGMAPPSLLQQQQQQTPFTQQKPTPIAPLAVPPAATAPQQQQAVSPPPLSQQAQQSNSDNLDEEQQAQMLIRVLQLTDEQIRMLPPTEKCGCKCVTISNRTDRGRKAN

SEQ ID NO: 122251 - protein, 244 aa, Heterodera glycines
  Homolog annotation: Hit_ID=NP_490676.1; Match level="QueryCoverage =100%, HitCoverage=100%, E-value=4e-92, Identity=64%"; Hit description=ribosomal Protein, Large subunit (28.1 kD) (rpl-7) [Caenorhabditis elegans] gb|AAB54165.1| Ribosomal pr
  Gene Ontology: Mol. function=structural constituent of ribosome; Cellular component=cytosolic ribosome (sensu Eukarya); Biological process=protein biosynthesis
  Essential gene: C elegans homolog=F53G12.10; Phenotype=Emb,Lva
  Coding regions on vcDNA: vcDNA=SeqID_48674; Strand=+; Position=24-758
MTEAKKLPEVPETLLKRRKIRAAQRAARAKNSLNTIKKAKAKKTEIFKRAEHYLVEYRQKQRQLVALKREAKKVGNYYVPDEPKLAFVVRIKGINKIHPRPRKVLQLLRLRQINNGVFVKLNKATIQMLRIADPYIAWGYPSQKIIRQLVYKRGYAKESGQRIPITDNAIVERNMGKSDVICVEDMIHQIWTVGPHFKQVTNFLWPFKLSNPVGGFKKKSNHFVEGGDYGNREDQINKLLEKMI

SEQ ID NO: 122252 - protein, 247 aa, Heterodera glycines
  misc_feature (205)..(205): Xaa can be any naturally occurring amino acid
  Homolog annotation: Hit_ID=AAO14563.2; Match level="QueryCoverage =100%, HitCoverage=34%, E-value=1e-132, Identity=97%"; Hit description=Hsp90 [Heterodera glycines]
  Gene Ontology: Mol. function=protein binding; Cellular component =centrosome; Biological process=reproduction
  Essential gene: C elegans homolog=C47E8.5; Phenotype=Emb,Ste
  Coding regions on vcDNA: vcDNA=SeqID_48675; Strand=+; Position=32-772
MSEQSGETFAFQAEIAQLMSLIINTFYSNKEIFLRELISNSSDALDKIRYQALTDPSQMESGKELFIKIVPNKADKTLTIIDTGIGMTKADLVNNLGTIAKSGTKAFMEALQAGADISMIGQFGVGFYSAFLVADRVTVTSKHNDDDCYQWESSAGGSFIIRNCADPEVTRGTKIVLHLKEDQTDYLEERRVREVVKKHSQVIGXPIKWVVKKERDKEISDDEAEEEKKEDEAKEEEKKPEDDVSDD

SEQ ID NO: 122253 - protein, 262 aa, Heterodera glycines
  Homolog annotation: Hit_ID=CAF90706.1; Match level="QueryCoverage =100%, HitCoverage=100%, E-value=1e-106, Identity=72%"; Hit description=unnamed protein product [Tetraodon nigroviridis]
  Gene Ontology: Mol. function=structural constituent of ribosome; Cellular component=eukaryotic 48S initiation complex; Biological process=protein biosynthesis
  Essential gene: C elegans homolog=F56F3.5; Phenotype=Emb,Ste
  Coding regions on vcDNA: vcDNA=SeqID_48676; Strand=+; Position=176-964
MAVGKNKKMGKKGAKKKAVDPFTRKEWYDIKAPAMFTHRNVGKTLVNRTQGTRISSDFLKGRVYEVSLGDLNSTDADFRKFRLICEEVQGKICLTNFHGMTFTRDKLCSIVKKWHTLIEANVAVKTTDGFLLRLFCIGFTKRNANQIKKTSYAKTSQVRMIRAKMVEIMQKEVSSGDLKEVVNKLIPDSIGKDIEKACSFYYPLQDVYIRKVKVLKKPKFELGKLLEMHGEGAGTVATITTATGEKIESRPDAYEPPVQQSV

SEQ ID NO: 122254 - protein, 272 aa, Heterodera glycines
  Homolog annotation: Hit_ID=NP_501455.1; Match level="QueryCoverage =84%, HitCoverage=20%, E-value=1e-23, Identity=31%"; Hit description =ethanol decreased 4 (4J268) [Caenorhabditis elegans] gb|AAB37553.2| Temporarily assigned gene name protei
  Gene Ontology: Biological process=reproduction
  Essential gene: C elegans homolog=C28C12.10; Phenotype=Ste
  Coding regions on vcDNA: vcDNA=SeqID_48677; Strand=+; Position=3-818
SEFGKYRPLPSDRKCPRKGCASDPPPATHCQPGHSSENGTVQPTKTSSLISSKNGCAEAEEEQCLFVEHFGPIPQYSETDEKENLRLRKLHEVALEIYQKQRAYVMKLQLIGLNYPRHLNDCEKRMNKKLLHSKHVIRRIADHFQTILNVHLTFLHNFYDKILKWDSRKPDLAEVFQKNADFLKICRLFLTEKQKLVAELQQTLNENHELAEATLTFEQALSKETSTRHSFSGGRSNCASVNDLKGISIVLQLDAVHQNVVQYKLLMERYRK

SEQ ID NO: 122255 - protein, 351 aa, Heterodera glycines
  Homolog annotation: Hit_ID=NP_490727.1; Match level="QueryCoverage =72%, HitCoverage=34%, E-value=4e-12, Identity=28%"; Hit description =prion-like Q/N-rich domain protein PQN-59, yeast splicing factor PRP related, Prion-like Q/N-rich domain
  Gene Ontology: Biological process=regulation of protein activity, epigenetic
  Essential gene: C elegans homolog=R119.4; Phenotype=Emb,Lva,Lvl
  Coding regions on vcDNA: vcDNA=SeqID_48678; Strand=+; Position=61-1113
MELQKQPVMATKEQLRLAELTQTGHDATIAHDDIAGQKRVKKVIELTRCTQSQAEVALIDSEGNVEDAVARLLDSPEKLVLWSQQGKKQKTKSSTPSVARTTTTHNQTKGKGQNEQNSAGPRVRTERQGQGFKGQNRTFTAGGAYRRDNVAANKQTTNKVVGTGTNTGDFSSTVEQSYGETAGHENDEWKNGPRVFMPSSAATVVMAETSTNGGVKWPALDNFTPSVEPAEPAAVHKPKTFAAVAAAKKASPQPSPPQHQQQQQQQQTITYESREPDWTKENWTTEPTNWSSENWASTGKLESTEILDNPEKLDTTEKLENTDMLGTAGNIEAANNLDTSVMLDTSCKLDT

SEQ ID NO: 122256 - protein, 163 aa, Heterodera glycines
  Homolog annotation: Hit_ID=XP_393173.1; Match level="QueryCoverage =98%, HitCoverage=14%, E-value=2e-79, Identity=94%"; Hit description =similar to Hypothetical protein CBG09037 [Apis mellifera]
  Essential gene: C elegans homolog=F25B5.4a; Phenotype=Emb
  Coding regions on vcDNA: vcDNA=SeqID_48679; Strand=+; Position=1-492
IQYPFNLAIMQIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGKN

SEQ ID NO: 122257 - protein, 211 aa, Heterodera glycines
  Homolog annotation: Hit_ID=CAE63558.1; Match level="QueryCoverage =92%, HitCoverage=47%, E-value=7e-28, Identity=33%"; Hit description =Hypothetical protein CBG08044 [Caenorhabditis briggsae]
  Gene Ontology: Mol. function=protein binding; Cellular component =spliceosome complex; Biological process=gametogenesis
  Essential gene: C elegans homolog=F56G4.4; Phenotype=Sck,Sma,Stp
  Coding regions on vcDNA: vcDNA=SeqID_48680; Strand=+; Position=3-635
EYWKSYAKKFCEICKIWYADNKVSAERHEQGLRHKAMVQQRLRESAKKAKDKEVEDHELRMTLLSMEQAARASFSSREEREVPMVPAPRIITSQKQTAEPTEEDEVKAKLREQKRKLAALKKRSKQSQFWSPDEGEMGEGDLPLEEELADWVQAETSDGQFYYWHIYTGETRWEQPEKFYTSAQYAERYANIVEETTDQREVGQCANSAYD

SEQ ID NO: 122258 - protein, 273 aa, Heterodera glycines
  Homolog annotation: Hit_ID=NP_502560.1; Match level="QueryCoverage =86%, HitCoverage=63%, E-value=2e-85, Identity=57%"; Hit description =fatty acid desaturase (43.5 kD) (fat-2) [Caenorhabditis elegans] emb|CAB05304.1| Hypothetical protein W02
  Gene Ontology: Biological process=embryogenesis and morphogenesis
  Essential gene: C elegans homolog=W02A2.1; Phenotype=Emb
  Coding regions on vcDNA: vcDNA=SeqID_48681; Strand=+; Position=108-926
MSPPCSFSPSSASSSSDSPSAEGQAQQNGQVLAPRPLPTWEEIRAAVPKECFEKSLLRSLYYLAIDLLVIGFLYAVVPFVETNFGLIGLFFWYCLLGMFLSSLFCVGHDCGHGTFSDWTWVNDIFGHISHALLMVPFWPWQKSHRQHHQFTSHVDKDKGHPWVLEDDYEGGGWLRKHFAKIPLSGLIRWNPIYTVAGLPDGSHFWPFSRLFSNNTERFKCLISSSLCLITSWAIFVLLDHSPWAFLKYYYVPLMFQGYWMVIITYLQHQDEQI

SEQ ID NO: 122259 - protein, 217 aa, Heterodera glycines
  Homolog annotation: Hit_ID=CAE75300.1; Match level="QueryCoverage =82%, HitCoverage=52%, E-value=1e-60, Identity=43%"; Hit description =Hypothetical protein CBG23270 [Caenorhabditis briggsae]
  Gene Ontology: Mol. function=transporter activity; Cellular component= mitochondrial inner membrane; Biological process=transport
  Essential gene: C elegans homolog=F55A11.4; Phenotype=Emb
  Coding regions on vcDNA: vcDNA=SeqID_48682; Strand=+; Position=56-746
MVIKSNSVISRSHSDHFQEASGSLSATSGSEDAIKHWGWWRHFVAGATAGCVSRSVTAPLDRLKVFLQVNANHKTPHTLPSAVDYLYREGGFLSFWRGNGINILKIAQESAIKFMFYEQIKQEFQKLTGHRDLDIFERFMAGASAGVIAQTAIYPLEVLKTRLALRRTGELNRGLCHFAREMYHREGFTCLYRGYAANCIGIIPYAGIDLAVYETLK

SEQ ID NO: 122260 - protein, 198 aa, Heterodera glycines
  misc_feature (191)..(191): Xaa can be any naturally occurring amino acid
  Homolog annotation: Hit_ID=CAE66740.1; Match level="QueryCoverage =85%, HitCoverage=46%, E-value=3e-66, Identity=71%"; Hit description =Hypothetical protein CBG12090 [Caenorhabditis briggsae]
  Gene Ontology: Mol. function=endopeptidase activity; Cellular component=proteasome regulatory particle, lid subcomplex (sensu Eukarya); Biological process=embryonic cleavage
  Essential gene: C elegans homolog=R12E2.3; Phenotype=Emb
  Coding regions on vcDNA: vcDNA=SeqID_48683; Strand=+; Position=40-632
MAPAPEKEKTEDKKLKDGQKPNVTTDHAHCLSNVQPNLPVNKVVVHPLVLLSVVDHFNRVNKTHKVNRVVGVLLGCMKHDKTLDIANCFAVPYDEDSENSNIFFLDADFLENMFGMFYKVAAREKIVGWDHSGPRLCKNDILINEVIKRFTPNPVLGIIQASQGRQDLALPTDAYVEVQEVHNDGSPPVKXFEHVPSG

SEQ ID NO: 122261 - protein, 186 aa, Heterodera glycines
  Homolog annotation: Hit_ID=CAE63933.1; Match level="QueryCoverage =100%, HitCoverage=100%, E-value=5e-79, Identity=75%"; Hit description=Hypothetical protein CBG08510 [Caenorhabditis briggsae]
  Gene Ontology: Mol. function=structural constituent of ribosome; Cellular component=cytosolic ribosome (sensu Eukarya); Biological process=protein biosynthesis
  Essential gene: C elegans homolog=Y48G8AL.8a; Phenotype=Emb,Lva
  Coding regions on vcDNA: vcDNA=SeqID_48684; Strand=+; Position=33-593
MGKIHYCKRPDNSTKSCKARGSDLRVHFKNTHETARAIKHMPLKRAIRFLENVREKKEIVPFRHFNGGVGRKAQAQAWGTTQGRWPKKSAEFLLQLLRNAESNAEVKGLDVDHLVIDHIVVQAAAKMRRRTYRAHGRINPYMSSPCHIEVILTEKKDVVAKPAGALVKVKKESKKKQRRQLARGEF

SEQ ID NO: 122262 - protein, 214 aa, Heterodera glycines
  misc_feature (181)..(181): Xaa can be any naturally occurring amino acid
  Homolog annotation: Hit_ID=NP_496290.2; Match level="QueryCoverage =95%, HitCoverage=86%, E-value=5e-39, Identity=45%"; Hit description =programmed cell death 10 (24.8 kD) (2K896) [Caenorhabditis elegans] emb|CAA90115.2| Hypothetical protein
  Essential gene: C elegans homolog=C14A4.11; Phenotype=Dpy,Emb
  Coding regions on vcDNA: vcDNA=SeqID_48685; Strand=+; Position=30-671
MSNNDIIFGNEEGVNYLAPWTYSCLIKTSIDRLKTALSENREAIHALNHLQEVFRQIDRASPSFLYDFSKLLLIESGVAGTNVQESYLRMHANAATEELELPQFAHIAEFQYLSMRAVSLCKVLARIPDEMTDRRPFLETIKEIASSIKQLLDTTNAIIALVPRCYQPRQINLTPFLSYFXNWLSVEKRKREFVQVSKRVSSTLKDYFKHQEPN

SEQ ID NO: 122263 - protein, 145 aa, Heterodera glycines
  Homolog annotation: Hit_ID=P46825; Match level="QueryCoverage=92%, HitCoverage=23%, E-value=2e-36, Identity=55%"; Hit description =Kinesin light chain (KLC) gb|AAA16578.1| kinesin light chain
  Essential gene: C elegans homolog=M7.2; Phenotype=Emb
  Coding regions on vcDNA: vcDNA=SeqID_48686; Strand=+; Position=289-723
MRRRRRLPRKMLSQEEIFRNTRTVAQGLDALREENEAIKNKLLVGMDVLTPDERQLIDEKASIVEKNLENIQLGLEESQVMLALASHLQNLEAEKQKYKAQVRRLCQENAWIRDELNSTQQQLRQCEQDKAQLEEENKHFEIIEQ

SEQ ID NO: 122264 - protein, 160 aa, Heterodera glycines
  Homolog annotation: Hit_ID=AAC47533.1; Match level="QueryCoverage =72%, HitCoverage=55%, E-value=1e-37, Identity=68%"; Hit description =calponin homolog MjCAP-1 [Meloidogyne javanica]
  Gene Ontology: Mol. function=troponin C binding; Biological process =growth
  Essential gene: C elegans homolog=F28H1.2; Phenotype=Emb,Lva
  Coding regions on vcDNA: vcDNA=SeqID_48687; Strand=+; Position=41-523
MGSRSVAGGVGASIMNKQASKYNESEGELLLNWIKQVTGATMTVNGTRENFQAQLKDGTLLCKVALKLEPNSIKGVTDKASSTFQQMSNLELFIEFCRKQGVITQELFRAVDLVEARDLYSVCMTLNSLGRIMQKKGKSHPKHVSASEIVNIPSTDALRL

SEQ ID NO: 122265 - protein, 406 aa, Heterodera glycines
  Homolog annotation: Hit_ID=AAL40720.1; Match level="QueryCoverage =98%, HitCoverage=97%, E-value=0.0, Identity=79%"; Hit description =calreticulin [Meloidogyne incognita]
  Gene Ontology: Mol. function=calcium ion storage activity; Cellular component=endoplasmic reticulum lumen; Biological process=regulation of transcription, DNA-dependent
  Essential gene: C elegans homolog=Y38A10A.5; Phenotype=Unc
  Coding regions on vcDNA: vcDNA=SeqID_48688; Strand=+; Position=22-1242
MLSSFPLLLSLVGLIAVHAEVFFKEEFSDDSWTDRWVTSKSKDDYGKFELSAGKFFGDKVRDQGLKTSQDARFYAISAKFPKKFSNKGKPLVVQFTVKHEQNIDCGGGYMKLMASDISQENFHGETPYHLMFGPDICGPGTKKVHVILGYKGKNQLIKKDIRCKDDELSHLYTLILSPDNTYEVQIDGEKVESGELEADWDLLPAKKIKDPDAKKPEDWDDKEYIDDPDDKKPDDWEKPEHIPDPDAKKPDDWDDEMDGDWEPPMIDNPEYKGTWKPKQIKNPNYKGKWIHPEIDNPEYQPDDDLYLREDWGAIGIDIWQVKSGTIFDNILVADSVEDAKKHAADTFDQLKEAEKKQKEAHDEEERKKFEEEEKKRKEEEEKKPKIDEEEVEEDEEEKKEEEHDEL

SEQ ID NO: 122266 - protein, 236 aa, Heterodera glycines
  Homolog annotation: Hit_ID=CAE58533.1; Match level="QueryCoverage =93%, HitCoverage=59%, E-value=2e-51, Identity=47%"; Hit description =Hypothetical protein CBG01690 [Caenorhabditis briggsae]
  Gene Ontology: Mol. function=transcription regulator activity; Biological process=cell cycle
  Essential gene: C elegans homolog=R08C7.2a; Phenotype=Gro
  Coding regions on vcDNA: vcDNA=SeqID_48689; Strand=+; Position=14-721
MARNRPNANIITSDLGEAQIKKHKPKDTRLLQQRLVAWQPILTAKTVIPLVFSISILFIPIGIVLLRISQSVQEYVVQYVNDANECKDYHANGQCAVNFTLNEDFKGDVYFYYALENFFQNHRRYMKSRNDQQLSGIDFLNTKDCTPFEKAPDGRPIAPCGAIANSLFNDSFQLNYLGGNGYANISWSHEGLVWPVDLESKFRNPTCDGQPCKTIAELCHKFSLTVRPPNWEKDLC

SEQ ID NO: 122267 - protein, 472 aa, Heterodera glycines
  Homolog annotation: Hit_ID=NP_508494.1; Match level="QueryCoverage =72%, HitCoverage=62%, E-value=1e-132, Identity=60%"; Hit description= C2H2 type zinc finger containing protein (XD472) [Caenorhabditis elegans] gb|AAA81404.2| Hypothetical pr
  Gene Ontology: Mol. function=zinc ion binding; Cellular component =nucleus; Biological process=regulation of transcription, DNA -dependent
  Essential gene: C elegans homolog=F53B3.1; Phenotype=Egl
  Coding regions on vcDNA: vcDNA=SeqID_48690; Strand=+; Position=10-1428
MPIILNQGILSTTCDDQQRETLKLQLEPAAEYNETNFKRTVLNASGTPINGAFTFWSAPSTAAPAATASVSNLSATTTVISSEPDLTPLTPSTSDVTVNGHSSNVKVLKPVPLVIRTQSADEIAGAVAHPTKPSEIRKLIRSKMARCRICRNRFLDKHIYERHLRDRHPKEHAAYLSQQEDEVRQQRKEEFEANRLDELVRGGFIPPQEDLDASKYEVNIKEIPLPGELTGGVPARFDRFGVLFQPKRVYKKKVSPQCPFCDKRYRNEYSLKKHIAKKHTECAEWAQCLKCFKAVPSKAEMVDHLGEMIYLCFECVPPRNLCNDVRLYNHRTKFHRGQNSGFKCNLCNQKFLTPRKLRKHKKMSHVFTKTYQCHFCEELFINETAVTTHERIHTGIIKFECKICDYKCNRFLNMEDHVKEDHGYLCSICQSKLSEWGDLKNHMLMDHGGYLSSEFNSGYIESPRVWLMFKGD

SEQ ID NO: 122268 - protein, 259 aa, Heterodera glycines
  Homolog annotation: Hit_ID=NP_498703.1; Match level="QueryCoverage =84%, HitCoverage=64%, E-value=2e-25, Identity=36%"; Hit description =DNA polymerase delta p38 (3I946) [Caenorhabditis elegans]
  Essential gene: C elegans homolog=ZK652.10; Phenotype=Age,Unclassified
  Coding regions on vcDNA: vcDNA=SeqID_48691; Strand=+; Position=10-786
MMVKSALSNSLSILNGFTSRAFTTSNIRSLRFRSQRPQNELRTVGKMVAQSDSPYEKGQCFVHKLFAYRGVIIRSKNCSVFTKRISDTQTVQQEVLPFYQVLIDKDDWSEMNFETDMTTFLKSTGNREETAISGMDIVSHDEILPFEPSVSELKSLSDGSGEAAPIKHYLYDQLFKKKTGEETKRDAGVNRQRPEEEMCWIFPIAVTKQTTDCFEVQVSTFNLGSNNLNRSHSPHNWRIVLRVENSQNNTMYLRNTVLK

SEQ ID NO: 122269 - protein, 441 aa, Heterodera glycines
  Homolog annotation: Hit_ID=AAP20434.1; Match level="QueryCoverage =99%, HitCoverage=97%, E-value=0.0, Identity=95%"; Hit description =beta-tubulin isotype 1 [Cooperia oncophora]
  Gene Ontology: Mol. function=MHC class I protein binding; Cellular component=tubulin; Biological process=embryogenesis and morphogenesis
  Essential gene: C elegans homolog=C36E8.5; Phenotype=Emb
  Coding regions on vcDNA: vcDNA=SeqID_48692; Strand=+; Position=28-1350
MREIVHIQAGQCGNQIGSKFWEVISDEHGIQPDGTYKGETDLQLERINVYYNEAHGGKYVPRAVLVDLEPGTMDSIRAGPYGQLFRPDNFVFGQSGAGNNWAKGHYTEGAELVDNVLDVVRKEAEGCDCLQGFQLTHSLGGGTGSGMGTLLISKIREEYPDRIMSSFSVVPSPKVSDTVVEPYNATLSVHQLVENTDETFCIDNEALYDICFRTLKLQNPTYGDLNHLVSVTMSGVTTCLRFPGQLNADLRKLAVNMVPFPRLHFFMPGFAPLSAKGAAAYQACSVAELTKQMFDAKNMMAACDPRHGRYLTVAAMFRGRMSMREVDDQMMSVQNKNSSYFVEWIPNNVKTAVCDIPPRGLKMSATFVGNSTAIQELFKRISEQFTAMFRRKAFLHWYTGEGMDEMEFTEAESNMNDLISEYQQYQDATVDDEGEYEAEDT

SEQ ID NO: 122270 - protein, 231 aa, Heterodera glycines
  Homolog annotation: Hit_ID=XP_421139.1; Match level="QueryCoverage =100%, HitCoverage=25%, E-value=8e-42, Identity=42%"; Hit description= PREDICTED: similar to KIAA0252 [Gallus gallus]
  Gene Ontology: Cellular component=DNA-directed RNA polymerase II, holoenzyme; Biological process=growth
  Essential gene: C elegans homolog=F25B3.6; Phenotype=Emb,Lva,Lvl,Unc
  Coding regions on vcDNA: vcDNA=SeqID_48693; Strand=+; Position=3-695
SKRRNKIQAEEKRKKETLKATLDLDEIFGNENEGGKSAGSSSSSTSSSRSSSPDLTKSRSPSPEVKQEIKTRDEIIRCQLFRRKLAKFVHAPFFAKTVVGCFVRISIGPNKSDGKQVYRAAQVVEVVETAKVYEVEPNSDIRTNKGFRLKVSDGEPMRVYRLEFVSNSLIMESEFLFWFNKMRSSNTPMLTVDFVDRKRKEIVNALNYKYNEAEINLLIKEKQRFKRQPTN

SEQ ID NO: 122271 - protein, 376 aa, Heterodera glycines; identical to SEQ ID NO: 121231
  Homolog annotation: Hit_ID=AAN15196.1; Match level="QueryCoverage =100%, HitCoverage=100%, E-value=0.0, Identity=100%"; Hit description= actin [Globodera rostochiensis] gb|AAN78299.1| actin 1 [Heterodera glycines] gb|AAG47837.2| actin 1 [Hete
  Gene Ontology: Biological process=reproduction
  Essential gene: C elegans homolog=M03F4.2a; Phenotype=Ste
  Coding regions on vcDNA: vcDNA=SeqID_48694; Strand=+; Position=88-1218

SEQ ID NO: 122272 - protein, 436 aa, Heterodera glycines
  Homolog annotation: Hit_ID=NP_741529.1; Match level="QueryCoverage =99%, HitCoverage=93%, E-value=1e-147, Identity=56%"; Hit description= adenylosuccinate synthetase, possibly N-myristoylated (50.2 kD) (5F298) [Caenorhabditis elegans] gb|AAM2
  Gene Ontology: Mol. function=protein binding; Biological process =purine nucleotide metabolism
  Essential gene: C elegans homolog=C37H5.6a; Phenotype =Emb,Gro,Pvl,Stp,Unc
  Coding regions on vcDNA: vcDNA=SeqID_48695; Strand=+; Position=7-1314
ISKMNGSLTNGNKVDRGVTILLGAQWGDEGKGKVMDFLIGHHKIDIDARCQGGNNAGHTVLANGREYHFHLLPSGLASKKVLNIVGNGAGLNLDALFEELESNKIEDSADRLFVSDSAHLVLPVHIATDIMRQNALGQNSKLGTTKRGIGPAYSSKCFRNGIRLGELLHQPEKFEQNYRSLVAHFKTLFPDIELDTESDVKQLKAHAARLLQMGIVCNTTVFLHKKRLEGKSILVEGANGTLLDIDFGTYPFVTSSNSTVGGCITGLGIPPTAVRRVIGVVKAYQTRVGSGPFPTELLDADGQPSEEGKRLQEVGAEIGVTTRRKRRCGWLDLVLLRYSAMINGFTSLAVTKVDILDQFHEIKIAIGYELNGRQIEYPPATVDDWANLCVHYKTFEGWQSPTTSARQWEQLPDKCRAYLEFIQNQLGVPVEYIGVG

SEQ ID NO: 122273 - protein, 307 aa, Heterodera glycines
  Homolog annotation: Hit_ID=CAE59164.1; Match level="QueryCoverage =75%, HitCoverage=35%, E-value=5e-16, Identity=31%"; Hit description =Hypothetical protein CBG02470 [Caenorhabditis briggsae] emb|CAE59162.1| Hypothetical protein CBG02468 [Cae
  Essential gene: C elegans homolog=C25H3.6a; Phenotype=Emb,Lva,Unc
  Coding regions on vcDNA: vcDNA=SeqID_48696; Strand=+; Position=256 -1179
MVAACVATPSVTVTATAATYFNHNQTGFAGTLGGGGGSKKGMEANSNPSKASKGVTMTTAEVDQLRQQLQSVVENGDLTASNVCVEQLESAVLSKDTLEATRIGRFVNDVRKQTAQQWPDFSKRCRALIKQWQKVAEYRPSSSCEGSSNGGTPQLVSPALKRGLTPRAGAVTTPGKRTTPHQPQQQLRVTSTGLCPPDSRQHTGRSSSTLASSVSPVENGVPTASGSYAPLPSTVKKESPRQITATVQQQHSIHKSASVGASLSCLGGSSAAKRTGPMLNGIAEDGGTVSGGAHLASSSFYGTRPFL

SEQ ID NO: 122274 - protein, 405 aa, Heterodera glycines
  Homolog annotation: Hit_ID=CAE62116.1; Match level="QueryCoverage =76%, HitCoverage=16%, E-value=9e-52, Identity=44%"; Hit description =Hypothetical protein CBG06155 [Caenorhabditis briggsae]
  Gene Ontology: Mol. function=microtubule binding; Cellular component =microtubule cytoskeleton; Biological process=gametogenesis
  Essential gene: C elegans homolog=C10C6.1; Phenotype=Stp
  Coding regions on vcDNA: vcDNA=SeqID_48697; Strand=+; Position=2-1216
GIVPFMGDTPEALFANIINEDVEYPEGDEALDSDAESLIHLLLEKNPLDRLGTVGGAPQVSAHPFFAPLDFDTILRQKAEFVPQLENDEDTSYFDSRSDRYNHDANESAEDDDAAAVPMFWSFSTASPRHSIVGLELPAGGMAMLQAAHAAAIERSGQPLQQQDRIVDDDRVESRRRLLSSATTASSGIGSGPNSAFGPLSSTLLTRGGNCSDSQDSSHESAVGRRATAAASEFACDVMPSAVILRRRFSNQRHHTNDSSTSSSAGTTIGTTAGGGVGSSTDDSSSLDIATTMHLEQPRRSQGQLPRLAISPCGTTFNSSTGGAIVTHQRESACGTGGEFLSPVNERHITAGGGSGGMKRMEKRPSAVVHELITDVVRVSSSYGQSLARQSRSSSCRVSNMSPGA

SEQ ID NO: 122275 - protein, 269 aa, Heterodera glycines
  Homolog annotation: Hit_ID=NP_491588.1; Match level="QueryCoverage =55%, HitCoverage=37%, E-value=2e-34, Identity=53%"; Hit description =trans-prenyltransferase (43.0 kD) (1F982) [Caenorhabditis elegans] gb|AAB37678.2| Coenzyme q (ubiquinone)
  Gene Ontology: Mol. function=trans-hexaprenyltranstransferase activity; Cellular component=mitochondrion; Biological process=lipid metabolism
  Essential gene: C elegans homolog=C24A11.9; Phenotype=Age,Unclassified
  Coding regions on vcDNA: vcDNA=SeqID_48698; Strand=+; Position=142-948
MFVVVRCCLFPPAVRRSVLPMSANANGSQSHHFHCRPLTLFALGNNSSRKRRQKAEHSAAGSPQSLTDCSSAMGVELPPTITERLSTLKKDVIDALLDKNAVPPELITSLMAGVGGSAFSKALELVPSYNQNLQKMAKYYFTAKGGKLIRPTVSLLMSAACNQCAKRPTTPADTAPGRTPTSIVNESEEQPIEISMNQYRIAMVAEMIHNATLVHDDVIDESNTRRGQPTANARWGNKQAVLVGDFILARATKVLCSIGEPPVIETMAE

SEQ ID NO: 122276 - protein, 322 aa, Heterodera glycines
  misc_feature (75)..(75): Xaa can be any naturally occurring amino acid
  Homolog annotation: Hit_ID=CAE73363.1; Match level="QueryCoverage =100%, HitCoverage=59%, E-value=1e-101, Identity=49%"; Hit description=Hypothetical protein CBG20797 [Caenorhabditis briggsae]
  Gene Ontology: Mol. function=helicase activity; Biological process =growth
  Essential gene: C elegans homolog=Y48C3A.7; Phenotype=Lpd
  Coding regions on vcDNA: vcDNA=SeqID_48699; Strand=+; Position=1-967
NRLEVLDASLRRAGRFDREIALGMPDQRARMEILKIVTRHMKLDVDVDLAVLARLSPGYVGADLLALVQESNSKXSVVRALCSVVDANVNTENIVENFPPKNIDDIRGELTRTLNWLNTPFAEHQKRLNMDEFRVRMSDFEWALRVVKPSAKREGFATVPDVRWEDIGALNAVREELKWSILYPIQKPELFQHFGTSAQPQGILLSGPPGCGKTLLAKAVANETGMSFISVKGPELLSMYVGESERAVRTVFQRARDSAPCVVFFDEIDALCPKRSQRENSGSSRLVNQLLTEMDGLDGRRNVFLIGATNRPDIVDPAITRP

SEQ ID NO: 122277 - protein, 188 aa, Heterodera glycines
  Homolog annotation: Hit_ID=NP_501757.1; Match level="QueryCoverage =98%, HitCoverage=18%, E-value=2e-67, Identity=67%"; Hit description =DEAD/DEAH box helicase and helicase, C-terminal (116.4 kD) (4K593) [Caenorhabditis elegans] emb|CAA94235.
  Gene Ontology: Mol. function=ATP dependent RNA helicase activity; Cellular component=nucleolus; Biological process=RNA localization
  Essential gene: C elegans homolog=W08D2.7; Phenotype=Emb,Lva,Unc
  Coding regions on vcDNA: vcDNA=SeqID_48700; Strand=+; Position=251-814
AGDEEENQFIQNCQRIRSYQVASEKNCNHEAIVPYDVEYQQLKKTNTPAKLYEFKLDMFQSQALKCLDNQQSVLVSAHTSAGKTVVALYAIAMALRDKQRVIYTSPIKALSNQKYRELVEEFEDVGLVTGDVTLNPNASCVVMTTEILRSMLYRGCEIVREVGWVIFDEIHYMRDKERGVVWEETLIL

SEQ ID NO: 122278 - protein, 211 aa, Heterodera glycines
  Homolog annotation: Hit_ID=CAE59841.1; Match level="QueryCoverage =93%, HitCoverage=57%, E-value=8e-56, Identity=56%"; Hit description =Hypothetical protein CBG03313 [Caenorhabditis briggsae]
  Gene Ontology: Mol. function=ubiquitin-specific protease activity; Cellular component=endoplasmic reticulum; Biological process =skeletal development
  Essential gene: C elegans homolog=F19B6.2a; Phenotype=Emb,Lva,Lvl,Unc
  Coding regions on vcDNA: vcDNA=SeqID_48701; Strand=+; Position=12-644
MFDFHQFMGLGGGAVATYSVQLRAFSAPFFQRHDERRINELNYGGKILLPNSCLDNLMRRNIQYPMLFKLTNVGPALQRGTHAGVLEFLAEEGRCYLPSWMMAQLALREGDLITVEYKALPNATYAKFKPMSTDFYNISNPRAMLEVELRKFSCLTKGDVIAVQYNEQVYEFQVKALKPENAVTIVECDINIEFDAAEGYVEPNRTHQQRN

SEQ ID NO: 122279 - protein, 233 aa, Heterodera glycines
  Homolog annotation: Hit_ID=NP_499675.1; Match level="QueryCoverage =65%, HitCoverage=40%, E-value=2e-11, Identity=36%"; Hit description =human Mortality factor-Related Gene related (38.3 kD) (mrg-1) [Caenorhabditis elegans] emb|CAA21528.1| Hy
  Essential gene: C elegans homolog=Y37D8A.9; Phenotype=Fgc
  Coding regions on vcDNA: vcDNA=SeqID_48702; Strand=+; Position=18-716
MPSRNLSAKKKQQNSLVRDESTSSPSRTPKSVSKASNSNSSQQKLQKKQNSSELSTISSESVEKDLSSSMSTNPHGHPTDKKWTIGEKVLCRYLNSEHIYYEAKVMFLKDLSGGDVGYGIHYPGWSNRHDEVVPQHEALIRFKNYSDEEATKAKEDVKRAQQMLNAKKRKRSELKNRSQAHDESSRSSTPGSADNASKRKIARRTTIETSAVAKKDMPQVTLTDPLRRILIDD

SEQ ID NO: 122280 - protein, 212 aa, Heterodera glycines
  Homolog annotation: Hit_ID=NP_492476.1; Match level="QueryCoverage =94%, HitCoverage=17%, E-value=1e-88, Identity=76%"; Hit description =RNA polymerase (1J858) [Caenorhabditis elegans] emb|CAA99827.1| Hypothetical protein F14B4.3 [Caenorhabdi
  Gene Ontology: Mol. function=protein binding; Cellular component =nucleolus; Biological process=growth
  Essential gene: C elegans homolog=F14B4.3; Phenotype=Lva,Lvl
  Coding regions on vcDNA: vcDNA=SeqID_48703; Strand=+; Position=1-636
HDDRVPAFTELTLIRHSPDSENIQMQFAAFFIYSGLGRLMRPVRNLLFDQIEQIGIFEQVYLSIIIDPEEAEPGVTMHQELHPSSLFSFAGNLIPFPDHNQSPRNVYQCQMGKQTMGVPVHAWQTRTDNKMYKLQTAQKPLLKLEAHDKYEMDEYPLGTNACVAVISYTGYDMEDAMVINKASYQRGFAHGTVVKVQRISLVDRSTGGFGQN

SEQ ID NO: 122281 - protein, 213 aa, Heterodera glycines
  Homolog annotation: Hit_ID=NP_741143.1; Match level="QueryCoverage =88%, HitCoverage=50%, E-value=4e-62, Identity=60%"; Hit description =3-hydroxyisobutyryl-Coenzyme A hydrolase (42.7 kD) (3G645) [Caenorhabditis elegans] gb|AAA50696.1| Hypoth
  Gene Ontology: Mol. function=3-hydroxyisobutyryl-CoA hydrolase activity; Biological process=embryogenesis and morphogenesis
  Essential gene: C elegans homolog=F09F7.4a; Phenotype=Emb
  Coding regions on vcDNA: vcDNA=SeqID_48704; Strand=+; Position=2-640
FLGLSSRNVFPQSVRPSSLFACHFSSGTNDDVLFERVNQKLVITLNRPKALNALNFPMIRKIYPQLRNSSFDLALVKGTGGLAFCAGGDVLAVSKSYKANDPDRIFQQFFLQEYQLNHLIGSLSRPYVAFIDGITMGGGCGLSLHGAFRAATERTILAMPETALGLFPDVGGTYFLPRLSGQLGMFLALTGFRLHGADVFHAGLATHYVESAK

SEQ ID NO: 122282 - protein, 298 aa, Heterodera glycines
  misc_feature (232)..(232): Xaa can be any naturally occurring amino acid
  Homolog annotation: Hit_ID=CAE72630.1; Match level="QueryCoverage =100%, HitCoverage=61%, E-value=1e-109, Identity=62%"; Hit description=Hypothetical protein CBG19828 [Caenorhabditis briggsae]
  Gene Ontology: Biological process=embryogenesis and morphogenesis
  Essential gene: C elegans homolog=H04M03.4; Phenotype=Unclassified
  Coding regions on vcDNA: vcDNA=SeqID_48705; Strand=+; Position=3-897
QFAVPLFPDAVKKQCLKELKQRYENKEIKSPPENFEEWVLHHFGPQILDVFFNPYSKKVWTVKPSKMSPIWVGTRVAKLPQEKLEELCSMDANVLKNADFGWGPNAQFNFPKYGGTGAVWKNMTEKLPSEWFKYNSKVLRVDHRQKCVHYVQLNANGQPTGPTKSLKYDALINSSPIDAFVADNKICEMPLLEHNKVFVIGVGLKLPMTEFCEKYTWLYFPDPDVPFYRVTXSRYGEVTPDNTKFWSVLCECARPSDDTMTEAEIRQWAIEGLITKSIIKREQIINEYSICLPYGYPI

SEQ ID NO: 122283 - protein, 211 aa, Heterodera glycines
  Homolog annotation: Hit_ID=NP_501798.1; Match level="QueryCoverage =84%, HitCoverage=44%, E-value=2e-46, Identity=51%"; Hit description =novel nuclear protein 1 (45.9 kD) (4K746) [Caenorhabditis elegans] emb|CAA93111.1| Hypothetical protein C
  Gene Ontology: Cellular component=nucleus; Biological process=rRNA processing
  Essential gene: C elegans homolog=C47E12.7; Phenotype=Lva
  Coding regions on vcDNA: vcDNA=SeqID_48706; Strand=+; Position=82-714
MMDEDMEEVEIVFAQRLASGEPTARQRAMKHLRTHIRERTKTDAKGFSSVSLARLCKGLHYALWMQDKMTLQEELADEICALCNYFRTDEQLLEFVVVLFTTLSKEWPYIDRWRMDKFLMLVRRLVRTLFRRLSSHRWDPPLCDQFLQMFCSSLLSANSPLCESLKFHCASVWLDELDTAATAKVTPSEGNAGKNCEAFPLDAQRSLDFVW

SEQ ID NO: 122284 - protein, 229 aa, Heterodera glycines
  Homolog annotation: Hit_ID=XP_392738.1; Match level="QueryCoverage =100%, HitCoverage=19%, E-value=4e-59, Identity=48%"; Hit description= similar to ENSANGP00000006566 [Apis mellifera]
  Essential gene: C elegans homolog=D2021.1; Phenotype=Gro,Pvl,Sma,Unc
  Coding regions on vcDNA: vcDNA=SeqID_48707; Strand=+; Position=12-698
MGESTWAIRSSKPWSTISRYGQYQAESFRHSLKEETEKLRQANPKLFQQQTPSTSDTPPVDCASPAPSKKRKTAASMAAGSGTPTSRGRVEESSPYKIIKFGTNIDLSDERKFYVQLKELNKLPAFCRLHSASNMLSYLGHTVFGMNTVQLYLKVPGCRTPGHLENNSFASVNVNIGPGECEWFGVPYEYWPVLENLCKERNIDFLRGAWWPSVSDLVKSDVPFYRFTQ

SEQ ID NO: 122285 - protein, 437 aa, Heterodera glycines
  Homolog annotation: Hit_ID=NP_492906.1; Match level="QueryCoverage =85%, HitCoverage=85%, E-value=1e-109, Identity=51%"; Hit description= Cyclin-Dependent Kinase (cdk-9) [Caenorhabditis elegans] emb|CAB07238.2| Hypothetical protein H25P06.2b
  Gene Ontology: Mol. function=[RNA-polymerase]-subunit kinase activity; Cellular component=transcription elongation factor complex; Biological process=RNA elongation from Pol II promoter
  Essential gene: C elegans homolog=H25P06.2a; Phenotype=Emb,Gro,Unc
  Coding regions on vcDNA: vcDNA=SeqID_48708; Strand=+; Position=336 -1690
MLEMNGVGNSKDYDTKVKAILEQCRISQKLLNYTEHFNYPYVSEVTYYEQLLKIGQGTFGEVFKARCKRTGKLVALKKILMENEKEGFPITALREIKMLQRLRHQHITELVEVCTSKQKSGKEKFCFYLVFTFCEHDLAGLLSNTQVKIRLVDIKTMMQHILRGLHKIHSSQILHRDMKAANVLITGDGVLKLADFGLARIMYKQPEHCYTNRVVTLWYRPPELLLGTRNYGPAIDIWGAGCIMAELWIRAPILQGNTEQSQLELISKLCGSINPHSWPGVCWRLAFPKKPNPPKGQNLPRRVRERINPFLQNNEQALSLIDFMLTLNPEKRPSASAALDHNFFFETPIPAINIQELLQQLRGTNLFEYTSGCGAHANRRRPVAPAAPMHQQQIRGKMPSVGGAMHRATGGAPQRAQHQTVGGPPNIHRSTGGAPQR

SEQ ID NO: 122286 - protein, 271 aa, Heterodera glycines
  Homolog annotation: Hit_ID=NP_508269.1; Match level="QueryCoverage =99%, HitCoverage=40%, E-value=3e-32, Identity=30%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
  Coding regions on vcDNA: vcDNA=SeqID_48709; Strand=+; Position=1-813
INMIGATWIKNLKITAQGREIYDSNSLYAYKAYLDAELSYSKNVKESDLQASGYYVDSENQDGTDITQQGFELRRKLFSQSQTAQFITKLDADIFNQDRYMVNGVEIDIQLTPNDNEFMVMAAADDKYRIEITACKLYVKTLEVVDGLALDIQKKLESKEAKYAHRKTLIKSTFISENRTEYNGTLFTGQLPKRVILGMVENAAYVGNQKKSPFNFKPFDIRSVTLIANGKQWPAAPFELNFNKNLYTRAFHEMNEALGMASSTDSNGISL

SEQ ID NO: 122287 - protein, 212 aa, Heterodera glycines
  Homolog annotation: Hit_ID=NP_497675.1; Match level="QueryCoverage =83%, HitCoverage=41%, E-value=7e-55, Identity=62%"; Hit description =nadh dehydrogenase (48.3 kD) (3E332) [Caenorhabditis elegans] gb|AAF59528.2| Hypothetical protein Y53G8AL
  Gene Ontology: Mol. function=NADH dehydrogenase (ubiquinone) activity; Cellular component=mitochondrial matrix; Biological process=sodium ion transport
  Essential gene: C elegans homolog=Y53G8AL.2; Phenotype=Emb,Lva
  Coding regions on vcDNA: vcDNA=SeqID_48710; Strand=+; Position=7-642
MIISSKAVQLLTCYRNRITRKLQYSTTENVPVNVPEPVISSSNMAQFRKGAGGRSSFSGNVITVFGNTGFTGRRVVNRLARHANQLILPYRCDSYFLRELKVPCDLGQVLFFPFQLDDDESIRKAVKYSNVVINMIGTYVDTPNYSIYDANVEGAWRIARICREMGVERLIHVSALNADPSYKTQFIKNGAFLKSKGMAEQAVRAEFPSATI

SEQ ID NO: 122288 - protein, 342 aa, Heterodera glycines
  Homolog annotation: Hit_ID=NP_492650.1; Match level="QueryCoverage =96%, HitCoverage=88%, E-value=1e-114, Identity=59%"; Hit description= polyA+ RNA export protein, Nuclear Pore complex Protein NPP-17 (npp -17) [Caenorhabditis elegans] emb|CAB
  Gene Ontology: Mol. function=RNA binding; Cellular component =cytoskeleton; Biological process=mRNA-nucleus export
  Essential gene: C elegans homolog=F10G8.3; Phenotype=Gro,Pvl,Rup,Stp
  Coding regions on vcDNA: vcDNA=SeqID_48711; Strand=+; Position=1-1026
LFGSSIGTSSPFGSKPSGGLFGAANTAVVQPSTSTTTQQDIEVPQAPDDTVQAMKFNPLVAGSPIFLAAGSWDNTCRIWQVNENGMVEPKAMQNVGAPILSLDWSEDGSKIFIAGADKQAFAWDLGSNQMAVVGTHNEPVRSCHWIATPQYSCLMTGSWDRTLRFWDMRQLPTQNSLATIQLPERVYCSDMVFPLMVVALADRHIKMYKLDGTPSEIQDVESQLKFQSRCIAIFKDKMTGQPNGFALGSTEGRVAIQCLQPKDPKDNFTFKCHRSAELINNYQEIYPVNDVAFHPTHQTLATAGADGKYSFWDKDARTKLKGSDALPMPITKCAIHSGGNIM

SEQ ID NO: 122289 - protein, 238 aa, Heterodera glycines
  Homolog annotation: Hit_ID=AAO85519.1; Match level="QueryCoverage =93%, HitCoverage=71%, E-value=7e-63, Identity=53%"; Hit description =putative serine/threonine phosphatase [Oesophagostomum dentatum] gb|AAO85518.1| putative serine/threonine
  Gene Ontology: Mol. function=protein serine/threonine phosphatase activity; Cellular component=cytoplasm; Biological process=protein amino acid dephosphorylation
  Essential gene: C elegans homolog=W09C3.6; Phenotype=Ste
  Coding regions on vcDNA: vcDNA=SeqID_48712; Strand=+; Position=2-718
HGQFPDLMRIFNCLGTPPEKKYLFLGDYVDRGAQSVETIMLLLCYKVKYPTSIVLLRGNHETSNINATYGFKKELEERYPAHSQALFDSFNDTFAWMPLTGLIGQKILCMHGGISNKIRSIEQLKQLERPMLLPPTDSLHIDLMWADPMEAQGQRPNPRGAGVLFGEDVVIRTCQLLKISCIIRAHQFIQSGFEPMFNQRLITVFSAPAYTGQTNTGAVLEVKTSSHFTTHFFPPQSQ

SEQ ID NO: 122290 - protein, 299 aa, Heterodera glycines
  Homolog annotation: Hit_ID=NP_508588.1; Match level="QueryCoverage =91%, HitCoverage=43%, E-value=4e-82, Identity=55%"; Hit description =chitinase (66.9 kD) (cht-1) [Caenorhabditis elegans] gb|AAA83586.1| Chitinase protein 1 [Caenorhabditis e
  Gene Ontology: Mol. function=extracellular matrix structural constituent; Cellular component=extracellular matrix; Biological process=response to bacteria
  Essential gene: C elegans homolog=C04F6.3; Phenotype=Emb
  Coding regions on vcDNA: vcDNA=SeqID_48713; Strand=+; Position=1-897
KSFIDSAIAFVRKHGFDGIDIVREYPKGGEQKRNFSRFFKELKDAVRKEASSSGRPRLLITAAVAAGTENIDNGYDIPTVGKLLDFVLLMGYDFHGSWEQQTGMNAPLYGRSKDVPEKRLWNVAGAANYWAKKGMPKSKIIIGIPTYGRGWTLSNPQQFRGIEAPAQVAKATKFVKLAGIGSYFEFCEMLANGAQRYVDRETLVPFLVADNDQWFSYDDVESIRNKLSWIRQNSFGGAFVWTLDFDDFNGQCPGSQLGRYPLIRTIAQELGGIQLSQTPVSALSNSPSPSTGAALPAVT

SEQ ID NO: 122291 - protein, 278 aa, Heterodera glycines
  Homolog annotation: Hit_ID=CAB88203.1; Match level="QueryCoverage =100%, HitCoverage=95%, E-value=1e-140, Identity=76%"; Hit description=putative cuticular collagen [Globodera pallida]
  Gene Ontology: Mol. function=structural constituent of cuticle; Cellular component=extracellular; Biological process=cuticle biosynthesis (sensu Nematoda)
  Essential gene: C elegans homolog=C15A11.6; Phenotype=Emb
  Coding regions on vcDNA: vcDNA=SeqID_48714; Strand=+; Position=13-846
MQETHIVLGIASLCSLLAIIATVVTLPSLYSEMNQLNNKVRDGVEAFRVNTDSAWTDLMDVQVVVAPPSKARDNPFNSIFRAKRQLPGHCHCGPPQRPNCPPGPPGPSGPPGQPGQPGGAGLPGQPGAPGQPAPPCPPQNIPCPRCPAGPPGSPGGQGPPGQQGAPGQPGAPAPGGGQGPPGASGPQGQPGQPGRSGTPGQPGQPGNNAVIFNTIPGPRGAPGAPGQPGSPGSQGQPGQPGGQGPPGPSGAPGLPGLSGNSGQPGQPGAPGQPGKDSG

SEQ ID NO: 122292 - protein, 211 aa, Heterodera glycines
  Homolog annotation: Hit_ID=CAE62078.1; Match level="QueryCoverage =100%, HitCoverage=100%, E-value=3e-59, Identity=53%"; Hit description=Hypothetical protein CBG06101 [Caenorhabditis briggsae]
  Essential gene: C elegans homolog=ZK809.3; Phenotype=Emb,Lva
  Coding regions on vcDNA: vcDNA=SeqID_48715; Strand=+; Position=15-650
MGNYYSPPKRVGQNPFTRSGAPPPKLVIRKDKDVPMHRVNDPMSLQLHMADERVRTAGLSKAEREWREKWVHDQSMHPDEPIHVDAVHRQLNPIRVLYRWPMDKLYKHFLRPTFGNYWATIIRVYVPKFFWFFMTFEFFYYVWKYESKSWQKRIGFSTINRPDRYVLVKDHDEETLKLGLTDYSRSDYFDKEFYQRIKTANIDFGPPKRPW

SEQ ID NO: 122293 - protein, 140 aa, Heterodera glycines
  Homolog annotation: Hit_ID=NP_498231.1; Match level="QueryCoverage =100%, HitCoverage=100%, E-value=2e-70, Identity=92%"; Hit description=ribosomal Protein, Large subunit (15.0 kD) (rpl-23) [Caenorhabditis elegans] gb|AAK18857.1| Ribosomal p
  Gene Ontology: Cellular component=cytosolic ribosome (sensu Eukarya); Biological process=protein biosynthesis
  Essential gene: C elegans homolog=B0336.10; Phenotype=Emb,Ste
  Coding regions on vcDNA: vcDNA=SeqID_48716; Strand=+; Position=27-449
MSKRGRGGASGAKFRVSLALPVGAVINCADNTGAKNLFVIAVYGIRGRLNRMPSAAVGDMFVCSVKKGKPELRKKVLQAVVVRQRKQYRRKDGTFIYFEDNAGVIVNNKGEMKGSAITGPVAKECADLWPRIASNASSIA

SEQ ID NO: 122294 - protein, 155 aa, Heterodera glycines
  Homolog annotation: Hit_ID=NP_492761.1; Match level="QueryCoverage =96%, HitCoverage=98%, E-value=4e-62, Identity=75%"; Hit description =nucleoside diphosphate kinase (1L130) [Caenorhabditis elegans] emb|CAB02101.1| Hypothetical protein F25H2
  Gene Ontology: Mol. function=ATP binding; Cellular component=nucleus; Biological process=negative regulation of cell proliferation
  Essential gene: C elegans homolog=F25H2.5; Phenotype=Pvl,Stp
  Coding regions on vcDNA: vcDNA=SeqID_48717; Strand=+; Position=55-522
MSSDKNKERTFIAIKPDGVQRGLVAKIIKQFEQRGYKLVAMKLAKATVPHLEVHYQDLKDKPFFAGLVKYMASGPIVAMVWEGLDVVKQGRVLLGATNPLASAPGTIRGNFCIEMGRNICHGSDSVPSADREIAHWFKPEELVDWESAQNAWVYE

SEQ ID NO: 122295 - protein, 231 aa, Heterodera glycines
  misc_feature (224)..(224): Xaa can be any naturally occurring amino acid
  Homolog annotation: Hit_ID=NP_497835.1; Match level="QueryCoverage =96%, HitCoverage=86%, E-value=9e-49, Identity=44%"; Hit description =i-94 protein (30.9 kD) (3F268) [Caenorhabditis elegans] emb|CAA86740.1| Hypothetical protein C16C10.2 [Ca
  Gene Ontology: Mol. function=structural constituent of ribosome; Cellular component=small nucleolar ribonucleoprotein complex; Biological process=protein biosynthesis
  Essential gene: C elegans homolog=C16C10.2; Phenotype=Lva,Lvl
  Coding regions on vcDNA: vcDNA=SeqID_48718; Strand=+; Position=153-845
MPGNETIRGHLEKRKDWIRRTRDHQEKSADIKKLKRSARERNPDEFHFHMLRSQIGFDGTHRDLETEEEEKSEAQRLLSDVSDINFVQFKLGMERKKIEKLKAVLHFCDETEKPQNKHIIFAEDEEEARNFDPRQYFNTSEQFLARTFNRPIEGDARKSLSVTEKRKLKETEKERRRPYAELCKRMERERELTVVLQKVELKRDLALFKKSELKPKLIKKRDAXEAAIYKW

SEQ ID NO: 122296 - protein, 196 aa, Heterodera glycines
  Homolog annotation: Hit_ID=CAE65024.1; Match level="QueryCoverage =94%, HitCoverage=43%, E-value=8e-57, Identity=56%"; Hit description =Hypothetical protein CBG09862 [Caenorhabditis briggsae]
  Gene Ontology: Mol. function=GTP binding; Cellular component=mRNA cleavage and polyadenylation specificity factor complex; Biological process=mRNA cleavage
  Essential gene: C elegans homolog=F59A2.4; Phenotype=Emb
  Coding regions on vcDNA: vcDNA=SeqID_48719; Strand=+; Position=41-628
MDQNNDQRRAVNEYRLNEDNELRLEVGKEEVILELLEGSAEIFGSQISMHKRYSLPPGFRAAVFTYKGALIEVVGRTDSAYIAQQTPMIIYLNTHAALESMRKSAETQLVADRTSSARGPRLLVAGPTDVGKSTLCRILCNYAVREGRTPLYVDLDIGQGSVSIPGTIGCLYIEKPADIVDGFDRKAAYVHNFGHI

SEQ ID NO: 122297 - protein, 192 aa, Heterodera glycines
  Homolog annotation: Hit_ID=CAE65929.1; Match level="QueryCoverage =44%, HitCoverage=26%, E-value=2e-11, Identity=41%"; Hit description =Hypothetical protein CBG11102 [Caenorhabditis briggsae]
  Gene Ontology: Mol. function=receptor binding; Cellular component =cell junction; Biological process=EGF receptor signaling pathway
  Essential gene: C elegans homolog=Y54G11A.10; Phenotype=Gro
  Coding regions on vcDNA: vcDNA=SeqID_48720; Strand=+; Position=11-589
MASKIVPIAVSPSFNFLRRPLPSLVFRRSLFKSPLDAPFCGIYRTNGGICRTDDILVCQRKMDYHLGANVRHQRGRNQHLLKANCDGTVVITRGKTFEEFKQEYERESVSRRAAFTRGTIFTVLFYPGIFVGILAVISVMSHRWYTYHGTGRELRPVSNAFVRFVAAFFGCYSYFPYNTDPDPEPIAVVEKE

SEQ ID NO: 122298 - protein, 214 aa, Heterodera glycines
  Homolog annotation: Hit_ID=CAE70883.1; Match level="QueryCoverage =81%, HitCoverage=55%, E-value=3e-13, Identity=31%"; Hit description =Hypothetical protein CBG17673 [Caenorhabditis briggsae]
  Essential gene: C elegans homolog=C33H5.10; Phenotype=Gro,Stp
  Coding regions on vcDNA: vcDNA=SeqID_48721; Strand=+; Position=17-658
MEVDHQSLDSICENILSISRHLDLPLADNLDNAHLSLFKTKLTEFAKESKKQKAIPSLLLPSNLSLNDNEWAKFGQYVDLMNADYAERALLLKRRAEVTIDSFLWSDRVKQIEDKIRQVLEVGGFTNVHFDPVHADDVLAANLDLLYVTKTSDAQLRRGKRTFVTDHRVKADIVPDRGGRTEQMQPMQRETFHQQETQRQQQQQFRGGGAGAGR

SEQ ID NO: 122299 - protein, 340 aa, Heterodera glycines
  Homolog annotation: Hit_ID=CAE65161.1; Match level="QueryCoverage =93%, HitCoverage=80%, E-value=4e-68, Identity=40%"; Hit description =Hypothetical protein CBG10030 [Caenorhabditis briggsae]
  Gene Ontology: Mol. function=DNA primase activity; Cellular component= alpha DNA polymerase:primase complex; Biological process =embryogenesis and morphogenesis
  Essential gene: C elegans homolog=F58A4.4; Phenotype=Emb
  Coding regions on vcDNA: vcDNA=SeqID_48722; Strand=+; Position=1-1023
GELHQQKLLYKIDLGAVYNRPPCDRKNIGEFFPVERELVFDIDLNDYDTIRQCCKDKSVCKKCWRWIIIAVDVLEHLLRTHFGFQHLLWVFSGRRGIHCWVADKKARALSSRGREAITKYLTFNKDGSAINKYRVHPFVTESYRKIMESDDFEQLIMEQGWLDSADQWNSTILAHWADKNLAELLDKSFSRLQTPKLRWESMKLRFDDATRINARGIKLPPTPSDEARRFFISLVMKFAYPQLDAKVTAGLNHLLKSPFSVHPENGNIAVPLSAKEIRAFDPNVVPRIDKLLAQLASLRESSQENKENQRSIVYRQTSLAPHIAVFEQWTAQILNSEAQK

SEQ ID NO: 122300 - protein, 350 aa, Heterodera glycines
  Homolog annotation: Hit_ID=CAE70179.1; Match level="QueryCoverage =84%, HitCoverage=74%, E-value=1e-47, Identity=35%"; Hit description =Hypothetical protein CBG16652 [Caenorhabditis briggsae]
  Essential gene: C elegans homolog=F09G8.3; Phenotype=Lva
  Coding regions on vcDNA: vcDNA=SeqID_48723; Strand=+; Position=16-1065
MLCFLRSANGCSSVGFSSSVCSRFAFPRLCVLASLSNESGLSECLPQSVESVSASAAAIRERERRERLLTISDAMKFYLERKQDEMAILEKEKLLYAQGKRHLANIMGFDPDSISGDQISQSIRYLFPSGLFDKKALPVMKPPEEVFPKIVKIDVDASGSPKHSLFFTAKPKFYSLLSDINKRTQKLVNAFDGHQTKVNEVEKMQTMELALLGEKPAEKGQINLMGTQWVTKDQLQQQMQEILSDDEYANFIIALEYISQLPNSAEEEDFIMSLRRGIGASEKNRLFRAKVPEVTINEDGRRECWRICKTRASAVKIVVRDGGTGLFTVNGQHYCTFRSLLARECLLAPM

SEQ ID NO: 122301 - protein, 285 aa, Heterodera glycines
  misc_feature (208)..(208): Xaa can be any naturally occurring amino acid
  Homolog annotation: Hit_ID=NP_492006.1; Match level="QueryCoverage =100%, HitCoverage=51%, E-value=1e-117, Identity=71%"; Hit description=asparagiNyl tRNA Synthetase (61.2 kD) (nrs-1) [Caenorhabditis elegans] emb|CAA95808.1| Hypothetical pro
  Gene Ontology: Mol. function=ATP binding; Cellular component =cytoplasm; Biological process=protein biosynthesis
  Essential gene: C elegans homolog=F22D6.3a; Phenotype=Emb,Lva
  Coding regions on vcDNA: vcDNA=SeqID_48724; Strand=+; Position=3-903
PPTLVQTQVEGGSTLFSLNFFGESAFLTQSSQLYLETCIASLGDCYCISQSYRAEKSRTRRHLAEYSHVEAEFPFITFEDLMVRIEEMTCDTVNRVMADPEIRELIQQQWQKDSQYEFVAPKRPFLRMTYAEAIEWLQNNEVMNEEGKPFQFGEDIPEGPERFMTDTIGQPILLNRFPHGIKAFYMSRCADQPELTESVDLLMPGVVXIVGGSMRIWKEDELLGAFQKADIDPKPYYWYVDQRKYGGCPHGGFGLGLERFVCWLANQHHIRDVCLFPRNIGRCAP

SEQ ID NO: 122302 - protein, 72 aa, Heterodera glycines
  Homolog annotation: Hit_ID=CAE73689.1; Match level="QueryCoverage =97%, HitCoverage=93%, E-value=8e-18, Identity=58%"; Hit description =Hypothetical protein CBG21200 [Caenorhabditis briggsae]
  Essential gene: C elegans homolog=T27E9.2; Phenotype=Gro
  Coding regions on vcDNA: vcDNA=SeqID_48725; Strand=+; Position=33-251
MPKEEVPEGVDQLTYFREQCEHKVAHLKSILEECNERVRSKPKTTEICHMEMIDYVEGLDHCAKPKAFKALK

SEQ ID NO: 122303 - protein, 106 aa, Heterodera glycines
  Homolog annotation: Hit_ID=CAB58173.1; Match level="QueryCoverage =100%, HitCoverage=33%, E-value=3e-27, Identity=54%"; Hit description= putative nucleosome binding protein [Anisakis simplex]
  Gene Ontology: Mol. function=chaperone activity; Cellular component =chromatin assembly complex; Biological process=nucleosome assembly
  Essential gene: C elegans homolog=D2096.8; Phenotype =Gro,Pvl,Rup,Stp,Unc
  Coding regions on vcDNA: vcDNA=SeqID_48726; Strand=+; Position=1-321
VTQKIVKKKQKKGAQAGKYVTKTVTNESFFNFFDPKVTTITEEMDDIEEQKTNDDFEVGQIIREQLIPRAVLFFTGEAAEEDEYDEFDDEEEMGDEQSEEEDNAMH

SEQ ID NO: 122304 - protein, 287 aa, Heterodera glycines
  Homolog annotation: Hit_ID=CAA65506.1; Match level="QueryCoverage =99%, HitCoverage=98%, E-value=2e-92, Identity=57%"; Hit description =cuticular collagen [Teladorsagia circumcincta]
  Gene Ontology: Mol. function=structural constituent of cuticle; Cellular component=extracellular; Biological process=cuticle biosynthesis (sensu Nematoda)
  Essential gene: C elegans homolog=T07H6.3a; Phenotype=Bmd,Gro,Unc
  Coding regions on vcDNA: vcDNA=SeqID_48727; Strand=+; Position=3-866
DFDKHAAQREAESLRTLAFFGVCLSTVATVIAVLSVPFAYQHFQQIGAQMQNEVDFCKMRSGNMWREVTRTQAYSKVSHDSRHKRQAGGCCGCGVSPPGPPGPPGPSGQPGGDGQPGGSGQPGAPGQAAPRPYPPSGGCVPQCEAAQPGLPGPPGPPGPEGQNGQPGQSAPPASPGRPGPQGPPGPDGQPGNPGESGQPGQPGKLTQGPPVVGPPGPSGPPGQPGQPGENGQPGQPGNPGPQGYPGDGGSPGQPGNPGGSGEPGQPGAQGSSGQCYHCPPPRTAPGY

SEQ ID NO: 122305 - protein, 214 aa, Heterodera glycines
  Homolog annotation: Hit_ID=NP_509206.1; Match level="QueryCoverage =96%, HitCoverage=24%, E-value=3e-21, Identity=32%"; Hit description =protruding VuLva PVL-1, Suppressor of PolyraY SPY-1, Beta -catenin/Armadillo Related, associates to cadher
  Gene Ontology: Mol. function=transcription co-activator activity; Cellular component=cell-cell adherens junction; Biological process =Wnt receptor signaling pathway
  Essential gene: C elegans homolog=C54D1.6; Phenotype=Egl,Pvl,Rup,Unc
  Coding regions on vcDNA: vcDNA=SeqID_48728; Strand=+; Position=4-645
MLSWLEDKNEKFLNIVTDIMQKVITKNSEQMTFFIGMNGHQKLVGLIANCRQEALLWRVTKLMDKIVQMDAERMVGAGLLEALQRHLDHPSQRLLRQVLSCVRSVSHVPTADRTVQPLLQKLLQLLGTSDIRLKENCVDILANLCANNSQNKSFLVENGAVPSMFQLLYELDSVRSGGGEQPTGDDPFQRQLEGIQETALTLLKSLCSGQNDDA

SEQ ID NO: 122306 - protein, 202 aa, Heterodera glycines
  Homolog annotation: Hit_ID=CAE57635.1; Match level="QueryCoverage =88%, HitCoverage=32%, E-value=1e-35, Identity=46%"; Hit description =Hypothetical protein CBG00620 [Caenorhabditis briggsae]
  Gene Ontology: Mol. function=microtubule binding; Cellular component =spindle pole; Biological process=meiotic spindle assembly
  Essential gene: C elegans homolog=F22B5.7; Phenotype=Emb
  Coding regions on vcDNA: vcDNA=SeqID_48729; Strand=+; Position=24-629
MRRFDNRSSGGRFAKISANKRGCALNRVDISKLNINFESPKWQERKEALDALQQLLLQSPRLADLPNYRELIGRLTKIMANDANIFVAASATKCVMLFAKGLRAEFTPHVSLVVPVIFDKFKVEKRLLRDALVECIDVIAAYTSFDHLSKALLEAMTSKQNPSQKSQTDLFIYRLFRSLPAKDVPKGLLKDLVAILSKHGFD

SEQ ID NO: 122307 - protein, 183 aa, Heterodera glycines
  Homolog annotation: Hit_ID=CAE70382.1; Match level="QueryCoverage =53%, HitCoverage=76%, E-value=4e-17, Identity=46%"; Hit description =Hypothetical protein CBG16943 [Caenorhabditis briggsae]
  Essential gene: C elegans homolog=F25H5.6; Phenotype=Gro,Unclassified
  Coding regions on vcDNA: vcDNA=SeqID_48730; Strand=+; Position=64-612
MLCSLRGVLPNFFKRHLSVAIQKNIPEEHDEGFVDVANTEILCKYVFINYQFGAEGPGPKIQHNSEYPAWLFTLDLEPSKELEDLDPENSGWKYWEKWEERRQQQMLRHDELKYKYFWLQNSPAVQTHMRFTTEKYKTHKFLTIPVTTPGVYLKHTRRLRLKQRVWKSLEESEQMMKENDGWG

SEQ ID NO: 122308 - protein, 216 aa, Heterodera glycines
  Homolog annotation: Hit_ID=NP_501283.1; Match level="QueryCoverage =99%, HitCoverage=32%, E-value=2e-39, Identity=44%"; Hit description =component of rsec6 8 secretory complex p71 (4I544) [Caenorhabditis elegans] gb|AAA82266.1| Hypothetical p
  Gene Ontology: Cellular component=exocyst; Biological process =synaptic vesicle docking
  Essential gene: C elegans homolog=C33H5.9; Phenotype =Gro,Rup,Sma,Stp,Unc
  Coding regions on vcDNA: vcDNA=SeqID_48731; Strand=+; Position=3-650
NPEQYLANLHELYLKTHKLLGLLQEKFRTNSLDPQFLPTLTQSVFGPYLVTYAKIEHKFIADKCTFTLRKFYESKGHQKRSILSSGLQELKSRLLTAEDFGGETFLSEIIAINILQEFKNAFARCSSLCKKTESLELNTVLFDMLLKFLYTEHVEYAIELGLACIPLSEPRIEPSPNFFKVIQQKSAITHLFAKLFDDTIHPGKRDTQIEGRIASK

SEQ ID NO: 122309 - protein, 199 aa, Heterodera glycines
  Homolog annotation: Hit_ID=NP_510300.1; Match level="QueryCoverage =98%, HitCoverage=58%, E-value=3e-46, Identity=47%"; Hit description =nervous system antigen like (35.7 kD) (XO384) [Caenorhabditis elegans] emb|CAB04477.1| Hypothetical prote
  Gene Ontology: Mol. function=sodium/potassium-exchanging ATPase activity; Cellular component=sodium/potassium-exchanging ATPase complex; Biological process=transport
  Essential gene: C elegans homolog=C17E4.9; Phenotype =Bmd,Emb,Gro,Sma,Unc
  Coding regions on vcDNA: vcDNA=SeqID_48732; Strand=+; Position=24-620
MTKTDNGKFTEKNNTLMANGRTKPSEKTSLSTCIYNKQDGTFLGRSAKSWAQIIGFYIVFYIFLALFWLGCLWTFLNTNDDFIPRYHGENTIIGANPGVGYQPWLASNPESTLIKFYENDTSSYKDYLNAIDTFLEKYHNTENTRFCDENGIDSNSQHVKDGKVSSLNDVKACRFELGFLDDNGCGKKDDYGFNKGQPC

SEQ ID NO: 122310 - protein, 166 aa, Heterodera glycines
  Homolog annotation: Hit_ID=NP_507636.1; Match level="QueryCoverage =49%, HitCoverage=20%, E-value=3e-24, Identity=58%"; Hit description =nuclear Hormone Receptor (43.9 kD) (nhr-70) [Caenorhabditis elegans] emb|CAB11571.1| Hypothetical protein
  Gene Ontology: Mol. function=transcriptional activator activity; Cellular component=transcription factor complex; Biological process =gametogenesis
  Essential gene: C elegans homolog=Y40B10A.8; Phenotype=Emb
  Coding regions on vcDNA: vcDNA=SeqID_48733; Strand=+; Position=128-625
MPSPSLVPISATADTANASPAADDNCCAVCADDAHGVHFGVQVCRACAAFFRRSTIAARVYRCRYDGNCDIAQREVRCVCRACRLAKCLALGMDPDAVQRHRDQIGPRQNKTKLENEKRRTEDGGRKCQRHSPPTTDSMCQQHFESTNAEGTRPNNFMRETEQQQN

SEQ ID NO: 122311 - protein, 302 aa, Heterodera glycines
  misc_feature (147)..(147): Xaa can be any naturally occurring amino acid
  Homolog annotation: Hit_ID=CAE65943.1; Match level="QueryCoverage =99%, HitCoverage=50%, E-value=1e-116, Identity=64%"; Hit description= Hypothetical protein CBG11120 [Caenorhabditis briggsae]
  Gene Ontology: Biological process=reproduction
  Essential gene: C elegans homolog=C34C6.4; Phenotype=Ste
  Coding regions on vcDNA: vcDNA=SeqID_48734; Strand=+; Position=2-905
LHQAFLESGRQHWIGVTEDMNGYRQEGLGKMDMTIKDGRRWSASSAYLTNILDRPNLFTTAGVTCTSVLFNNHRAIGIEFIRYHRFMLTEEVDAYSREKIYCEDSVILCAGAINTPQLLMLSGVGPASHLKVHQIPVVQDMPGVGQXNLQDHLELYVQQKCTKPITLYNKSTWRHPHRMVINGLQWFLTKKGLAATSHLESGGFARSSTEIDHPDLQFHFLPSTVHEDGRQSPNCHAFQVHVGPMRTKSAGEITLQSKDPRTSPLMNPNYLSHENDFVEFRKAVRLSRELFAQKAFDEFRGE

SEQ ID NO: 122312 - protein, 123 aa, Heterodera glycines
  Homolog annotation: Hit_ID=NP_997676.1; Match level="QueryCoverage =100%, HitCoverage=100%, E-value=3e-39, Identity=67%"; Hit description=similar to 60S RIBOSOMAL PROTEIN L35 [Rattus norvegicus] gb|AAH86116.1| Unknown (protein for MGC:98516)
  Gene Ontology: Mol. function=structural constituent of ribosome; Cellular component=cytosolic large ribosomal subunit (sensu Eukarya); Biological process=protein biosynthesis
  Essential gene: C elegans homolog=ZK652.4; Phenotype=Emb,Ste
  Coding regions on vcDNA: vcDNA=SeqID_48735; Strand=+; Position=32-403
MTRVKTHELRAKKKEELMKMLEEQKTELASLQVSKVTNGAVSKLSNIHVVRKNIARILTVINQAQKMNLLKFYKGKKYRPIDLRFKKTRAMRRELTKHELSLKTHKQKVKERRCPTRIYALKA

SEQ ID NO: 122313 - protein, 206 aa, Heterodera glycines
  Homolog annotation: Hit_ID=CAB88203.1; Match level="QueryCoverage =100%, HitCoverage=87%, E-value=1e-100, Identity=67%"; Hit description=putative cuticular collagen [Globodera pallida]
  Gene Ontology: Mol. function=structural constituent of cuticle; Cellular component=extracellular; Biological process=cuticle biosynthesis (sensu Nematoda)
  Essential gene: C elegans homolog=C15A11.6; Phenotype=Emb
  Coding regions on vcDNA: vcDNA=SeqID_48736; Strand=+; Position=3-620
AIIATVCTIPSLYSQMNEISNKVHDGVEVFRVNTDSAWTDLMDVQVAVAPPSKPRENPFGSIFRAKRQLPGYCQCGPIAQPSCPPGPPGPPGPAGHPGQPGHPGGPGQPGAPGQPSAPCPVQHVACPKCPAGPPGHPGGQGPPGPAGGPGQPGAPAHGGGQGPPGPPGPQGSPGQPGHPGGKGQPGNPGAPGTSSKSIPGPKGPPG

SEQ ID NO: 122314 - protein, 189 aa, Heterodera glycines
  Homolog annotation: Hit_ID=CAE75171.1; Match level="QueryCoverage =94%, HitCoverage=94%, E-value=5e-52, Identity=54%"; Hit description =Hypothetical protein CBG23108 [Caenorhabditis briggsae]
  Essential gene: C elegans homolog=C06H2.1; Phenotype=Emb,Lva
  Coding regions on vcDNA: vcDNA=SeqID_48737; Strand=+; Position=13-582
MAQPAKRVAVSSVNWAKLAERLTPQQEEELNRLKAQNSSYHAEVVQHQADLPKVDWATLKKQMPENSTVLDSLQKQWEALSIPYGTIPDNLKKQIDQWVKFNEARVKFHELKTADGLVEMKKIEDKWAKMPPVEQLWRDQLVQYFPHKYQDLRYLNEYYDPWGIGVNDTNWRERFKDFQSRPREGATLH

SEQ ID NO: 122315 - protein, 208 aa, Heterodera glycines
  misc_feature (194)..(194): Xaa can be any naturally occurring amino acid
  Homolog annotation: Hit_ID=NP_500797.1; Match level="QueryCoverage =99%, HitCoverage=75%, E-value=5e-65, Identity=56%"; Hit description =fatty acid ELOngation (31.7 kD) (elo-6) [Caenorhabditis elegans] gb|AAK29807.1| Fatty acid elongation pro
  Gene Ontology: Mol. function=transferase activity, transferring groups other than amino-acyl groups; Cellular component=integral to endoplasmic reticulum membrane; Biological process=fatty acid elongation
  Essential gene: C elegans homolog=F41H10.8; Phenotype=Gro
  Coding regions on vcDNA: vcDNA=SeqID_48738; Strand=+; Position=1-625
RLWNLWLAMFSIAGCLVTSYALLREIGTYGLVSSYTNCRDFFEGFTGLWTWWFCMSKFAELGDTYFIVLRKKPLMFLHWYHHVATLNYGLMSYVDNTAFNTWIVWLNFSVHAVMYTYYFLAACRIRLPAWFAQCLTTSQITQFLITLAILAHVGVRLLVGSHVDTTPMTYGDCLLMEISYRGLVGNFFYHSYIXGGGKKFQKEKQMKQ

SEQ ID NO: 122316 - protein, 213 aa, Heterodera glycines
  Homolog annotation: Hit_ID=CAE64991.1; Match level="QueryCoverage =98%, HitCoverage=60%, E-value=5e-19, Identity=31%"; Hit description =Hypothetical protein CBG09827 [Caenorhabditis briggsae]
  Gene Ontology: Mol. function=phosphatase regulator activity; Biological process=signal transduction
  Essential gene: C elegans homolog=Y71H2B.3; Phenotype =Reproductive,defect
  Coding regions on vcDNA: vcDNA=SeqID_48739; Strand=+; Position=30-668
MSHSQSEKSLDQQFDCCECVVDDLLKGRLGDSQFAQRNNVLRDCIQSLQSVAKTIDGLSLFSANDSVEELPTNSLRFLLVPAYLATALQEIGVEMDKRGAYLRASKTYYREFLQNMSIFGLVNFRLPWLNEDERNSDDQQKENGRNRSKLISSFDDAKARRQHTISRLQQLEQLEKTVEQLKNEKRRNDDEAAQRELIFALLRFWSIRSVKEL

SEQ ID NO: 122317 - protein, 230 aa, Heterodera glycines
  Homolog annotation: Hit_ID=CAE73721.1; Match level="QueryCoverage =95%, HitCoverage=88%, E-value=1e-68, Identity=55%"; Hit description =Hypothetical protein CBG21240 [Caenorhabditis briggsae]
  Gene Ontology: Mol. function=adenylate kinase activity; Cellular component=mitochondrial intermembrane space; Biological process =purine nucleotide metabolism
  Essential gene: C elegans homolog=C29E4.8; Phenotype=Emb
  Coding regions on vcDNA: vcDNA=SeqID_48740; Strand=+; Position=26-715
MVNWPWSAKQRDEPAQDKQKVVTTHPEPTQGIHGIRTILMGPPGAGKGTQATKLAKKYESCHLSTGDLLRAEIKAGTPLGQKIKGLVEGGDLVSDDIVCEMIDKHLSTAECRNGFILDGFPRNTAQAEKLDALLEKRQRPLQAALELALDDSLLVKRITGRLFHVPSGRSYHEQFNPPKKAMTDDFTGEPLVHREDDNEKVLRKRLADYHSVTMPLIDYYSKRRIHHRID

SEQ ID NO: 122318 - protein, 322 aa, Heterodera glycines
  Homolog annotation: Hit_ID=NP_492779.1; Match level="QueryCoverage =100%, HitCoverage=58%, E-value=1e-133, Identity=74%"; Hit description=RNA helicase (61.3 kD) (1L203) [Caenorhabditis elegans] gb|AAC17654.2| Hypothetical protein B0511.6 [Ca
  Gene Ontology: Mol. function=ATP dependent RNA helicase activity; Cellular component=nucleolus; Biological process=35S primary transcript processing
  Essential gene: C elegans homolog=B0511.6; Phenotype=Lva
  Coding regions on vcDNA: vcDNA=SeqID_48741; Strand=+; Position=3-968
FERMTEIQAKSIPPLLEGKDVLGSAKTGSGKTLAFLIPSIELLLRNGWKQQQGTGVLIVSPTRELSMQTYGVLYELMEKHPNISHGLVMGGANRQNEEKRLAGGVAILVATPGRLLDHLQNTSNFVVRNLKCLIVDEADRIFDIGFEQEMHQIVKLLPKKRQSMLFSATCSPKVDELVKTALKTDPLKIGVMEQQRDPNDMATVEGLEQGYVVCPSEKRFLLLFTFLKKNRNKKIMVFFSSCASVRFHSDLLNFIDLPVMNIHGKLKQQQRTRTFFQFCQASAGTLLCTDVAARGLDIPRVDWIVQYDPPDEPREYIHRVGR

SEQ ID NO: 122319 - protein, 202 aa, Heterodera glycines
  Homolog annotation: Hit_ID=CAA91120.1; Match level="QueryCoverage =100%, HitCoverage=46%, E-value=4e-85, Identity=77%"; Hit description= Hypothetical protein C26D10.2a [Caenorhabditis elegans] pir||T19484 hypothetical protein C26D10.2 - Caeno
  Gene Ontology: Mol. function=ATP dependent RNA helicase activity; Cellular component=nucleus; Biological process=RNA localization
  Essential gene: C elegans homolog=C26D10.2a; Phenotype=Emb
  Coding regions on vcDNA: vcDNA=SeqID_48742; Strand=+; Position=57-662
MDEEQLLDYEEEQEETQEQQSKNDAATNGDATKKIKGNYASIHSSGFRDLMLRPELLRAIIDCGFEHPSEVQHECIPQAILGMDIVCQAKSGMGKTAVFVLATLQQLTPTDGTVSVLVMCHTRELAFQISKEYERFSKYMPGVKVSVFFGGMPIKKDEEVLAKNTPHIVVGTPGRLLALGRTGHLKLKGGKFFVLDECDKMI

SEQ ID NO: 122320 - protein, 385 aa, Heterodera glycines
  misc_feature (162)..(162): Xaa can be any naturally occurring amino acid
  misc_feature (368)..(368): Xaa can be any naturally occurring amino acid
  Homolog annotation: Hit_ID=CAE67141.1; Match level="QueryCoverage =99%, HitCoverage=68%, E-value=1e-128, Identity=60%"; Hit description= Hypothetical protein CBG12564 [Caenorhabditis briggsae]
  Gene Ontology: Mol. function=phenylalanine-tRNA ligase activity; Cellular component=cytoplasm; Biological process=morphogenesis
  Essential gene: C elegans homolog=T08B2.9a; Phenotype=Emb,Lva
  Coding regions on vcDNA: vcDNA=SeqID_48743; Strand=+; Position=2-1155
LAADNFDAQRVLNILAERDNFQSNELADQLSIDHQRLIGGLKSLQVKEGLGCASEVKIKRIQLTAEGEEIIQKGSHEFNVCKIVGEKGISKSEIEKTSFGRIGLGKAMQCGWVGMDTRERVPLVVRKVANGEDGDKERLKLVKNGKGDQLTAQCVAQLRKRXWIMDSAIKALSVAKGANFATTVQKQELDLTSEMIASGSWRGKQFKQYNISAMGVPPPSGHLHPLLKVRAEFRDIFFQMGFSEMPTNRFVESSFWNFDALFQPQQHPARDSHDTFFLSRPALSTEFPEDYLESVRKVHSEGGFGSIGYRYDWKLEEAQKNLLRTHTTAVSARQLYLLAQKPFQPSKMFSIDRVFRNETLDATHLAEXHQVEGVVAERNLSLAHV

SEQ ID NO: 122321 - protein, 336 aa, Heterodera glycines
  Homolog annotation: Hit_ID=NP_498280.1; Match level="QueryCoverage =71%, HitCoverage=95%, E-value=4e-90, Identity=53%"; Hit description =paxillin (3G980) [Caenorhabditis elegans] gb|AAA62294.1| Hypothetical protein C28H8.6a [Caenorhabditis el
  Gene Ontology: Mol. function=protein binding; Cellular component =focal adhesion; Biological process=integrin-mediated signaling pathway
  Essential gene: C elegans homolog=C28H8.6a; Phenotype=Lva
  Coding regions on vcDNA: vcDNA=SeqID_48744; Strand=+; Position=121 -1128
MPSGGDDEQQFEEAVKPALESLLADLQKTTEVLRQGKHGKGRRQQKEDESAALLDLKKLRNSPRQRNQSPAAVANLRNGRSEELQPRRDPMLEGDKLGIHTIPKGDCASCNQAVIGPVVIALGKMWHPEHFCCAHCGDSIENRNFFERQGKAYCESDYHDLFSPRCSYCNGPIKERCVTALGGKNFHVEHFVCAECGKSFGDGGFHEKSNSAYCRDCFYRTYAPKCQSCKQPITHKFITALNTHWHPECFCCQECGQPFHCVSLFDHLGRLLCEMCLHTRVGSICARCRLPISGRCVSAMSQKFHPEHFTCSYCTDQLDKGTFKESAGRPFCLRCY

SEQ ID NO: 122322 - protein, 286 aa, Heterodera glycines
  Homolog annotation: Hit_ID=NP_506254.1; Match level="QueryCoverage =99%, HitCoverage=56%, E-value=5e-66, Identity=43%"; Hit description =putative protein, with a transmembrane domain (5N488) [Caenorhabditis elegans] emb|CAB01420.1| Hypothetic
  Essential gene: C elegans homolog=F15B9.5; Phenotype=Unclassified
  Coding regions on vcDNA: vcDNA=SeqID_48745; Strand=+; Position=3-860
LFLSFVLFFSINFSPSVVAQRTQWDAFNFPNPTAPGDFHRCKMRSTALLCDPDEVLSEQERYRLNYELGLIESATRQENGREFCERKGINAAVAIARQVKGGQEQDVRNMANDLLRRWTLDKQCEKALVIVLSLEDRRFWVARMPRVPVYAQEFTELFKREQGTFKTGRNSEGLQNVIRAIRDRALSKQFPSARPDDDGRSKGTPFVPMPKPTPHPEGKHKQRGGGGVLSWLFILLVIVFVVIPLACCCCCLYFCFFRKKDSGSNNRTPHNAENGGSGAERRGGTG

SEQ ID NO: 122323 - protein, 210 aa, Heterodera glycines
  Homolog annotation: Hit_ID=CAE75168.1; Match level="QueryCoverage =99%, HitCoverage=19%, E-value=4e-21, Identity=32%"; Hit description =Hypothetical protein CBG23105 [Caenorhabditis briggsae]
  Gene Ontology: Mol. function=ubiquitin-specific protease activity; Cellular component=nucleus; Biological process=pathogenesis
  Essential gene: C elegans homolog=H19N07.2a; Phenotype=Gro
  Coding regions on vcDNA: vcDNA=SeqID_48746; Strand=+; Position=3-632
KLTRVCSWLGSELNYDPAKIMLYKNVLHGDKPGMWIPHQQLLELQVSQMLNLNTGSYDPRFQRIFKFFYAKLPLPMVDFDNHAHVLLHLMNEKFQLTEMSIFVDKNASVQTLLDEARKEFRFSSMGTKTLRLVQASADGTFRVYQVLKNDILYKDIQLRPSLMLRVEEIPKDQLEVGTDEYLLPVAHFDREPNRTFGVPFFIKICNGEKV

SEQ ID NO: 122324 - protein, 186 aa, Heterodera glycines
  Homolog annotation: Hit_ID=NP_496755.1; Match level="QueryCoverage =88%, HitCoverage=67%, E-value=5e-12, Identity=28%"; Hit description =putative secreted or extracellular protein precursor (24.4 kD) (2N223) [Caenorhabditis elegans] emb|CAB04
  Essential gene: C elegans homolog=F58G1.4; Phenotype=Gro
  Coding regions on vcDNA: vcDNA=SeqID_48747; Strand=+; Position=3-560
VLRVSDLTKANERVPFRLLNLSLASLDVNMRPFCDSEGHSAVRLPGFLLILSGQMVLSRPLPPLNASSLRLSLTLEQNSVWVGRICDKGRSQSAFLSDDFSTFSLCSLLPDACNSLEALASKYAESDFPLLLPLSDLFPTDQPIALVPMANFPLLEGYWKAQAQIQADDGNAMEEEEDEQNEQHIL

SEQ ID NO: 122325 - protein, 220 aa, Heterodera glycines
  Homolog annotation: Hit_ID=CAE59203.1; Match level="QueryCoverage =93%, HitCoverage=27%, E-value=1e-56, Identity=53%"; Hit description =Hypothetical protein CBG02514 [Caenorhabditis briggsae]
  Gene Ontology: Mol. function=protein binding; Cellular component =mitochondrial membrane; Biological process=mitochondrial fusion
  Essential gene: C elegans homolog=ZK1248.14; Phenotype=Emb,Gro
  Coding regions on vcDNA: vcDNA=SeqID_48748; Strand=+; Position=3-662
ATINHISASNGNDQKRRHLASGNEPLQRFGEAKKWMTDIYGQLDGHVGELLEFYLGLVKNGQKFVPPAQIDEIGHFRDSVRAIREVIGRDKMKVVFFGRTSNGKSSVINAMLSCRVLPQGMGHTTCCFLQVEGGSEQDKYFMMEDGAKHFPIAELDSVGHALGSEGMGSLGRDSLIHIFYPKSASKLLQNDVLIVDSPGVDLSPEFDSWIDKHCLDADVF

SEQ ID NO: 122326 - protein, 208 aa, Heterodera glycines
  Homolog annotation: Hit_ID=CAE62583.1; Match level="QueryCoverage =95%, HitCoverage=74%, E-value=2e-52, Identity=53%"; Hit description =Hypothetical protein CBG06697 [Caenorhabditis briggsae]
  Gene Ontology: Mol. function=protein phosphatase inhibitor activity; Cellular component=cytoplasm; Biological process=energy pathways
  Essential gene: C elegans homolog=F25H9.6; Phenotype=Gro,Stp
  Coding regions on vcDNA: vcDNA=SeqID_48749; Strand=+; Position=16-639
MATLSNTDSEEIPQKRPRENDKKDLTTSAEKNNSANGGSSESAKTTAVSHRAPFDATHRINRLGGKYHVLLAVTGSVASIKVNELIAELYKQSPENRLAIKVVATQSALNFFDAADTQEIVYDDRDEWNMWKKRGDPVLHIELRKWADSMLVAPLDANSLAKIANGICDNLVTSVVRAWDQRKPLYFAPAMNTAMWENPLTYQHLKTL

SEQ ID NO: 122327 - protein, 289 aa, Heterodera glycines
  Homolog annotation: Hit_ID=CAE60157.1; Match level="QueryCoverage =88%, HitCoverage=47%, E-value=1e-47, Identity=39%"; Hit description =Hypothetical protein CBG03709 [Caenorhabditis briggsae]
  Gene Ontology: Biological process=reproduction
  Essential gene: C elegans homolog=T05F1.1; Phenotype=Ste
  Coding regions on vcDNA: vcDNA=SeqID_48750; Strand=+; Position=1-867
AHLNAAERGRPYLFIVAHYDTYGIIPSLGIGSDSNGSGTAVLLELLAILSQIYSLPSHKARYNLVFVLSAGGKFSYQGSRSFIDDFNERHSDERIALAICLDSLARGDSLFVHASKIPSDETKAFRFIQTLRHFANRPVELISKKISLASDRLAWEHEIYNIRRIHAVTISHFSNHSNPFRNSLLDIPTSLDFSMLEDNAKLIANALVSFVFDLDSRLCNNAKENNLACSLLNDAVEVDPKRLKAWVSMFGSKSRPIVVSQHQLVANLFEVVKRLAHSAHVSEIVVNDY

SEQ ID NO: 122328 - protein, 267 aa, Heterodera glycines
  Homolog annotation: Hit_ID=CAE67771.1; Match level="QueryCoverage =97%, HitCoverage=78%, E-value=2e-79, Identity=54%"; Hit description =Hypothetical protein CBG13346 [Caenorhabditis briggsae]
  Gene Ontology: Mol. function=proteasome endopeptidase activity; Cellular component=proteasome regulatory particle (sensu Eukarya); Biological process=protein deubiquitination
  Essential gene: C elegans homolog=C08B11.7; Phenotype=Emb,Lva
  Coding regions on vcDNA: vcDNA=SeqID_48751; Strand=+; Position=43-843
MTNEAGNWCLIESDPGLFTELISGLGVKGTQVEELYSIDDEQHLSSLRPIYGLIFLFKWRPGEELEGTPMPDAPVYFAQQVITNACASQALINLLLNISSSDVQLGPILDHFKSFTVGFDPATRGLTLSNSEDIRKLHNSFTREHFVELDVPKAKAEDNFHFITYVPVDGKIYELDGMREAPICLADIEPGKESWVDTLRPFIQRRIQKYTEGEIHFNLMALVPNLKTKYEQRVAELSAVGMDSDEVTKELNELHMLISGEEEKFRN

SEQ ID NO: 122329 - protein, 208 aa, Heterodera glycines
  Homolog annotation: Hit_ID=CAE59341.1; Match level="QueryCoverage =94%, HitCoverage=11%, E-value=1e-25, Identity=34%"; Hit description =Hypothetical protein CBG02686 [Caenorhabditis briggsae]
  Essential gene: C elegans homolog=C56E6.1; Phenotype=Lva
  Coding regions on vcDNA: vcDNA=SeqID_48752; Strand=+; Position=3-626
MTEPSASIVRPTFFDSVERWADRDFGEDLRNFLEEISYSDLASYAQLIHHKDIIIQCLLRHLADRSLSLPAFCDFCSAIATDLRDDFHTHFWQIFDAISNLVLASKGKEQCSDNELECTFRAMEQIVRINFRFVSARLKQLFSRLLPLFAFPSDGRLRFISARTFSFVFLKSPFPHKLAKFLLVKCFSDCGHLRDGLSLVFFDPFLGV

SEQ ID NO: 122330 - protein, 167 aa, Heterodera glycines
  Homolog annotation: Hit_ID=NP_495912.1; Match level="QueryCoverage =100%, HitCoverage=55%, E-value=6e-43, Identity=54%"; Hit description= haymaker protein (32.4 kD) (2J262) [Caenorhabditis elegans] emb|CAA93850.1| Hypothetical protein C18E9.6
  Essential gene: C elegans homolog=C18E9.6; Phenotype=Gro,Sma
  Coding regions on vcDNA: vcDNA=SeqID_48753; Strand=+; Position=3-506
TYGLTFANPSVSANNCQGTLVAQMLRRATKNLDLGAEYIYHRDERFPGKQSNTLSYALRYIQPTWIFSGTLAPTELHLCYYHKQSEHLQFGVEFEANFKLQEVNTTFAYQIEVPDSLTLRACCDTNWKVGAVLEKKLSKQLPFSLAISGVLDHVKAQGKFGIGLLIG

SEQ ID NO: 122331 - protein, 509 aa, Heterodera glycines
  Homolog annotation: Hit_ID=CAE69279.1; Match level="QueryCoverage =100%, HitCoverage=47%, E-value=1e-109, Identity=42%"; Hit description=Hypothetical protein CBG15333 [Caenorhabditis briggsae]
  Gene Ontology: Mol. function=pre-mRNA splicing factor activity; Cellular component=spliceosome complex; Biological process =processing of 20S pre-rRNA
  Essential gene: C elegans homolog=C06E1.10; Phenotype=Lva
  Coding regions on vcDNA: vcDNA=SeqID_48754; Strand=+; Position=1-1527
ATLKLQDFLRQRLFSISQPKVVSVQARQFPVTIYFERRTPTNYLEATFKKVCKIHEEYPAGGILAFVTGQREVTHLVKLLENKYTKISASKLLRKEKMKKCRKKETKEEEEEGLLLDNDEFGTSDMDLEDEAWQNTFFGSDDESLNASQSFKKYPPLLAIPLYSLLPVNLQKKIFNEPPDDGSRVCVVSTNVAETSLTIPNVRYVIDSGREKKREYDPITGVSRFVVGWCSKASADQRSGRAGRVQSGYAFRLYSSAVYEDMRDHSTPEILNKPIDQLILMLKAMNFTKIDNFPFPTPPRLDQIKSSELRLSHIGALRVQEGLYTITQLGQSLAQLPLTPSFAKVVISSIRGGLLPFAVTLVSALSVREPLLFISSTKEDGTEERRKRMSEVIKQRFLWCAVGEARLFGDLTVILNTVGAADYEEENARAIEALGLRPKALKEINKQRHQLTLLLNKSDSVEKLPEKFRMDAPSQEQLRRLRHIMVKCHPDKLAKKVQSLDAPKGAYKT

SEQ ID NO: 122332 - protein, 448 aa, Heterodera glycines
  Homolog annotation: Hit_ID=NP_497663.1; Match level="QueryCoverage =100%, HitCoverage=100%, E-value=0.0, Identity=90%"; Hit description =MEChanosensory abnormality MEC-12, TuBulin, Alpha, specific of 15 protofilament microtubules found in mec
  Gene Ontology: Mol. function=GTP binding; Cellular component =microtubule; Biological process=microtubule-based process
  Essential gene: C elegans homolog=C47B2.3; Phenotype=Emb
  Coding regions on vcDNA: vcDNA=SeqID_48755; Strand=+; Position=61-1407
MREVISIHVGQAGVQIGNACWELYCLEHGIQPDGKMPSDQNNQDDSFSTFFSETGNGRHVPRAVMVDLEPTVIDEIRTGTYKHLFHPEQLITGKEDAANNYARGHYTVGKEIIDPVLDRIRRIADNCTGLQGFLIFHSFGGGTGSGFTSLLMERLSVDYGKKSKLEFSIYPAPQVSTAVVEPYNSVLTTHTTLEHSDCAFMVDNEAIYDICRRNLDVERPSYTNLNRLISQVVSSITASLRFDGALNVDLTEFQTNLVPYPRIHFPLATYSPVISAEKAYHESLSVSEITNMCFEPSNQMVKCDPRHGKYMAVCLLYRGDVVPKDVNAAIASIKTNRSIQFVDWCPTGFKVGINYQPPTVVPGGDVAKVPRAVCMLSNTTAIADAWSRLDHKFDLMYAKRAFVHWYVGEGMEEGEFSEAREDLAALEKDYEEVAIDTVEGDGAGDDDY

SEQ ID NO: 122333 - protein, 456 aa, Heterodera glycines
  Homolog annotation: Hit_ID=NP_505415.2; Match level="QueryCoverage =97%, HitCoverage=97%, E-value=5e-87, Identity=42%"; Hit description =ubiquinone biosynthesis monooxgenase coq6 (49.1 kD) (5J819) [Caenorhabditis elegans] gb|AAB54238.2| Coenz
  Gene Ontology: Mol. function=ubiquinone biosynthesis monooxygenase activity; Cellular component=mitochondrion; Biological process =electron transport
  Essential gene: C elegans homolog=K07B1.2; Phenotype=Age,Unclassified
  Coding regions on vcDNA: vcDNA=SeqID_48756; Strand=+; Position=733 -2286
MLKHCTQIRSFATHQSTFYDVVIVGGGLVGSAMACSIGTNSALGPSTRVLLLESGRLHSVKQSKEAETKHTYNNRVSAVSPSSPFLFYSQFGVWDEICSKRVHPISALYVEDGCAKSKIHFKQLDKRSPIAHIVENELIVAALQQCIRDRCANVEVRQGAVVDQNLSVPDNLGQNVTIQFEDGTIEASLMIAADGSKSTARKRAGIDFEETAYEQRAVVGTLALQHNSESDESFAWQRFVPSGPVALLPLGRELCSLVWTVSTADAARLLQLSPEHFVEELNGTLQFDNSSANSLVNNSLDCLGKALNFLPSKESPAKCTIPRVLSLPYDDRAVFPLSLGYAYDYIRPRVALIGDAAHRVHPLAGQGVNLGWSDVRFLTAALQRAFDEGGDLGSLTYLRDFDSASQRRNGPIIFAIDCLNRLYSTDHPFCTLFRSVGLNILDRILPAKDLIVHLAS

SEQ ID NO: 122334 - protein, 209 aa, Heterodera glycines
  Homolog annotation: Hit_ID=CAE58955.1; Match level="QueryCoverage =98%, HitCoverage=78%, E-value=4e-58, Identity=50%"; Hit description =Hypothetical protein CBG02223 [Caenorhabditis briggsae]
  Gene Ontology: Mol. function=NADH dehydrogenase (ubiquinone) activity; Cellular component=membrane fraction; Biological process =growth
  Essential gene: C elegans homolog=F59C6.5; Phenotype=Emb,Lva
  Coding regions on vcDNA: vcDNA=SeqID_48757; Strand=+; Position=10-636
MSAVKGRREQDRKEWAAYWNIRWKEVENSFVGKYSYYTNRFLDWPVTWFRENIVERLHDKHKMPYYHRKISRVPEIDECGVNDRICLFEAEEQFRLDKLVDHYIRDILYQRFTQCVRAEGYDHLYKCAKHVDDYENAELNFFIKYGELGSEQTVVACYMKQKHRLIWERRHPEIMEERKRAHEEHTENMNKDKFNMHFWIKDNIYRKKQ

SEQ ID NO: 122335 - protein, 154 aa, Heterodera glycines
  Homolog annotation: Hit_ID=CAE71331.1; Match level="QueryCoverage =98%, HitCoverage=93%, E-value=1e-46, Identity=59%"; Hit description =Hypothetical protein CBG18231 [Caenorhabditis briggsae]
  Gene Ontology: Mol. function=RNA binding; Cellular component=small nuclear ribonucleoprotein complex; Biological process=positive regulation of growth rate
  Essential gene: C elegans homolog=Y48A6B.3; Phenotype=Gro
  Coding regions on vcDNA: vcDNA=SeqID_48758; Strand=+; Position=3-467
MEDSEQNITEQSVSAPTTDHDEYEELCKLVNPISKPLANRKLAKKVYKLVKKAAKEKGFLRHGLADVMKAFRKNEKGIIVLAGNVSPIDVYSHIPAICEEKGLPYVFTPSREHLGLCAGYKRPAIVLLVKRHDSFAELFDQTHESTYALVVEPE

SEQ ID NO: 122336 - protein, 232 aa, Heterodera glycines
  Homolog annotation: Hit_ID=CAE70046.1; Match level="QueryCoverage =100%, HitCoverage=57%, E-value=1e-104, Identity=79%"; Hit description=Hypothetical protein CBG16478 [Caenorhabditis briggsae]
  Gene Ontology: Mol. function=helicase activity; Cellular component =eukaryotic translation initiation factor 4 complex; Biological process=regulation of translational initiation
  Essential gene: C elegans homolog=F57B9.6; Phenotype=Lva
  Coding regions on vcDNA: vcDNA=SeqID_48759; Strand=+; Position=2-700
KIKMFVLDEADEMLSRGFKDQIYEVFKSLPNDVQVVLLSATMPNEVLDVTKKFMRNPIQILIKKEELTLEGIRQFYIFVDKEEWKFETLCDLYDTVNITQAVIFANTRRKVEDLARNMTQKKFTVSLIHGEMEQQDRDVIMREFRSGSSRVLITTDLLARGIDVQQVSVVINYDLPGNRENYIHRIGRSGRFGRKGVAINFVTKQDQQMLKEIETYYSTQIEEMPANIGDMI

SEQ ID NO: 122337 - protein, 217 aa, Heterodera glycines
  Homolog annotation: Hit_ID=NP_499912.1; Match level="QueryCoverage =89%, HitCoverage=15%, E-value=6e-49, Identity=50%"; Hit description =filamin (118.6 kD) (4B124) [Caenorhabditis elegans] gb|AAC69000.1| Hypothetical protein Y66H1B.3 [Caenorh
  Gene Ontology: Mol. function=actin cross-linking activity; Cellular component=actin cytoskeleton; Biological process=signal transduction
  Essential gene: C elegans homolog=Y66H1B.3; Phenotype=Bmd,Emb,Stp
  Coding regions on vcDNA: vcDNA=SeqID_48760; Strand=+; Position=84-734
MNNSNHTQSVEVKLLKDDDWKRIQQNTFTRWVNQHLKKAPGSPKIENLATDFHDGILLIQLAEVLAQRNLVRFNRKPTMRTQKLDNISTVLNFFQKEEHIKIVNIDSSHIADHNLKLILGLMWTLILHYSLSQSIASTESVNGDEDGLGNGTDHQRHPSPRKSTSSSASEQQSPKKRLLAWIQERVPHLVVTNFTSDWTNGIVLGALVDACLGSGAF

SEQ ID NO: 122338 - protein, 321 aa, Heterodera glycines
  Homolog annotation: Hit_ID=CAE61727.1; Match level="QueryCoverage =92%, HitCoverage=84%, E-value=3e-66, Identity=44%"; Hit description =Hypothetical protein CBG05678 [Caenorhabditis briggsae]
  Gene Ontology: Mol. function=ATP binding; Cellular component =extracellular space; Biological process=amino acid activation
  Essential gene: C elegans homolog=F18E3.7a; Phenotype=Emb
  Coding regions on vcDNA: vcDNA=SeqID_48761; Strand=+; Position=2-964
LNLLFNSPISVHYLFRRHFAHFPLMKAAVVGEGAVGASVALAIRRAHPNANITVFSDRDFEKTTSYGPEGIFRVDVPGTERLAKESFEFWAKTERDELAHKTGVRLISGYCQSNDRKWIEAQESSMSDIVYNWKWLSERELRTLFVRPYCYGAHYTTYAAEGRLYVPWLRAQLVAESGQGLLHFQRQRIESLEQLIDSDQFTLVVNCAGLEGGRLAGDDGTSVYPNRGVGLEVEAPGHVHFTYWGRDIFCIPMVSNNRLMIGTLRQDNCWELEVTEQDRSAIWTRFIELQPNFRDAKIVSAWCGLRPNRHGGVRIEHQLRT

SEQ ID NO: 122339 - protein, 169 aa, Heterodera glycines
  Homolog annotation: Hit_ID=AAK26104.1; Match level="QueryCoverage =97%, HitCoverage=96%, E-value=2e-65, Identity=73%"; Hit description =SKP1-like protein ASK10 [Arabidopsis thaliana]
  Gene Ontology: Mol. function=protein binding; Cellular component=SCF ubiquitin ligase complex; Biological process=reproduction
  Essential gene: C elegans homolog=F46A9.5; Phenotype=Emb
  Coding regions on vcDNA: vcDNA=SeqID_48762; Strand=+; Position=37-546
MSASKFFLKSNDDEVFEVDRNVIRLSTTLNTMFQDLGMDQAEAGEKMYTDPIPLANVNGAILRKVIAWCNHHKDDAPTGEDAESKERRTDDIPSWDVEFLKVDQGTLFELILAANYLDVRGLLDVACKTVANMIKGKSPDEIRRTFNIKNDFTPEEEEQIRRENAWCED

SEQ ID NO: 122340 - protein, 650 aa, Heterodera glycines
  Homolog annotation: Hit_ID=AAN78300.1; Match level="QueryCoverage =100%, HitCoverage=100%, E-value=0.0, Identity=99%"; Hit description =heat shock protein 70 A [Heterodera glycines]
  Gene Ontology: Mol. function=non-chaperonin molecular chaperone ATPase activity; Cellular component=intracellular; Biological process=reproduction
  Essential gene: C elegans homolog=F26D10.3; Phenotype=Lva,Ste
  Coding regions on vcDNA: vcDNA=SeqID_48763; Strand=+; Position=36-1988
MPAKANAIGIDLGTTYSCVGVFQHGKVEIIANDQGNRTTPSYVAFTDTERLIGDAAKNQVAMNPSNTVFDAKRLIGRKFDDPAVQSDMKHWPFKVVQGEGARPKVMVEVKGEDKAFFPEEVSSMVLIKMKETAEAFLGQTVTDAVVTVPAYFNDSQRQATKDAGTIAGLNVLRIINEPTAAAIAYGLDKKGQGERHVLIFDLGGGTFDVSILTIEDGIFEVKSTAGDTHLGGEDFDNRMVNHFVAEFKRKHKKDLSSNPRALRRLRTACERAKRTLSGSTQASIEIDSLFDGIDFYTNITRARFEELCADLFRNTMDPVEKALRDAKMDKSQIHDIVLVGGSTRIPKVQKLLSDFFSGKELNKSINPDEAVAYGAAVQAAILSGDKSETVQDLLLLDVAPLSLGIETAGGVMTSLIKRNTTIPTKTSQTFTTYSDNQPGVLIQVYEGERAMTKDNNLLGKFELSGIPPAPRGVPQIEVTFDIDANGILNVSAQDKSTGKQNKITITNDKGRLSKEEIERMVQEAEKFSKEDEVQRDRVSAKNALESYCFNIKQTMEDSNLKDKISEDDKKKVLEKCGEVLAWLDANQAAEKEEFEHQQKELEGICNPIITKLYQAGGAMPGGPMPGGGMPGGGGAAGAGGAGGPTIEEVD

SEQ ID NO: 122341 - protein, 195 aa, Heterodera glycines
  Homolog annotation: Hit_ID=NP_495841.1; Match level="QueryCoverage =85%, HitCoverage=24%, E-value=3e-15, Identity=28%"; Hit description =initiation factor eIF-2Be (75.5 kD) (2I953) [Caenorhabditis elegans] emb|CAA91063.1| Hypothetical protein
  Essential gene: C elegans homolog=D2085.3; Phenotype=Gro
  Coding regions on vcDNA: vcDNA=SeqID_48764; Strand=+; Position=145-729
SFQISTFNLFNLKVDIFSSSGFVASCLNWVSKLHSPNVIVALPNQPNDVAAELLKKWASKFKQLQAFGVSNCQSLNDVLREVDFRQILRNDFMLIQNLATFCFSYLTRQIEKFRNDRRQNNKNVLTLLYYSKRNYGRKFEEDRSLIGYIEQTQKLTHYENIGKHRTFTVPKSEFLHDTVFRVDLFSCGIALCGIE

SEQ ID NO: 122342 - protein, 190 aa, Heterodera glycines
  Homolog annotation: Hit_ID=XP_392565.1; Match level="QueryCoverage =99%, HitCoverage=99%, E-value=6e-75, Identity=72%"; Hit description =similar to ribosomal protein L18 [Apis mellifera]
  Gene Ontology: Cellular component=cytosolic ribosome (sensu Eukarya); Biological process=protein biosynthesis
  Essential gene: C elegans homolog=Y45F10D.12; Phenotype=Ste
  Coding regions on vcDNA: vcDNA=SeqID_48765; Strand=+; Position=29-601
MGIDINHKYDRKVRRTAPKSEDPYLRVLVKLYRFLAKRVDTSKRFNAVVLKRLFMSKRNRPPLSIARIVRYVKKPGNEKKLVVCVGSVTDDKRIYTVPAMTVCALRFTDAARARIIAAGGECITFDQLALRAPKGENTLLLQGRRKAREAEKHFGPPPGVPGSHAKPLVRAKGRKFERARGRRKSRGYKN

SEQ ID NO: 122343 - protein, 321 aa, Heterodera glycines
  misc_feature (66)..(66): Xaa can be any naturally occurring amino acid
  Homolog annotation: Hit_ID=CAE64813.1; Match level="QueryCoverage =100%, HitCoverage=49%, E-value=1e-112, Identity=61%"; Hit description=Hypothetical protein CBG09607 [Caenorhabditis briggsae]
  Gene Ontology: Mol. function=RNA binding; Cellular component =cytoplasm; Biological process=reproduction
  Essential gene: C elegans homolog=Y32F6A.3; Phenotype=Emb,Lva
  Coding regions on vcDNA: vcDNA=SeqID_48766; Strand=+; Position=2-964
PQYGVSQPICTKEPTEKDLRLTKELESYLRSSGIFESDLDIQKRFDVLRRINSLVKSWVKQAFFLXVPPEQLDTVGGKLFTFGSYRLGVHTPGADIDSLCVVPRHIERIDFFTSFYQMLKEDEKTADLHKVEDAFVPLIKLRYDGIELDILFARLALKEIKEDQELSDDNLLKNLDEKSIRSLNGCRVADEILRLVPNRLNFILVLRAGKLWAKNHGIYSNVLGFLGGISWAILVARTCQLYPNATPSVLLQKFFLDFSAWDWPHPVILKDVDATPRIDIPYFIDMIWDPRTRASDRYHLMPIITPAFPEQNSTFNVTRST

SEQ ID NO: 122344 - protein, 251 aa, Heterodera glycines
  Homolog annotation: Hit_ID=NP_741810.1; Match level="QueryCoverage =98%, HitCoverage=59%, E-value=1e-100, Identity=69%"; Hit description= aspartate aminotransferase Complex With Alpha-Methyl (45.6 kD) (XG861) [Caenorhabditis elegans] gb|AAA80
  Gene Ontology: Cellular component=mitochondrion; Biological process =aspartate catabolism
  Essential gene: C elegans homolog=T01C8.5; Phenotype=Gro
  Coding regions on vcDNA: vcDNA=SeqID_48767; Strand=+; Position=49-801
MDQQEKSSGWFANVEMGPPDVILGVTEAFKRDDNPKKVNLGVGAYRDDQGMPFVLPSVKQAEKELLEANLDKEYAGIAGLPDFTAKAIELALGRDSEVLKAKRNATVQSVSGTGALRTGAEFLSKWFPHNKVVYQPTPTWGNHVPVFKFAGFEIQKYRYYDPKTCGFDENGCLEDILNIPAKSVILFHACAHNPTGVDPTPEQWTKISDACKSRDLYVFFDMAYQGFATGDVDGDAHALRYFVQQGDNICL

SEQ ID NO: 122345 - protein, 302 aa, Heterodera glycines
  Homolog annotation: Hit_ID=NP_496958.1; Match level="QueryCoverage =100%, HitCoverage=33%, E-value=1e-135, Identity=73%"; Hit description=5'-3' exoribonuclease 2 (101.3 kD) (2O455) [Caenorhabditis elegans] emb|CAB54449.1| Hypothetical protei
  Gene Ontology: Mol. function=5'-3' exoribonuclease activity; Cellular component=chromosome; Biological process=cell growth
  Essential gene: C elegans homolog=Y48B6A.3; Phenotype=Emb,Lva,Lvl
  Coding regions on vcDNA: vcDNA=SeqID_48768; Strand=+; Position=51-956
MGVPAFFRWLSRKYVSIIVDAVEQRRREIDGVKIPIDATQPNENYQEFDNLYLDMNGIIHPCTHPEDRPAPKTEEEMFILIFEYIDRLFSIVRPRKLLYMAVDGVAPRAKMNQQRSRRFRAAQEAAEKRELIENVRKRLESEGIPLPPPRKEEEHFDSNCITPGTPFMARLSVALRYYVHKRITYDPAWQKIQVILSDANVPGEGEHKIMDYVRRQRASPAHDPNTVHCLCGADADLIMLGLATHESNFNIIREEFLPNQPRACELCGQYGHEVEHCEGLARAETGADQRDPLKKEKNFSFI

SEQ ID NO: 122346 - protein, 303 aa, Heterodera glycines
  Homolog annotation: Hit_ID=AAA81160.2; Match level="QueryCoverage =98%, HitCoverage=68%, E-value=1e-117, Identity=68%"; Hit description= Ectopic membrane ruffles in embryo protein 1 [Caenorhabditis elegans]
  Gene Ontology: Mol. function=NEDD8 activating enzyme activity; Biological process=endomitotic cell cycle
  Essential gene: C elegans homolog=F11H8.1; Phenotype=Emb
  Coding regions on vcDNA: vcDNA=SeqID_48769; Strand=+; Position=2-957
IDENRRWSDLRCLTDRASTFANSGFVPGIKNLKEVHKMPVLVVGAGGLGCEILKDLALSGFHDIHIIDMDTIDLSNLNRQFLFRENDIGRSKAEVAAAFIEKRVFGCKVTPHNCKIQDKSLEFYRKFFIIICGLDSIEARRWLNATVCSLVEFDDGNNPKSNTIVPLIDGGTEGFKGNSRVIIPFMTPCIQCTIDLYTPQVNFPVCTIAHTPRLPEHCVEYVKVVLWEKEKPFGQDVKLDADDPAHVEWAFRAAQQRANEYEIKDVDLRLTQGVLKRIIPAVASTNAIIAGSCALEALKLASK

SEQ ID NO: 122347 - protein, 426 aa, Heterodera glycines
  Homolog annotation: Hit_ID=CAE63008.1; Match level="QueryCoverage =76%, HitCoverage=60%, E-value=4e-79, Identity=45%"; Hit description =Hypothetical protein CBG07248 [Caenorhabditis briggsae]
  Gene Ontology: Mol. function=ubiquitin-protein ligase activity; Biological process=protein polyubiquitination
  Essential gene: C elegans homolog=C11H1.3; Phenotype=Dpy,Gro,Pvl,Unc
  Coding regions on vcDNA: vcDNA=SeqID_48770; Strand=+; Position=164 -1441
MGQLLVAFRGAANGNRNNDNQNAATNPSAGLRRLFVLLSAFLPFGQQTANNLEQRNDNNQQGESAEMGQFRAGFGRRRRRHAPAPPDLSGSGEAGGHGSPCGANGGGSFFGSHFLMGGELYDSSKPEVFLFGDQQDLELLGSKSVKFPFSAKGVTDSIGVLNALVNVRKDSVKFTKVGRAGGGYSSGFYRLEFVFDCDVSCFVQIHFCAREQIDEQQPQLLQIVSRQPQFEHSERFHFPVGANQHFSHFTFKPHRYDMKMMHWDGGPVFPVVIEIRSVSDQFPEQVQTTLCSIERSNDQSAVLILKPMKQKLFSDGVLFLLQEIFGIENKEMETAPPALADENGAECIICMANSRDTMILPCRHLCICNGCAETLRYKLNNCPICRSPFKALLKIKAMRNSLVGKGVGSDGSMTTARIRHEPVTLI

SEQ ID NO: 122348 - protein, 133 aa, Heterodera glycines
  Homolog annotation: Hit_ID=NP_497284.1; Match level="QueryCoverage =100%, HitCoverage=31%, E-value=6e-18, Identity=35%"; Hit description= cytochrome Bc1 Complex From Chicken like family member (45.6 kD) (3B499) [Caenorhabditis elegans] gb|AAC
  Gene Ontology: Cellular component=mitochondrion
  Essential gene: C elegans homolog=T24C4.1; Phenotype=Stp
  Coding regions on vcDNA: vcDNA=SeqID_48771; Strand=+; Position=1-399
GTDSTNYLGVRLLWVTGQSGATLQAKLSKDLMLVHMSVPRTMSPVAISVLGEFVQPALKSWDVLSVQEEMAYDLSQQSPYDLTIEGLYRAAFRNGSLSNALLSPHYQIGNITNKRTQQFVNSRWLTKETALIG

SEQ ID NO: 122349 - protein, 246 aa, Heterodera glycines
  Homolog annotation: Hit_ID=AAC05332.1; Match level="QueryCoverage =95%, HitCoverage=54%, E-value=2e-44, Identity=39%"; Hit description =extra sex combs [Schistocerca americana]
  Gene Ontology: Mol. function=protein binding; Cellular component =nuclear chromatin; Biological process=chromatin silencing
  Essential gene: C elegans homolog=C09G4.5a; Phenotype=Lvl,Sck,Stp
  Coding regions on vcDNA: vcDNA=SeqID_48772; Strand=+; Position=13-750
MLYNGKFLNKKNYTITFELAGSFVENHRGTVYSVSFNPFTHSEAPIYFATVGKNRVSVYLCPPEKGFQLVRQFEDQDAKDEFYYTVTWAYNLEKAQHVLVVGGFRGIIRVISPLNGRLHCALIGHGDSINELCTSPVSPMIVASASKDLTVRIWNVTYSQCLAILGGTNGHRDQVISLDFDSSGAFLATASMDHAVKLWHIGKGTEVHENITASLRGQLNSVQSVEMHFPICHSKDQHTNYLDCVR

SEQ ID NO: 122350 - protein, 194 aa, Heterodera glycines
  misc_feature (125)..(125): Xaa can be any naturally occurring amino acid
  misc_feature (167)..(167): Xaa can be any naturally occurring amino acid
  Homolog annotation: Hit_ID=CAE71286.1; Match level="QueryCoverage =97%, HitCoverage=55%, E-value=1e-75, Identity=66%"; Hit description =Hypothetical protein CBG18174 [Caenorhabditis briggsae]
  Gene Ontology: Mol. function=actin binding; Cellular component=Arp2/3 protein complex; Biological process=embryogenesis and morphogenesis
  Essential gene: C elegans homolog=Y79H2A.6; Phenotype=Emb
  Coding regions on vcDNA: vcDNA=SeqID_48773; Strand=+; Position=2-585
VSAQSDSPVPNWLLNIGPISCHAWNKDKTQLAVSPSNNEIHIFARLETVWNPLHVLREHDLLITGLDWAPNTNRIVSCSHDKNAFVWTWEAEKNSWKPEMVVVRINRAATCVKWSPNENKFAVGXRENDWWVAKQIKKLIRSTVTSLNWHPNNILLAVGACDFKTRXFSAYVKEIDEKPTPNPWGTKMPLGELL

SEQ ID NO: 122351 - protein, 219 aa, Heterodera glycines
  Homolog annotation: Hit_ID=NP_501800.1; Match level="QueryCoverage =100%, HitCoverage=19%, E-value=6e-60, Identity=51%"; Hit description= UBA (human ubiquitin) related, UBiquitin Activating enzme related (124.1 kD) (uba-1) [Caenorhabditis ele
  Gene Ontology: Mol. function=ubiquitin activating enzyme activity; Cellular component=cytoplasm; Biological process=reproduction
  Essential gene: C elegans homolog=C47E12.5; Phenotype=Emb
  Coding regions on vcDNA: vcDNA=SeqID_48774; Strand=+; Position=2-864
DGDHVVFTDFEHAELNELPPVPVTLKGSKVFNIGNALAAFSGAVQGPVSRGRVQQVKVPKKMSFYSLSLALAEPDFMIWDFAKFDEPAQLHALWQALYSFEEMKNYSPLPRSDADAKLLKEMLPKDAPEMPDSLLLNFSYQACGNLQPIASLIGGLVAQEAMKAVTHHTTPLKQFLYTDSLEALPGADSTFDAAKLEKNDCAPRNNRYDGQAAVFGWAF

SEQ ID NO: 122352 - protein, 189 aa, Heterodera glycines
  Homolog annotation: Hit_ID=NP_510818.2; Match level="QueryCoverage =75%, HitCoverage=22%, E-value=1e-56, Identity=69%"; Hit description =neuralized, possibly N-myristoylated (XR998) [Caenorhabditis elegans]
  Gene Ontology: Mol. function=ubiquitin-protein ligase activity; Cellular component=plasma membrane; Biological process=sensory organ precursor cell fate determination
  Essential gene: C elegans homolog=F10D7.5a; Phenotype=Emb,Sck,Ste
  Coding regions on vcDNA: vcDNA=SeqID_48775; Strand=+; Position=47-613
MGNSSTTARSDDPQSTLTAGETLSDYDENIINRGRVAPRKESFCKGLAFSNRPISINEIVCIRLSEIGTNWSGVMRFGVTNVDPASFRDIELPKFACPDLTSKGGYWAKSLAERYSVEGSILHFFTNANGEMYYGVNGVHKGLFLSGINVLSPLWIIVDIYGNSIAVEFIDPSEVQLQSKRTSSKNRAG

SEQ ID NO: 122353 - protein, 201 aa, Heterodera glycines
  misc_feature (165)..(165): Xaa can be any naturally occurring amino acid
  misc_feature (185)..(185): Xaa can be any naturally occurring amino acid
  Homolog annotation: Hit_ID=AAG12473.1; Match level="QueryCoverage =60%, HitCoverage=31%, E-value=3e-46, Identity=76%"; Hit description =transcription factor DP1 [Brugia malayi]
  Gene Ontology: Mol. function=transcription co-activator activity; Cellular component=transcription factor complex; Biological process =regulation of cell cycle
  Essential gene: C elegans homolog=T23G7.1; Phenotype=Emb,Stp,Unc
  Coding regions on vcDNA: vcDNA=SeqID_48776; Strand=+; Position=19-620
MNQRSEMPAQLRFQPSNAIGTHQRSIITAQQFQQQPFCVKRARYDYDLYEGQSHHNFQRQRFNQTPPSAIHPMRTFQIRHRSTDKTRGLRHFAQKVCEKVKQKVQTNYNEVAEELVNEYFDNIAEVPSDPEKLQYDTRNIRRRVYDALNVLMAMNIIEKEKKEIXWVGLPTSSLAECRRLEEEKXQRQERIRQKTEQLQEL

SEQ ID NO: 122354 - protein, 221 aa, Heterodera glycines
  misc_feature (161)..(161): Xaa can be any naturally occurring amino acid
  misc_feature (202)..(202): Xaa can be any naturally occurring amino acid
  Homolog annotation: Hit_ID=CAE68128.1; Match level="QueryCoverage =90%, HitCoverage=27%, E-value=2e-58, Identity=53%"; Hit description =Hypothetical protein CBG13773 [Caenorhabditis briggsae]
  Gene Ontology: Mol. function=glutamine-tRNA ligase activity; Cellular component=cytoplasm; Biological process=glutaminyl-tRNA aminoacylation
  Essential gene: C elegans homolog=Y41E3.4; Phenotype=Emb,Lva
  Coding regions on vcDNA: vcDNA=SeqID_48777; Strand=+; Position=210-872
MFKLTKMLNVPHRPDKSSNIGKEETAPKKDRVGEDSTKVTTQKRFAEMFGHLHFHEVGKNDTTEGYVRTENTERLLREHVKAGGGKVVTRFPPEPNGILHIGHAKAINIDFGLAKARGGICYLRLDDTNPEKEEERFVQEIEDMVNWIGYSPYKITHASDXCDQLYSWALTLIRKNLGYVWPPSTDEKRGFNPSPSPWRDRXLEECLGLIQAKKDGALDGG

SEQ ID NO: 122355 - protein, 279 aa, Heterodera glycines
  Homolog annotation: Hit_ID=NP_509083.1; Match level="QueryCoverage =98%, HitCoverage=65%, E-value=1e-107, Identity=69%"; Hit description= fumarylacetoacetate hydrolase (46.0 kD) (XH66) [Caenorhabditis elegans] gb|AAK39259.1| Hypothetical prot
  Gene Ontology: Mol. function=fumarylacetoacetase activity; Biological process=tyrosine catabolism
  Essential gene: C elegans homolog=K10C2.4; Phenotype=Emb,Lva,Unc
  Coding regions on vcDNA: vcDNA=SeqID_48778; Strand=+; Position=11-847
MPSVSFVDVPVNSPFTFENLPFGVFSTNENSKKRIGVAIGAQILDLSVVKHLFTGPLLSERQNVFSQETLNQFMGLSRQCWLEARLTLQSLLSNANPMLRDDSELRERAFVAQSEAKMHLPALIGDYTDFYSSIYHATNVGTMFRGKDNALMENWKWLPVAYHGRASSIVVSGTAVNRPWGQVKAEDDTQPNFVTSRLMDFELEMAFFVGGPENALGTPIPIEKTEEHIFGMVLMNDWSARDIQKWEYVPLGPFLGKSFATTISPWVVTMEALRPFVVD

SEQ ID NO: 122356 - protein, 191 aa, Heterodera glycines
  Homolog annotation: Hit_ID=NP_741145.1; Match level="QueryCoverage =77%, HitCoverage=96%, E-value=5e-64, Identity=79%"; Hit description =myosin light chain (17.1 kD) (mlc-3) [Caenorhabditis elegans] gb|AAA50701.1| Myosin light chain protein 3
  Gene Ontology: Mol. function=structural constituent of muscle; Cellular component=muscle myosin; Biological process=muscle development
  Essential gene: C elegans homolog=F09F7.2a; Phenotype=Egl,Unc
  Coding regions on vcDNA: vcDNA=SeqID_48779; Strand=+; Position=103-678
SVRPRTSFARFFRRYTLISHSPTKHFTNKSSRRITKRKSREMPSQGELKEIFNLYDEELEGKIDATQIGDVARACGLKPTNAMVWKAAGEEYKRKGEKKLAFEEWLPIFEQLQKEKEVGTYADFVEGLKVFDKDESGKIMAAELRHVLLALGERLSAEEADELLLGAQDGEGMINYDQFIKKVLAGPYPED

SEQ ID NO: 122357 - protein, 373 aa, Heterodera glycines
  Homolog annotation: Hit_ID=NP_872121.1; Match level="QueryCoverage =95%, HitCoverage=56%, E-value=1e-157, Identity=74%"; Hit description= ferredoxin and Molybdopterin oxidoreductase (5D185C) [Caenorhabditis elegans] gb|AAO25977.1| Hypothetica
  Gene Ontology: Mol. function=NADH dehydrogenase (ubiquinone) activity; Cellular component=membrane fraction; Biological process =mitochondrial electron transport, NADH to ubiquinone
  Essential gene: C elegans homolog=Y45G12B.1a; Phenotype=Lva
  Coding regions on vcDNA: vcDNA=SeqID_48780; Strand=+; Position=7-1125
MLLFGSKNLSTLKIILRKNATAAVQAESPKQQKVEVTIDDKKVLVDPGMTILQACALVGVDIPRFCYHDRLSIAGNCRMCLVEVEKSVKPVASCAMPVMNGMRVKTNSAATKKAREGVMEFLLVNHPLDCPICDQGGECDLQDQSMAFGSDRSRHQNEYDGKRAVEDKDIGPLVKTIMTRCIHCTRCIRFANEIAGVPDLGSTGRGSDMQIGTYVEKLFASELSGNVIDLCPVGALTSKQYSFVARPWETRKTESVDVMDALGSNIVIAHRTGEILRIIPRMNDEVNEEWLSDKARFICDGLKRQRLLQPMLKNESDVLSPCNWEEALFTAAQKLRQITPNAIAGLAGGLVDAESLIALKDLLNQINSENVFS

SEQ ID NO: 122358 - protein, 338 aa, Heterodera glycines
  Homolog annotation: Hit_ID=CAE75362.1; Match level="QueryCoverage =98%, HitCoverage=76%, E-value=1e-149, Identity=76%"; Hit description= Hypothetical protein CBG23346 [Caenorhabditis briggsae]
  Gene Ontology: Mol. function=proteasome endopeptidase activity; Cellular component=proteasome regulatory particle (sensu Eukarya); Biological process=proteolysis and peptidolysis
  Essential gene: C elegans homolog=C52E4.4; Phenotype=Emb
  Coding regions on vcDNA: vcDNA=SeqID_48781; Strand=+; Position=28-1041
MSSDIVEKKETNPNETDDKTKEIKSLDEDEIAALSNYNMGPYADQLKQAEKDIDEIQKRINTLCGVKESDTGLAPPILWDIAADKMAMSHEQPLQVARCTKIIKEEGKETRYMINVKQFAKFVVDLHENVAPTDIEEGMRVGVDRNKYQIHLPLPAKIDASVTMMQVEDKPDVTYADIGGCEEQIKKLREVVEFPLLQPERFTSLGIEPPKGVLFFGPPGTGKTLCARAVANRTDACFIRVIGSELVKKYVGEGARMVRELFSLAKTKKACILFFDEVDAIGGARFDDGKGGDNEVQRTMLELVNQLDGFDSRGAIKVLMATNRPDTLDPALIRPGRI

SEQ ID NO: 122359 - protein, 338 aa, Heterodera glycines
  Homolog annotation: Hit_ID=CAE60123.1; Match level="QueryCoverage =76%, HitCoverage=80%, E-value=3e-70, Identity=44%"; Hit description =Hypothetical protein CBG03666 [Caenorhabditis briggsae]
  Essential gene: C elegans homolog=T07C12.11; Phenotype=Unclassified
  Coding regions on vcDNA: vcDNA=SeqID_48782; Strand=+; Position=15-1028
MLDETSASRAIGSNETAVMINSDEHELDTDPGVQGSDNGASSSMQRQLSAAMQAVVEEPTFNLRLIDAVRQSHCLYDASDKQYRSADYKIKVWNRLVHVLGFQGDARTLYNRWKQLRDKYGKEKKKLKYSGEQHSQWQYFKHLEFLDPHMVDRTQQRFERNKEGKTEQRQIVITDPNFALHLINQVRTQPCLYDIKDTKYRHTEYRNQAWAEIAKNLAFPGDVSALYKQWKKIRDRYVREKRKLRMTNGTENEEPNWELYRELVWIDRYLDERAAQVKRKQESSDLSGEEFIEDAYSTQNASGLSNSLPGNSATPLDSAHPHHHPQQHHYANVLMPNS

SEQ ID NO: 122360 - protein, 186 aa, Heterodera glycines
  misc_feature (120)..(120): Xaa can be any naturally occurring amino acid
  misc_feature (131)..(131): Xaa can be any naturally occurring amino acid
  misc_feature (148)..(148): Xaa can be any naturally occurring amino acid
  misc_feature (176)..(176): Xaa can be any naturally occurring amino acid
  Homolog annotation: Hit_ID=NP_499369.1; Match level="QueryCoverage =97%, HitCoverage=83%, E-value=7e-87, Identity=86%"; Hit description =RAN (nuclear import/export) related (24.3 kD) (ran-1) [Caenorhabditis elegans] emb|CAB07240.1| Hypothetic
  Gene Ontology: Mol. function=RAN small monomeric GTPase activity; Cellular component=nucleus; Biological process=embryogenesis and morphogenesis
  Essential gene: C elegans homolog=K01G5.4; Phenotype=Emb
  Coding regions on vcDNA: vcDNA=SeqID_48783; Strand=+; Position=55-610
MNQEQDNIPTFKLVLVGDGGTGKTTFVKRHLTGEFEKKYIATLGVEVHPLTFHTSRGQIRFNVWDTAGQEKFGGLRDGYYIQGQCAIVMFDVTARVTYKNVPNWHRDLVRVCENIPIVLXGNKVDVKDREXVRRKSITFNRKKNLQYXHISAKNNYNFKKPFLYLARKLIGDPKLXEFWGKPALPP

SEQ ID NO: 122361 - protein, 247 aa, Heterodera glycines
  Homolog annotation: Hit_ID=NP_741039.1; Match level="QueryCoverage =100%, HitCoverage=54%, E-value=6e-59, Identity=54%"; Hit description= serine/aRginine rich pre-mRNA SPlicing factor (52.7 kD) (rsp-7) [Caenorhabditis elegans] emb|CAA85414.2|
  Gene Ontology: Mol. function=pre-mRNA splicing factor activity; Cellular component=nuclear speck; Biological process=mRNA splicing
  Essential gene: C elegans homolog=D2089.1a; Phenotype=Unclassified
  Coding regions on vcDNA: vcDNA=SeqID_48784; Strand=+; Position=3-743
KVEEIRRTVYVGNLPKGCDGEEVLNFFNACIGEVMYLRMAAGNDYLPCDYAYVEFSQQSSVPLALQNSDSLEFQGRPLRIQHSKVAIIKPQRKTADQALEEVEEAIKSGSDGRTTTDTGRGYSPFRPGVSAPRVVPTSPRPSVKRSTRSRSTSSSHSRRSRSRSRRRRSRSRSTRSPSRSRRRRSRSRDRKRSRSRRRSRSRDKDRKKASKRSRSRDRSTRESGSKASKRDKDRSSRERDKEKSSKK

SEQ ID NO: 122362 - protein, 218 aa, Heterodera glycines
  misc_feature (15)..(15): Xaa can be any naturally occurring amino acid
  Homolog annotation: Hit_ID=CAE71280.1; Match level="QueryCoverage =99%, HitCoverage=26%, E-value=6e-78, Identity=66%"; Hit description =Hypothetical protein CBG18164 [Caenorhabditis briggsae]
  Gene Ontology: Mol. function=kinesin motor activity; Cellular component=kinesin complex; Biological process=mitochondrial transport
  Essential gene: C elegans homolog=R05D3.7; Phenotype=Dpy,Gro,Rup,Unc
  Coding regions on vcDNA: vcDNA=SeqID_48785; Strand=+; Position=7-658
MASECCIQVFCRVRXPLNESEKKNSSTNVVKFQSKDTIVVGGKPYAYDHVFEPSSNQEAVYSTAARHIVQDVLTGYNGTIFVYGQTSSGKTHTMEGVIGDSEKQGIIPRIVNDIFTHIYNFVDTEMEFLIKVSYFEIYNERIRDLLDVTKTNLAIHEDKNRIPFVKNITEVFVTNPDEVLAYIEEGKTNRQVAVTNMNEHSSRSHSVFQIQVQQDNKT

SEQ ID NO: 122363 - protein, 205 aa, Heterodera glycines
  Homolog annotation: Hit_ID=CAE59719.1; Match level="QueryCoverage =74%, HitCoverage=29%, E-value=1e-32, Identity=47%"; Hit description =Hypothetical protein CBG03152 [Caenorhabditis briggsae]
  Gene Ontology: Mol. function=signal transducer activity; Cellular component=nucleus; Biological process=embryogenesis and morphogenesis
  Essential gene: C elegans homolog=K08F8.1a; Phenotype=Emb
  Coding regions on vcDNA: vcDNA=SeqID_48786; Strand=+; Position=1-615
DGRHGVFFRNDLFPYSSGSSPVASFRLAVHHSRAPSTCGKFNESLLGELANSATLQSSLCVCTSIRRTAAVVEEEEEATEGRKLKLKEHPVTDEYKVSHEIVGIGESGKVMACFHKRRGEKCALKVLRDNARSRRELALHLSVFGHPHVVSIEDMFENSFDGFKCLLVGVEFMGGREVLTIFEQNGRLGYSEKCVGRIVSQIGSG

SEQ ID NO: 122364 - protein, 105 aa, Heterodera glycines
  Homolog annotation: Hit_ID=XP_319892.1; Match level="QueryCoverage =100%, HitCoverage=86%, E-value=6e-22, Identity=48%"; Hit description= ENSANGP00000010639 [Anopheles gambiae]
  Gene Ontology: Biological process=positive regulation of growth rate
  Essential gene: C elegans homolog=B0334.5; Phenotype=Gro
  Coding regions on vcDNA: vcDNA=SeqID_48787; Strand=+; Position=1-318
LFWRILCSLSVLSLAHCAYSAAQHRSYLRLVGQPFTHLPADLTTQTLLSLLFAIVSASFVVGDFQPIRTDLLISKKSWDVLGNCPSFYVYNHRAKCLMPKFDDID

SEQ ID NO: 122365 - protein, 175 aa, Heterodera glycines
  Homolog annotation: Hit_ID=NP_741323.1; Match level="QueryCoverage =97%, HitCoverage=98%, E-value=1e-42, Identity=47%"; Hit description =CCHC type  zinc finger containing protein (15.6 kD) (4C475) [Caenorhabditis elegans] gb|AAK84542.1| Hypot
  Gene Ontology: Mol. function=RNA helicase activity; Cellular component=cytoplasm; Biological process=post-embryonic development
  Essential gene: C elegans homolog=K08D12.3a; Phenotype=Unc
  Coding regions on vcDNA: vcDNA=SeqID_48788; Strand=+; Position=86-613
MSANTECYRCHEFGHISRDCPNAGRSGGGGGGGGGSRGGGGETKCYNCGRSGHFARECRDAGDRDRGRGGGGGGGGRGGDDRGSKCYNCGGYGHFARECRDERSASGGGRGGRDDRDDRGNKCYNCGKSGHFSRECPEGSDRRGGGGGGRDRDDRRCYNCNEPGHMSRDCPKEAR

SEQ ID NO: 122366 - protein, 260 aa, Heterodera glycines
  Homolog annotation: Hit_ID=CAE70912.1; Match level="QueryCoverage =96%, HitCoverage=95%, E-value=1e-111, Identity=78%"; Hit description= Hypothetical protein CBG17709 [Caenorhabditis briggsae]
  Gene Ontology: Mol. function=structural constituent of ribosome; Cellular component=eukaryotic 48S initiation complex; Biological process=protein biosynthesis
  Essential gene: C elegans homolog=C49H3.11; Phenotype=Emb,Lva,Ste
  Coding regions on vcDNA: vcDNA=SeqID_48789; Strand=+; Position=30-812
MADRAGFQSGFGGAAPPSARGRGGPRGRGRGAARGRGRGKDAEKEWVPVTKLGRLVKDRKVLTIEEIYLHSLPIKEFEIIDLLLSGLKDEVLKIMPVQKQTRAGQRTRFKAFVAIGDHNGHVGLGVKCSKEVATAIRGAIIAAKLAIIPVRRGYWGNKIGKPHTVPCKVTGKCASVLVRLIPAPRGTGIVGAPVPKKLLQMAGIDDCYTSAVGQTATLGNFAKATYYAIQRTYSYLTPDLWKENELPRNPLDHIGGGGAQ

SEQ ID NO: 122367 - protein, 111 aa, Heterodera glycines
  Homolog annotation: Hit_ID=AAN05584.1; Match level="QueryCoverage =95%, HitCoverage=92%, E-value=1e-42, Identity=80%"; Hit description =ribosomal protein L30 [Argopecten irradians]
  Gene Ontology: Cellular component=cytosolic ribosome (sensu Eukarya); Biological process=protein biosynthesis
  Essential gene: C elegans homolog=Y106G6H.3; Phenotype=Emb,Lva
  Coding regions on vcDNA: vcDNA=SeqID_48790; Strand=+; Position=117-452
MAVGKQKKSAENINARLAMVTKSGKYCLGYKQALKTLRSGKAKLVIISSNTPTLRRSEVEYYAMLSKTGVHEYHGNNIELGTACGKLFRVSMLSITDPGDSDIIRTMPTEA

SEQ ID NO: 122368 - protein, 173 aa, Heterodera glycines
  Homolog annotation: Hit_ID=CAE71615.1; Match level="QueryCoverage =97%, HitCoverage=98%, E-value=2e-82, Identity=83%"; Hit description =Hypothetical protein CBG18577 [Caenorhabditis briggsae]
  Gene Ontology: Mol. function=peptidyl-prolyl cis-trans isomerase activity; Cellular component=membrane fraction; Biological process =protein folding
  Essential gene: C elegans homolog=Y75B12B.2; Phenotype=Emb
  Coding regions on vcDNA: vcDNA=SeqID_48791; Strand=+; Position=57-578
MSARPKVFFDVMVGGKSTGRIVMELFSDIVPKTAENFRALCTGEKGMGKSGKPLHYKGSKFHRVIPSFMLQGGDFTRGNGTGGESIYGEKFPDENFKEKHTVPGLLSMANAGPNTNGSQFFITTVKTEWLDGKHVVFGRVVEGMDVVKQVEAQGNQSGKTANEITIADCGQLS

SEQ ID NO: 122369 - protein, 164 aa, Heterodera glycines
  Homolog annotation: Hit_ID=CAE58998.1; Match level="QueryCoverage =95%, HitCoverage=23%, E-value=1e-34, Identity=52%"; Hit description =Hypothetical protein CBG02271 [Caenorhabditis briggsae]
  Essential gene: C elegans homolog=R05F9.1a; Phenotype=Unc
  Coding regions on vcDNA: vcDNA=SeqID_48792; Strand=+; Position=127-618
MPSHSSCHRNQRSMSLGGPAHESLLSKQHSSSPPQTVELSRADNGDCVVLVVENTRFIVNPALLVVKPDTMLGRMFSLRARTGGGTNTLSVPSSSSSANDPGADRGSPSDLVRPNERNEYDVAEGLSAACFRVVMDFYHRGFMHVPQSISVAELREACDYLLVP

SEQ ID NO: 122370 - protein, 263 aa, Heterodera glycines
  Homolog annotation: Hit_ID=NP_498349.1; Match level="QueryCoverage =91%, HitCoverage=97%, E-value=1e-102, Identity=75%"; Hit description= ribosomal Protein, Small subunit (27.3 kD) (rps-3) [Caenorhabditis elegans] gb|AAF99870.1| Ribosomal pro
  Gene Ontology: Mol. function=structural constituent of ribosome; Cellular component=eukaryotic 48S initiation complex; Biological process=protein biosynthesis
  Essential gene: C elegans homolog=C23G10.3; Phenotype=Emb
  Coding regions on vcDNA: vcDNA=SeqID_48793; Strand=+; Position=66-857
MAQQQAITKKRKAVQDGIFKAELNNFLMKELAEDGYSGVEVRRAPSRTEVIIMATRTQSVLGERGKRIRELTALVQKRFGYSAGQIELYAEKVSSRGLCAVAQCESLRYKLVGGLAVRRACYGVLRFIMESNARGCEIVVSGKLRGQRAKAMKFVDGVMIHSGNPVTEYIQEAVRHVQMRQGVLGIKVKIMLPHDPKGQMGPRNPLPDHIQVKEPPIDVAPTTPYSEHREPMTTGMPPQTQMPPAHQQQQLPMVGQVPPPAQF

SEQ ID NO: 122371 - protein, 110 aa, Heterodera glycines
  Homolog annotation: Hit_ID=NP_498111.2; Match level="QueryCoverage =99%, HitCoverage=20%, E-value=1e-48, Identity=88%"; Hit description =ATP synthase subunit (57.5 kD) (atp-2) [Caenorhabditis elegans] gb|AAA19068.2| Atp synthase subunit prote
  Gene Ontology: Mol. function=hydrogen-transporting ATP synthase activity, rotational mechanism; Cellular component=soluble fraction; Biological process=energy pathways
  Essential gene: C elegans homolog=C34E10.6; Phenotype=Emb
  Coding regions on vcDNA: vcDNA=SeqID_48794; Strand=+; Position=2-334
YDIARGVQKILQDYKSLQDIIAILGMDELSEDDKLTVSRARKIQRYLSQPFQVAEVFTGHKGKFVTLEQTIDGFESILKGEMDHIPEVAFYMQGAIDDVHKKADELAKQS

SEQ ID NO: 122372 - protein, 208 aa, Heterodera glycines
  Homolog annotation: Hit_ID=NP_499174.2; Match level="QueryCoverage =99%, HitCoverage=49%, E-value=7e-44, Identity=46%"; Hit description =mannose-6-phosphate isomerase, type I (46.4 kD) (3K896) [Caenorhabditis elegans]
  Gene Ontology: Mol. function=mannose-6-phosphate isomerase activity; Biological process=fructose 6-phosphate metabolism
  Essential gene: C elegans homolog=C05C8.7; Phenotype=Emb,Lva
  Coding regions on vcDNA: vcDNA=SeqID_48795; Strand=+; Position=3-626
MKRLECAVQHYAWGKSGKDSFVAHLLPAERVDLDKRYAELWMGTHPNGPSRVIDGGAEASTNLKDFLAQNPQLLGHHEKGELSFLFIILSVDKALSIQSHPTKEQAKVLHAKDPANYPDDNHKPEMAIALTDFELLCGFQTPHGIISNVKAHRELLQLVGEPLLDELAQAEHHEPDWGERALRRMFCQVWTSPAEQIAHVVAQIVDRI

SEQ ID NO: 122373 - protein, 151 aa, Heterodera glycines
  Homolog annotation: Hit_ID=CAA34603.1; Match level="QueryCoverage =100%, HitCoverage=100%, E-value=1e-71, Identity=87%"; Hit description=unnamed protein product [Brugia pahangi] sp|P62300|RS13 _WUCBA 40S ribosomal protein S13 (40S ribosomal p
  Gene Ontology: Mol. function=structural constituent of ribosome; Cellular component=cytosolic small ribosomal subunit (sensu Eukarya); Biological process=protein biosynthesis
  Essential gene: C elegans homolog=C16A3.9; Phenotype=Emb
  Coding regions on vcDNA: vcDNA=SeqID_48796; Strand=+; Position=42-497
MGRMHNPGKGISRSALPYRRSVPTWQKLTNQEVEEQIVKLARKGLRPSQIGVILRDSHGVAQVRRITGNKIVRILRSKGMAPEIPEDLYHLIKKAVSIRKHLERFRKDIDSKYRLILVESRIHRLARYFKTKRMLPPTWKYESATASALVS

SEQ ID NO: 122374 - protein, 185 aa, Heterodera glycines
  Homolog annotation: Hit_ID=AAH53777.1; Match level="QueryCoverage =100%, HitCoverage=100%, E-value=6e-58, Identity=61%"; Hit description=MGC64315 protein [Xenopus laevis]
  Gene Ontology: Cellular component=cytosolic ribosome (sensu Eukarya); Biological process=protein biosynthesis
  Essential gene: C elegans homolog=Y45F10D.12; Phenotype=Ste
  Coding regions on vcDNA: vcDNA=SeqID_48797; Strand=+; Position=17-571
MGIDIKNHHVKKTQRREAASRNPYLLLLVKLYKFLARRTDAGFNKVVLQRLVKSKIYKPPVSLSKLSVSMKGREDKIAVVVGPITDDNRFHEVPKLTVAALRFTESARARIVKAGGECLTLDQLALRAPTGANTVLLRGSRQRVALKHFGKAPGTPGSTASPYIRSKGRKFQRARGRRASRGYRN

SEQ ID NO: 122375 - protein, 218 aa, Heterodera glycines
  Homolog annotation: Hit_ID=XP_419990.1; Match level="QueryCoverage =96%, HitCoverage=56%, E-value=2e-81, Identity=66%"; Hit description =PREDICTED: similar to XPA binding protein 1; MBD2 interactor protein; putative ATP(GTP)-binding protein [
  Essential gene: C elegans homolog=C34E10.2; Phenotype=Emb
  Coding regions on vcDNA: vcDNA=SeqID_48798; Strand=+; Position=12-665
MADDKSCDGASSALPPCLIVLGMAGSGKSSFVQRLASHLHSKKVFPYLVNLDPAAATVPFPANIDIRDTVNYKKVMQEYGLGPNGAILTSLNLFCTRFNQVLDLLDRQKGSMPYAIFDTPGQIEVFTWSASGTVITDSLAASFPTVVAYVMDSARSTNPTTFMSNMLYACSILYQTKLPFFVVLNKSDVVDPAFAVEWMKDFEQFQTALDQNSSSFMN

SEQ ID NO: 122376 - protein, 184 aa, Heterodera glycines
  Homolog annotation: Hit_ID=CAE66979.1; Match level="QueryCoverage =84%, HitCoverage=91%, E-value=8e-31, Identity=44%"; Hit description =Hypothetical protein CBG12375 [Caenorhabditis briggsae]
  Gene Ontology: Biological process=positive regulation of embryonic development
  Essential gene: C elegans homolog=F36A2.7; Phenotype=Emb,Lva
  Coding regions on vcDNA: vcDNA=SeqID_48799; Strand=+; Position=38-592
MVVLSKLGSPLRPFSNDYLLCRFQAFRNYAIKKERPPPAKIQVPPPANETGHWKYERDYSYDLRYSNPINKYSSFTRFITLTATGHKELWALFALLMLSSSLAIGIVFYSLGKIEVWVDRSTSTPPWDWARVRDKYWKFPTVLYDPTGITHVRLSPMEKLQDEMLEAAKERGTRDAKGYWVGKQ

SEQ ID NO: 122377 - protein, 177 aa, Heterodera glycines
  Homolog annotation: Hit_ID=NP_080173.1; Match level="QueryCoverage =96%, HitCoverage=37%, E-value=7e-40, Identity=47%"; Hit description =RIKEN cDNA 1500003O22 [Mus musculus] gb|AAH46799.1| RIKEN cDNA 1500003O22 [Mus musculus] gb|AAH22923.1| R
  Gene Ontology: Biological process=rRNA processing
  Essential gene: C elegans homolog=T07A9.8; Phenotype=Gro
  Coding regions on vcDNA: vcDNA=SeqID_48800; Strand=+; Position=1-531
AESEGAKGDGTEAEGSDRSPLLTSVDVSRFRFLNERLCSQTSASSAKLFEEDPDSFRLYHRGYRHQVSKWPVNPLEKIVLDLGSLPPGSVVADLGCGDAEIAKRLGERLRVHSFDLVASNERVLAADMADLPLEAESVDVCVYCLSVMGNNLAQFFREAHRVLKTHGKIQIGQITKR

SEQ ID NO: 122378 - protein, 123 aa, Heterodera glycines
  Homolog annotation: Hit_ID=AAK92166.1; Match level="QueryCoverage =98%, HitCoverage=97%, E-value=5e-53, Identity=80%"; Hit description =ribosomal protein L31 [Spodoptera frugiperda] emb|CAC19413.1| ribosomal protein L31 [Heliothis virescens]
  Gene Ontology: Mol. function=structural constituent of ribosome; Cellular component=cytosolic ribosome (sensu Eukarya); Biological process=protein biosynthesis
  Essential gene: C elegans homolog=W09C5.6a; Phenotype=Emb,Ste,Stp
  Coding regions on vcDNA: vcDNA=SeqID_48801; Strand=+; Position=24-395
MAKQKGEKKGKSALNKVVTREYTIHLHKRIHGIGFKNRAPRAIKEVKKFAEQQMGTPDVRVDTRLNKFLWSRGVRNVPFRVRVRLSRRRNDDEDSPHKLYTLVTHVPVTSFKRLTTVNVESED

SEQ ID NO: 122379 - protein, 159 aa, Heterodera glycines
  Homolog annotation: Hit_ID=NP_508542.1; Match level="QueryCoverage =71%, HitCoverage=88%, E-value=3e-28, Identity=56%"; Hit description =putative nuclear protein, with a coiled coil-4 domain (15.0 kD) (XD770) [Caenorhabditis elegans] gb|AAK39
  Essential gene: C elegans homolog=C15C7.5; Phenotype=Unclassified
  Coding regions on vcDNA: vcDNA=SeqID_48802; Strand=+; Position=163-642
MHSKDIKEKGGQQIGGQGEVGEGGTAENGQQRQNRGQSADAGALPQRTMGALYEMTPELENNQDEIRKLDSQLDHLNDYMDRVEERLKTHNDKLMETLRQQREDREKRRRSFHERLEQSRQEDDDFQQQLSSVLSRVDSVRSKKTEPKVKLEGDQLSSN

SEQ ID NO: 122380 - protein, 98 aa, Heterodera glycines
  Homolog annotation: Hit_ID=XP_509802.1; Match level="QueryCoverage =91%, HitCoverage=72%, E-value=2e-38, Identity=80%"; Hit description =PREDICTED: similar to ribosomal protein S27 [Pan troglodytes]
  Essential gene: C elegans homolog=F56E10.4; Phenotype=Lva
  Coding regions on vcDNA: vcDNA=SeqID_48803; Strand=+; Position=3-299
SCRIRHEDFSHTNEMPLAEDLLYPDPQKERQKHKLKRLVQHPNSFFMDVKCPGCYKITTVFSHAQTVVVCVGCSTVLCQPTGGKARLVEGCSFRKKGH

SEQ ID NO: 122381 - protein, 208 aa, Heterodera glycines
  Homolog annotation: Hit_ID=NP_498646.1; Match level="QueryCoverage =94%, HitCoverage=45%, E-value=3e-88, Identity=80%"; Hit description =rna helicase, Conserved Germline Helicase CGH-1 (48.7 kD) (cgh-1) [Caenorhabditis elegans] gb|AAK85443.1|
  Gene Ontology: Mol. function=RNA helicase activity; Cellular component=cytoplasm; Biological process=anti-apoptosis
  Essential gene: C elegans homolog=C07H6.5; Phenotype=Emb
  Coding regions on vcDNA: vcDNA=SeqID_48804; Strand=+; Position=44-667
MSAAVSSSRPMEDWKSELAMPDKDLRYKTSDVTATKGVEFEEFGLTRDLLKGIFEKGWEHPSPVQEASIGIALTGQDILARAKNGTGKTGAYCIPCIEKIDPSKEYIQAMIIVPTRELALQTSQICVELSKHLKIKIMVTTGGTDLRDDILRLNGIVHLVVATPGRILDLMEKGVANVAYCKTIVLDEADKLLSQDFQGVLDRLVQFL

SEQ ID NO: 122382 - protein, 193 aa, Heterodera glycines
  Homolog annotation: Hit_ID=CAE64489.1; Match level="QueryCoverage =79%, HitCoverage=15%, E-value=3e-22, Identity=32%"; Hit description =Hypothetical protein CBG09214 [Caenorhabditis briggsae]
  Gene Ontology: Mol. function=chromatin binding; Cellular component =nucleus; Biological process=embryogenesis and morphogenesis
  Essential gene: C elegans homolog=F34D10.2; Phenotype=Emb
  Coding regions on vcDNA: vcDNA=SeqID_48805; Strand=+; Position=71-649
MLIQENFRLQFYEPIRREHSLIVTNTDVDSLCATNILTHIFSCDDASYTLSPVDSFPTLEKAINDHVRQAKNIVLVNCIGSRSVSELSIARLTDEVTFWVLESRRPLNLEDIYNANSVRVLAPAAEVAEWTLPEASAIFETMVEQEDEDDDDEASDGDEENRPPSDDREEAEDGEAAMAGDSDRESDEEDSNG

SEQ ID NO: 122383 - protein, 501 aa, Heterodera glycines
  misc_feature (403)..(403): Xaa can be any naturally occurring amino acid
  Homolog annotation: Hit_ID=CAE60648.1; Match level="QueryCoverage =91%, HitCoverage=91%, E-value=1e-123, Identity=51%"; Hit description= Hypothetical protein CBG04294 [Caenorhabditis briggsae]
  Gene Ontology: Mol. function=proteasome endopeptidase activity; Cellular component=proteasome regulatory particle (sensu Eukarya); Biological process=proteolysis and peptidolysis
  Essential gene: C elegans homolog=F10G7.8; Phenotype=Emb
  Coding regions on vcDNA: vcDNA=SeqID_48806; Strand=+; Position=19-1522
MDPFHRNEAKVEVAVEPPTAIDQRVDDIMQTGRFGDGRLVKMEVDYSAQVDSQLIVADNLAKEGKTAEAIESLEKLEKDRRINCDMRSNQRLLCHMVKLAFDANNWQLLCETAKTLCKKRLLIKSSIKKMVQECCEMVPKAPDASSKSTLIDTLRAVTAGKIYLEVERARLTKQVAEKLEAEGKLDEAREMMMELQVETYGTMEVEEKVNYLLHQMRLSIANNHFTRASIISRKISTKFFEREGTQVQLMKLEFYKYMVQIGLSENNYLDVCKHFLAILNTPQIQENNVKKIEILKCVVFYLLLSAHDNEKWELLHRVNAMRELEQIPKHKELLELFIHQELIFWSKTIESEFAPILFAAQPPVEVISDSFLPSTHVFPMTKEDGQKRRERLHDCVGEHNVRXMVAKYYSRITFQRMAKLLEFGIEQMEAFVCKMIVDGVIPEVKIHRPSQIIYLSPKKNGAEVLDEWVFNVRKLTDTMNKVSQLIAKEEMVHGLQISQRI

SEQ ID NO: 122384 - protein, 216 aa, Heterodera glycines
  Homolog annotation: Hit_ID=AAL78213.1; Match level="QueryCoverage =98%, HitCoverage=85%, E-value=1e-112, Identity=96%"; Hit description= probable protein kinase Hgg-20 [Heterodera glycines]
  Gene Ontology: Mol. function=casein kinase I activity; Biological process=glia cell migration
  Essential gene: C elegans homolog=R90.1; Phenotype=Lva,Unc
  Coding regions on vcDNA: vcDNA=SeqID_48807; Strand=+; Position=45-692
MADELVALAPGTRVSGRWTILKKLGAGAFGAVYLCKDGKGTVAALKTEPIDTRQPLLVMEATVLDTLGKKLKNADGQHFCRLLDLGRSEQRNATSGDTVFNYVVMTVVGTPLDKLIRNAGDRFSPGTAIGMSIQLLSAIKALHNVGFLHRDIKPANTAIGRAETNEHRLLYLIDFGMARQFLRPDGTQRRPRASANFRGTPIYAPISAHIKRDYSR

SEQ ID NO: 122385 - protein, 344 aa, Heterodera glycines
  misc_feature (191)..(191): Xaa can be any naturally occurring amino acid
  Homolog annotation: Hit_ID=CAE74484.1; Match level="QueryCoverage =99%, HitCoverage=98%, E-value=1e-134, Identity=69%"; Hit description= Hypothetical protein CBG22235 [Caenorhabditis briggsae]
  Gene Ontology: Mol. function=structural constituent of ribosome; Cellular component=cytosolic large ribosomal subunit (sensu Eukarya); Biological process=protein biosynthesis
  Essential gene: C elegans homolog=B0041.4; Phenotype=Emb,Ste
  Coding regions on vcDNA: vcDNA=SeqID_48808; Strand=+; Position=34-1063
MASRPLVSIYNEKNEPTGKQIKLPAVFRAPIRPDIVSFIHDQIRKNKRQAYAVSTAAGHQTSAESWGTGRAVARIPRVRGGGTHRSGQGAFGNMCRGGRMFAPTKVYRRWHRRVNVAQRRYAIVSAIAASAVPALVQARGHVIDQLNEIPLVISDKIESFTKTKEAVGFLQRAHLWDDVEKVYKSKRFRAXGKGKRRNRRYKQKLGPLVIYNNDGGIVRAFRNVPGVTLLSVSHLNLLKIAPGGHLGRLVVWTESAFRQLDPLFGTWTRQSNVKKGFTLPRAKMTNSDFARIIRSEEITKVLRPTMARKVRRVAKIHGNPLKKPSLMAKLNPYAAVLRRAAVLA

SEQ ID NO: 122386 - protein, 115 aa, Heterodera glycines
  Essential gene: C elegans homolog=T07C12.11; Phenotype=Unclassified
  Coding regions on vcDNA: vcDNA=SeqID_48809; Strand=+; Position=256-600
MIEDAIASAINGGGSATVADIALLRNGRLSGASSVVAAGANDDFVRRLVDVVRREPALYDPSHEHYGNRHASTHFRTAIWQRLCKELDYPDDPQALQKQWKSIRDKYIKEKKRRK

SEQ ID NO: 122387 - protein, 271 aa, Heterodera glycines
  Homolog annotation: Hit_ID=CAE56261.1; Match level="QueryCoverage =90%, HitCoverage=75%, E-value=1e-67, Identity=53%"; Hit description =Hypothetical protein CBG23904 [Caenorhabditis briggsae]
  Essential gene: C elegans homolog=F56B3.8; Phenotype=Gro
  Coding regions on vcDNA: vcDNA=SeqID_48810; Strand=+; Position=18-830
MLRNLSKFGTILNGVADPLSALVVPSAAAGDASSLLLPCSAGAVQRQSRRWGFPRGHKHPPRLFFDFAHLKQITGGEYTTKPLQINRLGGRCPITRKKLCIHIGGGVKFDYFMLNLHPRGPTVADETYDERVIEVRRDPNRTPYIALVAGVKGKRWIYATQNMQAGQIIQTTCHIPERPVIGCEGNSYPLGALVEGTMVNSIELHRNNPNSHVVITEAGGCAEIIRHMDEFTVVRMPNKYEYAVRKECMAVVGKLSHVDWDKKHWGSAQMH

SEQ ID NO: 122388 - protein, 200 aa, Heterodera glycines
  Homolog annotation: Hit_ID=NP_502033.2; Match level="QueryCoverage =67%, HitCoverage=10%, E-value=3e-17, Identity=34%"; Hit description =ortholog of Glued p150, DyNactin Complex component DNC-1 (148.4 kD) (dnc-1) [Caenorhabditis elegans] emb|
  Essential gene: C elegans homolog=ZK593.5; Phenotype=Clr,Emb,Rup,Sck
  Coding regions on vcDNA: vcDNA=SeqID_48811; Strand=+; Position=2-601
ELPPSAKDGDPTRNGSPLTINGNPFVPLNERAYGRKKEAVEADGIRWQLAKKDEELLNLQKALKERDSEIGTMKLRVEMAKTQLAETTGKGGISVEMELLRQRCTGLENDLKRQKDEYEQQLDQLRQQLAEEHNRTREFSKKALFANMQNQQQQAAASALTMNASPGSVSASPLSRVGSSSGASTMGATDTTHGAASDVS

SEQ ID NO: 122389 - protein, 127 aa, Heterodera glycines
  Homolog annotation: Hit_ID=CAE64456.1; Match level="QueryCoverage =86%, HitCoverage=88%, E-value=4e-21, Identity=49%"; Hit description =Hypothetical protein CBG09169 [Caenorhabditis briggsae]
  Gene Ontology: Mol. function=protein phosphatase inhibitor activity; Cellular component=soluble fraction
  Essential gene: C elegans homolog=C07H6.2; Phenotype=Gro
  Coding regions on vcDNA: vcDNA=SeqID_48812; Strand=+; Position=48-431
MRQSPNQTPVTRTTTTTITEQQREGGGDQQTNSEQFVLRLEAPPDTRPRVQWSTGTVDNENMGKKKSKCCCIYKKKRSWDDPNASSEDDDGECESSHCRGHVEKQRKPPPSDDGNGGGGPGPSSIST

SEQ ID NO: 122390 - protein, 211 aa, Heterodera glycines
  Homolog annotation: Hit_ID=NP_491593.1; Match level="QueryCoverage =93%, HitCoverage=95%, E-value=9e-55, Identity=53%"; Hit description =ATP synthase mitochondrial (22.4 kD) (1F996) [Caenorhabditis elegans] gb|AAB37654.1| Hypothetical protein
  Gene Ontology: Mol. function=hydrogen-transporting ATP synthase activity, rotational mechanism; Cellular component=mitochondrion; Biological process=growth
  Essential gene: C elegans homolog=F27C1.7a; Phenotype=Emb,Lva
  Coding regions on vcDNA: vcDNA=SeqID_48813; Strand=+; Position=8-640
INLKASMLIKRAFSFSSRALQQHSVVRPPVQVTGIEGKYASALYSSGIKEKKLENIEKELRQVKELYDTNKEFKSFIDNPILNKQKKKEAVEDVLKKQGVSQQVQNFFGLLAENGRINKLTGVVSSFETIMRAHRGELHVEVASAEPLDKKHEQSLNDALQKFATRGQKLNLTFTVKPDLVGGLVVNIGDKYIDLSMATRLKKMDAVVKGS

SEQ ID NO: 122391 - protein, 310 aa, Heterodera glycines
  Homolog annotation: Hit_ID=CAE59414.1; Match level="QueryCoverage =100%, HitCoverage=40%, E-value=1e-110, Identity=61%"; Hit description=Hypothetical protein CBG02783 [Caenorhabditis briggsae]
  Gene Ontology: Mol. function=translation elongation factor activity; Cellular component=mitochondrion; Biological process=translational elongation
  Essential gene: C elegans homolog=F29C12.4; Phenotype=Lva
  Coding regions on vcDNA: vcDNA=SeqID_48814; Strand=+; Position=3-932
LVEELAFFNEVEDGSVLRKEEIPQEYREEAKILRQELLENLANCDDVIAECYLNEVTPSVKEIKEAIRRATIKRSFVPVLVGSALKNKGVQQMIDAIVHYLPNPSEVDNFVNLYDKNDNAERVLMDPLRTANSEKQKPFIGLAFKLEAGNFGQLTYFRIYQGRLVKGDTIYATRDGRKVRIQRLVRMHANTMEDVDVAYAGDICATFGVDCFSGETFCSDEQLRVHCESMHIPDPVISMSIKPIGKRDMENYLRALKRFAKEDPTFKLCYSKEHKETVVSGMRELHLEIYAQRMGNEYNCPVELGRPTVS

SEQ ID NO: 122392 - protein, 198 aa, Heterodera glycines
  Homolog annotation: Hit_ID=NP_503397.1; Match level="QueryCoverage =100%, HitCoverage=96%, E-value=2e-94, Identity=87%"; Hit description= RAB family member (22.5 kD) (rab-1) [Caenorhabditis elegans] gb|AAC69218.1| Rab family protein 1 [Caenor
  Gene Ontology: Mol. function=RAB small monomeric GTPase activity; Cellular component=endoplasmic reticulum membrane; Biological process=signal transduction
  Essential gene: C elegans homolog=C39F7.4; Phenotype=Ste
  Coding regions on vcDNA: vcDNA=SeqID_48815; Strand=+; Position=57-650
MAAMNPEYDYLFKLLLIGDSGVGKSCLLLRFADDTYTESYISTIGVDFKIRTIELEGKTIKLQIWDTAGQERFRTITSSYYRGAHGIIVVYDITDQDSFNNVKQWLQEIDRYASESVNKLLVGNKCDLTTKRAIETNVAKEYADQLNIPFLETSAKNSTNVEQAFITMATEIKNRMGPLQQAGGNASAVRIGPSQPVQ

SEQ ID NO: 122393 - protein, 291 aa, Heterodera glycines
  Homolog annotation: Hit_ID=CAA79619.2; Match level="QueryCoverage =95%, HitCoverage=69%, E-value=5e-42, Identity=35%"; Hit description =Hypothetical protein F02A9.4b [Caenorhabditis elegans] sp|P34384|YLPD_CAEEL Hypothetical protein F02A9.4b
  Essential gene: C elegans homolog=F02A9.4b; Phenotype=Lva
  Coding regions on vcDNA: vcDNA=SeqID_48816; Strand=+; Position=14-886
MLSKCLRSSIFGCFNCALQNVSSAAVLMNSVRHAGTAEHWRRAYLKDLYNRRQMVGPEPLRGRASEDNWNYPSEISALSHRLHIPDMDNALIVQALTDKSYFTRNDLDDEAMGDDGPLTTEVARDKSNDQLVEKGMPLFRHIVLTYLRAHWPLAPEEFIIAVATRIAPTSALAELATQLGLHHVVRTAEFPPTQQTLQSTLLALVGAMDVAKARDFVRRFVLPRLYEVPLEDVLPFRHPFAVLGDYLRTWQGATDIQPRTIGSGAVMKATPFYQGADYVDKQQIVGPSGGE

SEQ ID NO: 122394 - protein, 132 aa, Heterodera glycines
  misc_feature (18)..(18): Xaa can be any naturally occurring amino acid
  Homolog annotation: Hit_ID=BAC25377.1; Match level="QueryCoverage =93%, HitCoverage=86%, E-value=4e-44, Identity=69%"; Hit description =unnamed protein product [Mus musculus]
  Gene Ontology: Mol. function=structural constituent of ribosome; Cellular component=cytosolic small ribosomal subunit (sensu Eukarya); Biological process=protein biosynthesis
  Essential gene: C elegans homolog=T08B2.10; Phenotype=Lva
  Coding regions on vcDNA: vcDNA=SeqID_48817; Strand=+; Position=40-439
MVGRVRTKTVKKASRVIXEKYYTKLTNDFHTNKRICEEVAIVPSKKMRNRIAGFITHLMKRIERGPVRGISIKLQEEERERRDNYMPEISYLDAQNHQTISTDQETKDMIEYLGLGLNLEVKGPVPTGAGRR

SEQ ID NO: 122395 - protein, 133 aa, Heterodera glycines
  Homolog annotation: Hit_ID=NP_492601.1; Match level="QueryCoverage =90%, HitCoverage=91%, E-value=6e-37, Identity=56%"; Hit description =cytochrome C Oxidase, subunit Vb, LiPid Depleted LPD-4 (lpd-4) [Caenorhabditis elegans] emb|CAB03002.1| H
  Gene Ontology: Cellular component=extracellular space; Biological process=negative regulation of FGF receptor signaling pathway
  Essential gene: C elegans homolog=F26E4.9; Phenotype=Lpd
  Coding regions on vcDNA: vcDNA=SeqID_48818; Strand=+; Position=58-459
MTMNRLLPGRSLLPKIMRNFSHSNRLAASEADPEHYGYFPDPTEQTWGLEREMLAARLKGEDRYSPKIYYRAEHSTKDVPNVVRVHLEDKVVGCLCEHDGDHVNYWHIRKGDTKRCECGHWFKGVQADTDSFD

SEQ ID NO: 122396 - protein, 253 aa, Heterodera glycines; identical to SEQ ID NO: 120924
  Homolog annotation: Hit_ID=CAE67980.1; Match level="QueryCoverage =85%, HitCoverage=89%, E-value=2e-46, Identity=44%"; Hit description =Hypothetical protein CBG13586 [Caenorhabditis briggsae]
  Gene Ontology: Mol. function=endopeptidase activity; Cellular component=proteasome core complex (sensu Eukarya); Biological process=sporulation (sensu Saccharomyces)
  Essential gene: C elegans homolog=K08D12.1; Phenotype=Emb,Lva,Unc
  Coding regions on vcDNA: vcDNA=SeqID_48819; Strand=+; Position=43-804

SEQ ID NO: 122397 - protein, 209 aa, Heterodera glycines
  Homolog annotation: Hit_ID=NP_496549.1; Match level="QueryCoverage =99%, HitCoverage=99%, E-value=4e-92, Identity=78%"; Hit description =RAB family member (23.4 kD) (rab-7) [Caenorhabditis elegans] emb|CAA91357.1| Hypothetical protein W03C9.3
  Gene Ontology: Mol. function=ATP binding; Cellular component=Golgi apparatus; Biological process=embryogenesis and morphogenesis
  Essential gene: C elegans homolog=W03C9.3; Phenotype=Unclassified
  Coding regions on vcDNA: vcDNA=SeqID_48820; Strand=+; Position=55-684
MSSPRKKILLKVIILGDSGVGKTSLMNQYVNKRFSNQYKATIGADFLTKDVMIDDRLVTMQIWDTAGQERFQSLGVAFYRGADCCVLVYDVTHAPSFKSLESWRDEFLVQASPRDPEHFPFVLLGNKIDNDAARAVNAKRAQSWCQSKNGMPYFEVSARDGVNVEEAFQAIARAALARDSQETHDFPEFPDQIRLDQSRNGRQQNSSCC

SEQ ID NO: 122398 - protein, 190 aa, Heterodera glycines
  Homolog annotation: Hit_ID=CAE67904.1; Match level="QueryCoverage =58%, HitCoverage=35%, E-value=4e-27, Identity=50%"; Hit description =Hypothetical protein CBG13501 [Caenorhabditis briggsae]
  Gene Ontology: Mol. function=purine-nucleoside phosphorylase activity; Biological process=DNA modification
  Essential gene: C elegans homolog=K02D7.1; Phenotype=Unc
  Coding regions on vcDNA: vcDNA=SeqID_48821; Strand=+; Position=47-616
MASIVDSAKVNNFGIGTVVEPILVNKNGSTGGGGRRKNKTLFGISQAVHAEHPQQQLSEFAGGISPVDAVPMPTAANDCNNNSIEDIQSDRRRGPIDPTNFDHLVRLSELIRSMADLGTLQPEFGIICGSGLGAIADQMEGARILPFSEVPGFPQPSVIGHKGNLVFGRIGGHFCMCLQGRFHPYEHKMD

SEQ ID NO: 122399 - protein, 199 aa, Heterodera glycines
  Homolog annotation: Hit_ID=NP_508413.1; Match level="QueryCoverage =95%, HitCoverage=96%, E-value=5e-89, Identity=82%"; Hit description =ribosomal Protein, Large subunit (22.8 kD) (rpl-11.2) [Caenorhabditis elegans] gb|AAA83599.1| Ribosomal p
  Gene Ontology: Mol. function=structural constituent of ribosome; Cellular component=mitochondrion; Biological process=protein biosynthesis
  Essential gene: C elegans homolog=F07D10.1; Phenotype=Lva
  Coding regions on vcDNA: vcDNA=SeqID_48822; Strand=+; Position=30-629
MTKAEQAAEKKEKKLGNPMRDLKIQKLCLNICVGESGDRLTRAAKVLEQLTGQTPVLSKARYTVRSFGIRRNEKIAVHCTVRGPKAEEIIDRGLKVKEYELYRENFSDTGNFGFGIQEHIDLGIKYDPSIGIYGMDFYVVLGRAGLRVAKRRRIQGRIGASHRVQKEEAVKWFQQKYDGVILPPKPKESRKGGHRGRKR

SEQ ID NO: 122400 - protein, 610 aa, Heterodera glycines
  Homolog annotation: Hit_ID=CAA52188.1; Match level="QueryCoverage =99%, HitCoverage=99%, E-value=1e-92, Identity=34%"; Hit description =lamin [Caenorhabditis elegans] pir||S42257 lamin - Caenorhabditis elegans
  Gene Ontology: Mol. function=protein binding; Cellular component =lamin filament; Biological process=pronuclear envelope synthesis
  Essential gene: C elegans homolog=DY3.2; Phenotype=Emb
  Coding regions on vcDNA: vcDNA=SeqID_48823; Strand=+; Position=33-1865
MASKSKRTTRSQREAAIHIDASADETIESSSNGSTINSSSGHLSSRQDEKNHLCNLNDRLAGYIERVRSLETENARLQIQVREVEVVERKEKENLSARYEIKIDELRKQLEFFTREKAKLQIESDKAQSGFEELKARVGKLEKDLRKAEKERTAAQADVQELTARFNNTDTALGNAEREIEQLRNEFNNSENMVDMLRRQLEDEVLLRTELENRLHTAKDDLDFARRSHSNQIEEIRRKRQVEMTSFSDEVEHRYQAKLQEQLQAMRDDFDNRIAQNRAEVDELYRNKLGEAAENANRNRDLAAKAREEAAMWRVRVQDLENSSKDHQGIVESLNRRVKDLEAALRRAHEDADIRIQQRDEQIEQLQKEIALMISDYQDLLDVKVQLDTELQAYQKMLEQEETRLHITPSTSPNTSVVGQNISTPNMVISTPRPVSPRLATPVTQSESLTTVRRGVKRRRLNQDDIVSFDKTSSSWKSNGHSNGNLVIGEVDKEGQYVSVINKGKEDVAVGNWTLKSSAGGREVQYKFHSRQTVKAGKTLMVWSTNSGQEHQPPNNLVFKNQQWPHDDAIRTELLNADREVEAWNEAFLQHSFSSRVEEGTDIDKNCRIM

SEQ ID NO: 122401 - protein, 211 aa, Heterodera glycines
  Homolog annotation: Hit_ID=AAL78223.1; Match level="QueryCoverage =94%, HitCoverage=83%, E-value=1e-102, Identity=95%"; Hit description= hypothetical protein Hgg-29 [Heterodera glycines]
  Essential gene: C elegans homolog=ZC373.5; Phenotype=Unc
  Coding regions on vcDNA: vcDNA=SeqID_48824; Strand=+; Position=8-640
MRDLFIEDNSPITPARLAELIRHFYALGWMRDNGGGMAVLCNGAVFGSPTSVQKEKVSENDLFVIDATTGTVLKRPQNAASVPSATCGLLMNTGLNCVIHTHSKYANLVSQLVTGNEFAIQNQEMIQGVENRSSGLRLDNVDRLVVPIVDSELNEQMLSPVLLRTLDKYTEASAILVRGHGFFVFGSHCWQSTKMMLECYEYLFELACEMI

SEQ ID NO: 122402 - protein, 198 aa, Heterodera glycines
  Homolog annotation: Hit_ID=NP_491754.1; Match level="QueryCoverage =99%, HitCoverage=23%, E-value=2e-61, Identity=66%"; Hit description =HAlF transporter, PGP related (90.8 kD) (haf-9) [Caenorhabditis elegans] gb|AAK39394.1| Half transporter
  Gene Ontology: Mol. function=ATP-binding cassette (ABC) transporter activity; Cellular component=integral to membrane; Biological process=positive regulation of growth rate
  Essential gene: C elegans homolog=W04C9.1; Phenotype=Gro
  Coding regions on vcDNA: vcDNA=SeqID_48825; Strand=+; Position=1-594
IKLALVGQEPILFARSVAENIAYGLERCTIVDVVEAAKMANAHTFIQQTRDQYETNVGEKGSQMSGGQKQRIAIARALVRRPAILLLDEATSALDTESEHLVQEAIYKNLKGRSVILIAHRLSTVEKADKIVVISRGRLEQIGTHEQLLAQEGMYRSLVQRQMISVGDNGSELEMAGEVPTEGQEETLSGDGTDGAAR

SEQ ID NO: 122403 - protein, 211 aa, Heterodera glycines
  Homolog annotation: Hit_ID=NP_510553.1; Match level="QueryCoverage =90%, HitCoverage=41%, E-value=1e-53, Identity=55%"; Hit description =kynurenine aminotransferase (49.6 kD) (XQ61) [Caenorhabditis elegans] emb|CAA93673.2| Hypothetical protei
  Gene Ontology: Mol. function=arylformamidase activity; Biological process=nitrogen metabolism
  Essential gene: C elegans homolog=F28H6.3; Phenotype=Unclassified
  Coding regions on vcDNA: vcDNA=SeqID_48826; Strand=+; Position=50-682
MRHSAYFVERKFRLISFHFLRRVLSTSAMPTKPSRHSPSKIVHGAGKSIWVEFTALAVECNAVNLGQGFTDSPMPDFLTRHLADIGKSPERTDFHQYTRGYGHPRLVSVLAKLYSRLLSVSVDAQSEVLITVGAYLSLYYAFMGWLNAGDEAIIFEPAYDSYVSQIKMAGGIPVPVVLELDPEARGSSGYRLDMEVVRSKVTDRTKMIVIN

SEQ ID NO: 122404 - protein, 111 aa, Heterodera glycines
  Homolog annotation: Hit_ID=AAN05584.1; Match level="QueryCoverage =95%, HitCoverage=92%, E-value=1e-42, Identity=80%"; Hit description =ribosomal protein L30 [Argopecten irradians]
  Gene Ontology: Cellular component=cytosolic ribosome (sensu Eukarya); Biological process=protein biosynthesis
  Essential gene: C elegans homolog=Y106G6H.3; Phenotype=Emb,Lva
  Coding regions on vcDNA: vcDNA=SeqID_48827; Strand=+; Position=41-376
MAVGKQKKSAENINARLGMVTKSGKYCLGYKQSLKTLRSGKAKLVIISSNTPSLRRSEIEYYAMLSKTGVHEYHGNNIELGTACGKLFRVSMLSITDPGDSDIIRSMPTEA

SEQ ID NO: 122405 - protein, 89 aa, Heterodera glycines
  Homolog annotation: Hit_ID=XP_311506.1; Match level="QueryCoverage =94%, HitCoverage=93%, E-value=9e-30, Identity=72%"; Hit description =ENSANGP00000022836 [Anopheles gambiae]
  Essential gene: C elegans homolog=Y49E10.15; Phenotype=Emb
  Coding regions on vcDNA: vcDNA=SeqID_48828; Strand=+; Position=39-308
MAPPTNKVQKVMVQPINLIFRCLQSRSRIQIWLYENASSRIEGYIIGFDEYMNVVIDEAEEVQLKSLNRHKLGRILLKGDNITLIQTIQ

SEQ ID NO: 122406 - protein, 170 aa, Heterodera glycines
  Homolog annotation: Hit_ID=NP_501688.1; Match level="QueryCoverage =77%, HitCoverage=87%, E-value=1e-38, Identity=58%"; Hit description =nadh dehydrogenase 1 alpha subcomplex 5 (17.3 kD) (4K286) [Caenorhabditis elegans] emb|CAA92789.1| Hypoth
  Gene Ontology: Mol. function=NADH dehydrogenase (ubiquinone) activity
  Essential gene: C elegans homolog=C33A12.1; Phenotype=Lva
  Coding regions on vcDNA: vcDNA=SeqID_48829; Strand=+; Position=20-532
MLQRLFVGKNFTCLPLFTSHRNYPGSNFTFPIDWYENKYVLLHQRAREKVSPDFHKQTTGLNGLYVNENPHKDLRLLYHRILRVIGMIPDSSQYRMAVEEIVKHRLSLVEAEPDIQQLEQKIGMGQIEEVVQQAEYELECIRLFVAHKCWEPLVEKADEAQWRWPIGPGP

SEQ ID NO: 122407 - protein, 207 aa, Heterodera glycines
  Homolog annotation: Hit_ID=P46436; Match level="QueryCoverage=99%, HitCoverage=98%, E-value=6e-39, Identity=42%"; Hit description =Glutathione S-transferase 1 (GST class-sigma) gb|AAB30767.1| glutathione S-transferase, AsGST1 [Ascaris suum,
  Gene Ontology: Mol. function=glutathione transferase activity; Biological process=glutathione conjugation reaction
  Essential gene: C elegans homolog=R05F9.5a; Phenotype=Unclassified
  Coding regions on vcDNA: vcDNA=SeqID_48830; Strand=+; Position=36-659
MVQYKLYYFDGRGLGESIRLLLHYVGQPFEDIRIKDMEEWEKTYKPKFFYGKVPVLEVDGKPLGQSATILRYLAEKFGLAGKDECEKAKANEIIDFQKDANTDLAPYLYVKMGFRQGDLDKLRAEVFEPGVKHILPLFEKLLKESGSGYMLKSGLSMVDFQVANFLYTFTKLEPETINAFPELIKYVDRVHALPQLQQYLKQRPQDR

SEQ ID NO: 122408 - protein, 277 aa, Heterodera glycines
  Homolog annotation: Hit_ID=NP_741269.1; Match level="QueryCoverage =98%, HitCoverage=50%, E-value=1e-76, Identity=54%"; Hit description =coronin (67.1 kD) (cor-1) [Caenorhabditis elegans] emb|CAA83461.1| Hypothetical protein R01H10.3a [Caenor
  Gene Ontology: Mol. function=structural molecule activity; Cellular component=actin filament; Biological process=cell organization and biogenesis
  Essential gene: C elegans homolog=Y76A2B.1; Phenotype=Emb
  Coding regions on vcDNA: vcDNA=SeqID_48831; Strand=+; Position=3-836
PPYVHYINTHTTSEPQRGFAFMPKRGMNSLENEINRIYKVTTKGVVDILQFFVPRKSDLWQADLYPDTRSLIPALTAEEFVGGKNAPPNLIPVNPEAAKAGPKVQVAKKANILAQMPPQQEHPPEPPMQRPAPPQQQRAAPVRHDEEMGIVRSQRREPSPPEQQTPAPRQQVQLRSREARDETGGSQTAGQRRAAAELDRIRREQNRSGAGEADGQSTAATTPNASRRPSNSSAAAVSGSVEDELAKIKVVLRQHERRIRLLEDQLADANMANAYGI

SEQ ID NO: 122409 - protein, 195 aa, Heterodera glycines
  Homolog annotation: Hit_ID=NP_727306.1; Match level="QueryCoverage =70%, HitCoverage=61%, E-value=4e-32, Identity=43%"; Hit description =CG32708-PA [Drosophila melanogaster] gb|AAF46440.1| CG32708-PA [Drosophila melanogaster]
  Gene Ontology: Mol. function=general RNA polymerase II transcription factor activity; Cellular component=nucleus; Biological process =gametogenesis
  Essential gene: C elegans homolog=F57B10.8; Phenotype=Lva
  Coding regions on vcDNA: vcDNA=SeqID_48832; Strand=+; Position=1-585
IQTVPPFFTVKRLRETMSRFDGLGRVYLQSEKRGAQRKKRYTEGWVEFKNKKVAKEVVRLMNGRVVGGRRRSAAYDSVWTMKYLHGFKWEHLMEQLNYEQRIEQQRLRTEIVQEKRKADFFAQQVEKGESLKKLEEKILKKCGLWEQYQRQHKQLKNCGEGRSRNWRRTNHCCFKYLEETTEGKTLTIRGKGNQT

SEQ ID NO: 122410 - protein, 184 aa, Heterodera glycines
  Homolog annotation: Hit_ID=CAG09543.1; Match level="QueryCoverage =69%, HitCoverage=85%, E-value=3e-24, Identity=43%"; Hit description =unnamed protein product [Tetraodon nigroviridis]
  Gene Ontology: Mol. function=protein translocase activity; Cellular component=mitochondrial outer membrane translocase complex; Biological process=mitochondrial translocation
  Essential gene: C elegans homolog=F23H12.2; Phenotype=Lva
  Coding regions on vcDNA: vcDNA=SeqID_48833; Strand=+; Position=10-564
MSTFYSLNVSSNWLKYLSLGTALVVGYAVYIDRKRRLDPEYKQKIRQNRKQKQANFFYAKMSGGVDFPDPSDPQANEIFFFSQITPGEEKMKTGHIEEGITHLSNAIVTCSKPDELLRIFQQTIPPECFSLLVQAIPGAKMRRNASSSYRHGREPIDLDCAKIDDIGDNAVDKKMFVLQDDELE

SEQ ID NO: 122411 - protein, 260 aa, Heterodera glycines
  Homolog annotation: Hit_ID=NP_498415.2; Match level="QueryCoverage =93%, HitCoverage=40%, E-value=3e-86, Identity=65%"; Hit description =electron transfer flavoprotein-ubiquinone oxidoreductase, LEThal LET- 721 (65.3 kD) (let-721) [Caenorhabdi
  Gene Ontology: Mol. function=electron acceptor activity; Cellular component=mitochondrial inner membrane; Biological process=electron transport
  Essential gene: C elegans homolog=C05D11.12; Phenotype=Emb
  Coding regions on vcDNA: vcDNA=SeqID_48834; Strand=+; Position=20-799
MANNFLSVRRFLHCCPPLRNVVNGRWTTTHYTQRPREKDGRWKCVDMARVEDEFDVVIVGGGPAGLSAAIRLKQLAAEKAKELRVCLVEKAPEIGAHTLSGAIIETGGLDRLFPNWRELDSPIKQPVKKDAFAILTKNGRIPVPLVPGVPLNNHGNYIVRLGHLVRWLGERAEEHGVELYSGIAAQEVLFDEAGKTVCGVATGDVGIHKDGSPKESFERGMELKAKCTIFAEGCPGHLTKSVIGKFGLREGRDPMTFGNG

SEQ ID NO: 122412 - protein, 238 aa, Heterodera glycines
  Homolog annotation: Hit_ID=CAE56547.1; Match level="QueryCoverage =75%, HitCoverage=85%, E-value=4e-49, Identity=49%"; Hit description =Hypothetical protein CBG24279 [Caenorhabditis briggsae]
  Gene Ontology: Mol. function=translation initiation factor activity; Cellular component=ribosome; Biological process=protein biosynthesis
  Essential gene: C elegans homolog=R04A9.4; Phenotype=Unclassified
  Coding regions on vcDNA: vcDNA=SeqID_48835; Strand=+; Position=12-725
MFMAADDSNSEKESNSLSIRTDKLLSVPFNGEETSENTSQQQQQQTPVALPTSSSKILSKQHPLKTKWNFWFLNNKKKDMDWLERLSKVCTVSTVEEFWAFFDNIHPPSGMYGCDYNFFRDGIEPLWEVAQNKDGGRLVIQVDKQRNELLDGWWMEFLLACIGEQFGDDSDQVCGAVCNIRNKGSKISIWTTNASEEDKNRRIGHVLKDRLQASGGLKPIKINFEDHEVVQQKTSSAI

SEQ ID NO: 122413 - protein, 249 aa, Heterodera glycines
  Homolog annotation: Hit_ID=CAE65730.1; Match level="QueryCoverage =99%, HitCoverage=96%, E-value=1e-81, Identity=62%"; Hit description =Hypothetical protein CBG10813 [Caenorhabditis briggsae]
  Gene Ontology: Mol. function=endopeptidase activity; Cellular component=proteasome core complex (sensu Eukarya); Biological process=ubiquitin-dependent protein catabolism
  Essential gene: C elegans homolog=Y110A7A.14; Phenotype=Emb
  Coding regions on vcDNA: vcDNA=SeqID_48836; Strand=+; Position=11-760
MARRYDTRTTIFSPEGRLYQVEYAMEAIGQAGTCLGIRAPDGIFIAAQKLTANKLLDDRIMSEKIYKVSANIFCTVAGITSDANVLVDKLREMAVMNTLDFGENIPVEQLVIRLCNTKQHYTQVGGKRPYGVSLLYAGWDTHHGFQLYQSDPSGNYGGWKATCIGKGHQNALSILKQEYKDEDMTLEKAKDLAMKVLSKTIEAKMLPEQLEMAQLTLDEKGRPELRILEEAERKQLTDKWEASEEAKQP

SEQ ID NO: 122414 - protein, 277 aa, Heterodera glycines
  Homolog annotation: Hit_ID=NP_501910.1; Match level="QueryCoverage =88%, HitCoverage=50%, E-value=1e-25, Identity=33%"; Hit description =KOW (4L123) [Caenorhabditis elegans] emb|CAA94367.1| Hypothetical protein R11A8.2 [Caenorhabditis elegans
  Essential gene: C elegans homolog=R11A8.2; Phenotype=Bmd,Emb,Lva,Stp
  Coding regions on vcDNA: vcDNA=SeqID_48837; Strand=+; Position=2-835
KEQNSGDEEAEEADEHRTKKRGILSLEDGIIVDAEPLAKREKKQLVIPVLQVSSRAQISRIQKLVDEGTATETDLARLSLLIDSLDDEQRKTTTLPLDARHQTVPTVAVADDDDPDYASVPVGEFGLAFLRGCGWKDEKSCIGKSNPQVVPLRVIEPRPKGLGLGAVLPTTAPPTANALKAAENGDEEATTLGKHSYVRCLSGLNKGSYGQVMSMDEENASIFVELAWPPANVGKTVRVSQWAGEVVRRKEYRECVKGGSGGGGTAENGRRLERVRV

SEQ ID NO: 122415 - protein, 139 aa, Heterodera glycines
  Homolog annotation: Hit_ID=AAH49478.1; Match level="QueryCoverage =76%, HitCoverage=58%, E-value=2e-37, Identity=78%"; Hit description =Zgc:66168 protein [Danio rerio]
  Gene Ontology: Biological process=cell cycle
  Essential gene: C elegans homolog=ZK1010.1; Phenotype=Emb
  Coding regions on vcDNA: vcDNA=SeqID_48838; Strand=+; Position=19-438
LKMQIFVKTLTGKTITLEVEASDTIENVKAKIQDKEGIPPDQQRLIFAGKQLEDGRTLADYNIQKESTLHLVLRLRGGKVHGSLARAGKVRAQTPKVEKQEKKKKKRGRAFRRIQYKRRYVNVAAAGPGRRRGPNSNAA

SEQ ID NO: 122416 - protein, 208 aa, Heterodera glycines
  Homolog annotation: Hit_ID=CAE65556.1; Match level="QueryCoverage =95%, HitCoverage=70%, E-value=1e-47, Identity=46%"; Hit description =Hypothetical protein CBG10545 [Caenorhabditis briggsae]
  Essential gene: C elegans homolog=T21D12.3; Phenotype=Unclassified
  Coding regions on vcDNA: vcDNA=SeqID_48839; Strand=+; Position=3-626
SCRIRHEATSLPPLLLERLKKRGIVASKNEDEEVFAESYDQDDDSKLEISREKYRGGAPGCPNKHNPFHVCTDFCFDHWQEGYPESRLSDKYLEQRNKMLRNYPLPKDWVEIYDPGMHRHYYWNQMTDEVSWLSPKHPKAVISEAAAKSAKEAWNMSKIERSEGERGGRRGGREGDEREGTERRGKERYKGKRTKDYEIALPDSDEEE

SEQ ID NO: 122417 - protein, 172 aa, Heterodera glycines
  misc_feature (60)..(60): Xaa can be any naturally occurring amino acid
  Homolog annotation: Hit_ID=EAL25034.1; Match level="QueryCoverage =99%, HitCoverage=36%, E-value=3e-48, Identity=56%"; Hit description =GA18098-PA [Drosophila pseudoobscura]
  Gene Ontology: Mol. function=hydroxymethylglutaryl-CoA synthase activity; Cellular component=endoplasmic reticulum; Biological process=cell organization and biogenesis
  Essential gene: C elegans homolog=F25B4.6; Phenotype=Emb,Lva,Lvl,Unc
  Coding regions on vcDNA: vcDNA=SeqID_48840; Strand=+; Position=2-517
GSLSLTVTAALMVNHKVNPKDIGFLADGTETLVDKSKSVKSVLMDLFADSGNMDLEGADXKNACFGGTQALFHADDWMYAFYATQKRLAIDVCADVALYSAGPARCTGGAGAMAFLIGPNAPIALERGLRACHSQNVYDFYKPIGGVSTQFPRVDGPNSVDTYLNAVDMCLR

SEQ ID NO: 122418 - protein, 199 aa, Heterodera glycines
  Homolog annotation: Hit_ID=NP_500367.1; Match level="QueryCoverage =95%, HitCoverage=34%, E-value=4e-48, Identity=47%"; Hit description =rab geranylgeranyl transferase (67.2 kD) (4E295) [Caenorhabditis elegans] gb|AAC68985.1| Hypothetical pro
  Gene Ontology: Mol. function=protein geranylgeranyltransferase activity; Cellular component=protein farnesyltransferase complex; Biological process=lipid metabolism
  Essential gene: C elegans homolog=M57.2; Phenotype=Lva,Lvl,Unc
  Coding regions on vcDNA: vcDNA=SeqID_48841; Strand=+; Position=12-608
TPFAKKSEEQREAEEKKRAEKLQQFVDSRNLGFHKRKSGEYDDEMLTVCGELLKNNPDIYTLWNVRREAIEKRATKCEDESDEELAKRISELINGELKLTQSCLLRNPKSYSTWHHRYWSCLRHPTPPLRQELALCEKALGQDCRNFHCWDHRRSIARTAQLSAEEELRFSDTLVGRNPSNYSAWHYRGTLLPLMKPNT

SEQ ID NO: 122419 - protein, 116 aa, Heterodera glycines
  Homolog annotation: Hit_ID=NP_500608.1; Match level="QueryCoverage =66%, HitCoverage=98%, E-value=2e-23, Identity=68%"; Hit description =mitochondrial ribosomal protein S21 like (4F422) [Caenorhabditis elegans] gb|AAF99924.1| Hypothetical pro
  Essential gene: C elegans homolog=F29B9.10; Phenotype=Lva
  Coding regions on vcDNA: vcDNA=SeqID_48842; Strand=+; Position=31-381
MVRLIQNQFWRGTLTQPWGVKMFKYIWRKHSRFLVKTVMVQENDIDSAFHLLNRLMEREGLLKIIRNTQRYQKPFMQRSQLSIEASKAILEEDRDRKLKFLVRKHRADAYPGQLTM

SEQ ID NO: 122420 - protein, 380 aa, Heterodera glycines
  Homolog annotation: Hit_ID=NP_998660.1; Match level="QueryCoverage =100%, HitCoverage=48%, E-value=1e-89, Identity=46%"; Hit description= zgc:55483 [Danio rerio] gb|AAH48370.1| Zgc:55483 [Danio rerio]
  Gene Ontology: Mol. function=protein binding; Cellular component=SCF ubiquitin ligase complex; Biological process=apoptosis
  Essential gene: C elegans homolog=D2045.6; Phenotype=Emb
  Coding regions on vcDNA: vcDNA=SeqID_48843; Strand=+; Position=2-1144
FIYNHEITAMARNASKSPQLLVLYCDQLLRKSARNMEDEKMDENLEQVMTVFKYIDDKDMFQAFFHKFLCKRLDYDTSASEEQERCMIAKLKHMCGFEYTSKLERLLTDVPLSRDHSEQFKQQPRTSNVDFSVIDVMSNVWPLQQPVKLEIPRPLLDGIDSYTQYYTNRFNGRKLTWTLQMYHGELVSTSNTFPSKYSFLCNTQQIAVLMQYNERNTYTLGELHVALGTDFPGDQLCAVVQSLVKTNLLKLTSADGKALTETKLNDNEQKFTFNPGFHSRKLKVDLVRAMSSARETKKESEDVQKTVDEDRKLVIQAAIVRIMKMRKSLKHQLLVAEVLNQLTTRFQPKVPIIKKCIDSLIEKEYLKRSEEDRDMYEYLA

SEQ ID NO: 122421 - protein, 235 aa, Heterodera glycines
  Homolog annotation: Hit_ID=NP_507092.1; Match level="QueryCoverage =94%, HitCoverage=70%, E-value=1e-47, Identity=44%"; Hit description =hydroxysteroid dehydrogenase 12 family member (5Q705) [Caenorhabditis elegans] emb|CAB07363.1| Hypothetic
  Gene Ontology: Mol. function=ketoreductase activity; Cellular component=endoplasmic reticulum; Biological process=fatty acid biosynthesis
  Essential gene: C elegans homolog=C56G2.6; Phenotype=Lva
  Coding regions on vcDNA: vcDNA=SeqID_48844; Strand=+; Position=1-705
MEIIYAILSFFGLLFLLCLLFKFLRAIWRCVYPYFIARPKDLRRLVGAKWAVVTGASDGIGKEYAKQLANKGFNLMLISRSADKLKAVKEEIQPKQFLQPEVKWISFDLTNANIEDYEKWLFPELSKMDIGMLVNNVGSFPPLMRFHELPGGHRSIAKDLILNTMPHTILTAFVLKQMTERNKGIIVNIASVAAVFPLFHTALYSSVKKYLTWFSAILRKDYADTGIIIQSILPG

SEQ ID NO: 122422 - protein, 86 aa, Heterodera glycines
  Homolog annotation: Hit_ID=XP_420431.1; Match level="QueryCoverage =100%, HitCoverage=14%, E-value=1e-31, Identity=74%"; Hit description= PREDICTED: similar to U6 snRNA-associated Sm-like protein LSm6 (Sm protein F) [Gallus gallus]
  Gene Ontology: Mol. function=pre-mRNA splicing factor activity; Cellular component=small nuclear ribonucleoprotein complex; Biological process=mRNA splicing
  Essential gene: C elegans homolog=Y71G12B.14; Phenotype=Gro,Unc
  Coding regions on vcDNA: vcDNA=SeqID_48845; Strand=+; Position=23-283
MSAPTALATNSRRQTPSEFLKKIVGKPVVVKLNSGADYRGILSCLDGFMNIALEQTEEYHGGQLKAKYGDAFIRGNNVLYISTQKQ

SEQ ID NO: 122423 - protein, 139 aa, Heterodera glycines
  Homolog annotation: Hit_ID=CAE75063.1; Match level="QueryCoverage =75%, HitCoverage=59%, E-value=5e-10, Identity=34%"; Hit description =Hypothetical protein CBG22978 [Caenorhabditis briggsae]
  Essential gene: C elegans homolog=K12H4.5; Phenotype=Emb
  Coding regions on vcDNA: vcDNA=SeqID_48846; Strand=+; Position=3-422
QDNTNTIQSKSKSGYPTKMVIVYRPYVSRWRRAWTVIKAKPRFWLKYYPEFSAGWYMLVPSVIICLGTRFYFGGYPNNFGMGWNEKPFYRQFFEVRRPDDPLVLKWRLPEEYPARFQTNRQSDYYPTTAHNKHYAWDVK

SEQ ID NO: 122424 - protein, 198 aa, Heterodera glycines
  Homolog annotation: Hit_ID=NP_497722.3; Match level="QueryCoverage =82%, HitCoverage=44%, E-value=6e-46, Identity=57%"; Hit description =lipoate synthase and, Ribosomal Protein, Large subunit, L13A (39.8 kD) (rpl-16Co) [Caenorhabditis elegans
  Gene Ontology: Mol. function=lipoic acid synthase activity; Cellular component=mitochondrion; Biological process=embryogenesis and morphogenesis
  Essential gene: C elegans homolog=M01F1.3; Phenotype=Emb
  Coding regions on vcDNA: vcDNA=SeqID_48847; Strand=+; Position=3-596
MLSSVTFRFSYAISSSVAFPSSAFCPFFHNFRHISLLPKDGMTLHDFLPPGSTKAISFADDGQKTETAQRRTADGRLRLPEWLKRDVVAKQSDVNLIRMKKQLRGLKLATVCEEARCPNIGECLGGGPGRPSTAAIMLMGDTCTRGCRFCSVKTARRPPPPDPEEPLNTAKAVASWGVDYIVLTSVDRDDFGRTAARH

SEQ ID NO: 122425 - protein, 126 aa, Heterodera glycines
  Homolog annotation: Hit_ID=NP_502513.1; Match level="QueryCoverage =84%, HitCoverage=22%, E-value=3e-18, Identity=45%"; Hit description =spinster-like family member (53.5 kD) (4N853) [Caenorhabditis elegans] emb|CAA94337.1| Hypothetical prote
  Gene Ontology: Biological process=reproduction
  Essential gene: C elegans homolog=C39E9.10; Phenotype=Emb,Gro,Lva,Ste
  Coding regions on vcDNA: vcDNA=SeqID_48848; Strand=+; Position=1-381
NVDMLMSIIVPERRSIASAIQILFSHLFGDASGPYLVGAISDFVRGSSDLPADRFHSLIVAFYLPNALLFLSGAAFLGAAYSLPADLKRMEAEKAAAESPKPTTSATIGPSSANIGPQGRQNEAFE

SEQ ID NO: 122426 - protein, 229 aa, Heterodera glycines
  Homolog annotation: Hit_ID=NP_510561.1; Match level="QueryCoverage =100%, HitCoverage=41%, E-value=5e-76, Identity=58%"; Hit description= suox gene product (61.0 kD) (XQ117) [Caenorhabditis elegans] emb|CAB17069.1| Hypothetical protein H13N06
  Gene Ontology: Mol. function=sulfite oxidase activity; Cellular component=mitochondrial intermembrane space; Biological process =methionine catabolism
  Essential gene: C elegans homolog=H13N06.4; Phenotype=Gro,Slu,Stp,Unc
  Coding regions on vcDNA: vcDNA=SeqID_48849; Strand=+; Position=1-687
VHFEGADVDASGSRYGASIPFEKAMRPEVIIAYEMNGDVLTRDHGFPIRLVVPGHVGARQVKWLNAIRLSDEESPSTWQQRDYKAFPSSVQIGDPLPFDTTPAIQEYPVQSVICEPNSNTKIAPGAKTITVRGYAWSGGGRGIIRVEVSPDNGTTWKCAELEQCPEQNIEQMWGWTLWSVELPISEATIRNGRMELVCKATDRSYNTQPETGIALWNVRGLLHNAWHRV

SEQ ID NO: 122427 - protein, 185 aa, Heterodera glycines
  Homolog annotation: Hit_ID=NP_491654.1; Match level="QueryCoverage =88%, HitCoverage=29%, E-value=5e-76, Identity=79%"; Hit description =CBF1 interacting corepressor (65.8 kD) (1G222) [Caenorhabditis elegans] gb|AAB37808.1| Hypothetical prote
  Gene Ontology: Biological process=growth
  Essential gene: C elegans homolog=F55F8.4; Phenotype=Emb
  Coding regions on vcDNA: vcDNA=SeqID_48850; Strand=+; Position=82-636
MGKGFQNFMSKKDFHPSAWWNLKRKWEAEQKNDLEKRRQDELRVQYEKEQEILNNKALLGDEKARLGLSFMYDAPAGINKKKEEGPEPKFEWQRKYNAPREEWAKGNELIQDQPFGIQVRNVRCVKCRAWGHLNTDRECPLYGMSGNAEDHGYANNPSDIIRDLNVEKKTKTVSDVTTNEQIDIK

SEQ ID NO: 122428 - protein, 179 aa, Heterodera glycines
  Homolog annotation: Hit_ID=XP_394802.1; Match level="QueryCoverage =95%, HitCoverage=37%, E-value=4e-37, Identity=45%"; Hit description =similar to Drosophila cyclin E type I [Apis mellifera]
  Gene Ontology: Mol. function=cyclin-dependent protein kinase, intrinsic regulator activity; Cellular component=nucleus; Biological process=negative regulation of FGF receptor signaling pathway
  Essential gene: C elegans homolog=C37A2.4a; Phenotype=Emb
  Coding regions on vcDNA: vcDNA=SeqID_48851; Strand=+; Position=105-641
MKIGHRTPPRQKRATDPPPQFDSSDLGSPQKVWSLLCEKDEKLRRDPHVFSRQKKINAKMRAMLLDWLMDVCADKQLHRETFHLCIDYIDRFIALSDHQMQPQRLQLFGSTALVIASKVEEIYPPKIAEIAEYTDGCCSEADIRGIEEIMLEKLDWTCYPVTAVHWLALFMQLMNTDEV

SEQ ID NO: 122429 - protein, 409 aa, Heterodera glycines
  Homolog annotation: Hit_ID=NP_495455.2; Match level="QueryCoverage =94%, HitCoverage=94%, E-value=1e-153, Identity=68%"; Hit description= 3-Ketoacyl-coA Thiolase (kat-1AND2H367) [Caenorhabditis elegans] gb|AAA82397.2| 3-ketoacyl-coa thiolase
  Gene Ontology: Mol. function=acetyl-CoA C-acetyltransferase activity; Cellular component=mitochondrion; Biological process=lipid metabolism
  Essential gene: C elegans homolog=T02G5.4; Phenotype=Unclassified
  Coding regions on vcDNA: vcDNA=SeqID_48852; Strand=+; Position=25-1254
MFLLIGKYPFLTSTSIRAFSTIKEAFILEACRTPIGSFRSQLASVSAPALASECIKELLKRTKVPAKEVQEVFLGQVCQANVGQAPARQAALGAGLDVAVAVTTVNKVCSSGLKSSMLAAQQIQLNHQQLVIGGGMESMSHVPFYLERGELPYGGAKLIDGIVKDGLTDAYDSVHMGNCAEKTAKECQIGREEQDNYAIQSYKRAAQAWQNGQIGPEIVPVEIKTRKGTFKMERDEEYSKVDFDKLKALRTVFQKENGTVTAGNASTLNDGAAAVLMASEEKADALGVKPMAKVIAYGDAATHPMDFPIAPALVIPKILSAASLSIGDISLFELNEALSVVPLAVIKKLGIDPAKVNAHGGAVSIGHPIGMSGARILAHLVHALKPGQFGLAAICNGGGGASGMVIKKL

SEQ ID NO: 122430 - protein, 415 aa, Heterodera glycines
  misc_feature (332)..(332): Xaa can be any naturally occurring amino acid
  Homolog annotation: Hit_ID=NP_510133.1; Match level="QueryCoverage =100%, HitCoverage=51%, E-value=1e-178, Identity=76%"; Hit description=synthetase (86.5 kD) (XN405) [Caenorhabditis elegans] emb|CAA90672.1| Hypothetical protein T22H6.2a [Ca
  Gene Ontology: Mol. function=glutamate 5-kinase activity; Biological process=proline biosynthesis
  Essential gene: C elegans homolog=T22H6.2a; Phenotype=Gro
  Coding regions on vcDNA: vcDNA=SeqID_48853; Strand=+; Position=1-1246
VKLGSAVITRDDECGLALGRLASIVEQVSELQQTGRQMLMVSSGAVAFGRQKLRQELVMSMSMRQTLRGPAGMQTDKRACASSGMPGLMSLYEQLFQQYGITVAQVLLTKPDIDDPQRRKNLQATIESLLRLNIIPIVNANDAVAPDPKLNMHISDNDSLAGRLASEISADLMIILSNVNGVYTGPPEQEGTRLLHSYCPAEASSVSFGSNSKFGTGGMEAKVQACVTALHHGVSTVITNGMQNNVITDVVYGRKVGTMFCNTSRYEGPPIAETAAKVKESGRLLQSLSNEERAQMVRHMADLLMARESDILEANRLDLHNAKGAKLEAAMXDRLKLTKGKLLDLHSGLNMIADSANTLIGRVLKRTKVAENLILEQTTVPIGTLLVIFESRPDCLPQVGGLSIASGNSLLLKGG

SEQ ID NO: 122431 - protein, 167 aa, Heterodera glycines
  Homolog annotation: Hit_ID=NP_505968.1; Match level="QueryCoverage =100%, HitCoverage=39%, E-value=7e-43, Identity=55%"; Hit description= syntaxin 5a (45.9 kD) (5M245) [Caenorhabditis elegans] emb|CAA96656.1| Hypothetical protein F55A11.2 [Ca
  Gene Ontology: Mol. function=t-SNARE activity; Cellular component =integral to membrane; Biological process=synaptic vesicle docking
  Essential gene: C elegans homolog=F55A11.2; Phenotype=Emb,Lva,Unc
  Coding regions on vcDNA: vcDNA=SeqID_48854; Strand=+; Position=1-504
ENLKFKRERREKFSQSAAIPSNLPPSTSNGQMGSLLLHDEMASASSGSSTFALDMDKLEQQRVQEQTTLLLDDTEQFHQSRFNAMESIESSISELGTIFRQLATLVSEQGEMITRIDSNVEESSLNVEAAHHELLKYFNNISRNRWLIIKVFGVLMAFFVFFVIFLT

SEQ ID NO: 122432 - protein, 216 aa, Heterodera glycines
  Homolog annotation: Hit_ID=CAE71348.1; Match level="QueryCoverage =75%, HitCoverage=85%, E-value=1e-20, Identity=32%"; Hit description =Hypothetical protein CBG18251 [Caenorhabditis briggsae]
  Gene Ontology: Cellular component=chromatin; Biological process =embryogenesis and morphogenesis
  Essential gene: C elegans homolog=T12D8.7; Phenotype=Emb
  Coding regions on vcDNA: vcDNA=SeqID_48855; Strand=+; Position=9-659
WWQWQLLVHLAIIHVNQVKVIPPQKYLNVSETIKKMFHELGIKEYEPQLVLQLCDISYSLTKEILVDARSVSEFSGKKQVDRSDVDLAIKTFDEKHTNDRPPKAFVSELAAEKNALPLHPIRQNYGLRLPNDRFCQLQPNYIYIGDDPNNEDQAVHMEERPRQNGSSKFNAINNFDPESVSNLLMTDKNATQRKRPYTNGEMQKHTQEEDYDDEYD

SEQ ID NO: 122433 - protein, 176 aa, Heterodera glycines
  Homolog annotation: Hit_ID=CAE59837.1; Match level="QueryCoverage =88%, HitCoverage=97%, E-value=3e-42, Identity=51%"; Hit description =Hypothetical protein CBG03309 [Caenorhabditis briggsae]
  Essential gene: C elegans homolog=T09A5.5; Phenotype=Lva
  Coding regions on vcDNA: vcDNA=SeqID_48856; Strand=+; Position=1-531
MASPLQRLITCNSPQIGFVAGRIRFVPHFEKLAVSWSANSPKSEGAERFVKEFWPIIRENNPNIEYLLTRSHTECDPFVVGTFRWDRTRKQRLCWKHPHQILAIIEQWSIGGDYRPGRKRKVATIIPRGMQIIDNETKGHEVFKVFSRWKGEPTGNAMDPKKHPNYLYHLINEARK

SEQ ID NO: 122434 - protein, 321 aa, Heterodera glycines
  Homolog annotation: Hit_ID=NP_501859.1; Match level="QueryCoverage =99%, HitCoverage=97%, E-value=1e-139, Identity=73%"; Hit description= guanine nucleotide-binding protein -like (35.8 kD) (4K941) [Caenorhabditis elegans] emb|CAA93514.1| Hypo
  Gene Ontology: Cellular component=cytoplasm; Biological process =signal transduction
  Essential gene: C elegans homolog=K04D7.1; Phenotype=Gro,Slu
  Coding regions on vcDNA: vcDNA=SeqID_48857; Strand=+; Position=57-1022
MGEQMKLEGSLRGHNGWVTQIATNPLYKNMLVSASRDKTIIVWMLDESGSVLNGKPIKSLHGHGHFVSDVVMSSDGQYALSGSWDKTLRLWDLNTGQTTRQFVSHTQDVLSVAFSADNRQIVSGSRDKKIKLWNTLAQCKHTIVEECHSDWVSTVRFSPSHANPVIVSAGWDKIVKVWNLATCRLKTNHFGHTGYINSVTVSPDGSLCASGGKDGSAMLWDLNDGKHLYTLGGNDVINALAFSPNRYWLCAAVGPVVKIWDLENKTVVDELKLDIASTSAANPMRVSKKSCPQCISLAWSTDGQTLFAGYTDNIIRVWRIA

SEQ ID NO: 122435 - protein, 197 aa, Heterodera glycines
  Homolog annotation: Hit_ID=XP_550320.1; Match level="QueryCoverage =92%, HitCoverage=28%, E-value=3e-27, Identity=35%"; Hit description =putative Ubiquitin isopeptidase T; Ubiquitin-specific protease-5 [Oryza sativa (japonica cultivar-group)]
  Gene Ontology: Mol. function=ubiquitin-specific protease activity; Biological process=protein modification
  Essential gene: C elegans homolog=T27A3.2; Phenotype=Gro,Pvl,Slu,Stp
  Coding regions on vcDNA: vcDNA=SeqID_48858; Strand=+; Position=1-594
RRFAFDWILGTQHKLDVDVHVSDELDINAFFSTGELQPNEKSLPVDDTSAVIKERLWQEPNHEIVAKLLSMGFTENAAKKAALFTKNESAESAINWILQHSDDTDVNDPHPMLTKQSTPPLTSNQGQNASQKVRHGKGHYRLRAFISHIGSTPNSGHYVAHVKADNGQWHIFNDEKVAKSQHPPKTLGYLYLFQRAT

SEQ ID NO: 122436 - protein, 172 aa, Heterodera glycines
  Homolog annotation: Hit_ID=CAE71615.1; Match level="QueryCoverage =99%, HitCoverage=100%, E-value=8e-85, Identity=85%"; Hit description= Hypothetical protein CBG18577 [Caenorhabditis briggsae]
  Gene Ontology: Mol. function=peptidyl-prolyl cis-trans isomerase activity; Cellular component=extracellular space; Biological process= protein folding
  Essential gene: C elegans homolog=Y75B12B.2; Phenotype=Emb
  Coding regions on vcDNA: vcDNA=SeqID_48859; Strand=+; Position=21-539
MSRPKVFFDITIGGKAAGRIVMELYSDIVPKTAENFRSLCTGEKGMGKSGKPLHYKGSKFHRVIPNFMLQGGDFTRGNGTGGESIYGEKFVDENFKEKHTQPGILSMANAGPNTNGSQFFVTTVKTEWLDGKHVVFGRVTDGMDVVKAVEAQGSQSGRASKDIMIADCGQLS

SEQ ID NO: 122437 - protein, 147 aa, Heterodera glycines
  Homolog annotation: Hit_ID=NP_502065.1; Match level="QueryCoverage =100%, HitCoverage=100%, E-value=4e-84, Identity=99%"; Hit description=UBiquitin Conjugating enzyme E2, Ubiquitin conjugating enzyme, LEThal LET-70 (16.7 kD) (let-70) [Caenor
  Gene Ontology: Mol. function=ubiquitin conjugating enzyme activity; Cellular component=proteasome complex (sensu Eukarya); Biological process=chromosome organization and biogenesis (sensu Eukarya)
  Essential gene: C elegans homolog=M7.1; Phenotype=Emb
  Coding regions on vcDNA: vcDNA=SeqID_48860; Strand=+; Position=62-505
MALKRIQKELQDLGRDPPAQCSAGPVGDDLFHWQATIMGPPESPYQGGVFFLTIHFPTDYPFKPPKVAFTTRIYHPNINSNGSICLDILRSQWSPALTISKVLLSICSLLCDPNPDDPLVPEIARIYKTDRERYNTLAREWTQKYAM

SEQ ID NO: 122438 - protein, 210 aa, Heterodera glycines
  Homolog annotation: Hit_ID=NP_499749.1; Match level="QueryCoverage =96%, HitCoverage=59%, E-value=3e-46, Identity=48%"; Hit description =aspergillus NUclear Division related, evolutionarily conserved nuclear migration gene required for embryo
  Gene Ontology: Biological process=embryogenesis and morphogenesis
  Essential gene: C elegans homolog=F53A2.4; Phenotype =Emb,Evl,Pnm,Rot,Stp,Unc
  Coding regions on vcDNA: vcDNA=SeqID_48861; Strand=+; Position=39-668
MTSASSDQQDRVDGVLLSLATSLGGGVPELFDHIFSFLSRKTDFYTGASVDEARKIVLDAFEKHASGAKKEAEQKRMRKETEERKLAERRAAQKAKEEAEFTRVRELTDAEAAELQRKLDAEKLAEQKTTNADESMPINSSAKTSESGADGPTSTEEEKSSNKTKPNAGNGCDLERYQWTQTLGELEVRVPFPSLGFPLKAKDVIVEVKR

SEQ ID NO: 122439 - protein, 249 aa, Heterodera glycines
  Homolog annotation: Hit_ID=CAE71139.1; Match level="QueryCoverage =90%, HitCoverage=80%, E-value=1e-85, Identity=67%"; Hit description =Hypothetical protein CBG17994 [Caenorhabditis briggsae]
  Gene Ontology: Mol. function=laminin receptor activity; Cellular component=integral to plasma membrane; Biological process=cell adhesion
  Essential gene: C elegans homolog=B0393.1; Phenotype=Emb,Ste
  Coding regions on vcDNA: vcDNA=SeqID_48862; Strand=+; Position=40-786
MSSSLDVFKLTDDDAMKFLVCESHIGTKKMDYQMEHYVWKRRSDGIHIINIRKTWEKLLFAARAIAAIENPSDVVVVSAQPYAQRAVLKFAAHIGATPIVGRFTPGSLTNQIQKNFKEPRLLVVSDPQLDHQAVREASYVNTPVIAVANTDSPLKFVDIAIPANNKQKHSVGLIWWLLAREVLLLRGKISRQTGFMVDDKLIMPDLYFFRDPQEQEKEGTEGEAEADITVKEGGWGATGGMDTMGGDFP

SEQ ID NO: 122440 - protein, 380 aa, Heterodera glycines
  Homolog annotation: Hit_ID=AAP20434.1; Match level="QueryCoverage =100%, HitCoverage=84%, E-value=0.0, Identity=95%"; Hit description =beta-tubulin isotype 1 [Cooperia oncophora]
  Gene Ontology: Mol. function=MHC class I protein binding; Cellular component=tubulin; Biological process=embryogenesis and morphogenesis
  Essential gene: C elegans homolog=K01G5.7; Phenotype=Emb
  Coding regions on vcDNA: vcDNA=SeqID_48863; Strand=+; Position=2-1141
REIFHIQAGQCGNQIGSKFWEVISDQHGIQPDGTYKGESDLQLERINVYYNEAHGGKYVPRAVLVDLEPGTMDSIRAGAYGQLFRPDNFVFGQSGAGNNWAKGHYTDGAELVDNVLDVVRKEAEGCDCLQGFQLTHSLGGGTRSRMGTLLISKIREEYPDRIMSSFSVVPSPKVSDTVVEPYNATLSVHQLVENTDETFCIDNEALYDICFRTLKLQNPTYGDLNHLVSVTMSGVTTCLRFPGQLNADLRKLAVNMVPFPRLHFFMPGFAPLSAKGAAAYQALSVSELTKQMFDAKNMMAACDPRHGRYLTVAAMFRGRMSMREVDDQMMSVQNKNSSYFVEWIPNNVKTAVCDIPPRGLKMSATFVGNSTAIQELFKRI

SEQ ID NO: 122441 - protein, 205 aa, Heterodera glycines
  Homolog annotation: Hit_ID=NP_491961.1; Match level="QueryCoverage =99%, HitCoverage=96%, E-value=6e-95, Identity=82%"; Hit description =dna directed rna polymerase ii polypeptide e (24.3 kD) (1H427) [Caenorhabditis elegans] gb|AAF39906.1| Hy
  Gene Ontology: Mol. function=DNA-directed RNA polymerase activity; Cellular component=DNA-directed RNA polymerase I complex; Biological process=embryogenesis and morphogenesis
  Essential gene: C elegans homolog=H27M09.2; Phenotype=Emb
  Coding regions on vcDNA: vcDNA=SeqID_48864; Strand=+; Position=1-618
ETFKLWRVRKTVMQMCHDRGYLVTQDELDQTLDQFKDQFGDRPSERRPGRGELTILVAHNDDPTDQMYVFFPDDPKIGIKTIKQICQQMQEQNITRAIIVVQSGMTPSAKQAIVDMAPKYILEHFLEAELMINITEHELVPEHVVMSSEEKAELLARYKLRDNQLPRIQVSDPVARYFGLKRGQVVKIIRASETAGRYITYRLCN

SEQ ID NO: 122442 - protein, 140 aa, Heterodera glycines
  Homolog annotation: Hit_ID=P41955; Match level="QueryCoverage=87%, HitCoverage=79%, E-value=2e-29, Identity=44%"; Hit description =Succinate dehydrogenase cytochrome b560 subunit, mitochondrial precursor emb|CAE56795.1| Hypothetical protein
  Gene Ontology: Cellular component=mitochondrial inner membrane; Biological process=electron transport
  Essential gene: C elegans homolog=T07C4.7; Phenotype=Emb
  Coding regions on vcDNA: vcDNA=SeqID_48865; Strand=+; Position=2-424
LSSTAAKTPVQEFGSEYLKRQMNLGRPLSPHLQIYKPQLTWVMSGVHRILACIMSGALLVGVFGFGICSIDFTSFAERLNSWNLWRPAFDMAKGTELASVYRSGYLVIGLSTLISLLIVANSKHLTKEQFQQKYKKEANK

SEQ ID NO: 122443 - protein, 181 aa, Heterodera glycines
  misc_feature (122)..(122): Xaa can be any naturally occurring amino acid
  misc_feature (125)..(126): Xaa can be any naturally occurring amino acid
  Homolog annotation: Hit_ID=AAB47548.1; Match level="QueryCoverage =80%, HitCoverage=97%, E-value=2e-53, Identity=65%"; Hit description =similar to nonmuscle myosin essential light chain encoded by GenBank Accession Number U25057 [Toxocara can
  Gene Ontology: Mol. function=structural constituent of muscle; Cellular component=muscle myosin; Biological process=muscle development
  Essential gene: C elegans homolog=T12D8.6; Phenotype=Emb
  Coding regions on vcDNA: vcDNA=SeqID_48866; Strand=+; Position=15-559
MNKTDDQLAECREIFCYFDSKGDEKINVKQVGDVLRALGQSPTESEVRKCCEHWTEPDTRISFEEFVPIFQTVSKSRAQYTKDQFVEGLSHFDREGNGTIAVAELKHLLTNLGERLSEEEVXATXXAGHDVANGFVSIDSFIETVLRFPLTPPDNEKCRRFRRPSAKRAKNCPFSIDNVSI

SEQ ID NO: 122444 - protein, 417 aa, Heterodera glycines
  Homolog annotation: Hit_ID=CAE60034.1; Match level="QueryCoverage =99%, HitCoverage=62%, E-value=1e-155, Identity=63%"; Hit description= Hypothetical protein CBG03543 [Caenorhabditis briggsae]
  Gene Ontology: Mol. function=oxidoreductase activity; Cellular component=integral to membrane; Biological process=embryogenesis and morphogenesis
  Essential gene: C elegans homolog=K10D2.6; Phenotype=Emb
  Coding regions on vcDNA: vcDNA=SeqID_48867; Strand=+; Position=1-1254
HIFTGEFGRIGAYEKQRPPFEPKNPFLATLTLNRELHSVASDRSCRHIELAVDKALIRYETGDHIAIFPTNDTEKVDKLGNLLVVELDTVFKLVNTDEESTKKHPFPCPCTFRTALTHYVDICSPVKSHVLKALVEVSADEETKAKLTLLSTASEEGLREYAQFIVKERRSIVDVLQHFPACKPHLDLLLELLPRLQARYYSISSSPRVDASLVAVTAVVLRYNTSDGRLVKGVCTNFLADRAPGVSTAPVFVRKSTLRLPHRVQQPVIMVGPGTGFAPFRGFLHDRLWHKQQGKEVGEMHLFFGCRHPDHDHIYKEEMEEFVRVGLLTQLHVAYSRLGSEKVYVQHKLWEARQQIWELIQAGASVYICGDARNMARDVQNMFYKIFAEVGGLSDQESQKMMKDMERQRRYQADVWS

SEQ ID NO: 122445 - protein, 288 aa, Heterodera glycines
  Homolog annotation: Hit_ID=NP_494773.1; Match level="QueryCoverage =97%, HitCoverage=70%, E-value=1e-68, Identity=48%"; Hit description =transcription complex (2E664) [Caenorhabditis elegans] gb|AAL11099.1| Not-like (yeast ccr4/not complex co
  Gene Ontology: Mol. function=3'-5' exoribonuclease activity; Cellular component=CCR4-NOT core complex; Biological process=regulation of transcription, DNA-dependent
  Essential gene: C elegans homolog=B0286.4a; Phenotype=Unclassified
  Coding regions on vcDNA: vcDNA=SeqID_48868; Strand=+; Position=66-929
MLNDDDFPALPNSVLQSNQSQQISAQQRLPSQHTHQNNSLLVNDDATNARLSRMKQQMALENSDKVGIQTHPDGRVTNIPSGMLNDQCVTNETNIRLQINSFPLRFAMDGLLTFLRTIESAPSIVGLALGHDLTNLGLNLNSSKRNLFQTFGGPWADFPCRIQDLDAKVPDEYLTNATIRDKLPNIKMNKLHEDVLFYLFYNCPGEVYQVAAATELYSRDWRFHKVERVWLMRAPFSAPPREIGGTYERRSYLVFDPIQWRRIPREMVLEHKDLEGKPSVPGTGQSSA

SEQ ID NO: 122446 - protein, 248 aa, Heterodera glycines
  Homolog annotation: Hit_ID=NP_505843.1; Match level="QueryCoverage =91%, HitCoverage=67%, E-value=1e-93, Identity=71%"; Hit description =putative N-myristoylated protein family member, with at least 4 transmembrane domains (5L674) [Caenorhabd
  Essential gene: C elegans homolog=K10D6.2a; Phenotype=Emb
  Coding regions on vcDNA: vcDNA=SeqID_48869; Strand=+; Position=79-822
MPSTAIQKLLLAVSIFLIVAGIVLTVAGVFSPAWQVVDIREFRAEHQHGLWWDCIRAEKHVVAVGDFYEEAPLHCMYKFDESAALVIERALNHVDEDGAAGEAEHHRFWGWHKVVLSLILLSQLAAFVAVCTGVCAPYFAPSTFCFAISLFIAMLLSVLADGIFFFSANRVDIRFVTGMVGTYEQVIGYAFYLHLGGTLCWAFAFVCAIATTYKFLTSNGQQRKLFDDGPRLHSANLASVYRRPVVEW

SEQ ID NO: 122447 - protein, 234 aa, Heterodera glycines
  Homolog annotation: Hit_ID=CAE71716.1; Match level="QueryCoverage =98%, HitCoverage=80%, E-value=4e-64, Identity=53%"; Hit description =Hypothetical protein CBG18693 [Caenorhabditis briggsae]
  Essential gene: C elegans homolog=R09B3.1; Phenotype=Emb,Lva
  Coding regions on vcDNA: vcDNA=SeqID_48870; Strand=+; Position=75-776
MFEGPIKIWSWNVAGLRACVKKGGHKHIRESGADIVSLQETKCSEFPAEINALDEYPYKKLLMTNEKKGYAGVALLSKEKPIKVEEGMGDVDFDDHARYIQAEFAAFFLIAVYVPNAGQKLVNLQKRGRFDELLLNKLSALNERKAVIIAGDMNVAHQEIDLRNPETNRNKTAGFTDQERNAFTRLLDVGFVDVWRTRNPETTGAYTYWSYIGKRFADNIGWRLDYFVVSQRLF

SEQ ID NO: 122448 - protein, 162 aa, Heterodera glycines
  Homolog annotation: Hit_ID=NP_504633.1; Match level="QueryCoverage =79%, HitCoverage=97%, E-value=3e-12, Identity=34%"; Hit description =putative mitochondrial protein (14.0 kD) (5G906) [Caenorhabditis elegans] gb|AAB66018.1| Hypothetical pro
  Essential gene: C elegans homolog=T05H4.12; Phenotype=Ste
  Coding regions on vcDNA: vcDNA=SeqID_48871; Strand=+; Position=60-548
MAFRALSFARRPFTTSSICRKEIDLVAGVYLNKVREVVGKQSEILNSPQLKKELNDQLNRLAQKFHLPDADAVAKLGLQFKGASVVSSVDQLVDGGQSVDAQLNALNDSRAKYEAEQKGKRQAEQERIGAISGDADYAKEFFPIPPPHIEAQQLAAAAKAAQ

SEQ ID NO: 122449 - protein, 215 aa, Heterodera glycines
  Homolog annotation: Hit_ID=NP_509886.1; Match level="QueryCoverage =90%, HitCoverage=57%, E-value=1e-67, Identity=62%"; Hit description =u5 snRNP-specific protein (XL916) [Caenorhabditis elegans] emb|CAA91460.1| Hypothetical protein F08G12.2
  Gene Ontology: Mol. function=pre-mRNA splicing factor activity; Cellular component=small nucleolar ribonucleoprotein complex; Biological process=mRNA splicing
  Essential gene: C elegans homolog=C18E3.5; Phenotype=Egl,Sck
  Coding regions on vcDNA: vcDNA=SeqID_48872; Strand=+; Position=24-668
MTEVFKRPALPLVPASGKRQRLSSEDVSLVSLGDSTRTGEQRASGLQCPIMLLTGHEGEIYAAQFSPDGTCLASVGYDQRIFFWNVYGECENFSTLSGHKGAIMDVHFSTDGSFLFTCSTDKTVRVWDMESGKCVRRFRTHTDFVNGCHPARRGPSLVVSGCDGGKIIVHDVRRRGPVATFESVNNYQVTSVTFNDTAEQIISGGIDNVLKIWDI

SEQ ID NO: 122450 - protein, 64 aa, Heterodera glycines
  Homolog annotation: Hit_ID=NP_501634.1; Match level="QueryCoverage =100%, HitCoverage=100%, E-value=2e-19, Identity=75%"; Hit description=putative protein, with a coiled coil domain (6.9 kD) (4K83) [Caenorhabditis elegans] emb|CAA92514.1| Hy
  Essential gene: C elegans homolog=F49C12.11; Phenotype=Lva,Lvl,Unc
  Coding regions on vcDNA: vcDNA=SeqID_48873; Strand=+; Position=62-256
MSGRQGGKLKPLKQAKKDDKVLTEEDVEFKKKQMEEQKKLKEAAQKAAEKGGKLGGGIKKSGKK

SEQ ID NO: 122451 - protein, 218 aa, Heterodera glycines
  Homolog annotation: Hit_ID=NP_502290.1; Match level="QueryCoverage =97%, HitCoverage=95%, E-value=1e-102, Identity=82%"; Hit description= 3a splicing factor 6 (25.5 kD) (4M849) [Caenorhabditis elegans] emb|CAA92593.2| Hypothetical protein F11
  Gene Ontology: Mol. function=pre-mRNA splicing factor activity; Cellular component=nucleoplasm; Biological process=mRNA splicing
  Essential gene: C elegans homolog=F11A10.2; Phenotype=Emb
  Coding regions on vcDNA: vcDNA=SeqID_48874; Strand=+; Position=2-655
MDFQNRAGGKTGGGGVASATDANVDRRERLRQLALETIDLQKDPYFMRNHLGGYECKLCLTLHNNEGSYLAHTQGKKHQANLARRAAKEASDVPDMPVPQQAKIEPKKFVKIGRPGYKVTKERDHASGQQALLFQIDYPEIADGVVPRHRFMSSYEQKIQPPDKRWQYLLFAAEPYETIAFKIPAREIDRSEDKLWTLWNRESRQYGMQYALRHMHDD

SEQ ID NO: 122452 - protein, 208 aa, Heterodera glycines
  Homolog annotation: Hit_ID=AAC48266.2; Match level="QueryCoverage =65%, HitCoverage=14%, E-value=6e-35, Identity=54%"; Hit description =Valyl trna synthetase protein 1 [Caenorhabditis elegans]
  Gene Ontology: Mol. function=valine-tRNA ligase activity; Cellular component=intracellular; Biological process=embryogenesis and morphogenesis
  Essential gene: C elegans homolog=ZC513.4; Phenotype=Emb,Lva
  Coding regions on vcDNA: vcDNA=SeqID_48875; Strand=+; Position=7-630
MKLLRLRSYLHFSCNLHVRNLTNLSKFGTYNEKAIQLIQQHYDEATSSSHQFVDSPSQEVFRMVLPPPNVTGNLHIGHAITVALEDAICRYQRLLGKKVRWTPGFDHAGMATEQVVQRQLAQRFGKQTDEMSQSEFVAHCEEWKEARIRDISGQLRSMACSLDWPDLFYTMDQNFSRAVRVAFCRVQSLGLIVRETRPVFTALSADEE

SEQ ID NO: 122453 - protein, 383 aa, Heterodera glycines
  Homolog annotation: Hit_ID=NP_497229.1; Match level="QueryCoverage =35%, HitCoverage=24%, E-value=3e-11, Identity=28%"; Hit description =dna-directed RNA polymerases III polypeptide like (3B261) [Caenorhabditis elegans] gb|AAK29861.1| Hypothe
  Essential gene: C elegans homolog=W06E11.1; Phenotype=Lva
  Coding regions on vcDNA: vcDNA=SeqID_48876; Strand=+; Position=12-1163
MGPKKAPPARRKAEPSEGEEEVKRKKAKRIVIEDEPEEEANGTGSQLQQNGHEEAMAPVVKGGDEEDEVVSEVGIYLLPLAPSDAGGIAKMANSAGAASSVSINRLQFPQQHPNVLRRRFNGALSGRGNAQDGEEEEEDQEEQRTDRTGRKLFAQYKAQVKHLRLGFGSDCDEEAMASAVMPTFAGGGGIAELLTKNHTPSSSALFSPPPSASASSSAIKRGSDLTSDEMFTGEGFSQQGLLNYAVGFFKKGRLFLLPVDKTFEMRKPLRGTIERESTARTTALKPSSSVFSTSTRSVAADSAPSGTASASSSSVAVAAPLRIRFARAENDLQRRRREQSSFYKQKLVEQDQWIPLKVEHRDLLEMYEKDINKVLLSSECPPK

SEQ ID NO: 122454 - protein, 275 aa, Heterodera glycines
  Homolog annotation: Hit_ID=NP_499156.1; Match level="QueryCoverage =86%, HitCoverage=82%, E-value=4e-89, Identity=70%"; Hit description =Enoyl-CoA hydratase/carnithine racemase, mitochondrial (31.2 kD) (3K842) [Caenorhabditis elegans] emb|CAA
  Gene Ontology: Mol. function=enoyl-CoA hydratase activity; Cellular component=mitochondrion; Biological process=energy pathways
  Essential gene: C elegans homolog=T05G5.6; Phenotype=Lva
  Coding regions on vcDNA: vcDNA=SeqID_48877; Strand=+; Position=36-860
MFTKLMPFLSLRQPLAVASYSLIQQARKFSTAVMTNYEMIKVERVGADDVVALITLNRPKALNALCSQLMDELAHSLTYLDKDDGVHAIVLTGSERAFAAGADIKEMVPKKFAEVFGGGFLENWSQVATVRKPTIAAVNGHALGGGCELAMMCDIIYAGEKAMFGQPEIKIGTIPGAGGTQRLARIVGKSLAMKMCLTGEPINASKALESGLVAEVFPPDQLVSEAIKLGEKIAANSPLMVGMAKQAVNRSYETTLQEGLLFERRLFHASFATND

SEQ ID NO: 122455 - protein, 123 aa, Heterodera glycines; identical to SEQ ID NO: 119521
  Homolog annotation: Hit_ID=P30757; Match level="QueryCoverage=100%, HitCoverage=100%, E-value=2e-55, Identity=86%"; Hit description =Histone H2B pir||S16084 histone H2B - sipunculid (Sipunculus nudus)
  Gene Ontology: Mol. function=DNA binding; Cellular component =nucleosome; Biological process=nucleosome assembly
  Essential gene: C elegans homolog=H02I12.6; Phenotype=Gro,Pvl,Ste
  Coding regions on vcDNA: vcDNA=SeqID_48878; Strand=+; Position=65-436

SEQ ID NO: 122456 - protein, 205 aa, Heterodera glycines
  Homolog annotation: Hit_ID=CAE67093.1; Match level="QueryCoverage =95%, HitCoverage=54%, E-value=2e-84, Identity=80%"; Hit description =Hypothetical protein CBG12504 [Caenorhabditis briggsae]
  Gene Ontology: Mol. function=isocitrate dehydrogenase (NAD+) activity; Cellular component=mitochondrial matrix; Biological process=carbohydrate metabolism
  Essential gene: C elegans homolog=F43G9.1; Phenotype=Emb,Gro,Pvl
  Coding regions on vcDNA: vcDNA=SeqID_48879; Strand=+; Position=20-634
MLKNNLLIRGKSVLFSLPLRAFSLSAQCANGEPIRRVVLIPGDGIGPEISSAVQKIFEAAKTPIDWDPVDVTPVQGRDGIFRIPNKCIELMHKNKVGLKGPLETPIGKGHRSLNLAVRKEFNLYANVRPCRSLEGHKTLYDNVDGVTIRENTEGEYSGIEHEIGSGGVQSIKLITEQASRRVARFAFEYARQNGRKEVTAVHKAN

SEQ ID NO: 122457 - protein, 206 aa, Heterodera glycines
  Homolog annotation: Hit_ID=CAE60169.1; Match level="QueryCoverage =91%, HitCoverage=60%, E-value=3e-83, Identity=79%"; Hit description =Hypothetical protein CBG03723 [Caenorhabditis briggsae]
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_48880; Strand=+; Position=21-638
MAAHSPGSSGDTSTPSLRKFLTDALVGGTAAGIAKTGMAPIERVKLILQSQDASSQITADKRYKGIVDVLVRVPKEQGFLALWRGNLPNVLRYFPTQALNFAFKDTYQRMFMEGVDKDKQFWKSFVMSLASGGAAGATSLCFVYPLDFARTRLAVDVGKADTREFKGLADCIMKILKSDGPIGLYRGFFVSVQGIIIYRGRYFGCF

SEQ ID NO: 122458 - protein, 194 aa, Heterodera glycines
  Homolog annotation: Hit_ID=CAE64607.1; Match level="QueryCoverage =87%, HitCoverage=91%, E-value=1e-34, Identity=42%"; Hit description =Hypothetical protein CBG09363 [Caenorhabditis briggsae]
  Essential gene: C elegans homolog=CD4.3; Phenotype=Emb,Gro
  Coding regions on vcDNA: vcDNA=SeqID_48881; Strand=+; Position=47-631
MNRILSKNLFNRFFVGYENLPSCRHYPTLRSSANAPKPDDLYEPRFESDRKYPDVPLLNVLLQAYDFQPVEKFQAYVHWAAKHFGIQIVESYALAHTSELVKEYKAGSTIPVSQSVLKTYSRVVRVGPVPGIQLPLFIALLQAHAPVGMKIVVKKHSPRDERCRYIPDPQLEDFKETLRNLDDPVVRKLLGWEA

SEQ ID NO: 122459 - protein, 204 aa, Heterodera glycines
  Homolog annotation: Hit_ID=CAE67303.1; Match level="QueryCoverage =99%, HitCoverage=46%, E-value=2e-94, Identity=84%"; Hit description =Hypothetical protein CBG12756 [Caenorhabditis briggsae]
  Gene Ontology: Mol. function=adenosylhomocysteinase activity; Cellular component=cytoplasm; Biological process=one-carbon compound metabolism
  Essential gene: C elegans homolog=K02F2.2; Phenotype=Lva,Unc
  Coding regions on vcDNA: vcDNA=SeqID_48882; Strand=+; Position=24-635
MSSKPAYKVADISLADFGRKEITIAENEMPGLMAMRAKFGAQKPLKGARIAGCLHMTVQTAVLIETLLELGAEVQWSSCNIFSTQDHAAAAIAKRGVPVYAWKGETDEEYEWCIEQTLIFPDGKPLNMILDHRGNLTNLVHHQHAELLPGIIRLSEETTTGVHNLPKMLAAGLLKTAAINVNDSVTKSKFDNMYGIRESLPDGI

SEQ ID NO: 122460 - protein, 186 aa, Heterodera glycines
  Homolog annotation: Hit_ID=NP_740880.1; Match level="QueryCoverage =97%, HitCoverage=59%, E-value=8e-50, Identity=53%"; Hit description =quaking related 5 (33.2 kD) (1H379C) [Caenorhabditis elegans] gb|AAM81088.1| Hypothetical protein E02D9.1
  Gene Ontology: Mol. function=transcriptional repressor activity; Cellular component=nucleus; Biological process=RAS protein signal transduction
  Essential gene: C elegans homolog=E02D9.1b; Phenotype=Gro,Pvl,Unc
  Coding regions on vcDNA: vcDNA=SeqID_48883; Strand=+; Position=106-663
MSKFEGGFSSHDSYGYGQMPSAFPSIGGAAPSAPPFGFSGAPIGSHAFGGDIPSPLDAEIQIVLREIQSEVHQLENSGEYGEQLKNARRLLATEATKLENNIDPEWLEVDINKPIKVSKKVLIPSFRHPKFNFVGKVLGPKGTTLQNIAKSYKCHVYILGRGSTRDRTKEQEMLSSGDPQYAHYCG

SEQ ID NO: 122461 - protein, 104 aa, Heterodera glycines
  Homolog annotation: Hit_ID=NP_490842.1; Match level="QueryCoverage =83%, HitCoverage=95%, E-value=1e-35, Identity=82%"; Hit description =SUMO, small ubiquitin-like modifier, SUMO, small ubiquitin-like modifier SMO-1 (10.2 kD) (smo-1) [Caenorh
  Gene Ontology: Mol. function=protein tagging activity; Cellular component=chromosome; Biological process=cell organization and biogenesis
  Essential gene: C elegans homolog=K12C11.2; Phenotype =Dpy,Emb,Gro,Pvl,Stp
  Coding regions on vcDNA: vcDNA=SeqID_48884; Strand=+; Position=52-366
MADESGTNAGGAGAAGGAQPAEYIKLKVVGQDSNEVHFRVKYGTSMGKLKKAYAERTGVQVTSLRFLFDGRRVNDDDTPKSLEMEEDDVIEVYQEQLGGYIVEE

SEQ ID NO: 122462 - protein, 168 aa, Heterodera glycines
  Homolog annotation: Hit_ID=NP_001002579.1; Match level="QueryCoverage= 78%, HitCoverage=74%, E-value=3e-35, Identity=56%"; Hit description =zgc:92732 [Danio rerio] gb|AAH76212.1| Zgc:92732 [Danio rerio]
  Gene Ontology: Cellular component=mitochondrion; Biological process =embryogenesis and morphogenesis
  Essential gene: C elegans homolog=F52A8.5; Phenotype=Emb
  Coding regions on vcDNA: vcDNA=SeqID_48885; Strand=+; Position=38-544
MASTTIRFCSLFKRLPAKTFVSCRTLSTSRPMFADILYTDKHEWLSLDEARSVGTVGITNHAQESLGDVVYVELPEIGKKLDSGDTAGAIESVKAASDLYAPVAGEVVERNAEVEDKPALVNKDCYGKGWLYKMKVSNLKELDELMSEQSYKNFLAEESNKDDETQHF

SEQ ID NO: 122463 - protein, 1023 aa, Heterodera glycines
  Homolog annotation: Hit_ID=Q94637; Match level="QueryCoverage=73%, HitCoverage=41%, E-value=1e-72, Identity=25%"; Hit description =Vitellogenin 6 precursor gb|AAB49749.1| vitellogenin pir||T18561 vitellogenin vit-6 [similarity] - Oscheius sp
  Essential gene: C elegans homolog=C04F6.1; Phenotype=Emb,Gro
  Coding regions on vcDNA: vcDNA=SeqID_48886; Strand=+; Position=7-3078
MAILQNLNEKEAKIPTSVGVQLRILNSMPILANIEGQMKIKAESASLMSPLGIQFDVNTLASARLSQIQKMELWTPFASSGVESVRSAQVNLPLQAELNANSDQGISLKANLPKQKTQLASVHSLPITFTAKVDQNTKLVREPRQIVTIHDPKLERQQYELNSVQGQKNLAMPLHFRGHYHWPAEPTSYQQFAQLLLATENAVNIHYQPSRESPREAIFRVTGQHFEQLAQSEQPDAQLRNFFSEKFANAYSCDDEQCQQRGDCEQCEQIEQQQREDAQELEDQQMRQQSLHSFISAYKPRQQYKHSLKMVAQTNGGAKDAKAQGDIQAICDEQTAYCKVLVKVERPPIGNENQKWMLNAQAHVLMPETAASVEQLQTQPKQLKQFIAQAKAQWGQQGQQTQQVNIRVHGAQAHTQQVRAVLQQQQGSQLISAQHLRNMQRRSAFLNKFQIEAIYSLKANAQNAINRVLELFKSAYFWNTKSQLMSGQSAQKDGKIAATILIDPVTQKSANITIRTPAQQLRMEQIEVPYKVRPFALIRQRSAQQTHSLAQLFHQFSIKYRPQCTVDGRKVNTFDDLIYTAPLSSNCYSVVAKDCGSDQPQFVVLMKKVAQQQQQQTNKRAQNAAKVLKVITPEQQIECHPKTNAAGIPTQLICKVNGQQVTGDEQCQDSSSCVQFNNKQQDDVTIQTEAIAVRFNGRKAWLKVSQAYKNTQCGLCGHYDDSDDQGEELRMANGQRASDLAEFHRSYALEDAEECPQQVMNNFYSEQQQQNSEQDTFYGQFNQFEDEDEADDEQQQQSEKDEWQNEQFNGQFEEQNDGQVTDGGNPFEGIFNDQQQQQKCCCCCDDDEDEEGTNEQSQCRQNCQNGGECPEKCNKNDQKQCRKSSPPQPQQQQNCKGSDDEQCKGICNDGDEACAEQQQQWKAVWPILRTKTHEQNHAVCFSTRPVKHCPPDAYPYNPMNGYEQQQQPKTKKVSFVCMERAEPETRRLLRSLRRGQRVVDVNARGASFTENVSEPHQCWRRRY

SEQ ID NO: 122464 - protein, 216 aa, Heterodera glycines
  Homolog annotation: Hit_ID=CAE64415.1; Match level="QueryCoverage =53%, HitCoverage=11%, E-value=2e-18, Identity=44%"; Hit description =Hypothetical protein CBG09108 [Caenorhabditis briggsae]
  Gene Ontology: Mol. function=RNA binding; Cellular component =extracellular space
  Essential gene: C elegans homolog=C56G2.1a; Phenotype=Emb
  Coding regions on vcDNA: vcDNA=SeqID_48887; Strand=+; Position=136-783
MDDKSPAAIFAREFEHRQARDVDELRRIFHRHIEEESRNDEQQRHEKTAAPMLTTAPAMAAALPSARIVRTPHIGTNARENGTASLSAITPIAAAFRWCTPLANTPTVSRLTLPFRTPCFVHISVHVNPGHFFVQLPSHPTFSSLALLNQYMLTVYTHNQPGVGAPGLAKPYDVGVLCAAPAYNGWCRAITVAYDQDQDGMVGRFVDYGGFARLAR

SEQ ID NO: 122465 - protein, 211 aa, Heterodera glycines
  Homolog annotation: Hit_ID=CAE63626.1; Match level="QueryCoverage =88%, HitCoverage=93%, E-value=7e-42, Identity=48%"; Hit description =Hypothetical protein CBG08120 [Caenorhabditis briggsae]
  Gene Ontology: Mol. function=signal sequence binding; Cellular component=integral to membrane; Biological process=cotranslational membrane targeting
  Essential gene: C elegans homolog=T04G9.5; Phenotype=Emb
  Coding regions on vcDNA: vcDNA=SeqID_48888; Strand=+; Position=12-647
MFQKVFLVLLFLLAFTVSNLRSDEGIGEMDANQKPLNSARILASKFTLSQYAVESMDLVMEYNLFNVGDRTAFRVVLDDRNSFPTHSFDIVRGMLHIRWEKISPGENVTHSVVVRPRSYGIFNYTSAMVTYYVTEDAKQATVGYSTAPGEGNIYRLKDYERRFSSKIGIWLVFLLLALPTTLLPFFLWYKFQQKYATKSGTSGQQNSKKAQ

SEQ ID NO: 122466 - protein, 165 aa, Heterodera glycines
  Homolog annotation: Hit_ID=NP_587923.1; Match level="QueryCoverage =100%, HitCoverage=100%, E-value=1e-66, Identity=75%"; Hit description=60s ribosomal protein L12.1/L12A [Schizosaccharomyces pombe] ref|NP_587897.1| 60s ribosomal protein l12
  Gene Ontology: Mol. function=structural constituent of ribosome; Cellular component=cytosolic large ribosomal subunit (sensu Eukarya)
  Essential gene: C elegans homolog=JC8.3a; Phenotype=Ste
  Coding regions on vcDNA: vcDNA=SeqID_48889; Strand=+; Position=41-538
MPPKFDPNETKIITLRVTGGEVAGGSALAPKIGPLGLSPKKVGDDIAKATQAYKGLRVTVQLTVQNRQAAISVVPTASSLVIGALKEPPRDRKKEKNIKHSGNLTLDAIIDVARQMRPKSMARTLTGSVKEILGTAFSVGCTVDGMSPKEVQEKIDAGEIEIPEE

SEQ ID NO: 122467 - protein, 241 aa, Heterodera glycines
  Homolog annotation: Hit_ID=CAE67217.1; Match level="QueryCoverage =94%, HitCoverage=42%, E-value=5e-81, Identity=64%"; Hit description =Hypothetical protein CBG12654 [Caenorhabditis briggsae]
  Gene Ontology: Biological process=locomotory behavior
  Essential gene: C elegans homolog=F57B10.3a; Phenotype=Age
  Coding regions on vcDNA: vcDNA=SeqID_48890; Strand=+; Position=3-728
DTSPTSGAGFLQQLLDFLSAENYGELATIVGRYYAMDRDNRWERIKVAYEALVAGEGEKCEPANAVQLVNERYANQQTDEFLTPIVFSDEARVKDNDTLVFFNYRADRMREINKCMGDLQNLQDLGTNVALPNGLHIKTMTQYNAEFPFPILFPPVTHKNVLAEWLSVQQVSQFHCAESEKYAHVTFFFNGGREVQFEGEERELVPSPRVATYDLQPEMNCEGIADKVRNGSIMFRDSLRS

SEQ ID NO: 122468 - protein, 201 aa, Heterodera glycines
  Homolog annotation: Hit_ID=CAE57647.1; Match level="QueryCoverage =79%, HitCoverage=61%, E-value=6e-32, Identity=46%"; Hit description =Hypothetical protein CBG00635 [Caenorhabditis briggsae] emb|CAE57074.1| Hypothetical protein CBG24970 [Cae
  Gene Ontology: Mol. function=translation factor activity, nucleic acid binding; Cellular component=eukaryotic translation initiation factor 3 complex; Biological process=regulation of translational initiation
  Essential gene: C elegans homolog=F22B5.2; Phenotype=Emb,Lva
  Coding regions on vcDNA: vcDNA=SeqID_48891; Strand=+; Position=39-641
MSSNGTVSNQIGNLSNVGAIGNWVEAVDQETAQKRIEFLKDGIKTVIDYVDEPDGSKSKVIATYKVINKKVPRVVAERKKWKKFGTSKDDGPGPNIITTYVADEVEVQFTNRGGEQDDRDDKLAEALLKGQSSKAHCRFCKSDDHWSVTCPYKDMFKETSEEEQQEADKGGAKQTPGRYIPPSQRGGPAGERTMMTGGEQR

SEQ ID NO: 122469 - protein, 231 aa, Heterodera glycines
  Homolog annotation: Hit_ID=AAH74599.1; Match level="QueryCoverage =80%, HitCoverage=66%, E-value=2e-32, Identity=44%"; Hit description =MGC69468 protein [Xenopus tropicalis] ref|NP_001004819.1| MGC69468 protein [Xenopus tropicalis]
  Gene Ontology: Mol. function=RNA binding; Cellular component=nuclear speck; Biological process=growth
  Essential gene: C elegans homolog=C18D11.4; Phenotype=Lva
  Coding regions on vcDNA: vcDNA=SeqID_48892; Strand=+; Position=29-724
YSLILYIFLHKMGREHRSDRKRDYEKEHSPLADESSSGSRKRTKREKNRSVSPARSRSHTYSPSPRREISPKRRARSRSRSRDLPSSRGGGGGGGGYYGSRRFHDGRDNPNPNPCLGVFGMSLHTTERDLKHLFGRYGEVDSVQIVYDRLSGRSRGFGFVYFTHTKDAARAKENLVDAVIDGMKVRVDYSVTRGGGTHSRHVRKSFSRSPVRNNRSRTRSRSRSESRSVSR

SEQ ID NO: 122470 - protein, 227 aa, Heterodera glycines
  misc_feature (15)..(15): Xaa can be any naturally occurring amino acid
  Homolog annotation: Hit_ID=NP_501793.1; Match level="QueryCoverage =98%, HitCoverage=42%, E-value=3e-37, Identity=41%"; Hit description =SH2 motif and protein kinase family member (kin-5) [Caenorhabditis elegans] emb|CAA93289.1| Hypothetical
  Gene Ontology: Mol. function=protein tyrosine kinase activity; Cellular component=plasma membrane; Biological process=cell proliferation
  Essential gene: C elegans homolog=T04B2.2; Phenotype=Unclassified
  Coding regions on vcDNA: vcDNA=SeqID_48893; Strand=+; Position=3-683
VVELLPNDGDFLVRXTEEISGTERVYALSVNVGGFLNHVIFRRHKGMFSVDLNSDKGFRTIERFVDNYLRTGVSVTTQQYVALIRAVPRAHWELSHTSIILGNELGRGTFGVVKSGVYVDQQGTRAAVAIKEVSQTSTKEQIKEFMNEARVMRQLPHPNVIQFYGVAVGQEPLMIVMELATEGSLTNYLKHQRRSARVKLYMCLGASGGLDHIHSKGIIHCELACRK

SEQ ID NO: 122471 - protein, 213 aa, Heterodera glycines
  Homolog annotation: Hit_ID=NP_498064.2; Match level="QueryCoverage =92%, HitCoverage=16%, E-value=2e-46, Identity=51%"; Hit description =la related protein (3G102) [Caenorhabditis elegans] gb|AAK93859.2| Hypothetical protein R144.7 [Caenorhab
  Essential gene: C elegans homolog=R144.7; Phenotype=Emb
  Coding regions on vcDNA: vcDNA=SeqID_48894; Strand=+; Position=1-639
LNPWEKQQPNNNNRQNKGKENGTRQPQAMPVGWVLGVRSKTTSINEDAGPSHPSTSDALSTTVKPPASTSSIASVLPPHPSFSLIQENGFEQRVYTDWRSQCKKQREALGYDIPEMHTLYRIWSLFLRDNFNRSMYNEFRKFALEDADHGLRYGIESLFRFYSYGLEKKLRPKLYNDFQEATLQDVKRGHTFGLEKFLASLKYCKHSTQIGGD

SEQ ID NO: 122472 - protein, 228 aa, Heterodera glycines
  Homolog annotation: Hit_ID=CAB88203.1; Match level="QueryCoverage =99%, HitCoverage=99%, E-value=1e-105, Identity=64%"; Hit description= putative cuticular collagen [Globodera pallida]
  Gene Ontology: Mol. function=structural constituent of cuticle; Cellular component=extracellular; Biological process=cuticle biosynthesis (sensu Nematoda)
  Essential gene: C elegans homolog=C15A11.6; Phenotype=Emb
  Coding regions on vcDNA: vcDNA=SeqID_48895; Strand=+; Position=6-692
MQETHIVLGIASVCSLLAIIATVVTLPSLYSEMSQMNSKVRDGVEAFRVNTDSAWTDLMDVQVVVTPPSKPRDNPFNSIFRAKRQLPGHCQCAGLQQPSCPPGPPGPSGPPGQPGQPGGAGQPGQPGQPGQPGANGVVSRPIPGPKGPPGAPGQNGNPGSQGQPGQPGGQGPPGPPGAPGQPGQPGNSGQPGQPGAPGQPGKDSGYCPCPPRSSVLAVKKKMAAAKKA

SEQ ID NO: 122473 - protein, 186 aa, Heterodera glycines
  Homolog annotation: Hit_ID=CAE74731.1; Match level="QueryCoverage =100%, HitCoverage=49%, E-value=6e-72, Identity=69%"; Hit description= Hypothetical protein CBG22549 [Caenorhabditis briggsae]
  Gene Ontology: Mol. function=actin binding; Cellular component =lamellipodium; Biological process=cell adhesion
  Essential gene: C elegans homolog=T21D12.4; Phenotype=Emb,Lvl
  Coding regions on vcDNA: vcDNA=SeqID_48896; Strand=+; Position=356-965
DIVAILHLLITLALHYRAPIRFPNNVNVQVLIYTRHGKQISKSIVTEQLTTKQTELAPKGERDAFDTLFDYGPDKLQHVKNSLVAFCNKHLNKINLEVTDLETQFQDGVFLILLMGLLEGYFVPLYKFHLQVNNNDEKLKNVQFAYFLMEEAGMAKPKCRPADIVNGDLKSTLRVLHALFTKYKHV

SEQ ID NO: 122474 - protein, 269 aa, Heterodera glycines
  Homolog annotation: Hit_ID=NP_493558.1; Match level="QueryCoverage =99%, HitCoverage=93%, E-value=9e-75, Identity=54%"; Hit description =proteasome Beta Subunit (31.2 kD) (pbs-5) [Caenorhabditis elegans] emb|CAB04567.1| Hypothetical protein K
  Gene Ontology: Mol. function=endopeptidase activity; Cellular component=proteasome core complex (sensu Eukarya); Biological process=embryonic cleavage
  Essential gene: C elegans homolog=K05C4.1; Phenotype=Emb
  Coding regions on vcDNA: vcDNA=SeqID_48897; Strand=+; Position=47-853
MFYHDLHDNENSHDKELKQLVQMDDLAIPKFVMPPLGIKPKKFVRKHFGPNSRLPMAQFLKGTTTLSFVYKPKTPQDKGGVIVAVDSRATGGTYISSKTVEKIIPINDQLVATMAGGAADCQYWTRVVSKYCNLFELREGTQISVAAASKYFANVMYDYRGQELGVHSMVCGVDKFGPSIYMVEAEGTRVKIDTICSLGSGMLHAMSILDTKYKEAMTDAEALELGRKTIVYATFRDAASRGHCNLGHITSEGKTIYPPFDVNDKYYEF

SEQ ID NO: 122475 - protein, 212 aa, Heterodera glycines
  Homolog annotation: Hit_ID=CAE61399.1; Match level="QueryCoverage =84%, HitCoverage=36%, E-value=1e-48, Identity=52%"; Hit description =Hypothetical protein CBG05258 [Caenorhabditis briggsae]
  Gene Ontology: Mol. function=aspartic-type endopeptidase activity; Cellular component=lysosome; Biological process=induction of non -apoptotic programmed cell death
  Essential gene: C elegans homolog=R12H7.2; Phenotype=Ced
  Coding regions on vcDNA: vcDNA=SeqID_48898; Strand=+; Position=18-653
MVNKFLPLIIFVFLLIDTAICRHHHRHSHHHHQQNEQPEMISVPLRRMDTVRARLALTGSLEQFRKHRTESLRRTVERMNNNYNNNEEYSSAESDQEQMEMAQNGARVGTEIDELLRNYMDAQYYGDISIGSPAQNFTVIFDTGSSNLWVPSKKCPIYDIACSLHHKYDGAKSTSYQPDGRKVAIQYGTGSMKGFVSKDIVCMANICVQKQE

SEQ ID NO: 122476 - protein, 157 aa, Heterodera glycines
  Homolog annotation: Hit_ID=NP_506598.1; Match level="QueryCoverage =81%, HitCoverage=92%, E-value=4e-13, Identity=33%"; Hit description =putative cytoplasmic protein (16.5 kD) (5P4) [Caenorhabditis elegans] emb|CAB03983.1| Hypothetical protei
  Essential gene: C elegans homolog=C53A5.1; Phenotype=Emb,Lva
  Coding regions on vcDNA: vcDNA=SeqID_48899; Strand=+; Position=27-500
MAVVSRMWYIGKETCKFFHGAVKVFFDPNWQIPKTKLDPRMPAYPTQLHEWLRMFPWRHYWAYYPILRNFCYVFASAFVVTSITQPTSVKITKEHVINHELHHIEAKMLHAYTQRKEDLKYFKENDVMAKLRPKNFARDLSMGDFNYFPWGYSFGAH

SEQ ID NO: 122477 - protein, 162 aa, Heterodera glycines
  Homolog annotation: Hit_ID=CAE56013.1; Match level="QueryCoverage =75%, HitCoverage=94%, E-value=4e-27, Identity=45%"; Hit description =Hypothetical protein CBG23568 [Caenorhabditis briggsae]
  Essential gene: C elegans homolog=T02H6.11; Phenotype=Age,Gro,Lva,Ste
  Coding regions on vcDNA: vcDNA=SeqID_48900; Strand=+; Position=21-509
MHNILKRFFAHVSPSLLKKPLNDPFPIAAWRSHPANMAKGVKFDHDNAFVRFCRYYLWHYCWSGRQYGLQFYDQAFEPHPVVQEALRRLRLKDPYQYDLRLQRILLASQLGSKNERLPKNMWTKWDDETFYLNPYFNEIEEEKLEREASTGMKPGYQLKEQI

SEQ ID NO: 122478 - protein, 232 aa, Heterodera glycines
  Homolog annotation: Hit_ID=NP_496178.1; Match level="QueryCoverage =83%, HitCoverage=25%, E-value=7e-20, Identity=31%"; Hit description =XTP5 (87.0 kD) (2K391) [Caenorhabditis elegans] emb|CAA88437.1| Hypothetical protein ZK945.3 [Caenorhabdi
  Essential gene: C elegans homolog=ZK945.3; Phenotype=Egl
  Coding regions on vcDNA: vcDNA=SeqID_48901; Strand=+; Position=4-702
MLKQGDSNCHSKKASGSRYSELFECIRDNLLTFIKANMRQMLFDKISAVLVLDTLEVPSPSDPFLREIGDSDLDDCFRAIAEIATDEFVPHSPDGPSHIVQGGCARFVFRKLLQADPGRCDGHRLSDFLADLPADNLSSWTSMDCGCYTLVEVFKSGSDKARKVLRRALSVAMLQNSHLSGAKSLLDLLLGKGKEQPTREHSVANGGGAGRKNPRKAAAPFQKRRERKTNQA

SEQ ID NO: 122479 - protein, 133 aa, Heterodera glycines; identical to SEQ ID NO: 121281
  Homolog annotation: Hit_ID=NP_492601.1; Match level="QueryCoverage =90%, HitCoverage=91%, E-value=4e-40, Identity=57%"; Hit description =cytochrome C Oxidase, subunit Vb, LiPid Depleted LPD-4 (lpd-4) [Caenorhabditis elegans] emb|CAB03002.1| H
  Gene Ontology: Biological process=negative regulation of FGF receptor signaling pathway
  Essential gene: C elegans homolog=F26E4.9; Phenotype=Lpd
  Coding regions on vcDNA: vcDNA=SeqID_48902; Strand=+; Position=40-441

SEQ ID NO: 122480 - protein, 310 aa, Heterodera glycines
  misc_feature (273)..(273): Xaa can be any naturally occurring amino acid
  Homolog annotation: Hit_ID=NP_504301.1; Match level="QueryCoverage =100%, HitCoverage=78%, E-value=4e-43, Identity=33%"; Hit description= acyl-coa thioesterase family member (46.2 kD) (5F336) [Caenorhabditis elegans] gb|AAK68237.1| Hypothetic
  Gene Ontology: Mol. function=acyl-CoA thioesterase activity; Biological process=acyl-CoA metabolism
  Essential gene: C elegans homolog=C17C3.1a; Phenotype=Unclassified
  Coding regions on vcDNA: vcDNA=SeqID_48903; Strand=+; Position=82-1011
MSSESNMENFPVKLDMDYIKRLARIERTGPNTFNANFLVAGYRKAVNKDVFGGQMFAQAIAAAEATVDGDEFAPNAAHSMFIRKAFIDHPIEYIVTRTRDGRSFCTRTVEARQNGETVFCAQISLCVKERSSIEHQTEMPAEVPEPEELVPFFKTVRRVVTEHDEGRTERNGRTIANLRAVLEDEQQPSVFEFRPIHSDIFLGIRPHSPTPIRYWLKCAVPLGSERTNKALNRFLLAFITDATMASTANRAHASHNYHPSMVVSLDHIVHFHXDNFFADEWLLCENTSPIARNGRALTDGRIWNRKGQLL

SEQ ID NO: 122481 - protein, 232 aa, Heterodera glycines
  Homolog annotation: Hit_ID=CAE68452.1; Match level="QueryCoverage =99%, HitCoverage=83%, E-value=8e-61, Identity=49%"; Hit description =Hypothetical protein CBG14242 [Caenorhabditis briggsae]
  Gene Ontology: Mol. function=protein binding
  Essential gene: C elegans homolog=D2013.6; Phenotype=Gro,Stp
  Coding regions on vcDNA: vcDNA=SeqID_48904; Strand=+; Position=75-770
MSLNTANTPDGRGVIIYSGEMILLFVREVNLSFDKFTNAAFKGTKKGNLYLTTHRIIFNNTETSSRGNFKSLSMPFGCIRNVKLEQPIFGANYLAGELVAQPDGNWEGEVNWKLTFNRGGCIEFGQALLKTSEMANNFCPRPANAPPPYAPPPGAYYSPPPAYYWSGGQFNGYQAPVHAFPEQPPPESVFMYEQPPPYAGIGPIRGQNPVPYPSNTPLYPPQQQPLPTNTPS

SEQ ID NO: 122482 - protein, 225 aa, Heterodera glycines
  Homolog annotation: Hit_ID=CAE68163.1; Match level="QueryCoverage =99%, HitCoverage=57%, E-value=6e-97, Identity=70%"; Hit description =Hypothetical protein CBG13820 [Caenorhabditis briggsae]
  Gene Ontology: Mol. function=glutamate-ammonia ligase activity; Cellular component=cytoplasm; Biological process=glutamate metabolism
  Essential gene: C elegans homolog=C28D4.3; Phenotype=Emb
  Coding regions on vcDNA: vcDNA=SeqID_48905; Strand=+; Position=12-686
MNLRDQFSTNKYVAHRFMQLPTHNKVQVEYVWIDGSGENVRSKTRTVDFVPSKVDDLPVWNFDGSSTGQASGADSDVFIKPVAMYNDPFRMGNHKIVMCEAFDNKMQPHVTNNRARCKQTMDAAAKEHAWFGMEQEYTLLDVDQHPFGWPKAPFGFPGPQGPYYCGAGANKAYGRDIVDSHYRACLYAGILISGTNAEVMPGQWEFQVGPCEGIQMGDQLFMARF

SEQ ID NO: 122483 - protein, 103 aa, Heterodera glycines; identical to SEQ ID NO: 119330
  Homolog annotation: Hit_ID=NP_509231.1; Match level="QueryCoverage =100%, HitCoverage=100%, E-value=3e-52, Identity=99%"; Hit description=histone (his-38) [Caenorhabditis elegans] ref|NP _507034.1| histone (his-1) [Caenorhabditis elegans] ref
  Essential gene: C elegans homolog=ZK131.1; Phenotype=Unclassified
  Coding regions on vcDNA: vcDNA=SeqID_48906; Strand=+; Position=32-343

SEQ ID NO: 122484 - protein, 133 aa, Heterodera glycines
  Homolog annotation: Hit_ID=NP_493258.1; Match level="QueryCoverage =100%, HitCoverage=100%, E-value=3e-41, Identity=60%"; Hit description=profilin (14.3 kD) (pfn-1) [Caenorhabditis elegans] emb|CAA22318.1| Hypothetical protein Y18D10A.20 [Ca
  Gene Ontology: Cellular component=actin filament; Biological process =cytokinesis
  Essential gene: C elegans homolog=Y18D10A.20; Phenotype=Emb,Stp,Unc
  Coding regions on vcDNA: vcDNA=SeqID_48907; Strand=+; Position=63-464
MSGWDAYIQSLTSSCAEITRVAIIGNSDASVWARTEGENEFKASEPELKKLVGQFDDLSQVPSVGADLEGIHYIVPRTDENLIFGKRDKTGFFAVKTKSAILIAIYKDEESVVGADVRGAVEKMAKYLEDAGY

SEQ ID NO: 122485 - protein, 169 aa, Heterodera glycines
  Homolog annotation: Hit_ID=CAE67544.1; Match level="QueryCoverage =76%, HitCoverage=86%, E-value=1e-10, Identity=27%"; Hit description =Hypothetical protein CBG13069 [Caenorhabditis briggsae]
  Essential gene: C elegans homolog=F10E7.6; Phenotype=Clr,Gro,Sck
  Coding regions on vcDNA: vcDNA=SeqID_48908; Strand=+; Position=42-548
MASFLRFLACRHFSMSSVLRKEAEQLTNEHIDKIRQRTRFSETSAFHGRGSGGRTNGESGEDAFTNPFYIASYYDSKRFEAIRGVSIFASISLLLIYVAWFKEPNEVDELWDYDMRLVYFVAKKRVLKDQIEQAKKGGQGTVDLETDLINIEVQEQKIREEEEKKAKKI

SEQ ID NO: 122486 - protein, 222 aa, Heterodera glycines
  Homolog annotation: Hit_ID=NP_496279.1; Match level="QueryCoverage =98%, HitCoverage=95%, E-value=1e-56, Identity=48%"; Hit description =gene producing two messages overlaping 3' 5', encoding DNA-directed RNA polymerase subunit K/omega and a
  Gene Ontology: Biological process=positive regulation of body size
  Essential gene: C elegans homolog=C14A4.1; Phenotype=Unclassified
  Coding regions on vcDNA: vcDNA=SeqID_48909; Strand=+; Position=2-667
MAVFVKDQNFVPEKRVDEAGHILNDPSKSLADRFRALFLLRSVKSDRAVHWICKCFSDPSALLKHELAYCLGQMQNPAAIQKLIFVLQDTEQEPMVRHEAAEALGAIGDPSNEHGLSKLFEQYSGDAVREVAETCLLALRRTQWVKEKGKDDTESRSIYDSIDPAPAADGGKGAAEVEQLGQMLVDHNMALWDRYRAMFALRNLNNDRATKALADGLLCDDS

SEQ ID NO: 122487 - protein, 225 aa, Heterodera glycines
  Homolog annotation: Hit_ID=NP_001000.2; Match level="QueryCoverage =85%, HitCoverage=94%, E-value=4e-94, Identity=88%"; Hit description =ribosomal protein S5 [Homo sapiens] gb|AAH15405.1| Ribosomal protein S5 [Homo sapiens] gb|AAH18151.1| Rib
  Gene Ontology: Mol. function=structural constituent of ribosome; Cellular component=cytosolic small ribosomal subunit (sensu Eukarya); Biological process=protein biosynthesis
  Essential gene: C elegans homolog=T05E11.1; Phenotype=Ste
  Coding regions on vcDNA: vcDNA=SeqID_48910; Strand=+; Position=55-732
MATEVDENTAVADPWSTVEDVSGGESMHQLVTLDVPEIKLFGKWSLNDVDVSDISLVDYVAVKEKAAKYLPHSAGRYQQKRFRKATCPVVERLVSSMMMHGRNNGKKLMAVRIVKHAFEIIHLLTGENPVQVLVNAVINSGPREDSTRIGRAGTVRRQAVDVSPLRRVNQAIWLLCTGSREAAFRNIKTIAECLADELMNAAKGSSNSYAIKKKDELERVAKSNR

SEQ ID NO: 122488 - protein, 201 aa, Heterodera glycines
  Homolog annotation: Hit_ID=CAE75742.1; Match level="QueryCoverage =92%, HitCoverage=86%, E-value=2e-86, Identity=84%"; Hit description =probable 40S ribosomal protein S5 [Neurospora crassa]
  Gene Ontology: Mol. function=structural constituent of ribosome; Cellular component=cytosolic small ribosomal subunit (sensu Eukarya); Biological process=protein biosynthesis
  Essential gene: C elegans homolog=T05E11.1; Phenotype=Ste
  Coding regions on vcDNA: vcDNA=SeqID_48911; Strand=+; Position=12-617
MSLPVEIVNHDQSEAPKLFGKWSFEEVRCNDLALVDYIQISSPIYLPHTAGRYAAKRFRKAQCPVVERLTNSLMMHGRNNGKKLMATRIVKHAFEIIHLLTDANPLQILVDAIVNTGPREDSTRIGSQGTVRRQAVDVSPLRRVNQAIALLTTGTREAAFRNVKTIAECLADELINAAKGSSNSYAIKKKDELERVAKSNR

SEQ ID NO: 122489 - protein, 222 aa, Heterodera glycines
  Homolog annotation: Hit_ID=AAH20679.1; Match level="QueryCoverage =98%, HitCoverage=77%, E-value=2e-44, Identity=46%"; Hit description =Ribosomal protein L6 [Homo sapiens]
  Gene Ontology: Mol. function=structural constituent of ribosome; Cellular component=cytosolic large ribosomal subunit (sensu Eukarya); Biological process=protein biosynthesis
  Essential gene: C elegans homolog=R151.3; Phenotype=Emb,Lva
  Coding regions on vcDNA: vcDNA=SeqID_48912; Strand=+; Position=7-672
DKDSKMTSKTSPKMPRNYQIASGLQRFSKARMFHAKGMWVKLKKPFEKKAKHAQKAEKFVVKKIGGEKNGGERKVLKKKEPKLLPQVPSVQIKNKNRPKKVPLRKSISPGTVLIILAGRHRGKRVIFIKQLPKSGLLLVTGPLKLNATPLRRIAQAFVIATKTKLDISTMNVPEHLDDKYFKRQSGKVADRSKGGIFAEGANQQYAVTDQRKEDQKTVDSQV

SEQ ID NO: 122490 - protein, 112 aa, Heterodera glycines
  Homolog annotation: Hit_ID=AAT92169.1; Match level="QueryCoverage =100%, HitCoverage=100%, E-value=1e-31, Identity=61%"; Hit description=ribosomal protein, large P2 [Ixodes pacificus]
  Gene Ontology: Mol. function=structural constituent of ribosome; Cellular component=cytosolic large ribosomal subunit (sensu Eukarya); Biological process=protein biosynthesis
  Essential gene: C elegans homolog=C37A2.7; Phenotype=Emb,Gro
  Coding regions on vcDNA: vcDNA=SeqID_48913; Strand=+; Position=42-380
MKYVAAYMLASLGGNGDPSPKDLEKILAAGGLEVDMDNVKAVLNAVKGKSIEEVIAAGQKKLATMPTGGGAAAPTAAAAATAAPAAAEKKEEKKKEEVKEESDDDMGFGLFD

SEQ ID NO: 122491 - protein, 212 aa, Heterodera glycines
  Homolog annotation: Hit_ID=CAE70146.1; Match level="QueryCoverage =93%, HitCoverage=89%, E-value=9e-71, Identity=58%"; Hit description =Hypothetical protein CBG16608 [Caenorhabditis briggsae]
  Gene Ontology: Mol. function=protein binding; Cellular component =nucleus
  Essential gene: C elegans homolog=K04G7.11; Phenotype=Emb
  Coding regions on vcDNA: vcDNA=SeqID_48914; Strand=+; Position=13-648
MKPTIDLKQDISKYKERFQKLHHKREESRKINHEHVVEEDRRLKLPNNFEAKRKRQEWELEELVARKEAEERGEDYDRIKALGTQADIADKMEAAKRRKANPDTGFASYEAMSIRQYERMTNGIKPDMESYQKMKGVVGEDQFYASANTLIQGSHYPTDKALDKLSEDVHNQMKKRDQYHRRRMFDPDAPIDFINERNRKFNHKLERYYGKY

SEQ ID NO: 122492 - protein, 329 aa, Heterodera glycines
  misc_feature (181)..(181): Xaa can be any naturally occurring amino acid
  Homolog annotation: Hit_ID=NP_498457.1; Match level="QueryCoverage =97%, HitCoverage=94%, E-value=1e-119, Identity=66%"; Hit description= malate dehydrogenase (35.1 kD) (mdh-1) [Caenorhabditis elegans] gb|AAB53985.1| Malate dehydrogenase prot
  Gene Ontology: Mol. function=L-malate dehydrogenase activity; Cellular component=mitochondrial matrix; Biological process=malate metabolism
  Essential gene: C elegans homolog=F20H11.3; Phenotype=Emb,Gro
  Coding regions on vcDNA: vcDNA=SeqID_48915; Strand=+; Position=34-1024
MQQCSRLMSVRMKSSSIKVTLIGASGGIGQPLGLLLKKNPSIAHLALYDLVGTPGVAADLSHINTPAKVTGHLGPDQLVAALEGADVVIIPAGVPRKPGMTRDDLFTTNAGIVRDMAEAAAKTCPKAFMGIITNPVNSTLPIACEVYKNNDCFDPRRIFGVTLIDIVRAQAFVSKLKGMDXSQTKVSVVGGHSGVTIVPLLSRCTPKVSLSDSETKALTERIQEAGTEVVKAKAGAGSATLSMALAAEYFVSALINALKGQKSVQCAYVKSDVVEGLDYFAGPLELGPNGVEKILPLGDLTAYEKELISKAVPELKKEIAKGVNFIKQG

SEQ ID NO: 122493 - protein, 415 aa, Heterodera glycines
  Homolog annotation: Hit_ID=NP_491672.1; Match level="QueryCoverage =100%, HitCoverage=96%, E-value=0.0, Identity=83%"; Hit description =proteasome Regulatory Particle, ATPase-like, S6a (48.1 kD) (rpt-5) [Caenorhabditis elegans] gb|AAC19196.1|
  Gene Ontology: Mol. function=transcription co-repressor activity; Cellular component=26S proteasome; Biological process=embryonic cleavage
  Essential gene: C elegans homolog=F56H1.4; Phenotype=Emb
  Coding regions on vcDNA: vcDNA=SeqID_48916; Strand=+; Position=17-1261
MVETAEQPAKKEDEKMETAEDEIDAEILQMSTDQIRERSLLLDNEIRIMRSEIQRISHSMQTLKEKTKENNERIKINKTLPYLVSNVIELLDLEEQQEEEGANIDLDAHKTKCAVIKTSTRATYFLPVVGLVDPEEMKPSDLVGVNKDSYLILEKLPPEYDSRVKAMEVDERPKETYSDIGGCDSQIRELVEAIVLPMTKKDLFINIGIQPPKGVLMYGPPGTGKTMLARAVAAQTKSTFLKLAGPQLVQMFIGDGAKLVRDAFALAKEKAPSIIFIDELDAIGTKRFSSEKAGDREVQRTMLELLNQLDGFQPNDDIKVIAATNRVDVLDPALLRSGRLDRKIELPAPNEKARAHIVRIHSRNMNVDKDVNFDELARCTDDFNGAQCKAVCVEAGMIALRRESHIILHEDFMDA

SEQ ID NO: 122494 - protein, 213 aa, Heterodera glycines
  misc_feature (196)..(196): Xaa can be any naturally occurring amino acid
  Homolog annotation: Hit_ID=CAF90372.1; Match level="QueryCoverage =100%, HitCoverage=68%, E-value=5e-48, Identity=49%"; Hit description= unnamed protein product [Tetraodon nigroviridis]
  Gene Ontology: Biological process=nonselective vesicle transport
  Essential gene: C elegans homolog=F45G2.4; Phenotype=Gro,Lvl,Unc
  Coding regions on vcDNA: vcDNA=SeqID_48917; Strand=+; Position=27-665
MDTLFDVRNNFYLGAFQQCINEAQKVKCKSEEEKELKDAFMYRAYIGLNKCSVPLGEIDATDGNGSAALMAIRRFATFMSGAPEKRSEIVDQVAKEFETKKYADNEICLLISTLIFMHGEKTEEALRVLNRTASDSLECAALRVQCLLKLNRGDLAAKEVKRMQEMDEDATITQLAQAWLNMAMGRDKLKDAFYIXQEMVDKYGATPLLLTSQ

SEQ ID NO: 122495 - protein, 143 aa, Heterodera glycines
  Homolog annotation: Hit_ID=CAE69591.1; Match level="QueryCoverage =58%, HitCoverage=6%, E-value=3e-16, Identity=50%"; Hit description =Hypothetical protein CBG15813 [Caenorhabditis briggsae]
  Gene Ontology: Cellular component=cytoskeleton; Biological process =microtubule-based process
  Essential gene: C elegans homolog=ZK1151.1b; Phenotype=Bmd,Lva,Lvl,Unc
  Coding regions on vcDNA: vcDNA=SeqID_48918; Strand=+; Position=1-432
MLRQLDSVREYIQQLHARLLSLTDRFAQISPLWQRGEPISKPLPVMALCEYKSKDKIHIRQGDKYTLLDNHDQIQWRVRGMDDVEVVSTPGTSGATGATAVSQLIEEDEEKCARCATASATVRKIATSVESEELFLLSFVRLF

SEQ ID NO: 122496 - protein, 226 aa, Heterodera glycines
  Homolog annotation: Hit_ID=CAE71175.1; Match level="QueryCoverage =45%, HitCoverage=80%, E-value=3e-29, Identity=51%"; Hit description =Hypothetical protein CBG18032 [Caenorhabditis briggsae]
  Gene Ontology: Mol. function=ubiquitin-protein ligase activity; Cellular component=anaphase-promoting complex; Biological process =meiotic chromosome segregation
  Essential gene: C elegans homolog=F35G12.9; Phenotype=Mei,Ste
  Coding regions on vcDNA: vcDNA=SeqID_48919; Strand=+; Position=40-720
MMSSNEEEESGGSNDDQFSSPISPVSPIQPMSTDWSNAIDAQEMGAGGVGGGISSGSLHESLHELSPIWADSDLIGDTLSAVPDSPSDEDPYASTIYRPVSMVTPVAALPNPNPPSCSFGGPMESIEAKGPLELPTKTRLKVRIKRLDIVGSWRWVDGKEDACGICRTPFETCCMDCKFPGDECPLVLGQCKHPFHMHCIVKWTNTQSGQKPACPLCRQEWKFATS

SEQ ID NO: 122497 - protein, 208 aa, Heterodera glycines
  misc_feature (21)..(21): Xaa can be any naturally occurring amino acid
  Homolog annotation: Hit_ID=CAE64528.1; Match level="QueryCoverage =100%, HitCoverage=46%, E-value=3e-88, Identity=75%"; Hit description= Hypothetical protein CBG09267 [Caenorhabditis briggsae]
  Gene Ontology: Mol. function=proteasome endopeptidase activity; Cellular component=26S proteasome; Biological process=proteolysis and peptidolysis
  Essential gene: C elegans homolog=F29G9.5; Phenotype=Emb
  Coding regions on vcDNA: vcDNA=SeqID_48920; Strand=+; Position=12-636
MGQNQPQGGGRKPGDDKGQDXKKKRKYHGPPVPTRIGKRKKGSRGPDTANKMPTVTPITRCKLKLLKYDRIKDYLLMEEEFIKNMERLKPQDERQEEERVKVDDLRGTPMSVGSLEEVIDDQHAIVSTNVGSEHYVNILSFVDKEQLEPGCAVLLNHKTHSIVGVLAEDADPMVSVMKLEKAPTETYADVGGLEQQIQEIKEAVELPL

SEQ ID NO: 122498 - protein, 251 aa, Heterodera glycines
  Homolog annotation: Hit_ID=NP_492765.1; Match level="QueryCoverage =100%, HitCoverage=100%, E-value=5e-86, Identity=64%"; Hit description=proteasome Alpha Subunit (27.2 kD) (pas-5) [Caenorhabditis elegans] emb|CAB02097.1| Hypothetical protei
  Gene Ontology: Mol. function=endopeptidase activity; Cellular component=26S proteasome; Biological process=proteolysis and peptidolysis
  Essential gene: C elegans homolog=F25H2.9; Phenotype=Emb,Lva
  Coding regions on vcDNA: vcDNA=SeqID_48921; Strand=+; Position=73-828
MFLTRSEYDRGVNTFSPEGRLFQVEYAIETVKLGSTSIGIHTKEGVLLAAERRSMSKLVVDDSMSKISEVEKHIAVASAGLIADSRTWVEHARVEAQHFWFTYGGKIRVEDITQKVSRLALHFGDDDSTISLGRPFGVSMLFAGIDHTGAHLFHLDPSGTYIKCLAKAIGAGSDAAEQTLQEHCKNCDKKMEMAEAKQVALNTLKQLMEEKINSKNVEIVMIKPQTDKEGKTLGKIVWLEESELQEIISRL

SEQ ID NO: 122499 - protein, 227 aa, Heterodera glycines
  misc_feature (56)..(56): Xaa can be any naturally occurring amino acid
  Homolog annotation: Hit_ID=AAL78223.1; Match level="QueryCoverage =92%, HitCoverage=85%, E-value=4e-49, Identity=51%"; Hit description =hypothetical protein Hgg-29 [Heterodera glycines]
  Essential gene: C elegans homolog=ZC373.5; Phenotype=Unc
  Coding regions on vcDNA: vcDNA=SeqID_48922; Strand=+; Position=19-699
MEFKGEEWSDNPISECRMAELVRHFFALGWMCDNGSGMAVRVKDERTGEHLILNSXNSLEKEIFSENDLFVMKMNGEILKSPSKSDRSPTAPFYLLRDNPDLACVIHTHSKWANLITQLIRGDEFKISNQEMIQGCENRLTKSRLDNIDVLVVPIVQTEINEHLLYPILLRTLKQNAGASGILVRGHGFFCFGSNSWQSTKMMLECYEYLFELACEMLNYDLPLVKS

SEQ ID NO: 122500 - protein, 177 aa, Heterodera glycines
  Homolog annotation: Hit_ID=NP_492301.1; Match level="QueryCoverage =84%, HitCoverage=57%, E-value=3e-15, Identity=31%"; Hit description =putative protein family member, with a coiled coil domain, of bilaterial origin (27.8 kD) (1J62) [Caenorh
  Gene Ontology: Biological process=chromosome segregation
  Essential gene: C elegans homolog=K02B12.8; Phenotype=Him
  Coding regions on vcDNA: vcDNA=SeqID_48923; Strand=+; Position=99-629
MSTWIHCNHCFIVPTNDCNKTRFWFTSCGHLMCAKCLKAKRSNNNNGQHFECLLCHQQNVQLVELNRHLRPELLALFRPAKDLIDEFNAKLKQVLTFQQSHQKRLVDHLTDKAQRATKWAQSVQKDMQKVSAERDKLKLDLEQSNEKSRKTEEMLANTRHELQRLANKFHQQHHRGN

SEQ ID NO: 122501 - protein, 383 aa, Heterodera glycines
  Homolog annotation: Hit_ID=CAE70009.1; Match level="QueryCoverage =67%, HitCoverage=42%, E-value=3e-71, Identity=53%"; Hit description =Hypothetical protein CBG16423 [Caenorhabditis briggsae]
  Gene Ontology: Cellular component=plasma membrane; Biological process= cell-cell signaling
  Essential gene: C elegans homolog=ZK678.5; Phenotype=Emb
  Coding regions on vcDNA: vcDNA=SeqID_48924; Strand=+; Position=64-1212
MCPSNCFSLLFLLFCLFFVPSSVFSSFCGKSGVPYSFEVLSNGAPVLGCAQPSCVISATDSEGDFHEDSQFFTNADGQPDGFFRDGDRALKRYRHSTAPKLIANCSGQFGELSCPRKNQWVGGIEYIDHPRQPLILQCCTFEGLRFSQEVGSTTVGPGEAITGGEVVRGGRQISFDVIANVRKVSKSAEGETAGKVRYEVTVRRMNCLPDPPEVEVEFDGEVPMEVSKLLGNAKNKEVTDKVNRAGGTQQQQQNGSRKKVPMRQKSRKDGQPNAKQQQQQTASMGQRKQLQSLQQQQQVELQEVTGGEGERQPFGRNNEVAIQPNNGQMPRKNNHRPQKQQQQQNEAVQGDQQQIFNGGEGQHAIKFIEQNQHNLGTHFAEQQ

SEQ ID NO: 122502 - protein, 213 aa, Heterodera glycines
  Homolog annotation: Hit_ID=AAP94888.1; Match level="QueryCoverage =95%, HitCoverage=64%, E-value=7e-47, Identity=45%"; Hit description =P34 [Ascaris suum]
  Gene Ontology: Mol. function=casein kinase activity; Cellular component=nucleus; Biological process=signal transduction
  Essential gene: C elegans homolog=B0218.5; Phenotype=Unclassified
  Coding regions on vcDNA: vcDNA=SeqID_48925; Strand=+; Position=1-639
LGRDEQPDADSGQTMEFNYVVMSLVGRPMDKLLHESGDRFSPGTAIGTSIQLLKALKALHSVGYLHRDIKPANSAIGTPETNEQRLLYLLDFGMARKYVREDGTHRRQRDTARFRGTPIYAPISAHIKRDYSRRDDIESWFYMLIKFYKGSVPWNSLRDKNEIGLYKCRRMEDQPPEVRRQAIDELTAGCPPEFTEILSYIDRLQPESRPDYE

SEQ ID NO: 122503 - protein, 152 aa, Heterodera glycines
  Homolog annotation: Hit_ID=AAT92078.1; Match level="QueryCoverage =99%, HitCoverage=100%, E-value=2e-29, Identity=48%"; Hit description= S. cerevisiae fis1-related protein 2, isoform b [Caenorhabditis elegans]
  Gene Ontology: Cellular component=membrane
  Essential gene: C elegans homolog=F41G3.4; Phenotype=Emb
  Coding regions on vcDNA: vcDNA=SeqID_48926; Strand=+; Position=36-494
MDVATVVDEYIDSSDLERFRKTYEEQSRRGFPSAMAVFNYAHALIKSTKDDVSTGIFLLESLLKRSEEDIPKRDYVYYLAIAHTRIKEYDRALEYINLLLSAESDNHQALDLKELIEKRMKRDGLLGLALTVGFGGAAVVGVLGAALLARKK

SEQ ID NO: 122504 - protein, 297 aa, Heterodera glycines
  Homolog annotation: Hit_ID=CAE60169.1; Match level="QueryCoverage =93%, HitCoverage=88%, E-value=9e-88, Identity=62%"; Hit description =Hypothetical protein CBG03723 [Caenorhabditis briggsae]
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_48927; Strand=+; Position=58-948
MSEKDVPLAFSGPVKFVSNALAGGTAAVVTKTVIAPIERVKLLLQAQDASAHITADKRYKGIVDVLVRVPKEQGFLAFWRGNFPSIVRYFPAQALNFAFNDLYKGILSKNSSSKNGQFLGSFASGAAAGATSSLFTYWLDFARTRLALDIGRSRESREFTGLADLFAKIWRSDGLFGLYRGFSVSIWASIIYRACYFGFFDKAKAYASSDGKRPLSFLERWLIAQGVTMASGMLAYPLDTVRRRLMMQSGHKEHILYKNGRDCARKIFASEHGIAGFYKGGLSNILRSTGGRFWCSS

SEQ ID NO: 122505 - protein, 183 aa, Heterodera glycines
  Homolog annotation: Hit_ID=NP_510335.1; Match level="QueryCoverage =72%, HitCoverage=97%, E-value=2e-37, Identity=53%"; Hit description =cytochrome b5 (XO621) [Caenorhabditis elegans] pir||T19614 probable cytochrome b5 C31E10.7 [similarity] -
  Gene Ontology: Mol. function=electron transporter activity; Cellular component=microsome; Biological process=cell cycle
  Essential gene: C elegans homolog=C31E10.7; Phenotype=Gro,Lvl,Unc
  Coding regions on vcDNA: vcDNA=SeqID_48928; Strand=+; Position=1-552
IRPIVSLLSRSISPHPSLPSVSFSSALLFTSFRDFSSEFQRHTEACPNNPKMTASRRLTRAEVAEHNNSSDAWIIIGNKVYDVTKFLDEHPGGMEVLMEKAGEDRTEAFEDIGHSTDARQMKEDFLVGEIVESEHWKYSYDKRETGADKTMDQSEKRNSPVEMLVYALLFAVIVAIIYYLLLA

SEQ ID NO: 122506 - protein, 144 aa, Heterodera glycines
  Homolog annotation: Hit_ID=CAE63532.1; Match level="QueryCoverage =75%, HitCoverage=87%, E-value=3e-16, Identity=39%"; Hit description =Hypothetical protein CBG08012 [Caenorhabditis briggsae]
  Gene Ontology: Biological process=gametogenesis
  Essential gene: C elegans homolog=Y40B1B.7; Phenotype=Gro,Stp
  Coding regions on vcDNA: vcDNA=SeqID_48929; Strand=+; Position=6-440
MEIDSHPSAAVQPEPAPIEHQQQNNTRILPKSKKWWKKALNIRPMANSSTKPRSSWERKMQKKGEREQCRAVEAEIRQRLADERNARAQALKEREQRRKSNERKAEVVQVIRNSAKLKRMKRKQLRTTVQMRDTTATTSDGKQK

SEQ ID NO: 122507 - protein, 321 aa, Heterodera glycines
  Homolog annotation: Hit_ID=ZP_00193853.1; Match level="QueryCoverage =96%, HitCoverage=89%, E-value=3e-92, Identity=55%"; Hit description =COG2017: Galactose mutarotase and related enzymes [Mesorhizobium sp. BNC1]
  Gene Ontology: Biological process=galactose metabolism
  Essential gene: C elegans homolog=C01B4.6; Phenotype=Bmd,Lva
  Coding regions on vcDNA: vcDNA=SeqID_48930; Strand=+; Position=47-1009
MPMLAHFGSFQGQDVFECQLRSESGVVVKVISFGAIIRDWLVPTPQDQLRSVVLGFDSFENYVEHSPFFGAIVGRVANRIGRARFTVDGKEFLLTPNEGKNQLHGGTETFGRKVWKMEPLCDNAAAKWPSGVRLSLESADGEGTFPGNLRVSVTYRLTTNKLRMDIEATSDLPCPVNIVQHNYFNLSGHGDIREHSLKLAADWFTPTSSDQIPTGEILTVSGTELDFREEKKLQTKDGKPIELDHNFVLTKGKGTDAQIAAVLRAPDNSLALTLRSNQPGLQVYTSKSLSVPVPGLYGQRYAKFGGICLEDQNFPDAVNHE

SEQ ID NO: 122508 - protein, 210 aa, Heterodera glycines
  Homolog annotation: Hit_ID=AAH54266.1; Match level="QueryCoverage =100%, HitCoverage=100%, E-value=1e-85, Identity=73%"; Hit description=Rps8-prov protein [Xenopus laevis] sp|Q7SYU0|RS8_XENLA 40S ribosomal protein S8
  Gene Ontology: Cellular component=eukaryotic 48S initiation complex; Biological process=protein biosynthesis
  Essential gene: C elegans homolog=F42C5.8; Phenotype=Lva,Ste
  Coding regions on vcDNA: vcDNA=SeqID_48931; Strand=+; Position=50-682
MGISQDRWHKRRKTGGKRNPIHKKRKFEMGRPAANTKIGPKRIHLVRCRGGNIKHRGLRLDTGNFAWASEGCTRKTRIIDTMYNASNNELVRTKTLVKGMIVSIDAIPFRQWYEAHYALPLARKKGQKLTEDEEARIGGAQKRSKSTLKKYTERQKTAGVEPHLLEQFQAGRLLACISSRPGQSGRCDGYILEGKELEFYNKKLKAKKAK

SEQ ID NO: 122509 - protein, 299 aa, Heterodera glycines
  Homolog annotation: Hit_ID=CAE60390.1; Match level="QueryCoverage =100%, HitCoverage=92%, E-value=3e-84, Identity=51%"; Hit description= Hypothetical protein CBG03991 [Caenorhabditis briggsae]
  Gene Ontology: Mol. function=translation factor activity, nucleic acid binding; Cellular component=eukaryotic translation initiation factor 3 complex; Biological process=regulation of translational initiation
  Essential gene: C elegans homolog=Y74C10AR.1; Phenotype=Ste
  Coding regions on vcDNA: vcDNA=SeqID_48932; Strand=+; Position=21-917
MRPLALKGHERAITRVRLNREGDILFSASKGSAVCAWYTENGERIGTYEGHSGVVWDIDVSWDTQTMVSASGDQKVMVWDIETGVSKGFSEPGSVVRSIGLSYSGNLVVFTLNKPTTGGLPGIVVADLRDKMTQPILRDTFDDQCNACLFSHLDDHIVAGDHTGQLAMWDLRQPGAASNFTHPHKYQINDLQITADQTFIITASKDKTAQLHSAHDLQHLKTYKSNRPVNTASVSPSRDHIVLGGGEEHMEVTQTATTAEQFVARLYHLIFEEEFARFRGHFGPINSIIFDPTGDIVVS

SEQ ID NO: 122510 - protein, 225 aa, Heterodera glycines
  Homolog annotation: Hit_ID=NP_498360.2; Match level="QueryCoverage =92%, HitCoverage=86%, E-value=2e-38, Identity=38%"; Hit description =breast carcinoma amplified sequence 2 like (27.6 kD) (3H334) [Caenorhabditis elegans] gb|AAC24446.2| Hypo
  Essential gene: C elegans homolog=T12A2.7; Phenotype=Bmd,Unc
  Coding regions on vcDNA: vcDNA=SeqID_48933; Strand=+; Position=23-700
MLPAIKPANSDGIVLDALPYIDDQQYTDEHRQLALQLIQAECKKFPMTKNYLRNLPEPDYDKFTTPRIMEHQAKMANKQEIEKIDLLRYEVPSPANTSRSGNKKAWLGAIDNCRAQLSNQSLRKMNLELLDEFGPEAFLRSNQHLKKQVEKEEAELFKLRSQLYELNARRKRSQLDAGERLAALGQTWVELVTKNAAMVVPNDKLENQIRTLAKLCKMDSGICKK

SEQ ID NO: 122511 - protein, 295 aa, Heterodera glycines
  Homolog annotation: Hit_ID=CAE72952.1; Match level="QueryCoverage =94%, HitCoverage=35%, E-value=2e-59, Identity=46%"; Hit description =Hypothetical protein CBG20283 [Caenorhabditis briggsae]
  Gene Ontology: Mol. function=ubiquitin-specific protease activity; Biological process=protein modification
  Essential gene: C elegans homolog=T27A3.2; Phenotype=Gro,Pvl,Slu,Stp
  Coding regions on vcDNA: vcDNA=SeqID_48934; Strand=+; Position=1-885
DGAIMCGRFSQLAGIKGNGHAKAHFESTGFPLVVKLGTIENGDGDIYSYNEDAPVCDPWLGQHLARFGLDIKKFRKTEKTTLEIELDANLKHEFSAIQEEGLELVNVSGPGYTGLINLGSSCYINSALQVLLIVPDFVRAFTEELLLRKQPPEINEDFAAQLAKIFVAMKSGDYSREDNKHGAEKEKGIRPTTFRRIVGRNHPEFSTAKQQDVEEYVRFLFEKVDACSDLSSENPVAAFRFRLVTRFLDELSDCVRYSFRTDNILSVAIPMDLCKESDTVVNGVRRKSVTLEQCL

SEQ ID NO: 122512 - protein, 199 aa, Heterodera glycines
  Homolog annotation: Hit_ID=CAB48391.1; Match level="QueryCoverage =99%, HitCoverage=99%, E-value=2e-99, Identity=87%"; Hit description =peroxiredoxin [Globodera rostochiensis]
  Gene Ontology: Mol. function=thioredoxin peroxidase activity; Cellular component=cytoplasm; Biological process=response to oxidative stress
  Essential gene: C elegans homolog=F09E5.15; Phenotype=Sck,Sma
  Coding regions on vcDNA: vcDNA=SeqID_48935; Strand=+; Position=37-636
MSSSSKAFIGKPAPNFMADAVVNGDFKTISLEQFKGQYVVLFFYPLDFTFVCPTEIIAFSDKAGEFKKIGVQLIACSTDSKFCHLEWINKPRKQGGLGEMNIPVLADTSHKISRDYGVLMEEAGIAYRGLFIIDDKGVLRQITINDLPVGRSVDETLRLVQAFQYTDKHGEVCPANWQPGTDTIKPDPKGSQAYFDKKG

SEQ ID NO: 122513 - protein, 86 aa, Heterodera glycines
  Homolog annotation: Hit_ID=EAK82416.1; Match level="QueryCoverage =98%, HitCoverage=90%, E-value=3e-29, Identity=75%"; Hit description =hypothetical protein UM01635.1 [Ustilago maydis 521] ref|XP _399250.1| hypothetical protein UM01635.1 [Usti
  Essential gene: C elegans homolog=F56E10.4; Phenotype=Lva
  Coding regions on vcDNA: vcDNA=SeqID_48936; Strand=+; Position=8-268
MTLAVDLLNPSLESEKRKHKLKRLVQSPNSYFMDVKCGASGCSAINTVFSHAQTVVLCSSCSSVLATPTGGKARLTEGSSFRPKAQ

SEQ ID NO: 122514 - protein, 191 aa, Heterodera glycines
  Homolog annotation: Hit_ID=RGKWB; Match level="QueryCoverage=84%, HitCoverage=45%, E-value=1e-72, Identity=84%"; Hit description=GTP -binding regulatory protein beta chain - Caenorhabditis elegans emb|CAA35532.1| G-protein [Caenorhabditis el
  Gene Ontology: Mol. function=heterotrimeric G-protein GTPase activity; Cellular component=heterotrimeric G-protein complex; Biological process=G-protein coupled receptor protein signaling pathway
  Essential gene: C elegans homolog=F13D12.7; Phenotype=Emb
  Coding regions on vcDNA: vcDNA=SeqID_48937; Strand=+; Position=64-636
MNFLQSDSFSFIQGPFKERNDERNTTFDHNQLSKEAEGFKENIRSQISTREARKQAKDTTLALAAANLESNGRIQLRNRRILRGHMAKIYAMHWASDSRNLVSASQDGKLIVWDSYTTNKVHAIPLLSSWVMTCAYAPSGSFVACGGLDNICSIYSLKTREGNVRVSRELPGHTGYLSCCRFLDDNQIVTS

SEQ ID NO: 122515 - protein, 147 aa, Heterodera glycines
  Homolog annotation: Hit_ID=NP_499144.1; Match level="QueryCoverage =100%, HitCoverage=100%, E-value=4e-70, Identity=77%"; Hit description=eukaryotic G10 protein homolog (17.1 kD) (3K784) [Caenorhabditis elegans] emb|CAA82338.1| Hypothetical
  Gene Ontology: Biological process=bud site selection
  Essential gene: C elegans homolog=C07A9.2; Phenotype=Unclassified
  Coding regions on vcDNA: vcDNA=SeqID_48938; Strand=+; Position=17-460
MSLTTKLRRLRKKPPEGWDLIEPTLEEFEAKMREAETEPHEGKRRTETVWPLFRIHHQRSRYIYDLFYKEEKISRELYQFCIDARLIDAQLVAKWKKPGFENLCCLRCIQTRDTNFGTNCICRVPKSKLEAGRVIECVHCGCRGCSG

SEQ ID NO: 122516 - protein, 130 aa, Heterodera glycines
  Homolog annotation: Hit_ID=AAM63595.1; Match level="QueryCoverage =96%, HitCoverage=86%, E-value=1e-48, Identity=76%"; Hit description =60S ribosomal protein L26 [Arabidopsis thaliana] dbj|BAB08459.1| 60S ribosomal protein L26 [Arabidopsis th
  Gene Ontology: Mol. function=structural constituent of ribosome; Cellular component=cytosolic ribosome (sensu Eukarya); Biological process=protein biosynthesis
  Essential gene: C elegans homolog=F28C6.7a; Phenotype=Emb,Lva,Ste
  Coding regions on vcDNA: vcDNA=SeqID_48939; Strand=+; Position=39-431
MKFSKDVSSSRRKSRKAHFTAPSHVRRVIMSAPLAKELREKHNVRSMPIRKDDEVLVVRGNFKSQTGKVVQVYRKKYVIHIERITRDKVNGTSVPVGIHPSNVVITKLHLDKDRKALLERKAAGKAVQAE

SEQ ID NO: 122517 - protein, 221 aa, Heterodera glycines
  Homolog annotation: Hit_ID=CAE56730.1; Match level="QueryCoverage =92%, HitCoverage=96%, E-value=3e-98, Identity=82%"; Hit description =Hypothetical protein CBG24517 [Caenorhabditis briggsae]
  Gene Ontology: Cellular component=COPII-coated vesicle; Biological process=ER to Golgi transport
  Essential gene: C elegans homolog=T08D2.1; Phenotype=Unc
  Coding regions on vcDNA: vcDNA=SeqID_48940; Strand=+; Position=19-684
MSNSFRILSLFCPLFLLLFVPETSRALYFHIAETEKKCFIEEIPDETMVMGRYKVQLYDPNTKAYGDYPTIGMHVEAKDPEEKVILSKLYTSEGMFTFTSHSPGEHLICLYSNSSAWFSGAQLRVHLDIQVGEHAQDYEQVAAKDKLNELQLRVRQLLDQVEQITKEQNYQRYREERFRQTSESTNSRVLWWSVGQTIVLLLTGAWQMRHLKGFFEAKKLV

SEQ ID NO: 122518 - protein, 370 aa, Heterodera glycines
  misc_feature (15)..(15): Xaa can be any naturally occurring amino acid
  Homolog annotation: Hit_ID=NP_495445.2; Match level="QueryCoverage =98%, HitCoverage=94%, E-value=1e-115, Identity=54%"; Hit description= probable rna phosphate cyclase-like protein (41.6 kD) (2H339) [Caenorhabditis elegans] gb|AAB93426.2| Hy
  Gene Ontology: Mol. function=RNA-3'-phosphate cyclase activity; Cellular component=nucleolus; Biological process=35S primary transcript processing
  Essential gene: C elegans homolog=ZK1127.5; Phenotype=Emb,Lva
  Coding regions on vcDNA: vcDNA=SeqID_48941; Strand=+; Position=20-1130
MGVHNELQLEGCNFXRQHIVFSLLTGRTITITKIRSYDDNPGLKEFERIFLSMIKRLTNGTELKLSKNGTELSFRPGLIHGGELEFDCGVQRCISYFLEPLILMAPFCKKPLNVNLTGVTNSVDELSIDAIRATWLPVFSRFVLADQCTEIKIKARGFKPSGGGSVTFSSPIKRNLRAVQCIKPGKVCKIRGLAYVCKVTPSIASRMIDGAKKMLHGNISDIYITIDQRKGPQGGLSPGFGIFLTAETTEGVFFHGEAMSRPKGQNEDQTVPEEIGEQAARRLLDEIHMGGCADSSCQSLAATFMTLCDRDVSKFLLGPLTINSVHTLRNLQMFFEQMFKLEEWWKVMKEIVGKGGNAMKNGSEDKCLMT

SEQ ID NO: 122519 - protein, 165 aa, Heterodera glycines
  Homolog annotation: Hit_ID=CAE58558.1; Match level="QueryCoverage =100%, HitCoverage=99%, E-value=9e-75, Identity=77%"; Hit description= Hypothetical protein CBG01720 [Caenorhabditis briggsae]
  Gene Ontology: Mol. function=ubiquitin-like conjugating enzyme activity; Cellular component=chromosome; Biological process=growth
  Essential gene: C elegans homolog=F29B9.6; Phenotype =Emb,Gro,Pvl,Stp,Unc
  Coding regions on vcDNA: vcDNA=SeqID_48942; Strand=+; Position=36-530
MAGIAAGRLTEERKAWRKDHPFGFIARQCKKEDGTLDLYNWICAIPGPKSTIWEGGLYKLRMIFKDDFPSTPPKCRFEPPLFHPNVYPSGTVCLSLLDENKDWKPSITVKQLLLGIQELLVSPNPEDPAQAEAYQIYVQNRPEYERRVRKQAQQFSEDQVLKQLL

SEQ ID NO: 122520 - protein, 51 aa, Heterodera glycines
  Homolog annotation: Hit_ID=AAV34853.1; Match level="QueryCoverage =100%, HitCoverage=100%, E-value=3e-19, Identity=84%"; Hit description=ribosomal protein L39 [Bombyx mori] gb|AAK92174.1| ribosomal protein L39 [Spodoptera frugiperda] dbj|BAD
  Essential gene: C elegans homolog=C26F1.9; Phenotype=Emb,Lva
  Coding regions on vcDNA: vcDNA=SeqID_48943; Strand=+; Position=23-178
MAAHKTFIIKRKLAKAAKQNRPLPHWARMKTGNRIRYNAKRRHWRRTKLKL

SEQ ID NO: 122521 - protein, 209 aa, Heterodera glycines
  misc_feature (28)..(28): Xaa can be any naturally occurring amino acid
  Homolog annotation: Hit_ID=NP_497962.1; Match level="QueryCoverage =96%, HitCoverage=84%, E-value=7e-31, Identity=35%"; Hit description =DNaJ domain (prokaryotic heat shock protein) (29.3 kD) (dnj-18Co) [Caenorhabditis elegans] emb|CAA84728.1
  Gene Ontology: Biological process=embryogenesis and morphogenesis
  Essential gene: C elegans homolog=T04A8.9; Phenotype=Emb
  Coding regions on vcDNA: vcDNA=SeqID_48944; Strand=+; Position=2-627
RHNDVAAHKNHYQTLGVSRDASAKDIKXAFFELTKKHHPDMNPTDKTKAAEAFQNITDAYEVLGSEEKRQIYDTLTAPKPQAHFGRTPNFRRTRSNHINMGPAGGHKDWTDLDIDFRDFEHFQRENRRRQTFKDWARANTKSEFYWSSHQSSKSYKSPLALERENLEKKMHDEVMERRRRSATIPMFDELQRDKQKREQEERKKRMKNY

SEQ ID NO: 122522 - protein, 178 aa, Heterodera glycines
  Homolog annotation: Hit_ID=CAE59836.1; Match level="QueryCoverage =73%, HitCoverage=75%, E-value=2e-30, Identity=50%"; Hit description =Hypothetical protein CBG03308 [Caenorhabditis briggsae]
  Essential gene: C elegans homolog=T09A5.6; Phenotype=Emb,Gro,Slu,Stp
  Coding regions on vcDNA: vcDNA=SeqID_48945; Strand=+; Position=352-888
MEEIVQSAANGGISSTAPDQSSESRFNQLERNLELFQENARHMGVIASDFTSKSQEPLNQKIHTLISGLQVLDQLKSQFTDVRVPIELLDYLDRGQNPQLYTKELLERTRQRNKELNGKTEMYRKFQACLLQELHREMPSDVEEYVRIRKPSGMNGAAAGNAMANSAMAAEETQHAME

SEQ ID NO: 122523 - protein, 262 aa, Heterodera glycines
  misc_feature (60)..(60): Xaa can be any naturally occurring amino acid
  Homolog annotation: Hit_ID=NP_509146.1; Match level="QueryCoverage =98%, HitCoverage=59%, E-value=1e-104, Identity=69%"; Hit description= DeHydrogenase, Short chain (46.3 kD) (dhs-28) [Caenorhabditis elegans] gb|AAA83184.1| Dehydrogenases, sh
  Gene Ontology: Mol. function=sterol transporter activity; Cellular component=peroxisome; Biological process=protein targeting
  Essential gene: C elegans homolog=M03A8.1; Phenotype=Gro
  Coding regions on vcDNA: vcDNA=SeqID_48946; Strand=+; Position=67-852
MSLLSFEGRVALVTGAGGGIGRTYALEFARRGAKVIVNDLGGDRHGKSASTSAADKVVAXILAAGGKAVPNYDSVENGDKIVRTAIDNFGRIDIVINNAGILRDVSFGKMSEFDWDSVMKVHVKGAFSVTKAAWEHMRAQKYGRLVFTSSNSGIYGSFGQANYAAAKMALIGLSNTLALEGAKYNIASNVLVPTAGSRMTQTVMPEELLTAMKPEFVTPLTVFLAHESCNATGRVFEAGAGWYGTVEHVHSRGRRIAEPTVE

SEQ ID NO: 122524 - protein, 194 aa, Heterodera glycines
  Homolog annotation: Hit_ID=AAN05602.1; Match level="QueryCoverage =98%, HitCoverage=98%, E-value=6e-65, Identity=63%"; Hit description =ribosomal protein S7 [Argopecten irradians]
  Gene Ontology: Mol. function=structural constituent of ribosome; Cellular component=cytosolic small ribosomal subunit (sensu Eukarya); Biological process=morphogenesis
  Essential gene: C elegans homolog=ZC434.2; Phenotype=Lva
  Coding regions on vcDNA: vcDNA=SeqID_48947; Strand=+; Position=31-615
MVATFEKLVKTDGKAPDDLEKQVATALSELAHNSEIKAQLSELYFVGAQEYEFGNKKCILVWIPVPQLRDYQKIHPKLVRELEKKMSGCHVIFIAKRRILPKPQRGKNRKPLGQKRPRSRTLTAVHDSILADVVFPAEVVGKRTRVKLDGKQIIKVHLDKAQQTTVEHKVDTFSHLYKRLTGKDVVFEFPEPLF

SEQ ID NO: 122525 - protein, 202 aa, Heterodera glycines
  misc_feature (139)..(139): Xaa can be any naturally occurring amino acid
  Homolog annotation: Hit_ID=CAE58392.1; Match level="QueryCoverage =91%, HitCoverage=71%, E-value=5e-47, Identity=48%"; Hit description =Hypothetical protein CBG01521 [Caenorhabditis briggsae]
  Gene Ontology: Mol. function=structural constituent of ribosome; Cellular component=mitochondrion; Biological process=protein biosynthesis
  Essential gene: C elegans homolog=T23B12.3; Phenotype=Lva
  Coding regions on vcDNA: vcDNA=SeqID_48948; Strand=+; Position=17-623
MIKPVNTLKSLMRTMTDCRWMASVPMAFEQKVSMAQPQQSMAYLPDIETLTKGKVSPTILKPYIDPTLCSSHPNSFEREVTVRRMLDARVHLGHKVGTLNDNMKWALYGERLGICVFDLEITRHYLLKALEFVRSVALXGGRFLFVSTNKSSMLMVETMADEMGQYAHTRHWQPGTFTNSKSVFRGPIRLPNTVILLNTLTS

SEQ ID NO: 122526 - protein, 660 aa, Heterodera glycines
  Homolog annotation: Hit_ID=NP_510260.1; Match level="QueryCoverage =98%, HitCoverage=90%, E-value=0.0, Identity=54%"; Hit description =PolyA Binding protein (76.0 kD) (pab-2) [Caenorhabditis elegans] emb|CAA90444.1| Hypothetical protein F18H3
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_48949; Strand=+; Position=75-2057
MAPSYPLASLYVGDLHPDVTEAMLFERFSNAGPVLSIRVCRDAITRRSLGYAYVNFQQPADAERALDTMNFDMILNKPIRIMWSQRDPSIRRSGAGNIFIKNLGKEIDTKAIYDTFSMFGSILSCKIATDIEGGSKGYGFIHFETEEAANSAIAKVNGMLLDGKKVFVGKFVPRTAREKQIGDPSSRFTNVYVKNFGEAMDSEKLSEVFSQYGEIISAKVMEDDSGKSKGFGFVAYKDHESAARAVEKMNEVSVPGSEKVEQKFTVCRAQKKSERQAELKRRYEQYKAERIQRYQGVNLYVKNLHDTINDETLRSNFESYGNITSAKVMCDEHGRSKGFGFVCFEKADEATKAVVEMNNKIIENKPLYVALAQRKEDRKAQLASQYMQRLAAMRMQNPAGLMGTMYAPASGGFFLPQAIQNQRAAPFMQTPNLSGAQMRGAVPRWNNMGGFNHPMQGYMMGPAVGGQFGGANQIARGGPRSGGMGGGGGMRQYGGQPRQQQNRMPGMGGGHQQQGMRYQGQPKGMQQQQHQQAQQPQIAYSSYPQQQSRGMAPQMGGGGGGGVKAGHAITATHQEPLNTQMLTEADMTGQKQMLGERLYAMVARCFRDGDVEKVGKITGMLLEMENAEILLLLGDEEMLRLRVDEAATVLYQATCHKEAQ

SEQ ID NO: 122527 - protein, 175 aa, Heterodera glycines
  Homolog annotation: Hit_ID=NP_502789.1; Match level="QueryCoverage =98%, HitCoverage=62%, E-value=7e-26, Identity=39%"; Hit description =COenzyme Q (ubiquinone) biosynthesis (29.2 kD) (coq-3) [Caenorhabditis elegans] emb|CAB16512.1| Hypotheti
  Gene Ontology: Mol. function=methyltransferase activity; Cellular component=mitochondrion; Biological process=larval development (sensu Nematoda)
  Essential gene: C elegans homolog=Y57G11C.11; Phenotype =Age,Unclassified
  Coding regions on vcDNA: vcDNA=SeqID_48950; Strand=+; Position=87-611
MSSLIRGEIQQFASFANVFHWFDELHGCFRPLHSFNQLRIPWLSAHLATSSLNAVHLPLSGKQILDVGCGAGILSTSLCRRGALVTGLDADKSVLEIANGYKETMAPSLRKKIEFIPGTIERLAQEKDRIGTFDAVVSSEVVEHVSDLPLFIRSWCKLARPNSPIFFTTINRTIW

SEQ ID NO: 122528 - protein, 218 aa, Heterodera glycines
  Homolog annotation: Hit_ID=CAE70145.1; Match level="QueryCoverage =100%, HitCoverage=70%, E-value=3e-78, Identity=64%"; Hit description= Hypothetical protein CBG16607 [Caenorhabditis briggsae]
  Gene Ontology: Mol. function=pre-mRNA splicing factor activity; Cellular component=nucleus; Biological process=mRNA splicing
  Essential gene: C elegans homolog=K04G7.10; Phenotype=Emb
  Coding regions on vcDNA: vcDNA=SeqID_48951; Strand=+; Position=40-693
MTQFLPDNLLALFAPRPPIQFKPPPDDLFIHRKHMQMGGMAECVHGFEDPKDTPPKPKIETREEKRARKRKEKEELMAYKIEQGIATWTPADNPKATVDPYKTLFIGRINYETSESKLRREFEKYGKITKIIMVHDKNSKPRGYAFIEYAHKSEMSAAYKKADGTKIDGRRVVVDYKRGRTQKKWLPRPLGGGKGGPRPMRESKAKMLARELARKGGG

SEQ ID NO: 122529 - protein, 172 aa, Heterodera glycines
  Homolog annotation: Hit_ID=NP_499681.1; Match level="QueryCoverage =80%, HitCoverage=79%, E-value=2e-55, Identity=69%"; Hit description =cytochrome c oxidase Va (20.1 kD) (3N995) [Caenorhabditis elegans] emb|CAA21532.1| Hypothetical protein Y
  Gene Ontology: Mol. function=electron transporter activity; Cellular component=respiratory chain complex IV (sensu Eukarya); Biological process=aerobic respiration
  Essential gene: C elegans homolog=Y37D8A.14; Phenotype=Emb,Lva
  Coding regions on vcDNA: vcDNA=SeqID_48952; Strand=+; Position=19-537
MFSIVGKKVFNTTSCNFLSKAFYAHMSKDEIMWHWPAQKFDQHFIDYLNKPDIDGWEIRKALTELGNFDVVPDPKVVEAALRAIRRVNDFALAIRFLEQIKYKCGGPKSRSIVYPYIIQEVKPVMDELGIPTLEELGYDEPEFFTPDPEWYWEKSWYKLYGFDKLPGYKHLA

SEQ ID NO: 122530 - protein, 216 aa, Heterodera glycines
  Homolog annotation: Hit_ID=CAE68954.1; Match level="QueryCoverage =97%, HitCoverage=82%, E-value=1e-55, Identity=50%"; Hit description =Hypothetical protein CBG14934 [Caenorhabditis briggsae]
  Gene Ontology: Mol. function=electron transporter activity; Cellular component=nucleus; Biological process=carbohydrate metabolism
  Essential gene: C elegans homolog=C01G12.5; Phenotype=Gro
  Coding regions on vcDNA: vcDNA=SeqID_48953; Strand=+; Position=54-701
MTSKMVAVITGASSGLGKATAVLFARNGYHLSLCGRNEKALEGVASNCLAEGGLTREQVLTIIGDVCEEKTLQNIVKRTDESFGRIDVLVNCAGVIASGGAENTPTSVLDGLMNVNVKSMIRLSQLVVPYLEKTKGSIVNVSSIAGICAFPAVTYYCISKAAVDKFTECLSMELAPKGIRVNAVNPALIVTELHLRSGMPEEQYSDFVRRGAQTHA

SEQ ID NO: 122531 - protein, 294 aa, Heterodera glycines
  Homolog annotation: Hit_ID=AAK26378.1; Match level="QueryCoverage =100%, HitCoverage=88%, E-value=1e-175, Identity=99%"; Hit description=putative zinc finger protein [Heterodera glycines]
  Essential gene: C elegans homolog=Y53G8AR.9; Phenotype=Rup
  Coding regions on vcDNA: vcDNA=SeqID_48954; Strand=+; Position=14-895
MTNERDFSHDDHINNAIGTNGDSKDAAKRKDICRDFLNNICSRGNRCKFYHPEDSVEKNQNSADEPYQFCIDFQNQGCYRENCRYVHAFREDVDRYKRSGDVTLGLARALAALLKGDTINGIPLCKEFQNGHCARGPQCRYWHINRDEERRKRFGGGRNCGGSPSSLAFGAYPAVPPAGAQLSRRRGDEFVSEDFAPPSKRSFAHNQPFATIPGQMAPTSAPTAPSHPSPQLVIELERRNAELTTEVESLKRELNREKERYDDLMSLFRAAQGQPTVQRSVISTPSLVPANLQP

SEQ ID NO: 122532 - protein, 360 aa, Heterodera glycines
  Homolog annotation: Hit_ID=XP_415408.1; Match level="QueryCoverage =76%, HitCoverage=41%, E-value=3e-13, Identity=26%"; Hit description =PREDICTED: similar to 26S proteasome non-ATPase regulatory subunit 5 (26S proteasome subunit S5B) (26S pr
  Gene Ontology: Cellular component=26S proteasome
  Essential gene: C elegans homolog=F35G12.12; Phenotype=Emb
  Coding regions on vcDNA: vcDNA=SeqID_48955; Strand=+; Position=1-1080
VHLSEKCTRENKQGEKQAETRAQLKDDAFLREIHSRLKPGIENSERRFDVHKFTCAALELPDFSDFARLRPLIDALIAELDLNDFLGCTAALEMLAETAATAPKCVPFFGQIGLLDKVYALFIRTKEEPDMGIIHIACIRFFAYLCTTDDNALTKFPKFTADVFDAVFRFDAFDVTRRQLAFETLAVISSTSGAKQIFSQNETLYNMQRAMSNLAVAVATAAEPSLKARHLEAVRMFFDRIADESGCQPEQKCTTASAEAEEQLLHRWFRWLGEPFPRLLLQCVRDPISEVQLAALRVLMALTRHQWAYAHFCAITDFVNLLVDRSVNFDADAMQLKYALICRLVEAAPSALNDGQMEML

SEQ ID NO: 122533 - protein, 191 aa, Heterodera glycines
  Homolog annotation: Hit_ID=CAE75119.1; Match level="QueryCoverage =100%, HitCoverage=70%, E-value=1e-71, Identity=64%"; Hit description= Hypothetical protein CBG23047 [Caenorhabditis briggsae]
  Gene Ontology: Biological process=embryogenesis and morphogenesis
  Essential gene: C elegans homolog=Y75B8A.14; Phenotype=Emb
  Coding regions on vcDNA: vcDNA=SeqID_48956; Strand=+; Position=69-641
MKYAQLVVGPAGSGKSTYCAAVQLHCKTVGRTAFVVNLDPAAEQFNYDCAVDMRELISVEDVLEDEDMAMGPNGALVYCMEYLADNLDWLHSHLNEGEDDYFLFDCPGQIELYSHLPVMCQIVQALREWNFNVCSTFVMDTTFCLDSTKFMSATLTALSTTVSLQTPAVNVLSKMDLLRPEDRRTVEEIVD

SEQ ID NO: 122534 - protein, 154 aa, Heterodera glycines
  Homolog annotation: Hit_ID=NP_506872.1; Match level="QueryCoverage =87%, HitCoverage=68%, E-value=3e-11, Identity=29%"; Hit description =putative cytoplasmic protein, with a coiled coil-4 domain (5Q54) [Caenorhabditis elegans] emb|CAB03011.1|
  Essential gene: C elegans homolog=F28F8.5; Phenotype=Gro,Pvl,Slu,Stp
  Coding regions on vcDNA: vcDNA=SeqID_48957; Strand=+; Position=37-501
HLGNTTQTQRGEGGGDLSADKLREINSLIAAFPSSIGQTPPDSALGTALNNMMVQWNSLLSQVVTEVDHPQPILEHIKETAEFSVKQFRDACLGMISELTRTSVDWQLNFPNEMAEQEISEYENSIRRQEQLLGKIRQKLDDEILSGENSNFVP

SEQ ID NO: 122535 - protein, 154 aa, Heterodera glycines
  misc_feature (127)..(127): Xaa can be any naturally occurring amino acid
  Homolog annotation: Hit_ID=NP_498128.1; Match level="QueryCoverage =81%, HitCoverage=66%, E-value=2e-34, Identity=59%"; Hit description =CLocK (biological timing) abnormality CLK-1, ubiquinone biosynthesis protein (20.5 kD) (clk-1) [Caenorhab
  Gene Ontology: Cellular component=mitochondrial inner membrane; Biological process=electron transport
  Essential gene: C elegans homolog=ZC395.2; Phenotype=Age,Unclassified
  Coding regions on vcDNA: vcDNA=SeqID_48958; Strand=+; Position=216-675
MNFRPFAFLSLRFSSSSSASSSSLLPSYRKAIVHPIVRVDHAGELAADRIYAGQLAVLPKTHRLVPIIEQMRREERHHLDEMERLIVKYGVRSTALAPICSVAGFMLGVGTALLGEKAAMACTIAVXEEVIGQHYNDQIKELMADDANANRELM

SEQ ID NO: 122536 - protein, 350 aa, Heterodera glycines
  Homolog annotation: Hit_ID=CAB88204.1; Match level="QueryCoverage =93%, HitCoverage=95%, E-value=1e-131, Identity=60%"; Hit description= putative cuticular collagen [Globodera pallida]
  Gene Ontology: Mol. function=structural constituent of cuticle; Cellular component=extracellular; Biological process=cuticle biosynthesis (sensu Nematoda)
  Essential gene: C elegans homolog=C15A11.6; Phenotype=Emb
  Coding regions on vcDNA: vcDNA=SeqID_48959; Strand=+; Position=3-1055
ETQIVVGVASVCSLLAIVATLVVVPSLYSQINEISLKVHDGVQAFRVNTDSAWNELMEVQITVTPPAKPRENPFVSIFRSKRQLPGHCQCAGVQQPQCPPGPPGPAGAPGQPGYPGQAGEPGQPGMPGQPGAPCPDVPHVCQHCPAGPPGKPGDQGPAGQAGQPGRPGQPGQSGGVGPPGPPGPQGQAGSPGRPGGSGQPGQPGQNGVVYKTVPGPKGQPGQPGAPGQPGAPGRPGKPGDQGQPGAPGHPGQPGQPGAPGQPGHPGAAGAPGKDASYCACPPRSGGGYGVSGGGGGGAKVEHAPLPAEQAPVPEQPAESVGVAPAPAEVASNAAGGQGEAEAAKGYRKKM

SEQ ID NO: 122537 - protein, 249 aa, Heterodera glycines
  misc_feature (206)..(206): Xaa can be any naturally occurring amino acid
  misc_feature (245)..(245): Xaa can be any naturally occurring amino acid
  Homolog annotation: Hit_ID=AAL28701.1; Match level="QueryCoverage =100%, HitCoverage=98%, E-value=1e-34, Identity=35%"; Hit description= LD12396p [Drosophila melanogaster]
  Gene Ontology: Biological process=positive regulation of growth rate
  Essential gene: C elegans homolog=T26E3.4; Phenotype=Gro,Sck
  Coding regions on vcDNA: vcDNA=SeqID_48960; Strand=+; Position=1-746
MESSNEEQQLQEIEALESMYSNELRVLCRDFPNISVELDVRPDLDEFTELFGKSVISLRATFPSDYPNCFPVIDLPDFDGDDDENTLQKTQFWDECERRVRSELDKVMEDCVGMPMLFTLLGALQEFFVQMADDYLKNRDELERIKADKIEREERAKFEGTRVTVESFKKWNDAFLKSVRVPQEKTKDNQTTKRMTGKQLFLSDNXLNISDLQFIGNAKDENAVEIDQSLFEGDIDFDDDDEDYXPEAD

SEQ ID NO: 122538 - protein, 274 aa, Heterodera glycines
  Homolog annotation: Hit_ID=CAE60101.1; Match level="QueryCoverage =91%, HitCoverage=39%, E-value=2e-26, Identity=27%"; Hit description =Hypothetical protein CBG03634 [Caenorhabditis briggsae]
  Essential gene: C elegans homolog=C36E8.1; Phenotype=Gro
  Coding regions on vcDNA: vcDNA=SeqID_48961; Strand=+; Position=70-891
MPEKKPTKCLSKGKELPCGREIIQDFVMMMPGSMDKYHQLCSILSSFELWSEESRTSFLSQFLDSYDILDVNCSDLVLKLCKIRWHTVPPQMLSQFADFLCALAINHVHHINSVFNCFVDHFLPIGNAKDPSNFEAHRPPAVVDDHFQESLYALANLSIQNVVSCNPLTTPLLLKCFVKRFPHIKQPSPKLLAFMRNVLRFADWIRDEEISAEIWSLIVEKLLHIDALCFEREEEEQRPTHSNRLKQKKLDNETASEETTNPMREKLNTLVEFI

SEQ ID NO: 122539 - protein, 243 aa, Heterodera glycines
  Homolog annotation: Hit_ID=CAE57015.1; Match level="QueryCoverage =96%, HitCoverage=56%, E-value=3e-41, Identity=39%"; Hit description =Hypothetical protein CBG24890 [Caenorhabditis briggsae]
  Essential gene: C elegans homolog=Y44F5A.1; Phenotype=Gro,Pvl,Stp
  Coding regions on vcDNA: vcDNA=SeqID_48962; Strand=+; Position=48-776
MERLFNTPISSLSTNTSNCTRNTICLGFLDGSIQCFSFDTQRGITPSMESSVKLGGMWRKRMKRSVRAMQISEDGTSLYATSSNRAVCLYDVETGKRVRCIREGHKSRPSAMALLPGERRHFATGAENGEIKAWDFGQPKPNVHTFGEQADIINALHIWRNNLLAASGDGTLAVYDTHKGKVRIQSETMHSELLSLAVTERFTYVGAADGHIEVFRHGQFGNIRERMETPFLMGVEQMVVLRN

SEQ ID NO: 122540 - protein, 228 aa, Heterodera glycines
  Homolog annotation: Hit_ID=CAE66068.1; Match level="QueryCoverage =97%, HitCoverage=61%, E-value=9e-56, Identity=47%"; Hit description =Hypothetical protein CBG11282 [Caenorhabditis briggsae]
  Gene Ontology: Mol. function=extracellular matrix structural constituent; Cellular component=extracellular space; Biological process=cell-cell signaling
  Essential gene: C elegans homolog=F38E1.7; Phenotype=Emb
  Coding regions on vcDNA: vcDNA=SeqID_48963; Strand=+; Position=215-898
MAAQLASALSSPDYYNCQMQPGLTRRQRDICVRHPSAMRSISDGLRAAIDECHAQFERERWNCSATFNVGVPSEEDSTPETAYVFAISSAGASAAVARACARGEIPECGCGGGEQTVINSPDVEGLSGADPQQFIWAGCSDNIRFGNQFTRKFIDTAEKKRSDARSLMNLHNNRVGRLLLATNMRKKCKCHGVSGSCVTKTCWKTVPTMEEFAALLKQKYTNAKQMAL

SEQ ID NO: 122541 - protein, 224 aa, Heterodera glycines
  Homolog annotation: Hit_ID=NP_498155.2; Match level="QueryCoverage =92%, HitCoverage=88%, E-value=4e-33, Identity=42%"; Hit description =DNaJ domain (prokaryotic heat shock protein) (dnj-24) [Caenorhabditis elegans] gb|AAD31932.2| Dnaj domain
  Gene Ontology: Mol. function=heat shock protein activity; Biological process=protein folding
  Essential gene: C elegans homolog=T03F6.2; Phenotype=Ste
  Coding regions on vcDNA: vcDNA=SeqID_48964; Strand=+; Position=136-807
MGGEGSGRSGGVSPECLYAVLGVQKGADEAEIKKAYRRLALKWHPDKNPERKEKAEKMFKRVAQAYEVLSDEKRRTDYNRHGMCRPAEAAFASAHRRRTAPADSHYAHHQSHPFHAHFRSPFDIFREFFGDPLSSSDFHRSPFFAFPANGGMKQRRRHTTNLFGDGAFGAHFAGKDENNCEFSTVIRFSTSSKDPGKKIKKTITQTRLVNGKKIVTKKVEDNGQ

SEQ ID NO: 122542 - protein, 110 aa, Heterodera glycines
  Homolog annotation: Hit_ID=XP_319026.1; Match level="QueryCoverage =99%, HitCoverage=100%, E-value=6e-61, Identity=92%"; Hit description= ENSANGP00000013177 [Anopheles gambiae] gb|EAA13837.1| ENSANGP00000013177 [Anopheles gambiae str. PEST]
  Gene Ontology: Mol. function=transcription factor activity; Cellular component=nucleus; Biological process=G2/M transition of mitotic cell cycle
  Essential gene: C elegans homolog=Y54F10BM.14; Phenotype=Emb
  Coding regions on vcDNA: vcDNA=SeqID_48965; Strand=+; Position=48-380
MAKHHPDLIFCRKQPGVAIGRLCDKCDGRCVVCDSYVRPCTLVRICDECNYGSYQGRCVICGGPGTSDAYYCKECTIMEKDRDGCPKIVNLGSAKTDLFYERKKYAFKKT

SEQ ID NO: 122543 - protein, 95 aa, Heterodera glycines; identical to SEQ ID NO: 121066
  Homolog annotation: Hit_ID=CAE69444.1; Match level="QueryCoverage =85%, HitCoverage=82%, E-value=8e-32, Identity=77%"; Hit description =Hypothetical protein CBG15632 [Caenorhabditis briggsae]
  Gene Ontology: Biological process=regulation of cell cycle
  Essential gene: C elegans homolog=C09G4.3; Phenotype=Emb
  Coding regions on vcDNA: vcDNA=SeqID_48966; Strand=+; Position=28-315

SEQ ID NO: 122544 - protein, 172 aa, Heterodera glycines
  Homolog annotation: Hit_ID=AAL40718.1; Match level="QueryCoverage =99%, HitCoverage=98%, E-value=1e-80, Identity=88%"; Hit description =myosin regulatory light chain [Meloidogyne incognita]
  Gene Ontology: Mol. function=structural constituent of muscle; Cellular component=muscle myosin; Biological process=regulation of muscle contraction
  Essential gene: C elegans homolog=C36E6.3; Phenotype=Gro,Unc
  Coding regions on vcDNA: vcDNA=SeqID_48967; Strand=+; Position=77-595
MSEKKVKKVKKKSRTGSEASSFDQKTIQEFKEAFGIMDQDKDGVISKQDLKDLYATLGVVASDSQMDNMLKEAPGPINFTVFLTLFGERLTGTDPEATIIGAFQMFDKTDCGEITEETLMKILKNKRGEPLTEDEVQGMYKGNPPISGGKVDYKAFAHLITTGAAEELAKVG

SEQ ID NO: 122545 - protein, 65 aa, Heterodera glycines
  Homolog annotation: Hit_ID=AAH78605.1; Match level="QueryCoverage =96%, HitCoverage=91%, E-value=1e-25, Identity=87%"; Hit description =MGC85550 protein [Xenopus laevis]
  Essential gene: C elegans homolog=Y41D4B.5; Phenotype=Gro,Sck,Ste
  Coding regions on vcDNA: vcDNA=SeqID_48968; Strand=+; Position=66-263
MDKPIKLAKVTRILGRTGSQGQCTQVRVEFLDDTNRSIIRNVKGPVREGDILTLLEAEREARRLR

SEQ ID NO: 122546 - protein, 238 aa, Heterodera glycines
  misc_feature (155)..(155): Xaa can be any naturally occurring amino acid
  Homolog annotation: Hit_ID=AAN46118.1; Match level="QueryCoverage =100%, HitCoverage=41%, E-value=1e-125, Identity=98%"; Hit description=intermediate filament protein HG-IF1 [Heterodera glycines]
  Gene Ontology: Mol. function=structural molecule activity; Cellular component=lamin filament; Biological process=nuclear envelope reassembly
  Essential gene: C elegans homolog=W10G6.3; Phenotype =Lvl,Unc,Unclassified
  Coding regions on vcDNA: vcDNA=SeqID_48969; Strand=+; Position=48-762
MSDDYRSSIGPRPAFNRNSTAYSSTGGPVSGGNRVLKIVTETMSSSTSGGGGGMSPFGANAAQIRDSRDREKKELSDLNNRLANYIQKVRFLEAHNRKLKADLDMLQGRRGKDTITIKTMYESEIQTAKKLIEDTGRSKHELEQDVAKLQRDLDXQRRKYEEAVRSRAGDREKLDDLLVQLSNLEAEISLLKRRIALLEEELSKLRKENSRLQADLQRVRAELDQETLNRIDYQNQVQ

SEQ ID NO: 122547 - protein, 310 aa, Heterodera glycines
  Homolog annotation: Hit_ID=CAE66343.1; Match level="QueryCoverage =91%, HitCoverage=46%, E-value=4e-34, Identity=30%"; Hit description =Hypothetical protein CBG11595 [Caenorhabditis briggsae]
  Gene Ontology: Cellular component=nucleus; Biological process =locomotory behavior
  Essential gene: C elegans homolog=T01C3.1; Phenotype=Gro,Pvl,Rup,Unc
  Coding regions on vcDNA: vcDNA=SeqID_48970; Strand=+; Position=11-943
MALNNCFTENRYPNECILSYGSIAVSDPLDAFVCCRFSIHEHQENICAFGTEYGRVVICDVTAPIKGEDFIKHRFATGKNAVFDLCFIPDRPNLLLSLCGASNLELLDIERSSSIFLLGHRDTVRCASVWPENPFCVLTGSRDGDILLWDLREKPLKREIGRKSVSNSVSSLRRYQTAHEATIAITGLLHMSENYFISSSSSSSSGIRIWDLRYQIASSPIRSLFVPQKMSKESGVASMCWDRFRSSFFALCTDNAIYEYVPSLNSSFPVRSLRTNFVNSFFVQCAASPFSDHLLCGSSFSKAFIWDLQF

SEQ ID NO: 122548 - protein, 156 aa, Heterodera glycines
  Homolog annotation: Hit_ID=A47156; Match level="QueryCoverage=99%, HitCoverage=100%, E-value=6e-37, Identity=42%"; Hit description =hexamer-binding protein HEXBP - Leishmania major sp|Q04832|HEXP _LEIMA DNA-binding protein HEXBP (Hexamer-bind
  Gene Ontology: Mol. function=transcription factor activity; Biological process=cell cycle
  Essential gene: C elegans homolog=K08D12.3a; Phenotype=Unc
  Coding regions on vcDNA: vcDNA=SeqID_48971; Strand=+; Position=52-519
MSYGDYQQRPRGCFNCGSADHQARDCDQGVKCYNCGGTGHTSRDCSEPRKAKTCNNCNQEGHIARDCPDAPAQSARSCYKCGEVGHISRDCTQGRFAGGDRMAGRNCYKCGEAGHISRECPQNAGGDSSWGGNSGGSARACYKCGQEGHISRDCPP

SEQ ID NO: 122549 - protein, 164 aa, Heterodera glycines
  Homolog annotation: Hit_ID=CAE74453.1; Match level="QueryCoverage =93%, HitCoverage=100%, E-value=2e-60, Identity=68%"; Hit description= Hypothetical protein CBG22194 [Caenorhabditis briggsae]
  Gene Ontology: Mol. function=RNA cap binding; Cellular component =nucleus; Biological process=snRNA-nucleus export
  Essential gene: C elegans homolog=F26A3.2; Phenotype=Lva
  Coding regions on vcDNA: vcDNA=SeqID_48972; Strand=+; Position=5-499
MVFDPKSKDKARELGSYRDMRFEGSLPEQERRLAQSTTLYIGNLSYFTSEEQVWELFRRAGDVRRVIMGLDRFNKTPCGFCFVEYYTREDAENALRYISGTRLDDRVVRCDWDAGFKEGRQFGRGKHGGQVRDEYRQNFDSGRGGWNKTIQKRNDQFTQRNIKA

SEQ ID NO: 122550 - protein, 307 aa, Heterodera glycines
  misc_feature (277)..(277): Xaa can be any naturally occurring amino acid
  Homolog annotation: Hit_ID=CAA52290.1; Match level="QueryCoverage =100%, HitCoverage=100%, E-value=1e-161, Identity=95%"; Hit description=polyubiquitin [Volvox carteri] pir||S40611 polyubiquitin 5 - Volvox carteri
  Essential gene: C elegans homolog=F25B5.4a; Phenotype=Emb
  Coding regions on vcDNA: vcDNA=SeqID_48973; Strand=+; Position=2-922
DGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGKNIFVKTLTGKTITLEVEASDTIENVKAKIHDKEGIPPDQQRPIFAGKQLEDGRTLADYNIQKESTLHLVLRLPGGMHIFVKSLTGKTITLEVEASDTIXNVKAKIQDKEGIPPDQQRLIFSGEQLEDGR

SEQ ID NO: 122551 - protein, 232 aa, Heterodera glycines
  Homolog annotation: Hit_ID=CAE57721.1; Match level="QueryCoverage =91%, HitCoverage=33%, E-value=6e-10, Identity=25%"; Hit description =Hypothetical protein CBG00731 [Caenorhabditis briggsae]
  Essential gene: C elegans homolog=F10B5.6; Phenotype=Emb
  Coding regions on vcDNA: vcDNA=SeqID_48974; Strand=+; Position=81-776
MISRMASSSCSSPSSSSKFGPQMKCSTPKPVPMDDDGTEEGDHGEQLLLDRHELRILCDEHLQSGDCQTAAFWAEKLLALSIGRTLNERLPDIAHYLSVLTAAQFWQTIITLIERHDLFPKHLVFAFFHINALFHRELYSEIIALPVGYLCHWDDVPFIQPDSATYICAENDAVREPGIRQQLDTLLREKKYESRMLLLLAKTYLMVQNRPAAAGCLKHCLTANPFCSEAIH

SEQ ID NO: 122552 - protein, 360 aa, Heterodera glycines
  Homolog annotation: Hit_ID=NP_498047.1; Match level="QueryCoverage =100%, HitCoverage=30%, E-value=1e-178, Identity=82%"; Hit description=RNA polymerase II subunit (3G33) [Caenorhabditis elegans] gb|AAA21158.1| Hypothetical protein C26E6.4 [
  Gene Ontology: Mol. function=DNA binding; Cellular component=DNA -directed RNA polymerase II, core complex; Biological process =transcription from Pol II promoter
  Essential gene: C elegans homolog=C26E6.4; Phenotype=Emb
  Coding regions on vcDNA: vcDNA=SeqID_48975; Strand=+; Position=1-1080
AIVAILSYGGYNQEDSVIMNQAGIDRGLFRSVFYRSYRDSEQEIDNVNEQLIEKPTRDKCKGMRNAIYEKLDDDGITSPGTRVSGDDVIIGKTIALPEVEDELEASTARYSKKDASTTLRSSETGIVDQVMVSVNAEGNKFVKIRVRSIRTPQIGDKFASRHGQKGTMGMMYRQEDMPFTCEGITPDIIINPHAVPSRMTIGHLIECLQGKLSANKGEIGDATPFNDTVNVQKISALLEGYGYQLRGNEIMYNGFTGQKLSTQVFLGPTYYQRLKHMVEDKIHSRARGPVQGMNRQPMEGRARDGGLRFGEMERDCQISHGAAQFLRERLFEVSDPYTVYVCNQCGLVVIFNQRTNTFEC

SEQ ID NO: 122553 - protein, 354 aa, Heterodera glycines
  misc_feature (223)..(223): Xaa can be any naturally occurring amino acid
  misc_feature (252)..(252): Xaa can be any naturally occurring amino acid
  misc_feature (274)..(274): Xaa can be any naturally occurring amino acid
  Homolog annotation: Hit_ID=XP_506873.1; Match level="QueryCoverage =97%, HitCoverage=97%, E-value=8e-75, Identity=44%"; Hit description =PREDICTED B1215B07.34 gene product [Oryza sativa (japonica cultivar -group)] ref|XP_466836.1| putative ade
  Gene Ontology: Mol. function=adenosine kinase activity; Biological process=ribonucleoside monophosphate biosynthesis
  Essential gene: C elegans homolog=R07H5.8; Phenotype=Gro
  Coding regions on vcDNA: vcDNA=SeqID_48976; Strand=+; Position=64-1128
MDKNIGNKNNNEFLLLGMGNPLLDLQVATLDTQIHAKYGLAEDGADLINSENSASLLPIFDDISTLGNKIEFVPGGSAQNTVRVCQWMVKAFGVNLKSCYFFGAVGKDKYGQILHEKAQAANIEVRYQEVPTEKTGTCAVLVFGNKRSLVAHLGAAEHFTPVHLNIEANQSLIEKISNFYVEGYFLTVSLESILFLATHVISSTRPKHFALNLSAEYICQFFXDRLEKVLPYVDILFGNKQEALAYAKTREXEKRDVGDIALYLSEKEKVNGEXKRIVVITQGPLPVLVAHDCELTQFPVEPISEDKIVDTNGAGDAFCGGFLAAFSTGRSLDLCVRAGNFAARTIIQQIGCTF

SEQ ID NO: 122554 - protein, 162 aa, Heterodera glycines
  Homolog annotation: Hit_ID=CAE65142.1; Match level="QueryCoverage =96%, HitCoverage=80%, E-value=8e-65, Identity=73%"; Hit description =Hypothetical protein CBG10008 [Caenorhabditis briggsae]
  Gene Ontology: Mol. function=translation initiation factor activity; Cellular component=ribosome; Biological process=translational initiation
  Essential gene: C elegans homolog=T05G5.10; Phenotype=Emb
  Coding regions on vcDNA: vcDNA=SeqID_48977; Strand=+; Position=102-590
MAESGEHDHDFTSGESGAAATYPKQCSALRKNEFVMIKGRPCKVVEMSTSKTGKHGHAKVHLVALDIFTNKKLEDICPSTHNMEVPVVKRKEYQLLSTNEDGFISLMDLETCDTKDDLRLPEGEIGDQIKQAYEKDDNGILVSVVTACGEEAILGWKFMPNK

SEQ ID NO: 122555 - protein, 200 aa, Heterodera glycines
  Homolog annotation: Hit_ID=CAA70694.1; Match level="QueryCoverage =100%, HitCoverage=56%, E-value=1e-109, Identity=99%"; Hit description=cathepsin S-like cysteine proteinase [Heterodera glycines]
  Gene Ontology: Mol. function=cathepsin S activity; Cellular component= lysosome; Biological process=proteolysis and peptidolysis
  Essential gene: C elegans homolog=T03E6.7; Phenotype=Emb,Gro,Unc
  Coding regions on vcDNA: vcDNA=SeqID_48978; Strand=+; Position=40-639
MAFLSRLSILPNSPISLLAVSLAVLAFVALASANPPTARETAPNAQQNNANSVATGEIAKNIAEKMERMNEFIKAKKFIDAHNLAFEKGEVSFKVAPNHLMHFTPAQYNRIRGLQMRSNRQRHNMATLAGNSSTLPEKLDWREKGAVTEVKDQGDCGSCWAFSATGAIEGALAQKKASKIISLSEQNLIDCSSKYGNEGC

SEQ ID NO: 122556 - protein, 145 aa, Heterodera glycines
  Homolog annotation: Hit_ID=NP_002680.2; Match level="QueryCoverage =93%, HitCoverage=22%, E-value=6e-13, Identity=34%"; Hit description =polymerase (DNA-directed), alpha (70kD) [Homo sapiens] gb|AAH02990.1| Polymerase (DNA-directed), alpha (7
  Gene Ontology: Cellular component=chromatin; Biological process=DNA replication
  Essential gene: C elegans homolog=R01H10.1; Phenotype=Emb
  Coding regions on vcDNA: vcDNA=SeqID_48979; Strand=+; Position=3-440
LFELDSVHFAVSSSEILLHLCKTEICKSANVENEDRMRRLISHLFRARSLYPLCPCDQNLPFAPSASANAKLRLPRKPHVMVLPSLLQPVTKVVDDCVVLNPGRFDRGKGTGTFSVLDLDLSSAIGATSVSPFCEVSLFSTQQQQ

SEQ ID NO: 122557 - protein, 164 aa, Heterodera glycines
  Homolog annotation: Hit_ID=CAE65135.1; Match level="QueryCoverage =96%, HitCoverage=95%, E-value=6e-69, Identity=81%"; Hit description =Hypothetical protein CBG10001 [Caenorhabditis briggsae]
  Gene Ontology: Mol. function=hydrogen-transporting two-sector ATPase activity; Cellular component=integral to membrane; Biological process=proton transport
  Essential gene: C elegans homolog=R10E11.8; Phenotype=Ste
  Coding regions on vcDNA: vcDNA=SeqID_48980; Strand=+; Position=40-534
MSGDNSALIAAEQAAYGPFFGSLGVTAAMIFTAAGSAYGTAKSGTGIACMAVARPDLVMKAIIPVVMAGIVAIYGLVVAVIISGRLEAAGPGYTIDRGFSQFAAGLVCGLCGLGAGYAIGVVGDAGVRGLSQQPRLFVGMILMLIFSEVLGLYGMIVSLLLSSS

SEQ ID NO: 122558 - protein, 440 aa, Heterodera glycines
  Homolog annotation: Hit_ID=CAE67052.1; Match level="QueryCoverage =98%, HitCoverage=82%, E-value=3e-93, Identity=42%"; Hit description =Hypothetical protein CBG12459 [Caenorhabditis briggsae]
  Gene Ontology: Biological process=positive regulation of body size
  Essential gene: C elegans homolog=B0511.8; Phenotype=Emb,Lva
  Coding regions on vcDNA: vcDNA=SeqID_48981; Strand=+; Position=110 -1429
MFPFRPIRKVPWYRRKVPDRISLVAEETISPADEKLVGWRLHDYYEIQELVNILPTIKEKIDFVNPYERPWKQSELRWHRPWMAPLSKPRSAWVVPPTPAYFDVLDFSKYITKTRLATDEEAEWEFDAYYKGINLPTAKFEERVAESLALHLEREEMSKRENHPEKEREENRAKFLRSLIDDAHLILAHGNPKIIDHRISHSDRCESFWIRAGFLPLYESLPVWEMEKVPSIRKVKFTGDDRRRLGELSFTMRDKHTMQVRTKSPMKRLFDWDEPDKLEAPVFPPSFDVADELIMSPMVYNLLADTEPLWQCPGYEYDSGETHKYGRLAIKDITPLITRLDTHWRCDTEHERKEVLRECLAATAVVSLFNWLNGQAHCLGHTQYTEIVAPLSSQLILSDGLQLFYFALGQLNTLAINIDVEGFNNQRSNFCCVNGPFKLY

SEQ ID NO: 122559 - protein, 181 aa, Heterodera glycines
  Homolog annotation: Hit_ID=CAE60901.1; Match level="QueryCoverage =94%, HitCoverage=51%, E-value=4e-45, Identity=54%"; Hit description =Hypothetical protein CBG04617 [Caenorhabditis briggsae]
  Gene Ontology: Cellular component=nucleus; Biological process=rRNA processing
  Essential gene: C elegans homolog=C15H11.9; Phenotype=Lva
  Coding regions on vcDNA: vcDNA=SeqID_48982; Strand=+; Position=91-636
MTAPCIDVGNLLLIDVETDAEDLASSNSERINELTSKNAQLLFNEIWKLPRKIVQDATCSQLPEYTYGLPREKPIPKPKEPTKWEKFARAKGITKKKDRKVWDKTTQEWKPKYGYRRAENQSKEWLIEIPDQKDPYKDYFAEKTEEKREKNNKQELQRLKNISRASNKYKVPTGNRKVFKD

SEQ ID NO: 122560 - protein, 180 aa, Heterodera glycines
  misc_feature (162)..(162): Xaa can be any naturally occurring amino acid
  misc_feature (169)..(169): Xaa can be any naturally occurring amino acid
  Homolog annotation: Hit_ID=NP_730760.1; Match level="QueryCoverage =99%, HitCoverage=98%, E-value=1e-91, Identity=92%"; Hit description =CG8385-PE, isoform E [Drosophila melanogaster] ref|NP_730759.1| CG8385-PD, isoform D [Drosophila melanoga
  Gene Ontology: Mol. function=enzyme activator activity; Cellular component=cytosol; Biological process=G-protein coupled receptor protein signaling pathway
  Essential gene: C elegans homolog=B0336.2; Phenotype=Emb
  Coding regions on vcDNA: vcDNA=SeqID_48983; Strand=+; Position=105-644
MGLAISGLFSRLFGKKEVRILMVGLDAAGKTTILYKLKLGEIVTTIPTIGFNVETVEYKNISFTVWDVGGQDKIRPLWRYYFQNTQGLIFVVDSNDRERVGEAREELMRMLAEDELRDAVLLIFANKQDLPNAMNAAEMTDKLGLHNLRNRNWYIQATCATXGDGLYEXLDWLSNQLKNR

SEQ ID NO: 122561 - protein, 205 aa, Heterodera glycines
  Homolog annotation: Hit_ID=NP_499249.1; Match level="QueryCoverage =95%, HitCoverage=63%, E-value=3e-11, Identity=24%"; Hit description =general transcription factor iih polypeptide 3 34kDa (3L208) [Caenorhabditis elegans] emb|CAA87423.1| Hyp
  Gene Ontology: Biological process=embryogenesis and morphogenesis
  Essential gene: C elegans homolog=ZK1128.4; Phenotype=Emb
  Coding regions on vcDNA: vcDNA=SeqID_48984; Strand=+; Position=19-633
MNGGGSNNSFLCVIFDCNAYNWGCVVAERGVSTLNETVSALIALCNAHNFSSLGNRLLLLAKGAKQQEKKLFTNERITAKELTNFGPAIEGIIHQILAKNVSAEESPFNLSSALSLSICAFQRFKKQFPSSFGHVVFINLSEQFTSEQNALLNLFFASRQYSLHFHVASFHKTVPILQQASDITGGSYMYIDNTKLLAHKLLCHC

SEQ ID NO: 122562 - protein, 266 aa, Heterodera glycines
  Homolog annotation: Hit_ID=NP_498096.1; Match level="QueryCoverage =100%, HitCoverage=49%, E-value=4e-62, Identity=47%"; Hit description= nuclear matrix protein SNEV (3G260) [Caenorhabditis elegans] gb|AAK21467.1| Hypothetical protein T10F2.4
  Gene Ontology: Mol. function=pre-mRNA splicing factor activity; Cellular component=cytoplasm; Biological process=mRNA splicing
  Essential gene: C elegans homolog=T10F2.4; Phenotype=Emb
  Coding regions on vcDNA: vcDNA=SeqID_48985; Strand=+; Position=29-826
QMSRFVCAISGNEPEVAVASPVSGEVFEKRLLIKYIEENGTDPITGHKLDTSNLVELKQDPGIRSMQKSLATASLPSLLKQLQDEWDATMLNNFTLRQELKAAREELTHALYQNDAACRVINRLSSELQSARQIIATLPHGRRAAAESETEATDVEMRPEEAEEGAGADGLPGISEELVNFFTDKCQDFSTARKQRGRNLPEGLASVEQIQKYEEVACHDALHSASVPGITALDLQKNFIATGGMDKTIVLFDSETENIKNTFKGH

SEQ ID NO: 122563 - protein, 165 aa, Heterodera glycines; identical to SEQ ID NO: 119918
  Homolog annotation: Hit_ID=NP_503425.2; Match level="QueryCoverage =100%, HitCoverage=100%, E-value=1e-58, Identity=68%"; Hit description=UNCoordinated locomotion UNC-60 (unc-60) [Caenorhabditis elegans] gb|AAL02461.1| Uncoordinated protein
  Gene Ontology: Mol. function=actin binding; Cellular component=actin filament; Biological process=cell organization and biogenesis
  Essential gene: C elegans homolog=C38C3.5a; Phenotype=Let
  Coding regions on vcDNA: vcDNA=SeqID_48986; Strand=+; Position=32-529

SEQ ID NO: 122564 - protein, 283 aa, Heterodera glycines
  Homolog annotation: Hit_ID=NP_871953.1; Match level="QueryCoverage =91%, HitCoverage=62%, E-value=1e-123, Identity=77%"; Hit description= i mitochondrial  ascsu pyruvate dehydrogenase e1 component type (45.8 kD) (2I357Co) [Caenorhabditis eleg
  Gene Ontology: Mol. function=pyruvate dehydrogenase activity; Cellular component=extracellular space; Biological process=acetyl -CoA metabolism
  Essential gene: C elegans homolog=T05H10.6a; Phenotype=Emb
  Coding regions on vcDNA: vcDNA=SeqID_48987; Strand=+; Position=37-885
MIFLTSFSKHPLSAAFRFFSSVNEVTLQTRPYKLFKLDSGPSTEVRLTRDEALDYYRKMQLVRRMETSANNLYKEKRIRGFCHLYSGQEACAIGMVAATDPKDAVITAYRCHGWTYLMGATVQDILAELTGRIAGNVYGKGGSMHMYAKNFFGGNGIVGAQVPIGAGIAFAMKYRRQKNVCLTLYGDGAANQGQLFEATNMAKLWGLPCIFVCENNGFGMGTPVDRASASTDYYTRGDYVPGIWVDGMDVLTVREATRWAKEYCDAGNGPLMMELAPYRYYGQ

SEQ ID NO: 122565 - protein, 185 aa, Heterodera glycines
  Homolog annotation: Hit_ID=EAA61312.1; Match level="QueryCoverage =99%, HitCoverage=73%, E-value=1e-56, Identity=63%"; Hit description =conserved hypothetical protein [Aspergillus nidulans FGSC A4] ref|XP_ 411244.1| conserved hypothetical prot
  Gene Ontology: Mol. function=structural constituent of ribosome; Cellular component=cytosolic large ribosomal subunit (sensu Eukarya); Biological process=protein biosynthesis
  Essential gene: C elegans homolog=F53G12.10; Phenotype=Emb,Lva
  Coding regions on vcDNA: vcDNA=SeqID_48988; Strand=+; Position=20-574
KRWGTEKNATAALEAAKGRRAASKVKRVVIFKRAEQYVKEYRKAEREEIRLKRVARQANNFHVPAEPKLAFVIRIKGINKIAPKPRKVLQLLRLYQINNGVFLHLNKATLEMLKLVEPYVAYGTPNLKTVRELIYKRGYRKGHGQRIALSDNAVVEKSRRQGGPYLRWKILFDEIYTVGPNLQKG

SEQ ID NO: 122566 - protein, 164 aa, Heterodera glycines
  Homolog annotation: Hit_ID=NP_505624.1; Match level="QueryCoverage =90%, HitCoverage=86%, E-value=3e-27, Identity=37%"; Hit description =putative protein of eukaryotic origin (5K684) [Caenorhabditis elegans] emb|CAA94859.1| Hypothetical prote
  Essential gene: C elegans homolog=ZK856.11; Phenotype=Lva
  Coding regions on vcDNA: vcDNA=SeqID_48989; Strand=+; Position=34-528
MSKTSKKNFVTKQLVKEIVIPADNEFVGKILASRGNNLHEVETDEGENFLVSMPTRFRKKLWVRRGTYVILQSIEEGDKVRAEIVHVLDPENIAFLMEKEVWPERFIVEAAQLTKRGQRTEENDDSDLFPATSESENSAEESSSLVSEDVALNGQTNAIDETTI

SEQ ID NO: 122567 - protein, 97 aa, Heterodera glycines; identical to SEQ ID NO: 121214
  Homolog annotation: Hit_ID=CAE65731.1; Match level="QueryCoverage =95%, HitCoverage=36%, E-value=2e-13, Identity=39%"; Hit description =Hypothetical protein CBG10814 [Caenorhabditis briggsae]
  Gene Ontology: Biological process=mitotic spindle positioning
  Essential gene: C elegans homolog=Y110A7A.11; Phenotype=Emb,Lva,Unc
  Coding regions on vcDNA: vcDNA=SeqID_48990; Strand=+; Position=26-319

SEQ ID NO: 122568 - protein, 214 aa, Heterodera glycines
  Homolog annotation: Hit_ID=NP_501489.2; Match level="QueryCoverage =100%, HitCoverage=39%, E-value=5e-35, Identity=36%"; Hit description= polymerase epsilon (4J448) [Caenorhabditis elegans] gb|AAB37729.2| Hypothetical protein F08B4.5 [Caenorh
  Gene Ontology: Mol. function=epsilon DNA polymerase activity; Cellular component=replication fork; Biological process=DNA replication
  Essential gene: C elegans homolog=F08B4.5; Phenotype=Emb,Pvl,Rup,Unc
  Coding regions on vcDNA: vcDNA=SeqID_48991; Strand=+; Position=2-643
VHLDNERVLKALYHLLQGFSASPPNIFVFCGPFLGIQRAHSYMEQAANAFRHFANILSEFSHAYHATEFIFVPSADDAPPLQIFPRPTLLQLIQKCFKEAKNMHFATNPCKLVFKDRHIVIFRDDVVEKVCRSAVFMPKNAMASRIPKLFCDTIWAQRHFSPLPLFINPIQPHFDPLFQLFPSPDALVIADRFKAFFEPADERRRLTMNPGPFS

SEQ ID NO: 122569 - protein, 217 aa, Heterodera glycines
  Homolog annotation: Hit_ID=NP_611046.2; Match level="QueryCoverage =99%, HitCoverage=45%, E-value=2e-23, Identity=33%"; Hit description =CG8190-PA [Drosophila melanogaster] gb|AAF58125.1| CG8190-PA [Drosophila melanogaster]
  Gene Ontology: Mol. function=translation initiation factor activity; Cellular component=cytoplasm; Biological process=translational initiation
  Essential gene: C elegans homolog=C15F1.4; Phenotype=Emb,Lva
  Coding regions on vcDNA: vcDNA=SeqID_48992; Strand=+; Position=1-651
DCQAVVFAGGRGSRMPSLTNQMPKALLPMANMPLYWFSLNLLRLNRVRDCLLIVPLGQKLQIENALKTDGGGRWPTLKGMDIEVVAIDSLEEDVDDWGTADVLKRLLGKLKSDHILLISGDLVSDVRLRDMFKQYMENNAVLSCLLTDSALGGPIPGPKDRVKKYRDFVILGPNGQLLFLVDEDDFAEEEGIPISLFDRCPKAKATAKYKDVHLYLV

SEQ ID NO: 122570 - protein, 179 aa, Heterodera glycines
  Homolog annotation: Hit_ID=NP_038900.1; Match level="QueryCoverage =94%, HitCoverage=63%, E-value=3e-42, Identity=51%"; Hit description =phosphomannomutase 1 [Mus musculus] sp|O35621|PMM1_MOUSE Phosphomannomutase 1 (PMM 1) gb|AAB62943.1| phos
  Gene Ontology: Mol. function=phosphomannomutase activity; Cellular component=cytosol; Biological process=GDP-mannose biosynthesis
  Essential gene: C elegans homolog=F52B11.2; Phenotype=Unclassified
  Coding regions on vcDNA: vcDNA=SeqID_48993; Strand=+; Position=35-571
MSAERKKSVLFLFDVDGTLTASRQSITPSMLAFMHSVKSRVPVAVVGGSDLAKIFEQLGGTQQRDQCLALFDFVFAENGLTGFKGTEPMPSESISKQLGEAKCQELTNFCLRYMSNIELPLKRGNFVEHRNGMINVSPIGRSCSQSERDQFVQFERTTPIRAQFVEALRQRFPIEQYGL

SEQ ID NO: 122571 - protein, 179 aa, Heterodera glycines
  Homolog annotation: Hit_ID=AAK71499.1; Match level="QueryCoverage =99%, HitCoverage=99%, E-value=6e-71, Identity=74%"; Hit description =translationally controlled tumor protein-like protein [Wuchereria bancrofti] sp|Q962A2|TCTP_WUCBA Translat
  Essential gene: C elegans homolog=F25H2.11; Phenotype=Gro,Stp,Unc
  Coding regions on vcDNA: vcDNA=SeqID_48994; Strand=+; Position=74-613
MIIYKDAFTDDELASDSFPMKLVDDLIYEFKGRHVVRKEGEITMSGANPSAEEIDEGTEEAVERGIDFVLNHRLQEMNCYENQATFKGYVKDFMKKIIEYMEKEQKSADEIAAFKKKIQAWVVSLLAKDRFKNLAFFIGENMAEGKGEGQVAIVEYRQENGEEVPTLMLIKEALIVEKC

SEQ ID NO: 122572 - protein, 221 aa, Heterodera glycines
  Homolog annotation: Hit_ID=P29522; Match level="QueryCoverage=99%, HitCoverage=99%, E-value=1e-56, Identity=48%"; Hit description =Elongation factor 1-beta' pir||S35514 translation elongation factor eEF-1 beta chain - silkworm dbj|BAA02602.1
  Gene Ontology: Mol. function=translation factor activity, nucleic acid binding; Cellular component=eukaryotic translation elongation factor 1 complex; Biological process=translational elongation
  Essential gene: C elegans homolog=F54H12.6; Phenotype=Lva
  Coding regions on vcDNA: vcDNA=SeqID_48995; Strand=+; Position=57-722
AHIGTMTVSKELNELNNCLSTRAYLHGFLPSQEDQYVFKSIKSVPSEKEYAHVARWYKHIQSFDDVERLNWSKKAGQTTQTVASKETPAKKVEAEEDFDLFGDEESDDEEKKRITKERLKAYAEKKAKKPGPVAKSNVIYDVKPWDDTIDIKEIEAKVRSVQCDGLVWGASKILPVAFGVQKLQICCCVEDDKVSTDWLEEQITDFEDLVQSVDVVAFNKV

SEQ ID NO: 122573 - protein, 118 aa, Heterodera glycines
  Homolog annotation: Hit_ID=NP_499164.1; Match level="QueryCoverage =71%, HitCoverage=28%, E-value=1e-19, Identity=50%"; Hit description =xylosylprotein beta 1 4-galactosyltransferase 7, SQuashed Vulva SQV -3 (33.8 kD) (sqv-3) [Caenorhabditis e
  Gene Ontology: Mol. function=xylosylprotein 4-beta -galactosyltransferase activity; Cellular component=Golgi apparatus
  Essential gene: C elegans homolog=R10E11.4; Phenotype=Emb
  Coding regions on vcDNA: vcDNA=SeqID_48996; Strand=+; Position=1-357
YDYKNFFGSVLVITLDDFKKVNGMSNEFWGWGLEDDDFYLRLKAAGMANKIRRPSNLSTNRSNTFLHLHTRNRRRDFSVEESRKKAFVAVPSRCRTAKLCHCQSRHSFGAEQLLACDF

SEQ ID NO: 122574 - protein, 376 aa, Heterodera glycines
  Homolog annotation: Hit_ID=AAQ89579.1; Match level="QueryCoverage =100%, HitCoverage=57%, E-value=0.0, Identity=100%"; Hit description =heat shock protein 70-C [Heterodera glycines] gb|AAM93256.1| heat shock protein 70-C [Heterodera glycines]
  Gene Ontology: Mol. function=Hsp70/Hsp90 organizing protein activity; Cellular component=endoplasmic reticulum lumen; Biological process =cell organization and biogenesis
  Essential gene: C elegans homolog=C15H9.6; Phenotype=Dpy,Lva
  Coding regions on vcDNA: vcDNA=SeqID_48997; Strand=+; Position=1-1131
RKDNRAVQKLRREVEKAKRALSVQHQVKLEVESLIDGEDFSETLTRAKFEELNMDLFRGTLKPVQKVLEDADLKKEDIHEVVLVGGSTRIPKVQQLLKEFFNGKEPSRGINPDEAVAYGAAVQAGVISGEENSEIVLLDVNPLTMGIETVGGVMTKLITRNTVIPTKKSQIFSTAADNQPTVTIQVFEGERPMTKDNHLLGKFDLTGIPPAPRGVPQIEVTFEIDVNGILHVTAEDKGTGNKNKITITNDHNRLSPEEIERMINDAEKFAEEDKKTKEVVEARNEFESYAYSLKNQLGDSEKLGGKLSAEDKTTIEGAVDEAISWLDSNKDAPPEELKERKKDLEAKVQPIISKLYAGQSPPPGSEPPPTEEKDEL

SEQ ID NO: 122575 - protein, 194 aa, Heterodera glycines
  Homolog annotation: Hit_ID=CAE58542.1; Match level="QueryCoverage =99%, HitCoverage=100%, E-value=2e-85, Identity=76%"; Hit description= Hypothetical protein CBG01701 [Caenorhabditis briggsae]
  Gene Ontology: Mol. function=small monomeric GTPase activity; Cellular component=nuclear membrane; Biological process=ER to Golgi transport
  Essential gene: C elegans homolog=ZK180.4; Phenotype=Ste
  Coding regions on vcDNA: vcDNA=SeqID_48998; Strand=+; Position=20-604
MSWILDWFSGVLNYLGLTKKSGKLVFLGLDNAGKTTLLHMLKDDRIAQHVPTLHPTSEELSLGGIRFTTFDLGGHVQARRVWKSYFPALDAIVFLVDAADLERIQEAREELWSLLQDEQVANAPLLILGNKIDKPNALGEDQLKYYLGVQQYCTGKGQVSRADLTTRPLEMFMCSVLRRQGYGEGFRWLSQYLD

SEQ ID NO: 122576 - protein, 213 aa, Heterodera glycines
  Homolog annotation: Hit_ID=CAE61654.1; Match level="QueryCoverage =100%, HitCoverage=81%, E-value=1e-103, Identity=79%"; Hit description=Hypothetical protein CBG05588 [Caenorhabditis briggsae]
  Gene Ontology: Mol. function=structural constituent of ribosome; Cellular component=cytosolic large ribosomal subunit (sensu Eukarya); Biological process=reproduction
  Essential gene: C elegans homolog=B0250.1; Phenotype=Emb,Lva,Unc
  Coding regions on vcDNA: vcDNA=SeqID_48999; Strand=+; Position=51-689
MGRRIRAQRKGRGGIFKSHSKHRKGPAKLRPVDYSERHGFIRGIVKDIIHDPGRGAPLAIVQFRDPYKYRVKKETMIAAEGLHTGQFIYCGKKAQVQIGNVMPIGELPEGTTVCNLEEKAGDRGRLARTSGNYAIIVAHNPDTKRTRIRLPSGAKKVVPSANRAMIGIVAGGGRTDKPLLKAGRAYHKYKVKRNCWPKVRGVAMNPVEHPHGG

SEQ ID NO: 122577 - protein, 201 aa, Heterodera glycines
  Homolog annotation: Hit_ID=NP_498517.1; Match level="QueryCoverage =90%, HitCoverage=41%, E-value=1e-53, Identity=60%"; Hit description =proteasome Regulatory Particle, Non-ATPase-like (49.1 kD) (rpn-6) [Caenorhabditis elegans] gb|AAA21173.2|
  Gene Ontology: Mol. function=proteasome endopeptidase activity; Cellular component=proteasome regulatory particle (sensu Eukarya); Biological process=embryogenesis and morphogenesis
  Essential gene: C elegans homolog=F57B9.10; Phenotype=Emb
  Coding regions on vcDNA: vcDNA=SeqID_49000; Strand=+; Position=72-674
MTASLQQIRAQPGWTADKCKEQIEVAKSENRTFQRQTLQAHLVHLLNKEHKFNEAIQLAAQLVRELKKVDDKDLLVDVQLEESIGFYHLSNYTKARAELVSARTIANTKYTPPAMQARLDLQSGILHAADDRDFKTAYSYFFEAFQAFDSVNESALAQQALKYMLLSKVMLDQSDEVHSIMTGKTAQKYAKTETEAMHAIA

SEQ ID NO: 122578 - protein, 180 aa, Heterodera glycines
  Homolog annotation: Hit_ID=CAE57200.1; Match level="QueryCoverage =95%, HitCoverage=42%, E-value=1e-49, Identity=55%"; Hit description =Hypothetical protein CBG00050 [Caenorhabditis briggsae]
  Gene Ontology: Mol. function=branched-chain amino acid aminotransferase activity; Cellular component=cytoplasm; Biological process=branched chain family amino acid biosynthesis
  Essential gene: C elegans homolog=K02A4.1; Phenotype=Emb,Lvl
  Coding regions on vcDNA: vcDNA=SeqID_49001; Strand=+; Position=54-593
MSSMSAAGGAIAASVEQQPAVEPDRSTFYHKDLSIVRATAGQMQPKPLGTVDQIKFGHHFSDHMMEVDWSDTAGWNQPEISPLHSVQLHPGAKVLHYAIELFEGMKAYRGIDDRIRLFRPEMNIARMKRTAARAALPDFDAEEMLKVIAELVRLDPEWAPYFAPSSLYIHAKLHRTDPRL

SEQ ID NO: 122579 - protein, 181 aa, Heterodera glycines
  Homolog annotation: Hit_ID=NP_730760.1; Match level="QueryCoverage =98%, HitCoverage=98%, E-value=8e-98, Identity=96%"; Hit description =CG8385-PE, isoform E [Drosophila melanogaster] ref|NP_730759.1| CG8385-PD, isoform D [Drosophila melanoga
  Gene Ontology: Mol. function=enzyme activator activity; Cellular component=cytoplasmic vesicle; Biological process=G-protein coupled receptor protein signaling pathway
  Essential gene: C elegans homolog=B0336.2; Phenotype=Emb
  Coding regions on vcDNA: vcDNA=SeqID_49002; Strand=+; Position=48-593
MGNMFANLFKGLFGKKEMRILMVGLDAAGKTTILYKLKLGEIVTTIPTIGFNVETVEYRNISFTVWDVGGQDKIRPLWRHYFQNTQGLIFVVDSNDRERVGEAREELMRMLAEDELRDAVLLVFANKQDLPNAMNAAEVTDRLGLHTLRNRNWYIQATCATSGDGLYEGLDWLSNQLKNRG

SEQ ID NO: 122580 - protein, 205 aa, Heterodera glycines
  Homolog annotation: Hit_ID=CAB02838.1; Match level="QueryCoverage =87%, HitCoverage=96%, E-value=3e-23, Identity=34%"; Hit description =Hypothetical protein C41G7.1a [Caenorhabditis elegans] pir||T19892 hypothetical protein C41G7.1 - Caenorha
  Gene Ontology: Mol. function=protein binding; Cellular component =nucleus; Biological process=spliceosome assembly
  Essential gene: C elegans homolog=C41G7.1a; Phenotype=Lva,Unc
  Coding regions on vcDNA: vcDNA=SeqID_49003; Strand=+; Position=2-619
ASESGSDKIVFQKNVTGRGSQVLDDAEFVKMYDRSTSKTLNTSSANDNAQSNQQKEQVQKWKVGDQCMALYEVDGKWYPAKIEQISPVKNTCTVSYIGYDQKAILKLEDILGESDVEAADDHGDEREAEGTSGTTKIADNDVKKDAFPIPDLCPPPPPSMFGKIAVAGNEKEALTNMLMSWYMSGYHTGFYQGVMHEKTTRQKPK

SEQ ID NO: 122581 - protein, 184 aa, Heterodera glycines
  misc_feature (33)..(33): Xaa can be any naturally occurring amino acid
  misc_feature (80)..(80): Xaa can be any naturally occurring amino acid
  Homolog annotation: Hit_ID=CAE65778.1; Match level="QueryCoverage =99%, HitCoverage=31%, E-value=3e-57, Identity=55%"; Hit description =Hypothetical protein CBG10873 [Caenorhabditis briggsae]
  Gene Ontology: Mol. function=metallopeptidase activity; Cellular component=extracellular; Biological process=embryogenesis and morphogenesis
  Essential gene: C elegans homolog=C37H5.9a; Phenotype=Emb
  Coding regions on vcDNA: vcDNA=SeqID_49004; Strand=+; Position=21-575
KINNPQFCGLTYVGRISPANPVYLSFQCTQRRXGIAIHETMHALGLHHEQLRLDRDLFININWANINPQNYDTFARSESXKYTSYGVRYDYGSIMHYASNIASKSAGLKTMTAKTNPGANDAQMGQRRGLSATDVEELRRMYCMPGCADANVYCGVWATNNLCQLASTRPWMMQNCRKSCSLCG

SEQ ID NO: 122582 - protein, 131 aa, Heterodera glycines
  Homolog annotation: Hit_ID=AAA35311.1; Match level="QueryCoverage =68%, HitCoverage=68%, E-value=5e-31, Identity=72%"; Hit description =histone H2A-alpha
  Gene Ontology: Mol. function=DNA binding; Cellular component =nucleosome; Biological process=establishment and/or maintenance of chromatin architecture
  Essential gene: C elegans homolog=T23D8.6; Phenotype=Emb
  Coding regions on vcDNA: vcDNA=SeqID_49005; Strand=-; Position=1-393
KPEKLLRRRRLAERAAKRRRTEKRRRAEKGRRRRAERVVFVKIAASGTYSTRSARAGVAFPVGRIHRLLRHGRHAQRIGAGAPVYMASVLEYLAAEVLELAGNAATENKKLRINPRHLQLAVRNHEEVNKL

SEQ ID NO: 122583 - protein, 188 aa, Heterodera glycines; identical to SEQ ID NO: 120932
  Homolog annotation: Hit_ID=NP_498660.1; Match level="QueryCoverage =98%, HitCoverage=97%, E-value=1e-74, Identity=74%"; Hit description =ribosomal Protein, Large subunit (21.5 kD) (rpl-9) [Caenorhabditis elegans] gb|AAK84469.1| Ribosomal prot
  Gene Ontology: Mol. function=RNA binding; Cellular component =cytosolic ribosome (sensu Eukarya); Biological process=reproduction
  Essential gene: C elegans homolog=R13A5.8; Phenotype=Emb,Ste
  Coding regions on vcDNA: vcDNA=SeqID_49006; Strand=+; Position=40-606

SEQ ID NO: 122584 - protein, 158 aa, Heterodera glycines
  Homolog annotation: Hit_ID=XP_396009.1; Match level="QueryCoverage =70%, HitCoverage=35%, E-value=2e-23, Identity=44%"; Hit description =similar to CG33104-PA [Apis mellifera]
  Gene Ontology: Biological process=gametogenesis
  Essential gene: C elegans homolog=F53A3.7; Phenotype=Emb,Sck,Stp
  Coding regions on vcDNA: vcDNA=SeqID_49007; Strand=+; Position=18-491
MRFTIQLLQKSQRCYKLLFANYTKQVASVSPLLIHRQNLISFSAFRNFCSSIETKKEEIGRIKSQLAIIFTCKVCSTRQGPKQFSRSAYENGVVLIRCDHCRNHHIIADNLGWFSDLDGKKNIEEILASKGEAIKKGTAVLEMEVPAEEEGDNAKYSK

SEQ ID NO: 122585 - protein, 366 aa, Heterodera glycines
  Homolog annotation: Hit_ID=AAR09171.1; Match level="QueryCoverage =100%, HitCoverage=100%, E-value=0.0, Identity=99%"; Hit description =aldolase [Heterodera glycines]
  Gene Ontology: Mol. function=fructose-bisphosphate aldolase activity; Biological process=fructose metabolism
  Essential gene: C elegans homolog=F01F1.12a; Phenotype=Gro,Unc
  Coding regions on vcDNA: vcDNA=SeqID_49008; Strand=+; Position=44-1144
MAEVGNSYRPPLSEEKQNELRAIAQKILQPGKGILAADESTGSIGKRFDTIGLENTENNRRRYRQLLFTTPSFGQNLSGVILFDETFRQSTDNGVRFVDVIKKAGAVAGIKVDTGVVPLAGTLDEGTTQGLDKLSDRCAEYKKGGCDFAKWRCVLNIGAHKPSHLALMENANVLARYASICQQNGLVPIVEPEVLCDGEHSLERCQKVTELTLAYTYKALANHHIYLEGTLLKPNMVTPGQSHSPKATPDQIGLATVTALRRSVPIAVPGIVFLSGGQSEIEATHNLNAINSVPGPKPWTLSFSYGRALQSSVIKKWNGKDENLGDAQKVLLHRAKANGDAQQGKYTGEEAAASAAESLFVAKHAY

SEQ ID NO: 122586 - protein, 212 aa, Heterodera glycines
  Homolog annotation: Hit_ID=NP_490762.1; Match level="QueryCoverage =97%, HitCoverage=98%, E-value=1e-39, Identity=42%"; Hit description =putative N-myristoylated nuclear protein, with a coiled coil domain, of eukaryotic origin (24.1 kD) (1B11
  Gene Ontology: Cellular component=endosome; Biological process =locomotion
  Essential gene: C elegans homolog=Y65B4A.3; Phenotype=Lva,Unc
  Coding regions on vcDNA: vcDNA=SeqID_49009; Strand=+; Position=3-641
ISLAFGQKRTDLRLAPTDHDRTTLSLKMQRDKLRQAYQRYERNIAKDAERARALLRDGRKDRALLLLKRKRFQETMINRIGFFLEQVERTITDMEMAQINREVFDNLRLGTEALKALNETISLDEVERLMEESKEAQEFQEELSTMLGQQMSEEDNDMVEEEFERMLSEQMPAVPTEQPTDTKEGRKTADKERTKEEKEPKRRREAVAQEAT

SEQ ID NO: 122587 - protein, 205 aa, Heterodera glycines
  Homolog annotation: Hit_ID=CAE56706.1; Match level="QueryCoverage =84%, HitCoverage=60%, E-value=9e-22, Identity=34%"; Hit description =Hypothetical protein CBG24492 [Caenorhabditis briggsae]
  Gene Ontology: Biological process=chromosome segregation
  Essential gene: C elegans homolog=C41G7.3; Phenotype=Him
  Coding regions on vcDNA: vcDNA=SeqID_49010; Strand=+; Position=3-617
SHSVFNRYTFQFVFTMPLHWTSVDTRNALLCAAVPSIGAFVGSTMAIKDQELVQFLKKQNFPSFARCCKYNYLLANTAVTIPFGYASYLVYKIGGGVSCTDSKIALGLYGATLLSGCFLVPTLKKHDTKALTANAVVLAGLSVATSVAFYNIDKISAYWTMPFTLWAILCAGLTVKANFDAPPAQPLDAPPAQPLEAPPAQPLEA

SEQ ID NO: 122588 - protein, 202 aa, Heterodera glycines
  misc_feature (59)..(59): Xaa can be any naturally occurring amino acid
  misc_feature (185)..(185): Xaa can be any naturally occurring amino acid
  Homolog annotation: Hit_ID=CAG08038.1; Match level="QueryCoverage =98%, HitCoverage=39%, E-value=1e-39, Identity=43%"; Hit description =unnamed protein product [Tetraodon nigroviridis]
  Gene Ontology: Cellular component=nucleoplasm; Biological process =establishment and/or maintenance of chromatin architecture
  Essential gene: C elegans homolog=Y105E8A.17; Phenotype=Emb,Gro,Unc
  Coding regions on vcDNA: vcDNA=SeqID_49011; Strand=+; Position=34-639
MFSTDAQDILGGGGSGSQLAKKSGLPTMKLTNLDKKKKITTNGQPKRPVGMHRELYNLXFTRARTITKKRSNSLMPTQTKKGFSLAKAQLGKRPVRKWLWCPFENEARKDGLALKHWEREDKHSTPYSFVQFNKQLDVPSFTDEEYEEHLVDPRWTREQTQHLLELCKQFDLRWPIIEDRFDQNXCRNRKSMEDMKERYYGL

SEQ ID NO: 122589 - protein, 194 aa, Heterodera glycines
  Essential gene: C elegans homolog=T06D8.7; Phenotype=Emb
  Coding regions on vcDNA: vcDNA=SeqID_49012; Strand=+; Position=14-598
MPSARVSSADSSAVSVSNKGISLGLSSSGTSPSNVIVSSVPVNSGTFRGLSPIGNVSSLVRDVFGPLAAVRRQSPTVQVAAGAGGGIIAGYVFGKTSKMVAILLGSTVLFLQFAQCKGYLQIQNGKLREDFEAARDKLGEMIDGMGAIGGEAVVGMIDGTGGRSSGNELFKIVSDSAHFLCGIVGGILVRFGMS

SEQ ID NO: 122590 - protein, 165 aa, Heterodera glycines
  Homolog annotation: Hit_ID=NP_499683.1; Match level="QueryCoverage =93%, HitCoverage=93%, E-value=2e-45, Identity=54%"; Hit description =putative protein, with at least 3 transmembrane domains (17.8 kD) (3O6) [Caenorhabditis elegans] emb|CAA2
  Essential gene: C elegans homolog=Y37D8A.16; Phenotype=Lva,Unc
  Coding regions on vcDNA: vcDNA=SeqID_49013; Strand=+; Position=83-580
MAPAAPLQFVAGTALKVVIVLLTIVVLVLLDPSYVTAYISINYEIVLIYIICALTLLYCIVSIIMYAIMQKSVREGEELHLTNCALSEIVFAGAGMICWMLVCGIGGTVAQRTIIETGQYFGWLGACAGIIVCLFMGVLAVFALDILTNKILSPTRKYRYSTPQM

SEQ ID NO: 122591 - protein, 92 aa, Heterodera glycines
  Homolog annotation: Hit_ID=EAA04924.2; Match level="QueryCoverage =93%, HitCoverage=95%, E-value=2e-36, Identity=81%"; Hit description =ENSANGP00000018702 [Anopheles gambiae str. PEST]
  Essential gene: C elegans homolog=W01D2.1; Phenotype=Gro
  Coding regions on vcDNA: vcDNA=SeqID_49014; Strand=+; Position=31-309
MTKGTSSFGKRHNKTHTLCRRCGRSSYHIQKHTCSSCGYPAKRKRTFQWSVKSIRRRTTGTGRMRHLKLVHRRFRNGFREGVTAPRKGGVKA

SEQ ID NO: 122592 - protein, 161 aa, Heterodera glycines
  Homolog annotation: Hit_ID=NP_500188.1; Match level="QueryCoverage =100%, HitCoverage=100%, E-value=3e-81, Identity=96%"; Hit description=vacuolar proton ATPase VHA-3, Vacuolar proton ATPase (16.4 kD) (vha-3) [Caenorhabditis elegans] ref|NP_
  Gene Ontology: Mol. function=hydrogen-transporting two-sector ATPase activity; Cellular component=integral to membrane; Biological process=proton transport
  Essential gene: C elegans homolog=Y38F2AL.4; Phenotype=Emb,Gro,Unc
  Coding regions on vcDNA: vcDNA=SeqID_49015; Strand=+; Position=60-545
MTYDLETAERAAYAPFFGYIGAASAQIFTVFGAAYGTAKSAVGICSMGVMRPELIMKSVIPVIMAGIIGIYGLVVAMVLKGKVTSASNGYTLNNGFAHLAAGLTCGLCGLGAGYAIGIVGDAGVRGTAQQPRLFVGMILILIFSEVLGLYGMIVALILGTS

SEQ ID NO: 122593 - protein, 374 aa, Heterodera glycines
  Homolog annotation: Hit_ID=AAS84611.1; Match level="QueryCoverage =100%, HitCoverage=100%, E-value=0.0, Identity=99%"; Hit description =cathepsin L-like cysteine proteinase I variant form precursor [Heterodera glycines]
  Gene Ontology: Mol. function=cathepsin S activity; Cellular component= extracellular space; Biological process=proteolysis and peptidolysis
  Essential gene: C elegans homolog=T03E6.7; Phenotype=Emb,Gro,Unc
  Coding regions on vcDNA: vcDNA=SeqID_49016; Strand=+; Position=54-1178
MFLLFLLSMLLLQTNGWRARERAIELADSDESIELQNIGQRKTDIRTPTERMSALRQMIERGFSDWNAYKQKHGKAYADQEVENERMLTYLSAKQFIDKHNEAYKEGKVSFRVGETHIADLPFSEYQKLNGFRRLMGDSLRRNASTFLAPMNVGDLPESVDWRDKGWVTEVKNQGMCGSCWAFSATGALEGQHVRDKGHLVSLSEQNLIDCSKKYGNMGCNGGIMDNAFQYIKDNKGIDKETAYPYKAKTGKKCLFKRNDVGATDSGYNDIAEGDEEDLRMAVATQGPVSVAIDAGHRSFQLYTNGVYFEKECDPQNLDHGVLVVGYGTDPTQGDYWIVKNSWGTRWGEQGYIRMARNRNNNCGIASHASFPLV

SEQ ID NO: 122594 - protein, 240 aa, Heterodera glycines
  misc_feature (234)..(234): Xaa can be any naturally occurring amino acid
  Homolog annotation: Hit_ID=NP_502087.1; Match level="QueryCoverage =98%, HitCoverage=68%, E-value=9e-97, Identity=72%"; Hit description =phosphate carrier protein, mitochondrial precursor (36.7 kD) (4L912) [Caenorhabditis elegans] emb|CAA9743
  Gene Ontology: Mol. function=phosphate carrier activity; Cellular component=integral to plasma membrane; Biological process=transport
  Essential gene: C elegans homolog=F01G4.6; Phenotype=Emb,Lva
  Coding regions on vcDNA: vcDNA=SeqID_49017; Strand=+; Position=67-788
MVGITELAEATKKAFGAGPLIAANCATAENAKSGNEVEFGSMKFYGLCGIGGILSCGITHTAIVPLDLVKCRIQVDPAKYKGIIGGFKVTLQEEGVRGLAKGWAPTAIGYSMQGLGKFGLYEMFKNVYAGMIGEELAYSCRTYLYLAASASAEFFADMMLAPMEATKVRIQTSPGAPPTLRGCAPFIYRTEGLMGFYKGLPPLWMRQIPYTMMKFACFERTVELLYKHVVPKPXAECTQA

SEQ ID NO: 122595 - protein, 262 aa, Heterodera glycines
  misc_feature (246)..(246): Xaa can be any naturally occurring amino acid
  Homolog annotation: Hit_ID=NP_508803.2; Match level="QueryCoverage =90%, HitCoverage=57%, E-value=2e-56, Identity=42%"; Hit description =longevity-assurance protein (XF316) [Caenorhabditis elegans] gb|AAK39252.2| Homolog of yeast longevity ge
  Gene Ontology: Cellular component=cytoplasmic vesicle; Biological process=intracellular protein transport
  Essential gene: C elegans homolog=Y6B3B.10; Phenotype=Unclassified
  Coding regions on vcDNA: vcDNA=SeqID_49018; Strand=+; Position=57-842
MDEKKGSIYYRIWDHLFFGFAGRSKFKRVAETGWRFTYYSIIWFVGVSVLYKEPQFSSVIECFREWPKHHLPNDVWQYYIIQSGFYLSLLFSLFAFDVRRSDHYEMATHHLATILLLFMSFSINFVRAGTLILLLHDSADVFLELGKLFRYAGWDRAVTIDFSVFMLVWISTRLVYFPLKLVRYMLFDAPKLIMETYRWTDILQKPIIPRVFLAVLCILLLLHIFWTYLLIKIAIKSVKSGVDDIXEDEDDDSEEEAEKRKN

SEQ ID NO: 122596 - protein, 264 aa, Heterodera glycines
  Homolog annotation: Hit_ID=CAE62009.1; Match level="QueryCoverage =98%, HitCoverage=98%, E-value=3e-73, Identity=52%"; Hit description =Hypothetical protein CBG06017 [Caenorhabditis briggsae]
  Gene Ontology: Mol. function=7-alpha-hydroxysteroid dehydrogenase activity; Cellular component=plasma membrane; Biological process =lipid metabolism
  Essential gene: C elegans homolog=F01G4.2; Phenotype=Pvl,Stp,Unc
  Coding regions on vcDNA: vcDNA=SeqID_49019; Strand=+; Position=21-815
MVSVGLANAQRLVAIVTGGASGLGCATVRRLVAKGFNVSLLDLPMSEGAKVVEELGTTDNVLFSPVDISSDDQVYFAMDATTEKFGGLIVLANCAGIAFAHRLYNPSSRAQMDLDKIRRLIDVNIFGTINVIRHALPLLIDNVPDENDQRGVIINTSSIAAFEGQMGQTLYSASKGAVASLTVPLARDYSNNGIRVMAIAPGLMDTPLLSSLPPKVKKFLSGTVPFPNRLGKPEEFAALVEHIIDNHYLNGEIIRLDGGIRMNA

SEQ ID NO: 122597 - protein, 130 aa, Heterodera glycines
  Homolog annotation: Hit_ID=CAE60902.1; Match level="QueryCoverage =96%, HitCoverage=92%, E-value=6e-21, Identity=43%"; Hit description =Hypothetical protein CBG04618 [Caenorhabditis briggsae]
  Gene Ontology: Cellular component=DNA-directed RNA polymerase I complex; Biological process=transcription
  Essential gene: C elegans homolog=C15H11.8; Phenotype=Gro,Stp
  Coding regions on vcDNA: vcDNA=SeqID_49020; Strand=+; Position=34-426
MFTPGDDFCAACGSIMQTPNELTAGSGVTNFIKCSVCDAKWPYKIVHGQLLSRHERNFEQRNAVGEERQKQQRKETAREEEEEDVTVEHVCPKCEWTTATYTTQQTRSADEGQTVFYQCVRCKHRSIEYS

SEQ ID NO: 122598 - protein, 164 aa, Heterodera glycines
  Homolog annotation: Hit_ID=CAE60322.1; Match level="QueryCoverage =95%, HitCoverage=72%, E-value=3e-40, Identity=51%"; Hit description =Hypothetical protein CBG03913 [Caenorhabditis briggsae]
  Gene Ontology: Cellular component=anaphase-promoting complex; Biological process=mitosis
  Essential gene: C elegans homolog=F15H10.3; Phenotype=Emb,Ste
  Coding regions on vcDNA: vcDNA=SeqID_49021; Strand=+; Position=60-551
MSVGLSSIVDDSHQRQSHFWAEILPPGVGHTNDISGDAIWTLSSCKEGLGVHQLLNDREDTYWQSDGLQPHSITIEFQRKTEVDFLLMFLDYKLDESYTPSKIQVQTGASVLDLDEPKSLSFTEPSGWQMIDLRHAGTKRPANVFVIVVQIIQNHQNGRDTHIR

SEQ ID NO: 122599 - protein, 134 aa, Heterodera glycines
  Homolog annotation: Hit_ID=NP_034515.1; Match level="QueryCoverage =91%, HitCoverage=96%, E-value=2e-24, Identity=50%"; Hit description =H2-K region expressed gene 2 [Mus musculus] gb|AAH22974.1| H2-K region expressed gene 2 [Mus musculus] gb
  Gene Ontology: Mol. function=tubulin binding; Cellular component =cytoplasm; Biological process=tubulin folding
  Essential gene: C elegans homolog=F21C3.5; Phenotype=Gro
  Coding regions on vcDNA: vcDNA=SeqID_49022; Strand=+; Position=15-419
MTKFEETKSKLEAEFEKLRNLEKDRSKCMTNRRQLESQLTENSMVKEEFDRLKSDAGVFKLIGPVLVKQNLEEAKQNVAKRIDYIRTEIERIESLLGDLEKNIEVQKESVERMRDTFRQTLAVATAPTANSINA

SEQ ID NO: 122600 - protein, 207 aa, Heterodera glycines
  misc_feature (65)..(65): Xaa can be any naturally occurring amino acid
  Homolog annotation: Hit_ID=NP_497623.1; Match level="QueryCoverage =94%, HitCoverage=38%, E-value=6e-85, Identity=77%"; Hit description =translation elongation factor Tu, elongated for truncated tRNAs found in nematode mitochondria (54.6 kD)
  Gene Ontology: Mol. function=translation elongation factor activity; Cellular component=mitochondrial ribosome; Biological process =gametogenesis
  Essential gene: C elegans homolog=Y71H2AM.23; Phenotype=Lva
  Coding regions on vcDNA: vcDNA=SeqID_49023; Strand=+; Position=48-669
MHQYNLLANRSLLFTKRFFAVGPPGTKATYKRTKPHMNVGTIGHVDHGKTTLSSAITKLLAAKKXAKFLKYDEIDNAPEERSRGVTINAAHLEYETDNRHYAHVDCPGHADYIKNMITGAAQMEGTILVVAITDGPMPQTREHLLLARQCGIPQENICVFLNKVDEVSDAETRELVEMEVRELLNEFGYPGDTAPIIAGSALCALEG

SEQ ID NO: 122601 - protein, 359 aa, Heterodera glycines
  Homolog annotation: Hit_ID=CAE59832.1; Match level="QueryCoverage =86%, HitCoverage=94%, E-value=1e-90, Identity=53%"; Hit description =Hypothetical protein CBG03304 [Caenorhabditis briggsae]
  Gene Ontology: Mol. function=protein phosphatase type 1 intrinsic regulator activity; Cellular component=cytoplasm; Biological process= cell cycle
  Essential gene: C elegans homolog=T09A5.9; Phenotype=Emb,Pvl,Stp,Unc
  Coding regions on vcDNA: vcDNA=SeqID_49024; Strand=+; Position=13-1092
MSQTEKELLAEKVDRQPNEEAKPTASLNLFDLSVMPDSETSIELNQMRVDAVPDLARFTQLQFLGLRQNLLTSLNANLGRLTTLTELELYDNQLTEIAGLDQLVNLVMLDMSYNRITKIQGLSTMTKLRRLFLVHNKIKRIEGLEGLDALELLELGDNRIKVIENLCHLVNLNELFVGHNDIQRIEGIQTLIKLRVLSLPANRLTKLEGLDTLTELEQLHLSDQGIESLDGLGNQSKLIILDAANNRIVNLDGLGHLQKLEDLWLNNNKIVVWSEVDKLAQLRALDTVYLEHNPLYTTDTNQYRRKAMLALPHIRQLDSTVCRQQKNVVEEDTKQNSEDNNNAKPNSQRSAVATTAQKT

SEQ ID NO: 122602 - protein, 158 aa, Heterodera glycines
  Homolog annotation: Hit_ID=AAV34867.1; Match level="QueryCoverage =100%, HitCoverage=100%, E-value=9e-66, Identity=78%"; Hit description=ribosomal protein S11-1 [Bombyx mori]
  Gene Ontology: Biological process=reproduction
  Essential gene: C elegans homolog=F40F11.1; Phenotype=Ste
  Coding regions on vcDNA: vcDNA=SeqID_49025; Strand=+; Position=35-511
MTEQTERAYQRQPTVFLNDKFRTQGIGKKAANKDRYWKNVGLGFKTPREAIEGIYIDKKCPFTGNVSIRGRILTGVVIKNKMQRTIVIRRDYLHFVPKYRRYEKRHKNMSVHCSPCFRDVSIGDIVTIGECRPLSKTVRFNVLKVIKASGAKKAFDKF

SEQ ID NO: 122603 - protein, 220 aa, Heterodera glycines
  Homolog annotation: Hit_ID=XP_420553.1; Match level="QueryCoverage =94%, HitCoverage=50%, E-value=2e-31, Identity=38%"; Hit description =PREDICTED: similar to COP9 signalosome subunit 4; COP9 (constitutive photomorphogenic, Arabidopsis, homol
  Gene Ontology: Cellular component=signalosome complex; Biological process=photoreceptor differentiation (sensu Drosophila)
  Essential gene: C elegans homolog=Y55F3AM.15; Phenotype=Emb,Lva,Unc
  Coding regions on vcDNA: vcDNA=SeqID_49026; Strand=+; Position=40-699
MDMSELCAKVNAIYKKETDHKVQSEGLQKLLEGVLTSVPSDNLKQITEAVSNLVETVVNNESTSMVVSRQFIADIASYLSQPSLNTALIKGIGEAVLTQLHARALAYEEQSTQIRMILANALERDRQFEQSARTLMGIPIETGQRGYRHEFKMELYLRITELFLEADNVEEADRHVKRASLLQQDVKEEALVIKYKALYARVLDRQGNFTEAAHRYPSYR

SEQ ID NO: 122604 - protein, 165 aa, Heterodera glycines
  Homolog annotation: Hit_ID=EAK82181.1; Match level="QueryCoverage =81%, HitCoverage=92%, E-value=2e-47, Identity=68%"; Hit description =hypothetical protein UM01318.1 [Ustilago maydis 521] ref|XP _398933.1| hypothetical protein UM01318.1 [Usti
  Gene Ontology: Mol. function=structural constituent of ribosome; Cellular component=eukaryotic 48S initiation complex; Biological process=protein biosynthesis
  Essential gene: C elegans homolog=F54E7.2; Phenotype=Emb,Ste
  Coding regions on vcDNA: vcDNA=SeqID_49027; Strand=+; Position=3-500
IITCRLHRYTSFTARRPRISLQRNINLTWADTVEVAAAEVHVASTMTVEEALQDVLKRSLIHDGLARGIRESVKALDRREAHLCVLAQSCDEKEYVRLIEALCAEHNIRLIKVEDNKKLGEWAGLCKIDRDGNPRKVVGASVVVVKDWGEESEALNIILEYFKSQ

SEQ ID NO: 122605 - protein, 274 aa, Heterodera glycines
  misc_feature (180)..(180): Xaa can be any naturally occurring amino acid
  Homolog annotation: Hit_ID=NP_499239.1; Match level="QueryCoverage =95%, HitCoverage=64%, E-value=8e-55, Identity=41%"; Hit description =transcription factor (41.6 kD) (3L178) [Caenorhabditis elegans] emb|CAA83139.3| Hypothetical protein T16H
  Gene Ontology: Mol. function=general RNA polymerase II transcription factor activity; Cellular component=transcription factor TFIIH complex; Biological process=negative regulation of transcription from Pol II promoter, mitotic
  Essential gene: C elegans homolog=T16H12.4; Phenotype=Emb,Gro,Unc
  Coding regions on vcDNA: vcDNA=SeqID_49028; Strand=+; Position=31-852
MDDDDAIGGAEAFKWEQAYTEGLNIRSVLQEDEHGSVEESIRRLVMDEKRQRRMDRLPAKIRLGMMRYVHLAVDCSSAILSADFFPSRLSVALECLRKFVDKFFLLNPLSQMGLIAVRDKRAERISGFTSSVQFLLESLQDISSTNCGGEFSLQSVLQCALHSFQAFPLPFPFLNSFAFXGLPAHSSKECILLIASLSSVDASPLRHTFEQLKMRSVRCSIVSFGAEVFSFKRLCATTEGKYSVALDEQHLELLLDEHVQPPPVQRRPGQQDSI

SEQ ID NO: 122606 - protein, 100 aa, Heterodera glycines
  Homolog annotation: Hit_ID=CAE65191.1; Match level="QueryCoverage =74%, HitCoverage=55%, E-value=7e-19, Identity=54%"; Hit description =Hypothetical protein CBG10064 [Caenorhabditis briggsae]
  Essential gene: C elegans homolog=ZK1098.7; Phenotype=Lva
  Coding regions on vcDNA: vcDNA=SeqID_49029; Strand=+; Position=54-356
MFAHLTRAERSGCIFNRILGLIIAGHLKWEQRPLWFDAYVAHSPHYEPKWDIKMPKRDEPLPQIFYQEDLIRAKKLLEMRNEEPKYELDQQQQQQPDQLN

SEQ ID NO: 122607 - protein, 556 aa, Heterodera glycines
  Homolog annotation: Hit_ID=NP_499300.1; Match level="QueryCoverage =98%, HitCoverage=82%, E-value=1e-125, Identity=45%"; Hit description= RNA splicing factor (71.2 kD) (3L514) [Caenorhabditis elegans] emb|CAA88957.1| Hypothetical protein M03C
  Gene Ontology: Mol. function=pre-mRNA splicing factor activity; Cellular component=nucleus; Biological process=embryogenesis and morphogenesis
  Essential gene: C elegans homolog=M03C11.7; Phenotype=Emb
  Coding regions on vcDNA: vcDNA=SeqID_49030; Strand=+; Position=12-1682
MSASIPRRSSQDSLAEKVKSKELIYEARMKIQERLKELGFPVQNTTVKGPSGSERFRETVLKPEEASAFTQLHMEKIKRLNEARSRAAKGLSTLNLKTPSLVFDTISAEKQMVAKREPSGPIRQSLEKADSSTIELKKSAASPHGQQIEPDSSTSAAQQEFLDPRIYIKPAARQKRHFEFKLPGEYEKLAKIQRSKAKLERLQSEIEKAAKQTGISSAVKLAIVTPSGLPETSTGEYIPLVEWWDEVVLGNNCKDYNEMPSQELAPVERYADSVTDLVEHPIQLKPPDEPLQPQYIKASLTKKERKKLRRQNRREALKERAEKIRLGLEKPPDPKLKISNLMRVLGTDAIQDPTKMEAKVRKQMAERAQKHVEDNRSRKLTREEKAAKAIRKIGEDTTLAVHVTVFKIKSLANPAKKFKVMMNAKQLQMTGVVIVLEDINVVVMEGGPKQQKFFKNLMLNRIRWSAEIAGQKHDRRATHNRANEMGEGTEDGPAEEKRNECVLIWEGVVQKRAFTGEPRFTPVTNHKQARELLEKYGVPHYWDLCYSTTVLLNDET

SEQ ID NO: 122608 - protein, 154 aa, Heterodera glycines
  Homolog annotation: Hit_ID=NP_491398.1; Match level="QueryCoverage =100%, HitCoverage=100%, E-value=2e-35, Identity=51%"; Hit description=ribosomal Protein, Small subunit (16.9 kD) (rps-10) [Caenorhabditis elegans] gb|AAK18912.1| Ribosomal p
  Gene Ontology: Mol. function=structural constituent of ribosome; Cellular component=cytosolic small ribosomal subunit (sensu Eukarya); Biological process=locomotory behavior
  Essential gene: C elegans homolog=D1007.6; Phenotype=Emb,Lva,Ste
  Coding regions on vcDNA: vcDNA=SeqID_49031; Strand=+; Position=48-512
MLMPQGDRKKIYEHLFEDGVCIAKKDYCLKSHPEIKGVKNLYVIKALKSLASRGLVKEQYAWHHYYFYLQPEGIVHLRAYLGLPDDVLPNTHKQRTDAIQKAFADKGGRGPIRADTDRGGYRAAADKQAEAGPGAAPISHRQGFGRGGGAPAPQ

SEQ ID NO: 122609 - protein, 262 aa, Heterodera glycines
  Homolog annotation: Hit_ID=NP_502793.1; Match level="QueryCoverage =100%, HitCoverage=55%, E-value=1e-140, Identity=95%"; Hit description=sec61 (52.2 kD) (4P588) [Caenorhabditis elegans] emb|CAB16516.1| Hypothetical protein Y57G11C.15 [Caeno
  Gene Ontology: Mol. function=protein transporter activity; Cellular component=endoplasmic reticulum membrane; Biological process =reproduction
  Essential gene: C elegans homolog=Y57G11C.15; Phenotype=Sck,Ste
  Coding regions on vcDNA: vcDNA=SeqID_49032; Strand=+; Position=58-843
MGIKFLEFVKPFCGFVPEVSKPERKIQFREKMLWTAITLFVFLVCCQIPLFGIMSTDSADPLYWLRVIMASNRGTLMELGISPIVTSGLIMQLLAGAKIIEVGDTPKERALFNGAQKLFGMVITIGQAIVYVASGMYGNPHEIGAGICLLIVIQLVVAGLIVLLLDELLQKGYGLGSGISLFIATNICETIVWKAFSPATMNTGRGTEFEGAIIALFHLLATRNDKVRALREAFYRQNLPNLMNLLATVLVFAVVIYFQGFR

SEQ ID NO: 122610 - protein, 123 aa, Heterodera glycines
  Homolog annotation: Hit_ID=NP_587693.1; Match level="QueryCoverage =97%, HitCoverage=98%, E-value=7e-28, Identity=50%"; Hit description =putative ribosomal protein L35 [Schizosaccharomyces pombe] emb|CAA21057.1| SPCC613.05c [Schizosaccharomyc
  Gene Ontology: Mol. function=structural constituent of ribosome; Cellular component=cytosolic ribosome (sensu Eukarya); Biological process=protein biosynthesis
  Essential gene: C elegans homolog=ZK652.4; Phenotype=Emb,Ste
  Coding regions on vcDNA: vcDNA=SeqID_49033; Strand=+; Position=15-386
MTKVKTFELRTKSKAELSKQLDDLRRELLSLRIKQQSGQSNQKPLEIRNVRRSIARVLTIINQSTKAEVLKEYAGKKYIPIDLRAKKTRAIRRALTPAERKIKTTRALKKAKHFPQRQFAVLA

SEQ ID NO: 122611 - protein, 118 aa, Heterodera glycines
  Homolog annotation: Hit_ID=CAE64681.1; Match level="QueryCoverage =96%, HitCoverage=94%, E-value=1e-46, Identity=83%"; Hit description =Hypothetical protein CBG09459 [Caenorhabditis briggsae]
  Gene Ontology: Mol. function=structural constituent of ribosome; Cellular component=cytosolic small ribosomal subunit (sensu Eukarya); Biological process=protein biosynthesis
  Essential gene: C elegans homolog=K02B2.5; Phenotype=Gro
  Coding regions on vcDNA: vcDNA=SeqID_49034; Strand=+; Position=25-381
MPPKTSKKTDPKGGKAAPAKKKEGGGGGKAKKKKWSKGKVRDKLANMVLFDQATYDKLYKEIISVKLITPSVVSERLKVRASLAKAGLEELHQKGLIKCVVKHGSQLVYTRATKAEEA

SEQ ID NO: 122612 - protein, 165 aa, Heterodera glycines
  Homolog annotation: Hit_ID=NP_502542.1; Match level="QueryCoverage =100%, HitCoverage=100%, E-value=6e-80, Identity=86%"; Hit description=ribosomal Protein, Large subunit (17.8 kD) (rpl-12) [Caenorhabditis elegans] emb|CAB05226.1| Hypothetic
  Gene Ontology: Mol. function=structural constituent of ribosome; Cellular component=cytosolic large ribosomal subunit (sensu Eukarya)
  Essential gene: C elegans homolog=JC8.3a; Phenotype=Ste
  Coding regions on vcDNA: vcDNA=SeqID_49035; Strand=+; Position=31-528
MPPKFDPTEIKIVYLRCVGGEIGATSALAPKVGPLGLSPKKIGEDIAKATQDWKGLKVTCKLTIQNRVAKIDVVPSAASLIIKELREPPRDRKKVKNVKHSGNLTIEQVINIARQMRPRSIARKLQGTVKEILGTAQSVGCTVDGQHPHDIVDMIRAGEIEVPEE

SEQ ID NO: 122613 - protein, 218 aa, Heterodera glycines
  Homolog annotation: Hit_ID=NP_491608.1; Match level="QueryCoverage =88%, HitCoverage=97%, E-value=7e-85, Identity=79%"; Hit description =ribosomal Protein, Large subunit (23.7 kD) (rpl-19) [Caenorhabditis elegans] gb|AAB53979.1| Ribosomal pro
  Gene Ontology: Cellular component=cytosolic ribosome (sensu Eukarya); Biological process=protein biosynthesis
  Essential gene: C elegans homolog=C09D4.5; Phenotype=Lva,Ste
  Coding regions on vcDNA: vcDNA=SeqID_49036; Strand=+; Position=39-692
MSNLRLQKRLAASVLKCGKGKIWLDPNEVNEISNANSRQNVRRLVKDGLIIRKPGKVHSRYRARERLEARRKGRHMGFGKRHGTRNARMPEKVIWMRRMRVLRHLLKRYRDAKKIDKHLYHELYLKAKGNAFKNKRNLMEYIFKKKTENQRSKQLAEQAEARRNKNKETRKRREERLVQKRKELLHKISESEKEKTPQPLVTKPAEKEQPKPQPVAAR

SEQ ID NO: 122614 - protein, 111 aa, Heterodera glycines
  Homolog annotation: Hit_ID=NP_504688.1; Match level="QueryCoverage =95%, HitCoverage=92%, E-value=8e-45, Identity=86%"; Hit description =SyNaptoBrevin related, synaptic vesicle-associated membrane protein (12.0 kD) (snb-1) [Caenorhabditis ele
  Gene Ontology: Mol. function=v-SNARE activity; Cellular component =synaptic vesicle; Biological process=nonselective vesicle transport
  Essential gene: C elegans homolog=T10H9.4; Phenotype=Rup,Unc
  Coding regions on vcDNA: vcDNA=SeqID_49037; Strand=+; Position=54-389
MDSPAGAQPSNPNAQQQGGARPSNKRLQQTQAQVDEVVGIMKVNVEKVLERDQKLSQLDDRADALQEGASQFEKSAATLKRKYWWKNIKMIVIMCAIVILLIIIIVIWAGK

SEQ ID NO: 122615 - protein, 190 aa, Heterodera glycines; identical to SEQ ID NO: 121702
  Homolog annotation: Hit_ID=NP_495248.1; Match level="QueryCoverage =83%, HitCoverage=98%, E-value=9e-29, Identity=41%"; Hit description =putative protein family member of bilaterial origin (17.5 kD) (2G537) [Caenorhabditis elegans] gb|AAA6835
  Essential gene: C elegans homolog=T24H7.3; Phenotype=Emb
  Coding regions on vcDNA: vcDNA=SeqID_49038; Strand=+; Position=15-587

SEQ ID NO: 122616 - protein, 177 aa, Heterodera glycines
  Homolog annotation: Hit_ID=XP_320933.1; Match level="QueryCoverage =71%, HitCoverage=34%, E-value=3e-18, Identity=37%"; Hit description =ENSANGP00000007768 [Anopheles gambiae]
  Gene Ontology: Mol. function=protein phosphatase activity; Cellular component=cytoplasm; Biological process=meiosis
  Essential gene: C elegans homolog=C24F3.2; Phenotype=Unclassified
  Coding regions on vcDNA: vcDNA=SeqID_49039; Strand=+; Position=27-560
MLSQIEDHLFLSFWIEYAQKYLIDAKIGRVLTVALDHIPQIRHLQNVEYRHIRMADVESEELLASQKLQNALDYVEDSVNRGINIVVHCQCGISRSATVVMAYLMRKYKWNVNDSFSFVKARRSCVQPNPSFLRQLEVFQKLDYRCDLLTLRNSKLFKEFECISENPSEGQLVTFTH

SEQ ID NO: 122617 - protein, 196 aa, Heterodera glycines
  Homolog annotation: Hit_ID=NP_871799.1; Match level="QueryCoverage =95%, HitCoverage=35%, E-value=2e-48, Identity=54%"; Hit description =nuclear Hormone Receptor (nhr-49) [Caenorhabditis elegans] emb|CAD57703.1| Hypothetical protein K10C3.6d
  Gene Ontology: Mol. function=transcriptional activator activity; Cellular component=transcription factor complex; Biological process =transcription from Pol II promoter
  Essential gene: C elegans homolog=K10C3.6a; Phenotype=Unclassified
  Coding regions on vcDNA: vcDNA=SeqID_49040; Strand=+; Position=70-657
MDIVDDPLSEPCHVCGDKSTGTHYGTVSCNGCKGFFRRTILRSQKFTCRFNKQCVIDKNYRCACRFCRFQKCLSAGMKKEAIQFERDAIGSPLPLKRRRVADDGRADHSPSPTGGRTATDGIGTAVGRPVMAQGDGKGQMESPPEIYVDIIGTLVEMEQRVNYEMSLRYRSLCGAVFPSSVGTDNASFAGDASSVF

SEQ ID NO: 122618 - protein, 218 aa, Heterodera glycines
  Homolog annotation: Hit_ID=NP_510256.1; Match level="QueryCoverage =99%, HitCoverage=63%, E-value=3e-54, Identity=47%"; Hit description =Cyclin-Dependent Kinase (39.4 kD) (cdk-4) [Caenorhabditis elegans] emb|CAB16925.1| Hypothetical protein F
  Gene Ontology: Mol. function=protein kinase activity; Cellular component=transcription factor complex; Biological process=G1 phase of mitotic cell cycle
  Essential gene: C elegans homolog=F18H3.5a; Phenotype=Lvl,Pvl,Unc
  Coding regions on vcDNA: vcDNA=SeqID_49041; Strand=+; Position=6-659
MRPPVDEDYRPIRVLGQGAYGEVWLVTSKENEREQFAMKKIPVKATEEGIPQSVVREVASLVALKQMKHPNILRLHDAFIRRKGGTISLNIVCEKCDWDLCDFLRKIPKNMCDAQCKYFARQIMTGIDFLHANSIIHRDLKPQNILVNKDHTLRIADFGLSRNYGLHATFTTEVVTLWYRSPELLLQCKYGTAVDLWSAGCILAELYTRDALFRGDTE

SEQ ID NO: 122619 - protein, 228 aa, Heterodera glycines
  Homolog annotation: Hit_ID=NP_491233.1; Match level="QueryCoverage =92%, HitCoverage=100%, E-value=1e-110, Identity=92%"; Hit description=RAB family member (23.6 kD) (rab-2) [Caenorhabditis elegans] gb|AAB52431.1| Uncoordinated protein 108 [
  Gene Ontology: Mol. function=protein transporter activity; Cellular component=endosome; Biological process=two-component signal transduction system (phosphorelay)
  Essential gene: C elegans homolog=F53F10.4; Phenotype=Unc
  Coding regions on vcDNA: vcDNA=SeqID_49042; Strand=+; Position=11-697
RFNIFTVTRNFNLVCFQMSYSYLFKYIIIGDTGVGKSCLLLQFTDKRFQPVHDLTIGVEFGARMITIDGKQIKLQIWDTAGQESFRSITRSYYRGAAGALLVYDITRRDTFNHLTSWLEDARQHSNSNMVIMLIGNKSDLEARREVKKEEGEQFARENGLVFMETSAKTAANVEEAFIDTAKEIYRKIQEGVFDINNEANGIKLGPQHPPSSPSSPGGAPLGRASNCC

SEQ ID NO: 122620 - protein, 152 aa, Heterodera glycines
  Homolog annotation: Hit_ID=CAE62476.1; Match level="QueryCoverage =98%, HitCoverage=98%, E-value=9e-60, Identity=73%"; Hit description =Hypothetical protein CBG06573 [Caenorhabditis briggsae]
  Gene Ontology: Mol. function=actin binding; Cellular component=actin filament; Biological process=cell organization and biogenesis
  Essential gene: C elegans homolog=C38C3.5c; Phenotype=Unc
  Coding regions on vcDNA: vcDNA=SeqID_49043; Strand=+; Position=86-544
MASGVKVDGECKQAYDELHNKHQFSFLIFRISDDDTTIIVENKGEKNAPYSDFVEEMKKVVGDGKQCRYAAVDVHVEIQRQGTEGSSNLSKVVFVQYCPDEAPVRRRMLYASSVRALKATLGLESLLQIQAAELSDIDEKVVKHEVMGRQRT

SEQ ID NO: 122621 - protein, 202 aa, Heterodera glycines
  misc_feature (29)..(29): Xaa can be any naturally occurring amino acid
  Homolog annotation: Hit_ID=NP_495618.1; Match level="QueryCoverage =100%, HitCoverage=22%, E-value=7e-64, Identity=56%"; Hit description= peptidase M20/M25/M40 and Peptidase family M28 (102.1 kD) (2H992) [Caenorhabditis elegans] gb|AAA62526.2
  Gene Ontology: Cellular component=membrane; Biological process =proteolysis and peptidolysis
  Essential gene: C elegans homolog=B0495.7; Phenotype=Unc
  Coding regions on vcDNA: vcDNA=SeqID_49044; Strand=+; Position=481 -1087
LGFLHWILVFCLVGTLYGMMVWQDQRMPXAVSSSEKGNFSEERARVVLNALTDLGPRPSGSDNCEIRAFRILTSKIEQLITAIERFGVNRLELDVQRPSGCFDLQFLSVFTLCYHKVTNLVVRIGPPGQRATDHSILINCHYDTLPDTPGATDDAVSCAIMVHILEVFVHSEKPLENDILFLFNAAEKNFLQASHGFITDHP

SEQ ID NO: 122622 - protein, 179 aa, Heterodera glycines
  Homolog annotation: Hit_ID=NP_493394.1; Match level="QueryCoverage =97%, HitCoverage=97%, E-value=2e-43, Identity=53%"; Hit description =cytochrome c oxidase subunit IV (1O250) [Caenorhabditis elegans] emb|CAB63334.1| Hypothetical protein W09
  Gene Ontology: Biological process=positive regulation of growth rate
  Essential gene: C elegans homolog=W09C5.8; Phenotype=Age,Gro,Ste
  Coding regions on vcDNA: vcDNA=SeqID_49045; Strand=+; Position=49-588
MGILTASKVCTLPRLSSARSMTWWWGPEKNNGREVVGPTFHGDEFYQDRLDRWYPSIRFRKNDEVITPIRHKELGDWKKLSIEEKKLIYRYSFRQTLAEFEALTPYGYLTVTLFFSMLGLTILYASFVRTYVTKFNDRLPDTFDDEYKESQAERRVVLERGNPYGPAYYYDYEKNRWKD

SEQ ID NO: 122623 - protein, 184 aa, Heterodera glycines; identical to SEQ ID NO: 120098
  Homolog annotation: Hit_ID=AAH74666.1; Match level="QueryCoverage =98%, HitCoverage=98%, E-value=4e-57, Identity=56%"; Hit description =MGC69249 protein [Xenopus tropicalis] ref|NP_001004848.1| MGC69249 protein [Xenopus tropicalis]
  Gene Ontology: Mol. function=snoRNA binding; Cellular component=small nuclear ribonucleoprotein complex; Biological process=rRNA processing
  Essential gene: C elegans homolog=C48B6.2; Phenotype=Lva,Lvl
  Coding regions on vcDNA: vcDNA=SeqID_49046; Strand=+; Position=24-578

SEQ ID NO: 122624 - protein, 204 aa, Heterodera glycines
  Homolog annotation: Hit_ID=CAE64981.1; Match level="QueryCoverage =99%, HitCoverage=32%, E-value=1e-79, Identity=72%"; Hit description =Hypothetical protein CBG09816 [Caenorhabditis briggsae]
  Gene Ontology: Mol. function=RNA helicase activity; Cellular component=cytoplasm; Biological process=mRNA processing
  Essential gene: C elegans homolog=Y54E10A.9a; Phenotype=Emb
  Coding regions on vcDNA: vcDNA=SeqID_49047; Strand=+; Position=3-614
VFLAVGRVGSTSENIGQKVVWVEEHNKRHFLMDLLDASEPEALTLIFVETKRGCGDLSYMLQQEGYHCVAIHGDLKQMERERHLENFRNGTAPILVATAVAARGLDIPNVKHVINYDLPNDIDEYVHRIGRTGRVGNIGMATSFFNDKNRNISHELTSLIVEANQELPDWLEEMARDSGRHGGGGGRSHLGAGSKRGGGGNRFG

SEQ ID NO: 122625 - protein, 155 aa, Heterodera glycines
  Homolog annotation: Hit_ID=NP_733306.1; Match level="QueryCoverage =56%, HitCoverage=15%, E-value=5e-13, Identity=43%"; Hit description =CG15509-PB, isoform B [Drosophila melanogaster] gb|AAN14187.1| CG15509-PB, isoform B [Drosophila melanoga
  Gene Ontology: Mol. function=RNA polymerase II transcription factor activity; Cellular component=cytoplasm; Biological process=JNK cascade
  Essential gene: C elegans homolog=F29G9.4; Phenotype=Pvl,Stp
  Coding regions on vcDNA: vcDNA=SeqID_49048; Strand=+; Position=250-714
MPRGTTKTAAQRRGGRRPREAEDHQLTDEDKDRRAKRRERNKQAAARCRRRREEKMQSLQEQVDELRKQNERRENEIRKMREKEQRLLEMLRLRNGGIVQQQLHHHLQAVHVQQQHQSVADHPTVSRPTSLLQPFLVGLNNKRDSVKPRQCHPRP

SEQ ID NO: 122626 - protein, 223 aa, Heterodera glycines
  Homolog annotation: Hit_ID=CAE72294.1; Match level="QueryCoverage =91%, HitCoverage=57%, E-value=3e-38, Identity=40%"; Hit description =Hypothetical protein CBG19424 [Caenorhabditis briggsae]
  Essential gene: C elegans homolog=T05G5.7; Phenotype=Emb
  Coding regions on vcDNA: vcDNA=SeqID_49049; Strand=+; Position=1-669
VFIVTFFRAPQLLMFEYIDQLDSENKHEEANCLLAKQSLNTGLNQQEILWRLARSCVQMAYPLDMKNPKKKKLLDEGHKYACSAYELCSDDFNVLKWTAAAVGSRTDFLGTKERIEQGNFFRDVLDKALAINPEEYTLLHMRGRLVLSVASLSWIERKAATVLFGPPPEVSLNEAIRDFTAVLELAPDWLENTLFLAKAYLANSDRESAVHHLKQLIDSYQQN

SEQ ID NO: 122627 - protein, 131 aa, Heterodera glycines
  Homolog annotation: Hit_ID=NP_496982.1; Match level="QueryCoverage =74%, HitCoverage=30%, E-value=5e-20, Identity=49%"; Hit description =abnormal cell LINeage LIN-7, lin-7 (lin-7) [Caenorhabditis elegans] emb|CAA22459.2| Hypothetical protein
  Gene Ontology: Mol. function=receptor binding; Cellular component =cell junction; Biological process=EGF receptor signaling pathway
  Essential gene: C elegans homolog=Y54G11A.10; Phenotype=Gro
  Coding regions on vcDNA: vcDNA=SeqID_49050; Strand=+; Position=1-396
AVSPSFNFLRRPLPLLVFRRSLFKPPLDSPFCGIYRTNGEICRTDDILVCQRKMNYHPGANVRHQRDRNQHLLKAVCDGTVVITREHCEVNPKNEWMYAQYAYRDFENIYKLTFNVIPRRMSNTFKLISEE

SEQ ID NO: 122628 - protein, 225 aa, Heterodera glycines
  Homolog annotation: Hit_ID=P46436; Match level="QueryCoverage=94%, HitCoverage=96%, E-value=7e-29, Identity=39%"; Hit description =Glutathione S-transferase 1 (GST class-sigma) gb|AAB30767.1| glutathione S-transferase, AsGST1 [Ascaris suum,
  Gene Ontology: Mol. function=glutathione transferase activity; Biological process=glutathione conjugation reaction
  Essential gene: C elegans homolog=R05F9.5a; Phenotype=Unclassified
  Coding regions on vcDNA: vcDNA=SeqID_49051; Strand=+; Position=50-727
MDAETKNYKLTYFSSRGIAEPIRLILHYKGIPFEDVTFSSTLADESSREKWLKQKQNYLYGQLPNLEWDEGTEHKVLAQSQTICRYLGNKYGLAGSDFWEAAKTDEIAEWFKDIWAAFLPFLKVAVGAEAGDKEAMKKEIFVPLIYDRLVTTLVEMLNKSGSGFLLPSGLTWADFVFANALTTFNNMDKGLLFESHKVLADYEKRVYSANESIKKYVEGREAKEF

SEQ ID NO: 122629 - protein, 153 aa, Heterodera glycines
  Homolog annotation: Hit_ID=NP_594672.1; Match level="QueryCoverage =98%, HitCoverage=96%, E-value=5e-56, Identity=72%"; Hit description =40s ribosomal protein s11-2 [Schizosaccharomyces pombe] ref|NP _594003.1| 40s ribosomal protein s11. [Schi
  Gene Ontology: Biological process=reproduction
  Essential gene: C elegans homolog=F40F11.1; Phenotype=Ste
  Coding regions on vcDNA: vcDNA=SeqID_49052; Strand=+; Position=32-493
MADIQTEKAFQKQAIFLNAKQVGAKKRGQRWYKDVGLGFKTPKEAIEGHYVDKKCPFTGDVSIRGRILTGTIVSNKMKRTVILRREYLHYVKKYNRYEKRHRNLAAHLSPAFVGVESGDVATVGQCRPLSKTVRFNVLKVQKAIAGSKQFKKF

SEQ ID NO: 122630 - protein, 164 aa, Heterodera glycines
  Homolog annotation: Hit_ID=NP_505625.1; Match level="QueryCoverage =98%, HitCoverage=67%, E-value=3e-29, Identity=38%"; Hit description =RNA polymerase (5K686) [Caenorhabditis elegans] emb|CAA94858.1| Hypothetical protein ZK856.10 [Caenorhabd
  Gene Ontology: Mol. function=DNA-directed RNA polymerase activity; Cellular component=DNA-directed RNA polymerase III complex; Biological process=transcription from Pol III promoter
  Essential gene: C elegans homolog=ZK856.10; Phenotype=Lva
  Coding regions on vcDNA: vcDNA=SeqID_49053; Strand=+; Position=2-496
EAFYDFKKYGASYILPGDASTHTPVLFRYVVFQPMINEILEGNILRSNQEGITISMQFFSDITVAPDKLPAVSKFDESVQVWRWEYQNENGDITPFYMDPGKRVRFKVISVKYQNVEPGAPPEATKAMTIEASMFDMGLGCVAWREPQCASELKQEANDPSEDE

SEQ ID NO: 122631 - protein, 114 aa, Heterodera glycines
  Homolog annotation: Hit_ID=NP_594438.1; Match level="QueryCoverage =95%, HitCoverage=97%, E-value=5e-33, Identity=59%"; Hit description =60S ribosomal protein L34 [Schizosaccharomyces pombe] emb|CAA16982.1| SPAC23A1.08c [Schizosaccharomyces p
  Gene Ontology: Mol. function=structural constituent of ribosome; Cellular component=cytosolic large ribosomal subunit (sensu Eukarya); Biological process=protein biosynthesis
  Essential gene: C elegans homolog=C42C1.14; Phenotype=Lva
  Coding regions on vcDNA: vcDNA=SeqID_49054; Strand=+; Position=33-377
MPERLTYRRRLCYNTKSNKTKVVKTPGGRNVFHYRNKLGSIPKCGDTGVPLKGIKAARPRQLAKMTKRKKTVTRAYGGCLSAAAVRQRIIRAFLVEEQQLANKILKAKSGGGKK

SEQ ID NO: 122632 - protein, 196 aa, Heterodera glycines
  Homolog annotation: Hit_ID=NP_500626.2; Match level="QueryCoverage =76%, HitCoverage=18%, E-value=2e-20, Identity=37%"; Hit description =ElaC homolog 2 (93.8 kD) (4F504) [Caenorhabditis elegans] gb|AAB92042.3| Homolog of elac2 (cancer suscept
  Essential gene: C elegans homolog=E04A4.4a; Phenotype=Gro
  Coding regions on vcDNA: vcDNA=SeqID_49055; Strand=+; Position=43-630
MRFSPRIFPSFLQQLINRNFLALHCPLPATSAAKFSTDGKSDVFCASLLHNELCEKLDKRKEEWRKQRPGTKEYTATKEQLNQLQEEIIKIENSKYEFLHTERDKMSIANLVLAPTQVTLEVISNGTTHLRPSVVLRTPLNAYLFNCPEGICRFLPTFRLRTNAINDMFFTKANWDNTGGIASVLLNKENTDETLR

SEQ ID NO: 122633 - protein, 244 aa, Heterodera glycines
  Homolog annotation: Hit_ID=XP_393437.1; Match level="QueryCoverage =97%, HitCoverage=62%, E-value=7e-74, Identity=55%"; Hit description =similar to ENSANGP00000017612 [Apis mellifera]
  Gene Ontology: Mol. function=ATP binding; Cellular component =intracellular; Biological process=aspartyl-tRNA aminoacylation
  Essential gene: C elegans homolog=B0464.1; Phenotype=Emb,Ste
  Coding regions on vcDNA: vcDNA=SeqID_49056; Strand=+; Position=2-733
STLHKETETDISVGNYGSYGLVQSSEKREDVVFVEIEKINADFDGKEIWLRGRLHDSRGKGKNCFAKIRQRIHSVQAVLFVGADISKQFVKFVQNIPKESIVDVYGLVARTPQPVTACTQSDVEIKVHKFFIVSQAEPRLPLQLEDAVRPDNDQEELAVVKLDTRLDNRVLDLRTPTSQAIFRLQGGVCDAFRKILSSRGFMEIHTPKIISAASEGGANVFEVSYFKGHAFLAQSPQLYKQMAI

SEQ ID NO: 122634 - protein, 346 aa, Heterodera glycines
  Homolog annotation: Hit_ID=CAE59466.1; Match level="QueryCoverage =100%, HitCoverage=47%, E-value=1e-123, Identity=66%"; Hit description=Hypothetical protein CBG02850 [Caenorhabditis briggsae]
  Gene Ontology: Mol. function=glucosamine-fructose-6-phosphate aminotransferase (isomerizing) activity; Biological process=fructose 6-phosphate metabolism
  Essential gene: C elegans homolog=F07A11.2a; Phenotype=Ste
  Coding regions on vcDNA: vcDNA=SeqID_49057; Strand=+; Position=4-1041
MCGIFAYLNFFSPKKRSEIIDILLQGLRRMEYRGYDSAGIAIDCSNDVNLPHADVAVYRKTGKVDNLDDTIKNSEGVDMDFTYNVHCGIGHTRWATHGKPKDENAHPQRSNFDNDFAVVHNGIITNYKEIKDYLLTKGYKFESETDTEVIAKLTQHIHQRHPHYGLRQLVEIVVQQLEGAFALAFKSRRFPGQLVATRRGSPLLVGIKSQSKLTTDHFPVFYSRPRRGPVSLVFDESCTTAMETPNKLNASDMFASFSAPFNDTINSTARKIECSDSTRSVRPCDLANFEVEYFVASDASAVIEHTRQVIFLEDDDVAFVEDGALSIHRIKRSDDTAALTEQTREV

SEQ ID NO: 122635 - protein, 89 aa, Heterodera glycines
  Homolog annotation: Hit_ID=AAH59707.1; Match level="QueryCoverage =100%, HitCoverage=100%, E-value=1e-44, Identity=94%"; Hit description=Zgc:73406 protein [Danio rerio]
  Gene Ontology: Mol. function=dynein ATPase activity; Cellular component=axonemal dynein complex; Biological process=microtubule -based movement
  Essential gene: C elegans homolog=T26A5.9; Phenotype=Emb
  Coding regions on vcDNA: vcDNA=SeqID_49058; Strand=+; Position=68-337
MGDRKAVIKNADMTEEMQQEAIECATQALEKYNIEKDIAAYIKKEFDKKFNPTWHCIVGRNFGSYVTHETKHFIYFYLGQVAILLFKSG

SEQ ID NO: 122636 - protein, 72 aa, Heterodera glycines
  Homolog annotation: Hit_ID=AAT92157.1; Match level="QueryCoverage =93%, HitCoverage=90%, E-value=2e-11, Identity=54%"; Hit description =copper transport protein [Ixodes pacificus]
  Essential gene: C elegans homolog=ZK652.11; Phenotype=Unclassified
  Coding regions on vcDNA: vcDNA=SeqID_49059; Strand=+; Position=67-285
MATPKLYKFHVEMTCEGCSNAVKRVLGKLEDKVKLLSVDLNAKEVQVESSSMGQDEILEVLKKTGKAVSPIE

SEQ ID NO: 122637 - protein, 202 aa, Heterodera glycines
  Homolog annotation: Hit_ID=NP_499264.1; Match level="QueryCoverage =91%, HitCoverage=39%, E-value=8e-82, Identity=76%"; Hit description =citrate synthase (51.5 kD) (3L304) [Caenorhabditis elegans] emb|CAA83004.1| Hypothetical protein T20G5.2
  Gene Ontology: Mol. function=citrate (SI)-synthase activity; Cellular component=mitochondrial matrix; Biological process=citrate metabolism
  Essential gene: C elegans homolog=T20G5.2; Phenotype=Emb
  Coding regions on vcDNA: vcDNA=SeqID_49060; Strand=+; Position=37-642
MLSRFSKIIVRGYAKDLNLKEVLANKIPEHNKKVVEFRKAHGSTVVQNITVDMIYGGMRSMKGMVTETSVLDPEEGIRFRGYSIPECQQKLPKAEGGEEPLPEGIWWLLCTGEIPDQKQVNAISKEWASRADLPAHVAQLLENFPPNLHPMSQFVAAIAALQSESKFAEAYSKGVPKSTYWEYAYEDSMNLLAKLPTIAAMI

SEQ ID NO: 122638 - protein, 207 aa, Heterodera glycines
  Homolog annotation: Hit_ID=NP_506079.1; Match level="QueryCoverage =88%, HitCoverage=49%, E-value=1e-27, Identity=40%"; Hit description =putative mitochondrial translation elongation factor Ts, with ubiquitin associated domain (34.1 kD) (5M75
  Gene Ontology: Cellular component=mitochondrion
  Essential gene: C elegans homolog=F55C5.5; Phenotype=Lva
  Coding regions on vcDNA: vcDNA=SeqID_49061; Strand=+; Position=1-624
RTADEAIVATVSKVGENIQLARASVISSSPANKLFGQTHPKEEFNGVQLGRFISLVSLGHKSDESVSDFPTAQLGQVICQHIIGMAPESLGEPRKKGAKRATQMEIVDNGEGTEKERSANAENESDTGEEEDLNASQVDQSELTRMDGEETQLLHQPFMLNPEQTVNEYLEAHGANIADFLRIEMGQEHTKTNDLVTRSKGFSFLGY

SEQ ID NO: 122639 - protein, 167 aa, Heterodera glycines
  misc_feature (89)..(89): Xaa can be any naturally occurring amino acid
  Homolog annotation: Hit_ID=NP_502795.1; Match level="QueryCoverage =79%, HitCoverage=29%, E-value=2e-23, Identity=44%"; Hit description =skinny hedgehog like (4P590) [Caenorhabditis elegans] emb|CAB16518.1| Hypothetical protein Y57G11C.17 [Ca
  Essential gene: C elegans homolog=Y57G11C.17; Phenotype=Unclassified
  Coding regions on vcDNA: vcDNA=SeqID_49062; Strand=+; Position=2-503
YRDEGPFKLYIPLITFGPFSSVHRQIGPNLAIIFLRHFVPMFAVFAFVLLWHGLSPNYFWWDTLRATALIAERIGHSLPKWHTSRPNLXEATFVRLKAASMLFTVIPGIFGIFFFLGLNGVGAFVFRSLLLDGLSQILSLRIFSSNSAGFVLLHFFLLGFCFNNVCL

SEQ ID NO: 122640 - protein, 181 aa, Heterodera glycines
  Homolog annotation: Hit_ID=NP_493272.1; Match level="QueryCoverage =99%, HitCoverage=73%, E-value=3e-74, Identity=73%"; Hit description =translation factor (26.3 kD) (1N561) [Caenorhabditis elegans] emb|CAB16860.1| Hypothetical protein C47B2.
  Gene Ontology: Cellular component=cytoplasm; Biological process =ribosomal large subunit biogenesis
  Essential gene: C elegans homolog=C47B2.5; Phenotype=Lva
  Coding regions on vcDNA: vcDNA=SeqID_49063; Strand=+; Position=23-565
MVALRAQFEASNDVGVFCKLTNAYCLVGIASSENFYSIVEAELADVIPVIHCTVAGCRIVGRVTAGNRHGLLVPNATTDQELQHIRNSLPDSVQIRRVDERLSALGNVIACNDHIAVVHADISKETEAALAEVLKVEVFRLSLGENALVGSYATMTSNGALVAAKTPPEVQREFTSLAQVP

SEQ ID NO: 122641 - protein, 149 aa, Heterodera glycines
  Homolog annotation: Hit_ID=Q9HFY6; Match level="QueryCoverage=100%, HitCoverage=100%, E-value=2e-77, Identity=97%"; Hit description =Calmodulin (CaM) gb|AAG31446.1| calmodulin [Blastocladiella emersonii]
  Gene Ontology: Mol. function=calcium ion binding
  Essential gene: C elegans homolog=T21H3.3; Phenotype=Emb,Ste
  Coding regions on vcDNA: vcDNA=SeqID_49064; Strand=+; Position=67-516
MADQLTEEQIAEFKEAFSLFDKDGDGTITTKELGTVMRSLGQNPTEAELQEMINEVDADGNGTIDFPEFLTMMARKMKDSDSEEEIKEAFKVFDKDGNGYISAAELRHVMTNLGEKLSEDEVDEMIREADVDGDGQINYEEFVKMMMSK

SEQ ID NO: 122642 - protein, 208 aa, Heterodera glycines
  Homolog annotation: Hit_ID=P46436; Match level="QueryCoverage=97%, HitCoverage=97%, E-value=4e-39, Identity=43%"; Hit description =Glutathione S-transferase 1 (GST class-sigma) gb|AAB30767.1| glutathione S-transferase, AsGST1 [Ascaris suum,
  Gene Ontology: Mol. function=glutathione transferase activity; Biological process=glutathione conjugation reaction
  Essential gene: C elegans homolog=R05F9.5a; Phenotype=Unclassified
  Coding regions on vcDNA: vcDNA=SeqID_49065; Strand=+; Position=15-641
MVQQYKLYYFDLRGLGEPIRLLLHYVGQPFEDIRFKDMEEWEKTYKPKFFYGKAPVLEVDGKPLAQSSAILRYLAEKFDLAGKDEWEKAKANEIIDFLKDATTDLLPYLMVKMGRQEGDLDKLRGEVFEPGVKRIFPLFEKLLKESGSGYMLKSGLSMVDFQVANFLYSFTMLEPDTINAYPELIKYVDRVHALPQLQQYLKQRPQDR

SEQ ID NO: 122643 - protein, 146 aa, Heterodera glycines
  Homolog annotation: Hit_ID=XP_319798.1; Match level="QueryCoverage =98%, HitCoverage=30%, E-value=4e-19, Identity=34%"; Hit description =ENSANGP00000005197 [Anopheles gambiae]
  Essential gene: C elegans homolog=B0280.9; Phenotype=Lva
  Coding regions on vcDNA: vcDNA=SeqID_49066; Strand=+; Position=2-442
GQDTFFDQGCVRATCLSCSPSGQFIACGSNTGIVNVYDLTKLSPSLAKSNAPRPVRMFDQLTTLVSFVRFNNDSQMLAFGSAVKRMSGRVANCSSGSVFQNFPAKQEHFASDKFTTCDFSPNSAFFSFGTKQGKMRLYQLHHSDVY

SEQ ID NO: 122644 - protein, 197 aa, Heterodera glycines
  Homolog annotation: Hit_ID=NP_498946.1; Match level="QueryCoverage =76%, HitCoverage=82%, E-value=4e-18, Identity=34%"; Hit description =putative protein of eukaryotic origin (3J896) [Caenorhabditis elegans] gb|AAK26132.2| Hypothetical protei
  Essential gene: C elegans homolog=F54F2.7; Phenotype=Gro
  Coding regions on vcDNA: vcDNA=SeqID_49067; Strand=+; Position=93-683
MSVSPPIAFPSPSHCHFSSIERNFSPFSVNSQPGLRYLRHASGVVVLTLDKSHVLMRDQCKNIAQVLWDMSLAKTSSAKSNESKGRKRGVDRSKLEPTGKGKKGGLPMSPQTRICIIRDSDGVDYVIRAGIRATLLEVNDEWLTKEPNLLRTAADNQGFIAILMPPISGNGLRNMKIPKEFDGTEGGERRDRETVWG

SEQ ID NO: 122645 - protein, 341 aa, Heterodera glycines
  Homolog annotation: Hit_ID=NP_502997.1; Match level="QueryCoverage =99%, HitCoverage=76%, E-value=1e-156, Identity=76%"; Hit description= insulin-like (49.3 kD) (4R792) [Caenorhabditis elegans] emb|CAB55167.1| Hypothetical protein Y116A8A.9 [
  Gene Ontology: Biological process=proteolysis and peptidolysis
  Essential gene: C elegans homolog=Y116A8A.9; Phenotype=Emb
  Coding regions on vcDNA: vcDNA=SeqID_49068; Strand=+; Position=2-1190
DKDDRTAINRMTSEEKKALDSSYEEIYNDFRRAAESHRQTRKYVKSWIKPGMKLIDICERLEAHSRRMINESGLEAGLAFPTGCSINHCAAHYTPNAGDETVLGPSDVVKIDYGTHVNGRIIDCAFTLTFDPKFDTLLNAVREATETGIREAGIDVRLCDIGEAIEEVMTSYELELDGKTFPIKPIRNLNGHSIGPYRIHAGKTVPIVKNGEQVKMEENEFFAIETFGSTGKGHVHDDMETSHYMKNYDLHEEHIPLRLTRSKKLLATINKNFGTLAFCRRWLDRLGETKYLMSLRDLCEKDIVAPYPPLCDQKGCYTAQWEHTILLRPTCKEVVSRGEDY

SEQ ID NO: 122646 - protein, 179 aa, Heterodera glycines
  Homolog annotation: Hit_ID=XP_329435.1; Match level="QueryCoverage =97%, HitCoverage=82%, E-value=2e-62, Identity=64%"; Hit description =hypothetical protein [Neurospora crassa] gb|EAA34700.1| hypothetical protein [Neurospora crassa]
  Gene Ontology: Mol. function=RNA binding; Cellular component =cytosolic large ribosomal subunit (sensu Eukarya); Biological process=protein biosynthesis
  Essential gene: C elegans homolog=E04A4.8; Phenotype=Emb,Gro
  Coding regions on vcDNA: vcDNA=SeqID_49069; Strand=+; Position=5-544
MSSASRFNEYQVVGRHQPSETNPQPTLYRMRIFAPNAVVAKSRFWYFLKKFRKVKKATGQIVAVNQVLEKNPTQVKTFGIWLHYNSRSGTHNMYKEYRELTRVNAVQACYQDMAARHRARFRSVQIIRVAEVATKDVRRPYIQQILEKNLKFPLPHRVYRAASKRHNSLFIASRPSTHA

SEQ ID NO: 122647 - protein, 79 aa, Heterodera glycines
  Homolog annotation: Hit_ID=XP_317573.1; Match level="QueryCoverage =100%, HitCoverage=75%, E-value=1e-33, Identity=88%"; Hit description= ENSANGP00000010151 [Anopheles gambiae]
  Gene Ontology: Biological process=cell cycle
  Essential gene: C elegans homolog=F45H11.2; Phenotype=Lon,Pvl
  Coding regions on vcDNA: vcDNA=SeqID_49070; Strand=+; Position=27-266
FIPMLIKVKTLTGKEIELDIEPTDKVDRIKEKVEEKEGIPPPQQRLIFAGKQMLDEKTAQDYKIQGGSVLHLVLALRGG

SEQ ID NO: 122648 - protein, 142 aa, Heterodera glycines; identical to SEQ ID NO: 120682
  Homolog annotation: Hit_ID=NP_506180.1; Match level="QueryCoverage =88%, HitCoverage=94%, E-value=2e-20, Identity=48%"; Hit description =unidentified Trans-Spliced transcript, Ribosomal Protein, Large subunit (13.7 kD) (rpl-28) [Caenorhabditi
  Gene Ontology: Mol. function=structural constituent of ribosome; Cellular component=cytosolic ribosome (sensu Eukarya); Biological process=protein biosynthesis
  Essential gene: C elegans homolog=R11D1.8; Phenotype=Lva
  Coding regions on vcDNA: vcDNA=SeqID_49071; Strand=+; Position=28-456

SEQ ID NO: 122649 - protein, 94 aa, Heterodera glycines
  Homolog annotation: Hit_ID=CAE74050.1; Match level="QueryCoverage =97%, HitCoverage=96%, E-value=7e-38, Identity=75%"; Hit description =Hypothetical protein CBG21702 [Caenorhabditis briggsae]
  Essential gene: C elegans homolog=F49C12.12; Phenotype=Emb,Lvl
  Coding regions on vcDNA: vcDNA=SeqID_49072; Strand=+; Position=24-308
MKICPLFGPKMSAFCMIISVWGIVFLGLLGVFFYMHAVTLFPDLHLEEEAKLERQMVEEKYEEKAKQCWIAAGMYVVTLIAVFWQNRFNTTQIL

SEQ ID NO: 122650 - protein, 237 aa, Heterodera glycines
  Homolog annotation: Hit_ID=NP_493644.1; Match level="QueryCoverage =75%, HitCoverage=44%, E-value=5e-81, Identity=81%"; Hit description =proteasome Regulatory Particle, ATPase-like, S10b (rpt-4) [Caenorhabditis elegans] gb|AAB70326.2| Proteas
  Gene Ontology: Mol. function=proteasome endopeptidase activity; Cellular component=26S proteasome; Biological process=proteolysis and peptidolysis
  Essential gene: C elegans homolog=F23F1.8; Phenotype=Emb
  Coding regions on vcDNA: vcDNA=SeqID_49073; Strand=+; Position=4-717
MRSPSPTDNDKARSLNVYRRKLAEYKEIENRLKELRTKERESHKLFDKSENEIKSLQSVGQIVGEVLKQLTEEKFIVKATNGPRYVVGCRRTIDKEKLKQGTRVALDMTTLTIMRQLPREVDPLVYKMSHEDPGNVSYAEIGGLSEQIRELREVVELPLINPELFKRVGITPPKGCLLYGPPGPPGAPGQPGQPGNSGQPGQPGAPGQPGKDSGYCPCPPRSSVLAVKKKMAAAKKA

SEQ ID NO: 122651 - protein, 399 aa, Heterodera glycines
  Homolog annotation: Hit_ID=NP_501878.1; Match level="QueryCoverage =99%, HitCoverage=63%, E-value=1e-153, Identity=69%"; Hit description= transketolase (66.0 kD) (4L9) [Caenorhabditis elegans] emb|CAB02889.1| Hypothetical protein F01G10.1 [Ca
  Gene Ontology: Mol. function=transketolase activity; Cellular component=cytoplasm; Biological process=positive regulation of growth rate
  Essential gene: C elegans homolog=F01G10.1; Phenotype=Emb,Gro,Lva
  Coding regions on vcDNA: vcDNA=SeqID_49074; Strand=+; Position=61-1257
MTISAPADVDKLQDAANRMRISSIEQTCAANSGHPTSSCSAAEIVATLFFAEMRYDVKDPRSASADRFILSKGHACPILYAAWEEAGLLSRDQVLSLRKIDSDIEGHPTPRLNFIDVATGSLGQGLSCAAGMAYTGKYVDHSSYRVYCLMGDGESAEGSVWEAAAFASFYKLDNLVAIVDVNRLGQSQETQLQHDIEAYVQRFAAFGWNAIGLEDGHDITALLNAYANAKNVTGKPTAIIAKTLKGKGIDGVADLNNQHGKPVSKDKAEPIRALLKSDKPANWTIPAPIRDAPAVDLGIGAIAMSAPPQYKMGEKVATRQAYGNALLKLAEANKRVIALDGDISNSTFSNLVQKKLPEQFVQCYIAEQNMVGVGVGMACRGRVLPHVSTFAAFFTRAGE

SEQ ID NO: 122652 - protein, 169 aa, Heterodera glycines
  Homolog annotation: Hit_ID=CAE66025.1; Match level="QueryCoverage =72%, HitCoverage=91%, E-value=4e-36, Identity=57%"; Hit description =Hypothetical protein CBG11219 [Caenorhabditis briggsae]
  Essential gene: C elegans homolog=T14B4.2; Phenotype=Emb,Lva
  Coding regions on vcDNA: vcDNA=SeqID_49075; Strand=+; Position=9-518
MLKAKPHVLFVQCRFLRMMKSIPKDSKFTAKFGDTSMFDFGEVRTSLLRKGQAPEEKCKQLFPTDPDAPIQLGFNPFQRADRKCLLCELGIQLDYKNGRLLQQFVSNFSGRVYDQHVTGLCKKQYQTLLATIATSRKAGYMPVLVKDAKYLRDPRLFDPLKPIRTHSYD

SEQ ID NO: 122653 - protein, 201 aa, Heterodera glycines
  misc_feature (168)..(168): Xaa can be any naturally occurring amino acid
  Homolog annotation: Hit_ID=NP_497965.1; Match level="QueryCoverage =86%, HitCoverage=78%, E-value=2e-54, Identity=54%"; Hit description =mitochondrial ribosomal protein L16 (3F793) [Caenorhabditis elegans] emb|CAA84730.1| Hypothetical protein
  Essential gene: C elegans homolog=T04A8.11; Phenotype=Lva
  Coding regions on vcDNA: vcDNA=SeqID_49076; Strand=+; Position=73-675
MTLRLGSKLKFSILLQNVGIRKNPFRNSYNYPITFEHVVFPPNNQFKLPTMPPEPIYDESLGETKHKLTKQFIEARGFEPIHTELIHKQYGLVAMSGGFIKAEDFAWIQQEVNEKLVDKQFAIWRVNAPWLPRVRRPPSTKKGGGKGPIHHYETPVRTGRVIVELGGXSTEQEARSMVMHRYEHMPFPVECVSQELMDKRR

SEQ ID NO: 122654 - protein, 122 aa, Heterodera glycines
  Homolog annotation: Hit_ID=CAE59329.1; Match level="QueryCoverage =99%, HitCoverage=100%, E-value=2e-44, Identity=75%"; Hit description= Hypothetical protein CBG02671 [Caenorhabditis briggsae]
  Gene Ontology: Mol. function=pre-mRNA splicing factor activity; Cellular component=nucleus; Biological process=mRNA splicing
  Essential gene: C elegans homolog=T28D9.10; Phenotype=Emb,Lva
  Coding regions on vcDNA: vcDNA=SeqID_49077; Strand=+; Position=66-434
MKLVRFLMKLSHESVTIELKNGTQVSGAIQGVDVAMNIHLRSVKMTVRGREQISLDTLSIRGNNIRYIVLPDSLPLDTLLIDDEPRKKPTQRRFGGRGGRGGPRGRGRGRGGPPRGGGGGRR

SEQ ID NO: 122655 - protein, 237 aa, Heterodera glycines
  Homolog annotation: Hit_ID=CAC70149.1; Match level="QueryCoverage =94%, HitCoverage=99%, E-value=3e-97, Identity=74%"; Hit description =putative pre-mrna cleavage factor [Brugia malayi]
  Gene Ontology: Mol. function=RNA binding; Cellular component=nucleus; Biological process=mRNA processing
  Essential gene: C elegans homolog=F43G9.5; Phenotype=Emb,Sck,Stp
  Coding regions on vcDNA: vcDNA=SeqID_49078; Strand=+; Position=3-716
RTPFIVINYCWLVNMTTTGWPAVVNSTAHNALLSQKNYSNLNRTINLYPLTNYTFGTKEPQSERDHSVQARFQRLRDEYEKTGMRRSVDGVLLVHEHSLPHVLLLQIGTTFFKLPGGELNHGEDEVDGLKRILTETLGRDDTPKTQWIVEDAIAQWWRPNFDPPRFPYVPAHVTKPKEQTKLFLVQLPDKAFFAVPKNFKLVAAPLFELYDNSAGYGPLIASLPQILSRFNFLYNYA

SEQ ID NO: 122656 - protein, 229 aa, Heterodera glycines
  misc_feature (103)..(103): Xaa can be any naturally occurring amino acid
  Homolog annotation: Hit_ID=CAE56761.1; Match level="QueryCoverage =97%, HitCoverage=43%, E-value=1e-32, Identity=37%"; Hit description =Hypothetical protein CBG24564 [Caenorhabditis briggsae]
  Gene Ontology: Mol. function=orotidine-5'-phosphate decarboxylase activity; Biological process=UMP biosynthesis
  Essential gene: C elegans homolog=T07C4.1; Phenotype=Gro
  Coding regions on vcDNA: vcDNA=SeqID_49079; Strand=+; Position=2-689
VSASLDKPMLLKRKEAKTYGKKQLIEGRFEAGQSALIIEDVVTSGASVLETVAALRAVGLRCVHVFCVLDRQQGGEQRLGREADIVLRSLLSMGSLLDFLVAXGTIDAGKKTQIVHQLQNPIFDDSATHLQEQKTEKNEAECVPLVVSSSVVPTTTSVGWAQQFADGTLNRRLAQIMVAKRTNVCLAVHCTHWDQILEIVSAVKEHVCAVKLHHDIVVDFGAEFVAKLH

SEQ ID NO: 122657 - protein, 318 aa, Heterodera glycines
  Homolog annotation: Hit_ID=CAE66814.1; Match level="QueryCoverage =91%, HitCoverage=64%, E-value=5e-95, Identity=56%"; Hit description =Hypothetical protein CBG12179 [Caenorhabditis briggsae]
  Gene Ontology: Mol. function=translation elongation factor activity; Cellular component=mitochondrial ribosome; Biological process =translational elongation
  Essential gene: C elegans homolog=C43E11.4; Phenotype=Emb,Sck,Stp
  Coding regions on vcDNA: vcDNA=SeqID_49080; Strand=+; Position=1-954
QRSVFSLSRRFYVSYAQPQQKVQTHKREKPHLNVGTIGHVDHGKTTLSAAITKVLSRQKKARFVSYEDIDKGAEERARGVTINIAHIEYESDNRHYAHTDCPGHIDFIKNMITGTAQMDSAVLVIAADDGVMPQTREHLLLAKQIGLREIIVFVNKTDLVDTDVMELVEIEARELLTAYGFDGENAKIVFGSALRALADDDDKCILELINALDGLEEPVRTENGPFLMPISSKCKITGRGSVLIGTIESGTVKKGDTLELLGQEYAQKTLIADIHVFGKSTAQSSAGEHVGLLCKNLYYDPISRGFWLTKPGTVTPTN

SEQ ID NO: 122658 - protein, 256 aa, Heterodera glycines
  Homolog annotation: Hit_ID=NP_775343.1; Match level="QueryCoverage =98%, HitCoverage=52%, E-value=1e-127, Identity=80%"; Hit description= histone deacetylase 1 [Danio rerio] gb|AAM34645.1| histone deaceytlase 1 [Danio rerio]
  Gene Ontology: Mol. function=apoptosis inhibitor activity; Cellular component=cytoplasm; Biological process=chromatin modification
  Essential gene: C elegans homolog=C53A5.3; Phenotype=Emb,Gon
  Coding regions on vcDNA: vcDNA=SeqID_49081; Strand=+; Position=45-812
MTIHSRKVVAYYYDGDVGNYYYGQGHPMKPHRIRMTHNLLLNYGLYRKMEVFRPKAASLEEMTKYHSDDYMCFLKSIKPDNIADFGRQMQRFNVGEDCPVFDGLFEFCQISSGGSIAAATKINKKHVDVAINWMGGLHHAKKSEASGFCYTNDIVLAILELLKYHQRVLYVDIDIHHGDGVEEAFYTTDRVMTVSFHKYGEYFPGTGDLKDVGAGIGRYYAVNFPLRDGIDDETYERIFAPVMEKIIGAYQPSVIV

SEQ ID NO: 122659 - protein, 236 aa, Heterodera glycines
  Homolog annotation: Hit_ID=JC4382; Match level="QueryCoverage=99%, HitCoverage=58%, E-value=1e-122, Identity=87%"; Hit description =ribosomal protein L3.e, cytosolic - Toxocara canis gb|AAA92285.1| ribosomal protein L3 sp|P49149|RL3_TOXCA 60
  Gene Ontology: Mol. function=structural constituent of ribosome; Cellular component=ribosome; Biological process=protein biosynthesis
  Essential gene: C elegans homolog=F13B10.2a; Phenotype=Emb,Ste
  Coding regions on vcDNA: vcDNA=SeqID_49082; Strand=+; Position=1-711
IAHTQMKLMKHRNKKAHIMEIQINGGTVAEKVDWAREHFEKQVPVEQVFEQDEMIDCIGVTRGKGFKGVTSRWHCKKLPRKTHKGLRKVACIGAWHPSRVSFTVARAGQKGYHHRTEINKKIYRIGKSCLTADGKKNGMTDFDITEKNINPMGGFPHYGLVNQDFLMIRGCCIGCKKRPITLRKTLIKQTKRFAFEKINLKFIDTSSKFGHGRFQTSAEKKTFMGKLKKDFLAESA

SEQ ID NO: 122660 - protein, 577 aa, Heterodera glycines
  Homolog annotation: Hit_ID=CAE60915.1; Match level="QueryCoverage =98%, HitCoverage=93%, E-value=0.0, Identity=87%"; Hit description =Hypothetical protein CBG04632 [Caenorhabditis briggsae]
  Gene Ontology: Mol. function=hydrogen-transporting ATPase activity, rotational mechanism; Cellular component=vacuolar membrane (sensu Fungi); Biological process=transport
  Essential gene: C elegans homolog=Y49A3A.2; Phenotype=Emb,Ste
  Coding regions on vcDNA: vcDNA=SeqID_49083; Strand=+; Position=37-1767
MPPTTREHIKESQYGFVYGVSGPVVTAEKMSGAAMYELVRVGHSELVGEIIRLEGDYATIQVYEETSSVTICDPVLRTGQPLSVELGPGIMGSIFDGIQRPLHDISEMTKSIYIPKGVNVKALNRAKRWEFMPRKDLRVGDHVTGGDIIGMVHESALVKHKIMVEPKACGTVKFIAPQGQYTVEDTILEVEFAGHTQKLTMMHIWPVRNPRPSAEKLAANFPLLCGQRVLDALFPCVQGGTTAIPGAFGCGKTVISQSLSKYSNSDAIIYVGCGERGNEMSEVLRDFPELTMEVDGVTTSIMERTALVANTSNMPVAAREASIYTGITLAEYFRDMGLNVAMMADSTSRWAEALREISGRLGEMPADSGYPAYLAARLASFYERAGKVKCFGSPEREGSVTIVGAVSPPGGDFADPVTSATLGIVQVFWGLDKKLAQRKHFPSINWLISYSKYMRALDDYYEKNFAEFVPLRTKCKEILQEEEDLSEIVQLVGKASLAEADKITLEVAKLIKDDFLQQNGYSSYDRFCPFYKTVGMLKNMIGFYDFARHSVETTAQSDNKITWNQIRDHLGDIIHEL

SEQ ID NO: 122661 - protein, 165 aa, Heterodera glycines
  misc_feature (110)..(110): Xaa can be any naturally occurring amino acid
  Homolog annotation: Hit_ID=NP_491707.1; Match level="QueryCoverage =57%, HitCoverage=7%, E-value=1e-20, Identity=55%"; Hit description=P- GlycoProtein related (pgp-2) [Caenorhabditis elegans] gb|AAB52482.2| P-glycoprotein related protein 2 [C
  Essential gene: C elegans homolog=C34G6.4; Phenotype=Unclassified
  Coding regions on vcDNA: vcDNA=SeqID_49084; Strand=+; Position=76-569
MEGIFGTQRGGGDILPNNDNNGNHNDRQPLLLEENEKASYGALGPTEDSFRQDKHWWKRSGKLKASKRQLGIFAYSSSVDYALIAFGTVASVLHGAGFPLLSIVLGGMTXRAENSDFVHGQTPRQNATNSSAISPISKEEFQSEVAAFSVYYLVLGFVMVVTSYI

SEQ ID NO: 122662 - protein, 263 aa, Heterodera glycines
  Homolog annotation: Hit_ID=CAE60688.1; Match level="QueryCoverage =88%, HitCoverage=36%, E-value=4e-99, Identity=72%"; Hit description =Hypothetical protein CBG04341 [Caenorhabditis briggsae]
  Gene Ontology: Mol. function=pre-mRNA splicing factor activity; Cellular component=nucleus; Biological process=cell organization and biogenesis
  Essential gene: C elegans homolog=F09D1.1; Phenotype=Emb
  Coding regions on vcDNA: vcDNA=SeqID_49085; Strand=+; Position=66-854
MPKRNASEAANATKFEKGPSAKNARIQTKKVSEELLNGKNRLNEAKEDDVPVWCLKKAQEEKPSRQCPYLDTIDRGVLDFDFEKLCSVSLSHINVYACMVCGKYFQGRGTNTHAYTHSLDSDHRIYLNLGTLKFYCLPENYEVIDPSLDDIKYVLKPTYTPEQIKLIGRNVKMARAWNDTLYYPGIIGLNNIKANDYTNVVFHALSHVPPLRDYFLREQNYMHIKRPPGDKLTLMPQRFGELLRKLWNPKAFKAHVSPHEMLQ

SEQ ID NO: 122663 - protein, 327 aa, Heterodera glycines
  Homolog annotation: Hit_ID=AAK66762.1; Match level="QueryCoverage =100%, HitCoverage=48%, E-value=0.0, Identity=99%"; Hit description =proprotein convertase 2 [Heterodera glycines]
  Gene Ontology: Mol. function=subtilase activity; Cellular component =Golgi apparatus; Biological process=proteolysis and peptidolysis
  Essential gene: C elegans homolog=K04F10.4a; Phenotype=Emb,Lvl
  Coding regions on vcDNA: vcDNA=SeqID_49086; Strand=+; Position=1-984
INSAINNGENAHYDESCSSTLASTFSNGGRNPESGVATTDLYGRCTRSHSGTSAAAPEAAGVFALTLEANPKLTWRDLQHLTVLTSSRNSLFDGRCRELPPLELEDIKRQLVSRQASCSHFEWQTNGVGLEYNHLFGFGVLDAAEMVLMAKVYKTAPPRFHCEAGTIEMPREIPASGEMVLTLRTDACTGSTTEVNFLEHVQAIVSLNSSRRGDTTLYLISPAGTPSMILSRRPKDDDAKDGFTNWPFMTTHTWGENPRGRWRLVVRFQPGKSTPKGHKYRGTLKKFTLMLHGTKEPPYRGIEPLQGHANSKLSVVESAHKRMANRR

SEQ ID NO: 122664 - protein, 181 aa, Heterodera glycines
  Homolog annotation: Hit_ID=CAE58579.1; Match level="QueryCoverage =99%, HitCoverage=99%, E-value=4e-72, Identity=70%"; Hit description =Hypothetical protein CBG01745 [Caenorhabditis briggsae]
  Gene Ontology: Mol. function=structural constituent of ribosome; Cellular component=cytosolic large ribosomal subunit (sensu Eukarya); Biological process=reproduction
  Essential gene: C elegans homolog=E04A4.8; Phenotype=Emb,Gro
  Coding regions on vcDNA: vcDNA=SeqID_49087; Strand=+; Position=102-647
MPIKASGETLRKYIVVGRKLPTANDPNPTLHEMVIFASNHVVAKSRFWYFTSMLRRVKKTHGEIISCQEVFEKKPGSVKNFGIWLRYDSRTGHHNMYREYRDVCEAGAVTQCYRDMGARHRAQADRIQIIKVQTISVADCKRAGVKQFQNSKIKFPLPHRVNSKRRNMTPFTTQRPRTHFV

SEQ ID NO: 122665 - protein, 172 aa, Heterodera glycines
  misc_feature (14)..(14): Xaa can be any naturally occurring amino acid
  Homolog annotation: Hit_ID=EAA67908.1; Match level="QueryCoverage =97%, HitCoverage=96%, E-value=2e-72, Identity=77%"; Hit description =hypothetical protein FG01081.1 [Gibberella zeae PH-1] ref|XP _381257.1| hypothetical protein FG01081.1 [Gib
  Gene Ontology: Mol. function=structural constituent of ribosome; Cellular component=cytosolic ribosome (sensu Eukarya); Biological process=protein biosynthesis
  Essential gene: C elegans homolog=T22F3.4; Phenotype=Emb,Gro,Pvl,Stp
  Coding regions on vcDNA: vcDNA=SeqID_49088; Strand=+; Position=15-534
MAAQNPMRELKLEXLVLNICVGESGDKLTRAAKVLEQLTGQTPVYSKAKYTVRSFGIRRNEKIAVHVTVRGAKAEEILERGLKVKEYELRAANFSQTGHFGFGITEHIDLDIKYDPTIGIYGMDFYCVMGRAGFRVSRRRRAVAKVGAPHRINKDETIEWFKKNYDGVILNK

SEQ ID NO: 122666 - protein, 225 aa, Heterodera glycines
  Homolog annotation: Hit_ID=EAA01159.2; Match level="QueryCoverage =76%, HitCoverage=30%, E-value=9e-48, Identity=54%"; Hit description =ENSANGP00000018451 [Anopheles gambiae str. PEST]
  Gene Ontology: Mol. function=ubiquitin-protein ligase activity; Cellular component=ubiquitin ligase complex; Biological process =locomotor rhythm
  Essential gene: C elegans homolog=K10B2.1; Phenotype=Emb,Lon,Lva,Pvl
  Coding regions on vcDNA: vcDNA=SeqID_49089; Strand=+; Position=26-700
NYRRKILKTKIQGPDLNRTKLLHTFTCTFRFDVASHLKRTVNKGQSIRIKIDRFSEWTEQDQTDFCKHLLQRMCHHQHGQIDQFLGPMLQRDFIALLPTGLAENVLHLLDAKSLCASEFVSRRWSRVIVNGLLWRKHIERQVRNDALWAGLAIRRGWKKYFFCSKDQATRAISQSWRQPKNGEDALEFQHKFYRELYPKITADIRQIEQNWREGRHRLERINCQS

SEQ ID NO: 122667 - protein, 256 aa, Heterodera glycines
  Homolog annotation: Hit_ID=NP_598842.1; Match level="QueryCoverage =97%, HitCoverage=91%, E-value=1e-45, Identity=37%"; Hit description =DnaJ homolog, subfamily C, member 9 [Mus musculus] gb|AAH23787.1| DnaJ homolog, subfamily C, member 9 [Mu
  Gene Ontology: Biological process=protein folding
  Essential gene: C elegans homolog=T24H10.3; Phenotype=Unc
  Coding regions on vcDNA: vcDNA=SeqID_49090; Strand=+; Position=18-785
MSFGKECVDLFGTKDLYQILKLDRSKSNLSSAQIKKAYYRQSILWHPDRFASAQHDETTRELAKQKFQVIGRAYVILGDSEKRKAYDETGSLDDENEFYEGKDWSAVWRGVFKKVTPEEIEAYLAKFRGSQEEIDEVKEAYQKHKGNMDKIMQSVVGAEHPDEDRIREIVRHGIERGELRAYARFVNEPASAPTRRAARAQREEGETQHALEELRQREDVSKGTDGDDSLGALKRAKQRKRAQKMDDFLDKLAQKY

SEQ ID NO: 122668 - protein, 244 aa, Heterodera glycines
  Homolog annotation: Hit_ID=NP_490748.1; Match level="QueryCoverage =72%, HitCoverage=93%, E-value=6e-17, Identity=29%"; Hit description =putative nuclear protein of fungal and metazoan origin (21.7 kD) (1B7) [Caenorhabditis elegans] gb|AAK299
  Essential gene: C elegans homolog=Y65B4BR.8; Phenotype=Emb,Pvl
  Coding regions on vcDNA: vcDNA=SeqID_49091; Strand=+; Position=15-749
MNSIGCPSSSNGPSSAMPSSSADCSADRSLPSSSSVIFQQFTIDQRHFVDEDYFSLESIFATNTNICCTFESKTPPALFPLLGRKAPEVISEKGYRANVPAWLVPAVDHICSFAVPTVYNSVNRDVIHAGAQSVNLEQLQRHYYTLGTFICRLVPGEQAQHIALALLSAFTQRIGRIVRDCTNTGAKPTRLDETEKRIFWTMQRTEHRKGLWMGNRREDEGRHRRAAKRKHCGGISTLLSVKNC

SEQ ID NO: 122669 - protein, 142 aa, Heterodera glycines
  Homolog annotation: Hit_ID=NP_492352.1; Match level="QueryCoverage =87%, HitCoverage=94%, E-value=8e-26, Identity=50%"; Hit description =ATP Synthase G homolog (14.9 kD) (asg-1) [Caenorhabditis elegans] emb|CAB03179.1| Hypothetical protein K0
  Essential gene: C elegans homolog=K07A12.3; Phenotype=Emb,Gro,Stp
  Coding regions on vcDNA: vcDNA=SeqID_49092; Strand=+; Position=42-470
MATRKLSFPEKIANILGVIYRYHEPRLPRYKDILKKVCVRELAPPTPKDWPQIKADYAKLDTVMRTQAYRQFKLKEFLVYSAVFVEVLCWFFVGEIIGRGSLTGYIVRSSFVDPKAAKKMAHFKWDDHHELKVENDEEQSGH

SEQ ID NO: 122670 - protein, 236 aa, Heterodera glycines
  Homolog annotation: Hit_ID=XP_315060.1; Match level="QueryCoverage =93%, HitCoverage=43%, E-value=4e-33, Identity=35%"; Hit description =ENSANGP00000011452 [Anopheles gambiae]
  Gene Ontology: Mol. function=cyclin-dependent protein kinase, intrinsic regulator activity; Cellular component=nucleus; Biological process=mitotic anaphase B
  Essential gene: C elegans homolog=ZC168.4; Phenotype=Emb,Lva,Stp
  Coding regions on vcDNA: vcDNA=SeqID_49093; Strand=+; Position=55-762
MNRIRKAVTVLSGNESNIPEKIAKAEPQHHDIEKPVSSLKFGGGATLFPAEYADDVDLYLRQLERRTPLDFDFLSVHKTVDGRMRQILVDWLVHVQVRFKLTIETLSLSVHILDRVLLALPGINKTNLQLLGVTSIFIAAKFEEVVMPNVDDFVYVAANMFKREDIMRMEPRVLSGLKFNLSVPYAVQFLRSYRFYASPSKSVWEFAKFVSEVAMVCYALAHFPPSVVAAVSLHLA

SEQ ID NO: 122671 - protein, 204 aa, Heterodera glycines
  Homolog annotation: Hit_ID=NP_491857.1; Match level="QueryCoverage =99%, HitCoverage=100%, E-value=2e-86, Identity=78%"; Hit description= RAB family member (22.7 kD) (rab-10) [Caenorhabditis elegans] gb|AAC48200.1| Rab family protein 10 [Caen
  Gene Ontology: Mol. function=RAB small monomeric GTPase activity; Biological process=negative regulation of FGF receptor signaling pathway
  Essential gene: C elegans homolog=T23H2.5; Phenotype=Unclassified
  Coding regions on vcDNA: vcDNA=SeqID_49094; Strand=+; Position=25-639
MAKKQYDLLFKLLLIGDSGVGKTCILYRFSDDAFNTSFISTIGIDFKIKTIELRGKKIKLQIWDTAGQERFHTITTSYYRGAMGIMMVYDITNAKSFDNIAKWLRYIDEHASEDVVKMLLGNKCDMSDRRVVPKERGEKIAIDHGIRFLETSAKANINIEKAFYDLAEAILDKVPDRNSMGPGPNIKPLTDGADRSTKSNCCYP

SEQ ID NO: 122672 - protein, 131 aa, Heterodera glycines
  Homolog annotation: Hit_ID=NP_725894.1; Match level="QueryCoverage =80%, HitCoverage=90%, E-value=7e-47, Identity=81%"; Hit description =CG9291-PA, isoform A [Drosophila melanogaster] ref|NP_523794.1| CG9291-PB, isoform B [Drosophila melanoga
  Essential gene: C elegans homolog=Y82E9BR.15; Phenotype=Emb,Lva
  Coding regions on vcDNA: vcDNA=SeqID_49095; Strand=+; Position=25-420
MSSSDLLAHNSSTSGSSSGATDKLAVFGGCEGPDACYVMLVSSDGHEFVIRKEHALISKTIRAMLSGPGQYAESETNEVHFREIPSHVLQKVCHYFAYKARYTNSATEIPEFFVAPEVALELLMAANFLDC

SEQ ID NO: 122673 - protein, 122 aa, Heterodera glycines
  Homolog annotation: Hit_ID=CAD91428.1; Match level="QueryCoverage =94%, HitCoverage=97%, E-value=2e-43, Identity=75%"; Hit description =ribosomal protein S20 [Crassostrea gigas]
  Gene Ontology: Mol. function=structural constituent of ribosome; Cellular component=cytosolic small ribosomal subunit (sensu Eukarya); Biological process=protein biosynthesis
  Essential gene: C elegans homolog=Y105E8A.16; Phenotype=Lva,Sma
  Coding regions on vcDNA: vcDNA=SeqID_49096; Strand=+; Position=87-455
MAFPYKDDKPQEAAPVEDRIRITLTSQNVKSLEKVCEQLIRGAKDENLVVKGPVRMPTKILRITTRKTPCGEGSKTWDRFQMRIHKRIINLNSSSDVLKKITGISIEPGVDVEVTIAESPSN

SEQ ID NO: 122674 - protein, 180 aa, Heterodera glycines
  Homolog annotation: Hit_ID=CAE59286.1; Match level="QueryCoverage =84%, HitCoverage=49%, E-value=1e-26, Identity=46%"; Hit description =Hypothetical protein CBG02619 [Caenorhabditis briggsae]
  Essential gene: C elegans homolog=C29F5.4; Phenotype=Emb
  Coding regions on vcDNA: vcDNA=SeqID_49097; Strand=+; Position=143-682
MAKLESFCAINGSRPLEAKAEFRPINSMDFHSDVGRMLYTIAILLMFSFVIFALMVRSISRSRSSAELETLLDAMRFREELDIQLRQKHRLRKAKRKVTAWLCRGNGAKLWQSSPHILIPNNAVSVRNHSLQSTGSYIPEIVISTENTNPATVEGILRNIERQNSFTPSLSLIYDFSYDS

SEQ ID NO: 122675 - protein, 271 aa, Heterodera glycines
  Homolog annotation: Hit_ID=CAE64409.1; Match level="QueryCoverage =99%, HitCoverage=65%, E-value=1e-124, Identity=83%"; Hit description= Hypothetical protein CBG09101 [Caenorhabditis briggsae]
  Gene Ontology: Mol. function=proteasome ATPase activity; Cellular component=26S proteasome; Biological process=proteolysis and peptidolysis
  Essential gene: C elegans homolog=F23F12.6; Phenotype=Emb
  Coding regions on vcDNA: vcDNA=SeqID_49098; Strand=+; Position=26-838
MENPSDFTLGGALPTSSTDDYLKLKRLENKLANLDVMEEYLKMDMRNLEKELVHAQEEVKRIQSVPLIIGQFLEAVDYDHAIVGSTTGSNYYVRVLSILDRELLKAGCSVSLHKYSNALVDVLPPESDSSIQMLRADEKPDVVYSDIGGLDTQKQEVREAVELPLTNGELYEQIGIEPPRGVLLYGPPGCGKTMLAKAVAKHTKASFIRVVGSEFVQKYLGEGPRMVRDVFRLAKENSPCIIFIDEIDAIATKRFDAQTGADREVQRILLE

SEQ ID NO: 122676 - protein, 284 aa, Heterodera glycines
  Homolog annotation: Hit_ID=AAH87182.1; Match level="QueryCoverage =99%, HitCoverage=59%, E-value=1e-103, Identity=44%"; Hit description= Unknown (protein for MGC:97999) [Xenopus laevis] ref|NP_032800.2| poly A binding protein, cytoplasmic 1 [
  Gene Ontology: Mol. function=poly(A) binding; Cellular component =cytoplasm; Biological process=mRNA metabolism
  Essential gene: C elegans homolog=Y106G6H.2a; Phenotype=Gro,Stp
  Coding regions on vcDNA: vcDNA=SeqID_49099; Strand=+; Position=59-910
MAPSYPLASLYVGDLHPDVTEAMLFERISNAGPVLSIRVCRDAITRRSLGYAYVNFPQPADAERALDTLNFDMILNKPIRIMRTQRDPSIRRSGAGNIFIKNLGKEIDTKAIYDTFSMFGSILSCKISTDIDGGSKGYGFIHFETEEAVNSAIAKVNGMLLDGKKVFVGKFLPRSARDKQIGDPSSRFTNVYVKNFGDAMNSEKLSEVFSQFGEIISAKVMEDDSGKSKGFGFVAYKDHESAARAVEKMNDVSVPGSEKVEQKFTVCRAQKKSERQAELKRRYE

SEQ ID NO: 122677 - protein, 238 aa, Heterodera glycines
  Homolog annotation: Hit_ID=EAA13221.3; Match level="QueryCoverage =94%, HitCoverage=30%, E-value=9e-70, Identity=58%"; Hit description =ENSANGP00000010668 [Anopheles gambiae str. PEST]
  Gene Ontology: Mol. function=ATP dependent helicase activity; Biological process=ribosome biogenesis
  Essential gene: C elegans homolog=Y55F3BR.1; Phenotype=Gro,Stp,Unc
  Coding regions on vcDNA: vcDNA=SeqID_49100; Strand=+; Position=2-715
LTLSCKHSVYIQIRFFLLDEADSLLGGQSDSAQIVHELHSRIPKYSEFGERLQMIVSSATLHNMAVQRLATQDMYFPQWIDLKGQDSDTETVHQVVCMVDPCEDKSWIRLRSKTGQSVHTDSVHARDQLQTGSDNPETLSEAVKVLKGEYLVKAIEEHKMDQAIIFCRTKLDCDNMEKFLAPRGYKCVCLHGDRSADERTRNLLSIKENIVRFLICTDVAARRLDILGVPYVDNVTLP

SEQ ID NO: 122678 - protein, 237 aa, Heterodera glycines
  Homolog annotation: Hit_ID=AAN15196.1; Match level="QueryCoverage =100%, HitCoverage=63%, E-value=1e-133, Identity=99%"; Hit description=actin [Globodera rostochiensis] gb|AAN78299.1| actin 1 [Heterodera glycines] gb|AAG47837.2| actin 1 [Het
  Gene Ontology: Biological process=reproduction
  Essential gene: C elegans homolog=T04C12.6; Phenotype=Ste
  Coding regions on vcDNA: vcDNA=SeqID_49101; Strand=+; Position=29-813
MCDEEVPALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGLVLDSGDGVTHTVPIYEGYALPHAILRLDLAGRDLTDYLMKILTERGYSFVTTAEREIVRDIKEKLCYVALDFEQEMATAASSSSL

SEQ ID NO: 122679 - protein, 354 aa, Heterodera glycines
  Homolog annotation: Hit_ID=NP_506375.1; Match level="QueryCoverage =97%, HitCoverage=62%, E-value=2e-55, Identity=37%"; Hit description =cellular senescence inhibited gene protein like (59.9 kD) (5O104) [Caenorhabditis elegans] emb|CAB01204.1
  Essential gene: C elegans homolog=F53F4.11; Phenotype=Lva
  Coding regions on vcDNA: vcDNA=SeqID_49102; Strand=+; Position=7-1071
MLREKCKEVKAQARFALKALKEHSERISRKALFLEEDSALFISVKYKKVPLARGNSMRKLIGLPCTDQNASNTSICLILPDFDRSNAAARDPDVDGQARRWAELLREKYGLTGEHIAKIFTITQLKREYGKQADRAKLANTYDIFMVDKKLMKIAVNFLGGTFRKATKMPLPIDSSVDISKKLKEAFSLVQLHFAPLKDSVAVRIGNLSQSLAELDSNFDVIIEAVFAHLPGGPSNIRSCYLQTSATKTSLPIFVDFGPSDEVLVEQPKNEQFAVELGECSTLPEGLMVKVRADGKVTVVKGNAGEEVLYPTAQDEWEQGDDIRPLNDDTVQKVLRKKAIGMSKGQRKRKDKAK

SEQ ID NO: 122680 - protein, 259 aa, Heterodera glycines
  Homolog annotation: Hit_ID=CAE56255.1; Match level="QueryCoverage =99%, HitCoverage=38%, E-value=5e-96, Identity=65%"; Hit description =Hypothetical protein CBG23896 [Caenorhabditis briggsae]
  Gene Ontology: Mol. function=CTP synthase activity; Cellular component=cytosol; Biological process=pyrimidine base metabolism
  Essential gene: C elegans homolog=W06H3.3; Phenotype=Emb,Lva,Unc
  Coding regions on vcDNA: vcDNA=SeqID_49103; Strand=+; Position=53-829
MAEEPVKLILVTGGVMSGVGKGIVSSSIGVLLKGCGYRVTVIKIDPYINVDAGTFSPFEHGEVFVLDDGGEVDLDLGNYERFLDIRLTRDNNITTGKIFHQVIQRERNGDYLGKTVKTVPHITDAIIEWVERVSKISVDGSGKTPQICIVELGGTIGDIEGMPYTMAFSMAFRRKTYRNRFLTVHVTKLLHESGEIKTKPAQNALRSLRETGLYPDLLLCRSQKPLTQALRSKIASFAQLDINEIIDVYDCHDIHSVPL

SEQ ID NO: 122681 - protein, 255 aa, Heterodera glycines
  Homolog annotation: Hit_ID=NP_499164.1; Match level="QueryCoverage =92%, HitCoverage=79%, E-value=5e-53, Identity=43%"; Hit description =xylosylprotein beta 1 4-galactosyltransferase 7, SQuashed Vulva SQV -3 (33.8 kD) (sqv-3) [Caenorhabditis e
  Gene Ontology: Mol. function=beta-N-acetylglucosaminyl-glycopeptide beta-14-galactosyltransferase activity; Cellular component=integral to membrane; Biological process=development of secondary sexual characteristics
  Essential gene: C elegans homolog=R10E11.4; Phenotype=Emb
  Coding regions on vcDNA: vcDNA=SeqID_49104; Strand=+; Position=148-915
MPQQQHQLCVTIPYRDRWTELQQMLPLLHNFLVTIQAIAPPPRYIVVNQSEEDALRFNRAALINIGALEAERVGCDYMAIHDVDIVPLNPNLSYHYPEDGHIMHVAAGQYHPIRRYDYKNFIGSVLVITLADFKKVDGMSNEFWGWGLEDDDFYLRLKAAGMANKIRRPSNLTTDRSNTFLHLHTRSRRRDFSVDEYRKKRKRRRNTLSGLRTLNYKLNGRHTIELTEDIQIWVLDVRLYCTPTIFGTECHQNVA

SEQ ID NO: 122682 - protein, 268 aa, Heterodera glycines
  Homolog annotation: Hit_ID=NP_508734.1; Match level="QueryCoverage =97%, HitCoverage=60%, E-value=1e-100, Identity=69%"; Hit description= choline kinase (49.2 kD) (XE909) [Caenorhabditis elegans] gb|AAK39220.1| Choline kinase a protein 2 [Cae
  Gene Ontology: Mol. function=choline kinase activity; Biological process=lipid metabolism
  Essential gene: C elegans homolog=B0285.8; Phenotype=Unclassified
  Coding regions on vcDNA: vcDNA=SeqID_49105; Strand=+; Position=73-876
MEIQRDSHLRSMKELLSTMDPQVDPNSHIEFKQKTHILCARFLGGAWKTVSLEDMKIHRIKGGMSNMLFFCRLTENHPPLKGEPDKVLLRVYFNPETESHLVAESVIFTLLSERHLGPKLYGIFSGGRLEEYIPSRPLTCHEIALPTMANKIAKRLARVHQLEVPIWKEPEYICDALERWLIQLKQMPSGSRDFDLPAESHEWAPPSINCEDLQKEIEHLRRLIVKSRSLVTFCHNDLQEGNILLPKAHSGNIRIGSESDEILSGIDG

SEQ ID NO: 122683 - protein, 297 aa, Heterodera glycines
  misc_feature (70)..(70): Xaa can be any naturally occurring amino acid
  Homolog annotation: Hit_ID=BAB55646.1; Match level="QueryCoverage =98%, HitCoverage=89%, E-value=7e-39, Identity=33%"; Hit description =ataxin-3 [Homo sapiens]
  Gene Ontology: Cellular component=cytoplasm; Biological process =synaptic transmission
  Essential gene: C elegans homolog=F28F8.6; Phenotype=Emb
  Coding regions on vcDNA: vcDNA=SeqID_49106; Strand=+; Position=47-939
MDLVYHEKQVGRMCAQHALNMLLQGDYFTPDSLASIAQELDQRERAMLRDESEFQSQNYDDSGYFSIQVXTEALRRQANLSLEPIISPNAMKVLQNPSLAHAYICHLEDHWFTIRKIGTTWFILNSLFKAPRIVSETFLELYVHQLNTEGWSLYVVEGELPACAAETVPREFWNETRRTKKFENDMERAIALSLNEARPFLVTKTADEELFGAATPVISQAEELDIQRALEDSLREANRATSVSTAESFLVGEAIRNSVLDLDASSSHTSTNSQTSSRNEEEDDPHNRQSCSSGYQR

SEQ ID NO: 122684 - protein, 262 aa, Heterodera glycines
  Homolog annotation: Hit_ID=AAD43464.1; Match level="QueryCoverage =100%, HitCoverage=45%, E-value=1e-148, Identity=98%"; Hit description=pre-mRNA splicing factor [Heterodera glycines]
  Gene Ontology: Cellular component=spliceosome complex; Biological process=locomotory behavior
  Essential gene: C elegans homolog=F49D11.1; Phenotype=Bmd,Emb,Lva
  Coding regions on vcDNA: vcDNA=SeqID_49107; Strand=+; Position=28-813
MDLLKSYDGSSSSDNEQELADIPSSSNHNKLLALKIPSINLTPNVIEQRAIQQVAVVDPKTKELYHNPRFDELFKPESGPQNPFKSEHQRAEKNTLTGYVEPAHFNAFHFERSLRSYDTLGYADNPTADTTSAKFVGDVGQAQEKAGESLFESVKTGGQKRKRVINYDASNVDGYTGPWARFEDEKTIARPDPELQKEMDEIVRKRKLKSRAGRKAAIAELHLAEESTKLHIKDDTDYLGRSFMEPPKYTGTNLREDFVPDR

SEQ ID NO: 122685 - protein, 265 aa, Heterodera glycines
  Homolog annotation: Hit_ID=CAE62694.1; Match level="QueryCoverage =98%, HitCoverage=44%, E-value=2e-66, Identity=51%"; Hit description =Hypothetical protein CBG06842 [Caenorhabditis briggsae]
  Gene Ontology: Cellular component=eukaryotic 48S initiation complex; Biological process=cell organization and biogenesis
  Essential gene: C elegans homolog=R08D7.3; Phenotype=Emb
  Coding regions on vcDNA: vcDNA=SeqID_49108; Strand=+; Position=1-795
IITLPQFDLPECVSNPNGWGPGSVSDSQVLSEFVGLPYQHFNKCDRIGRIVDWLGVDRFFKKGETRDRYNERVYGSSATAGVQFDYIHDNEESNFQLVDSSRPQKPQRPFRRQIPFRKLAQREQERREYEKYNVSTKMKRSILKEQQKAYKVFLRRGGGTRGTAQRPTGRRFNDRQAGKGRQPSVQVRPDWAVLKELDFVQLNKLYLPNIEPGKDIPGETYGTLHFYDKALMDKLSVKNPLHLEKFHASFYSLTTTEDPVFRKLS

SEQ ID NO: 122686 - protein, 134 aa, Heterodera glycines
  Homolog annotation: Hit_ID=NP_499523.1; Match level="QueryCoverage =96%, HitCoverage=49%, E-value=3e-23, Identity=42%"; Hit description =mitochondrial membrane (3M869) [Caenorhabditis elegans] pir||T19428 hypothetical protein C24H11.6 - Caeno
  Gene Ontology: Mol. function=DNA-directed RNA polymerase II activity; Cellular component=DNA-directed RNA polymerase II, core complex; Biological process=regulation of transcription from Pol II promoter
  Essential gene: C elegans homolog=C24H11.9; Phenotype=Gro
  Coding regions on vcDNA: vcDNA=SeqID_49109; Strand=+; Position=22-426
MCDRLTQTLDLVNDLANHMCNSVGVLHASAGPCEFGTAPEELKNEPNCRLFAQQIARTAKDIEILIDSLPADEQSLSVEEHEKALLELDDERARAAKELEQAVEKAEKLTDQLGELLSRIARLQMESRPMAFST

SEQ ID NO: 122687 - protein, 226 aa, Heterodera glycines
  misc_feature (200)..(200): Xaa can be any naturally occurring amino acid
  Homolog annotation: Hit_ID=NP_499404.1; Match level="QueryCoverage =69%, HitCoverage=42%, E-value=5e-16, Identity=32%"; Hit description =protein kinase (44.3 kD) (3M39) [Caenorhabditis elegans] emb|CAB16482.1| Hypothetical protein Y52D3.1 [Ca
  Gene Ontology: Mol. function=ATP binding; Biological process=protein amino acid phosphorylation
  Essential gene: C elegans homolog=Y52D3.1; Phenotype=Emb
  Coding regions on vcDNA: vcDNA=SeqID_49110; Strand=+; Position=67-745
MPYTDAVTMGNSSASGTVSVPKNPARLGTFLWGVSAATGRRVLLAELGPASASTVVAKKRAKIVAHLSMSHESLLLFCDPFVHAERTFLRCSFRADLGHCAHLLSAFYSEGLPESALRIILRATLNALEHLHSRGVIHRSVCAENIWLDSDGQIRLALTRHATRISDCPKWIGVEDRVHEFTSDLSEMVAWLAPEVLMQXGICLCELANGVVPFQEMEPLRILYEK

SEQ ID NO: 122688 - protein, 127 aa, Heterodera glycines
  Homolog annotation: Hit_ID=NP_507032.1; Match level="QueryCoverage =100%, HitCoverage=100%, E-value=2e-60, Identity=92%"; Hit description=histone (13.4 kD) (his-3) [Caenorhabditis elegans] ref|NP_505296.1| histone (13.4 kD) (his-19) [Caenorh
  Gene Ontology: Mol. function=DNA binding; Cellular component =nucleosome; Biological process=nucleosome assembly
  Essential gene: C elegans homolog=T23D8.6; Phenotype=Emb
  Coding regions on vcDNA: vcDNA=SeqID_49111; Strand=+; Position=67-450
MSGRGKGGKAKTGGKAKSRSSRAGLQFPVGRLHRLLRKGHYAERVGAGAPVYLAAVLEYLAAEVLELAGNASRDNKKTRINPRHLQLAVRNDEELNKLLSGVTIAQGGVLPNIQAVLLPKKTHGESQ

SEQ ID NO: 122689 - protein, 205 aa, Heterodera glycines
  Homolog annotation: Hit_ID=NP_490749.1; Match level="QueryCoverage =97%, HitCoverage=98%, E-value=6e-63, Identity=64%"; Hit description =nascent polypeptide-associated complex NAC and Ubiquitin-associated domain containing protein (21.8 kD) (
  Gene Ontology: Mol. function=TATA-binding protein binding; Cellular component=nascent polypeptide-associated complex; Biological process= nuclear positioning
  Essential gene: C elegans homolog=Y65B4BR.5a; Phenotype=Gro,Stp
  Coding regions on vcDNA: vcDNA=SeqID_49112; Strand=+; Position=39-656
MVTAEDTVKTKEEDPKKTTTDDGSSSEEEVPELEEGDVTEEQKKVAEAAGLSEQVAEKGSKQSRSEKKARKLFSKLGLKQVHGVSRVCIRKSKSILFVINKPDVYKSPGSDTYVVFGEAKIEDLAQHAQITDVENLKPPSIIRDVRNRITPAEEESDGEEADATGIEEKDIELVMSQANVSRNKAIKALKKADNDLVNAIMALTM

SEQ ID NO: 122690 - protein, 228 aa, Heterodera glycines
  Homolog annotation: Hit_ID=AAA81746.1; Match level="QueryCoverage =94%, HitCoverage=86%, E-value=9e-25, Identity=35%"; Hit description =Lamp/cd68 related protein 1 [Caenorhabditis elegans] ref|NP _509072.1| LAMP/CD68 related (25.8 kD) (lmp-1)
  Essential gene: C elegans homolog=C03B1.12; Phenotype=Clr
  Coding regions on vcDNA: vcDNA=SeqID_49113; Strand=+; Position=128-811
MKFAVKGDDNKYCILLDSPQITGAIRYEEKNGSFNTTTFSLSNSSASVDKNASSCDASIQRISIQFAPLIEGIATEMSKKWNITLEFTKKDGKNYALSDYSLGVVFFPAQKASQKSHVYEKNGTAEWVAQLESDQSKHPNGFTCSENKLALSDASTINFEFLKLVAFDDNEKDEFRDGQIFENCPLDARTSDLVPIVVGALLAGLVVIVLIAYLIGRARAKRQGYTSV

SEQ ID NO: 122691 - protein, 238 aa, Heterodera glycines
  Homolog annotation: Hit_ID=CAE71996.1; Match level="QueryCoverage =97%, HitCoverage=50%, E-value=2e-67, Identity=56%"; Hit description =Hypothetical protein CBG19072 [Caenorhabditis briggsae]
  Gene Ontology: Cellular component=integral to membrane
  Essential gene: C elegans homolog=Y57E12AL.1a; Phenotype=Egl,Gro,Pch
  Coding regions on vcDNA: vcDNA=SeqID_49114; Strand=+; Position=1-717
LPAPACALPKFVISFLFDLCFVISVVSLLPKVQERMPNSGLIQASMMSLYVCYLTWSALINNPDKECNPSLIPRHNSTGDAGGNVQVITTSLPVNSLVSLVIWFCCLLYASIRTSSYTALGKIGGAISEGNAEGQDIPLSEASMSVEEGDRGTTGRNVYDNEKGSVAYSYSFFHFIFALASLYVMMTLTSWYTPSDDLRYLNDNMASLWVRVISSWLCAALYLWTLLAPVLFPDRDFN

SEQ ID NO: 122692 - protein, 210 aa, Heterodera glycines
  Homolog annotation: Hit_ID=NP_495863.1; Match level="QueryCoverage =99%, HitCoverage=41%, E-value=5e-68, Identity=61%"; Hit description =phenylalanine hydroxylase, Biogenic Amine Synthesis related (52.1 kD) (bas-2) [Caenorhabditis elegans] em
  Gene Ontology: Mol. function=phenylalanine 4-monooxygenase activity; Biological process=phenylalanine catabolism
  Essential gene: C elegans homolog=ZK1290.2a; Phenotype=Emb
  Coding regions on vcDNA: vcDNA=SeqID_49115; Strand=+; Position=1-633
IPHESKPHYTPEPDILHELLGHCPLFADPDFAQFSQEFGLASLGASDEMVEKLATLYWFTVEFGICIQNGAKKAYGAGLLSSFGELEYALSGQPELAAFNPPETCQTKYPITSYQPKYFVAESFADAKNKLAYCICRARVLSIFNPPRSRSTWSTSIPRQFQVNYNPYTQRIEMLDNESAANKLVRDVKSQVSKLEEALRKLDKEKAKAK

SEQ ID NO: 122693 - protein, 297 aa, Heterodera glycines
  Homolog annotation: Hit_ID=CAE59273.1; Match level="QueryCoverage =96%, HitCoverage=97%, E-value=1e-123, Identity=76%"; Hit description= Hypothetical protein CBG02605 [Caenorhabditis briggsae]
  Gene Ontology: Mol. function=estrogen receptor binding; Cellular component=mitochondrion; Biological process=negative regulation of transcription
  Essential gene: C elegans homolog=T24H7.1; Phenotype=Emb,Gro
  Coding regions on vcDNA: vcDNA=SeqID_49116; Strand=+; Position=42-932
MAAIDPKDFFNKFAKPSKGAGVGAGLMTAAAVAGYALYKSMYTIEAGHRAIMFNRIGGLGDEVYREGLHFRIPWFQYPIVYDIRARPNQIRSPTGSKDLQMVNIGLRVLSRPDPGQLQTICRMLGTNWEERVLPSICNEVLKGVVAKFNASQLITQRQQVSLLVRKGLIERALDFNIILDDVAITELAFSPQYSAAVEAKQVAAQEAQRASFMVEKAIQQRQEKIVQAEGEAQAAKLLGESMKNDPGFLKLRKIRAAQKIARFIANSSNRVYLPSDGLFLNLADEDYLSLATNKGRR

SEQ ID NO: 122694 - protein, 274 aa, Heterodera glycines
  Homolog annotation: Hit_ID=NP_500844.1; Match level="QueryCoverage =81%, HitCoverage=59%, E-value=2e-26, Identity=32%"; Hit description =beclin 1 (42.8 kD) (4G426) [Caenorhabditis elegans] gb|AAA83597.2| Beclin (human autophagy) homolog prote
  Gene Ontology: Cellular component=cytoplasmic vesicle; Biological process=anti-apoptosis
  Essential gene: C elegans homolog=T19E7.3; Phenotype=Gro,Unc
  Coding regions on vcDNA: vcDNA=SeqID_49117; Strand=+; Position=3-824
VHSPAVHCLVLQWRLELHHSLFGPTEDGTDCASSTKSYALRSDGASCSTTTDAKPDFASTYEHCIDLTSTVGTSQSANLLDLVTESTSPLEVPMCKKCANAVTAELNKQLGHLEKECIQYKKSLDHLLQRRADCPFDMEASRIKLDALKSEERDLLEQLTLLEDEERTLLHELDTKQEERKKIGERDEQLYRQLRNNHSILIEQSDEQRSFKLQINQANEQIRRLSRMNVLDREFHIWGDAEYGTKRGFRVGRLEHEPREWSEIHAALGKTALL

SEQ ID NO: 122695 - protein, 118 aa, Heterodera glycines; identical to SEQ ID NO: 122611
  Homolog annotation: Hit_ID=CAE64681.1; Match level="QueryCoverage =96%, HitCoverage=94%, E-value=1e-46, Identity=83%"; Hit description =Hypothetical protein CBG09459 [Caenorhabditis briggsae]
  Gene Ontology: Mol. function=structural constituent of ribosome; Cellular component=cytosolic small ribosomal subunit (sensu Eukarya); Biological process=protein biosynthesis
  Essential gene: C elegans homolog=K02B2.5; Phenotype=Gro
  Coding regions on vcDNA: vcDNA=SeqID_49118; Strand=+; Position=16-372

SEQ ID NO: 122696 - protein, 106 aa, Heterodera glycines
  Essential gene: C elegans homolog=C30C11.1; Phenotype=Emb
  Coding regions on vcDNA: vcDNA=SeqID_49119; Strand=+; Position=23-343
MFFTRILPLEKAKYRTSKPRVLFRRFNRPFYQYTMRPLVQCPRCSASHEPWVLCMDCYRVLRDATEPIKRRMVSHNAYIGQRQQPMPRWTDENGINANPVIIVFSI

SEQ ID NO: 122697 - protein, 202 aa, Heterodera glycines
  Homolog annotation: Hit_ID=CAE74082.1; Match level="QueryCoverage =94%, HitCoverage=49%, E-value=5e-84, Identity=81%"; Hit description =Hypothetical protein CBG21737 [Caenorhabditis briggsae]
  Gene Ontology: Mol. function=GDP-mannose 46-dehydratase activity; Biological process=carbohydrate metabolism
  Essential gene: C elegans homolog=F56H6.5; Phenotype =Egl,Lva,Lvl,Prz,Unc
  Coding regions on vcDNA: vcDNA=SeqID_49120; Strand=+; Position=1-606
SLISGLLKRLEEDCIGSAPAAMDKDDAKQFEEYRARKVAMITGISGQDGSYLAEFLLAKGYQVHGVIRRSSSFNTGRIEHLYSNPMTHAVGSSFNLHYGDMTDSSCLIKLISTIRPTELYHLAAQSHVKVSFDLPEYTAEVDAVGTLRLLDAIHACGLTRLVRFYQASTSELYGKVQEVPQRETTPFYPRSPYAVAKLYSYW

SEQ ID NO: 122698 - protein, 212 aa, Heterodera glycines
  Homolog annotation: Hit_ID=NP_495800.1; Match level="QueryCoverage =71%, HitCoverage=64%, E-value=1e-55, Identity=65%"; Hit description =mitochondrial ribosomal protein S18b like (2I817) [Caenorhabditis elegans] emb|CAA91421.1| Hypothetical p
  Gene Ontology: Mol. function=structural constituent of ribosome; Cellular component=mitochondrial small ribosomal subunit; Biological process=protein biosynthesis
  Essential gene: C elegans homolog=T13H5.5; Phenotype=Lva
  Coding regions on vcDNA: vcDNA=SeqID_49121; Strand=+; Position=17-652
MLALKSLLGRSPLVNPLVLSLRNRSIKKVKKKLAAGETLGGPEDYAYNYVEKKRGFIKPIHTLEEQIEYMNSEVFAETYKGRPICFMWKRNMKGQWKLQPPPRLFCIDRNGRFNVGNACTVCRDEYLFFDYRNPKLLEHFLYPGTDQPLPIIQTGLCQEQYVNLQAQLLKAKEHGTFIFNVPFRHFNYGQWYPKDANALISSDLEEDQPSRD

SEQ ID NO: 122699 - protein, 205 aa, Heterodera glycines
  Homolog annotation: Hit_ID=NP_493382.1; Match level="QueryCoverage =96%, HitCoverage=94%, E-value=1e-60, Identity=57%"; Hit description =vacuolar protein (24.2 kD) (1O178) [Caenorhabditis elegans] emb|CAB54493.1| Hypothetical protein Y87G2A.1
  Gene Ontology: Cellular component=endosome; Biological process =protein-vacuolar targeting
  Essential gene: C elegans homolog=Y87G2A.10; Phenotype=Gro
  Coding regions on vcDNA: vcDNA=SeqID_49122; Strand=+; Position=85-702
MASIDLSQEVRLYDNNAERDRIDNMAELYAMVNALECLEKVFSRDYIHTKEYTAECSKLLVQIKVALRLVPGMTIDEFFRSYYIQCPAALERIREDRPITVRDDKGNALKCIADIVELFITFLDQLKLNIRAVDELFPNLNDLYASINTMSTLPDDFDAKLRVKSWHDKLQGMAAHEEITDEVARQMIFELETAYNAFQRFLRSG

SEQ ID NO: 122700 - protein, 222 aa, Heterodera glycines
  Homolog annotation: Hit_ID=CAE59999.1; Match level="QueryCoverage =97%, HitCoverage=23%, E-value=8e-28, Identity=35%"; Hit description =Hypothetical protein CBG03493 [Caenorhabditis briggsae]
  Gene Ontology: Mol. function=rRNA primary transcript binding; Cellular component=nucleolus; Biological process=35S primary transcript processing
  Essential gene: C elegans homolog=T23F6.4; Phenotype=Lva
  Coding regions on vcDNA: vcDNA=SeqID_49123; Strand=+; Position=34-777
MKTSPKIKSRKTASTNEVKKECPEGTENRENVGTSSRLIVKNLPCGKKTRWDEAKVRAHFSKFGTLTDVRLKLSEKTGACKFAFVGFSSAEHCQNAIKALDGAYIGGSKLTVEECKCEVDEEEDKEEAAEEADVDSLIEKQILDTGRLFLRNLPFVCSEEQIRQLFEPFGPLAELECVVDNAGKCKGYALCTFIFPEHAVAAWKALDGTVFMGRMLHIIAGE

SEQ ID NO: 122701 - protein, 139 aa, Heterodera glycines
  Homolog annotation: Hit_ID=NP_492576.1; Match level="QueryCoverage =97%, HitCoverage=100%, E-value=1e-44, Identity=65%"; Hit description= ribosomal Protein, Large subunit (15.4 kD) (rpl-14) [Caenorhabditis elegans] emb|CAB03835.1| Hypothetica
  Gene Ontology: Mol. function=structural constituent of ribosome; Cellular component=cytosolic large ribosomal subunit (sensu Eukarya); Biological process=positive regulation of growth rate
  Essential gene: C elegans homolog=C04F12.4; Phenotype=Emb,Lva
  Coding regions on vcDNA: vcDNA=SeqID_49124; Strand=+; Position=60-479
MIYHRFVEIGRVVYIAKGKDQGKLAVIVNVIDGNKVLLDGPSSGVPRGVWNFKDLQLTKFTLPLRIGQRTKGVREAYETAKINELWQGTEWAKRIDRKQKRAGLNDFERFKVFKAKQHRNRLVRVEMAKLKKISKPTAK

SEQ ID NO: 122702 - protein, 197 aa, Heterodera glycines
  Homolog annotation: Hit_ID=CAE62165.1; Match level="QueryCoverage =90%, HitCoverage=89%, E-value=1e-74, Identity=68%"; Hit description =Hypothetical protein CBG06212 [Caenorhabditis briggsae]
  Essential gene: C elegans homolog=T12G3.5; Phenotype=Gro
  Coding regions on vcDNA: vcDNA=SeqID_49125; Strand=+; Position=3-596
SIHISILLPHCKVQLGIRNWHDRSQVPRIFDDRRKATNKIKDVGYYFRYHRPGIDALPRIPDCKEQLYRPKYKIREPWRESQARFGENDYIDLLGDGSLHPAQLQYHVPRWLRGFPGQNRAIEPVKLIHYRNLYKSKLEQNSPHKWHQLNKRIKYLLQYHNYDKSDELRAERSLGLWEEEPDYFYKDKSRRSYQDLV

SEQ ID NO: 122703 - protein, 196 aa, Heterodera glycines
  Homolog annotation: Hit_ID=CAE60601.1; Match level="QueryCoverage =90%, HitCoverage=50%, E-value=1e-42, Identity=49%"; Hit description =Hypothetical protein CBG04238 [Caenorhabditis briggsae]
  Essential gene: C elegans homolog=C18A3.4a; Phenotype=Emb
  Coding regions on vcDNA: vcDNA=SeqID_49126; Strand=+; Position=80-667
MASGFWAFVGRAWEWLKTLILPQSINGTCLNQTFINDTPSAGEFLADLEPFQIVLLSVGSVLTFTVFLLAFLQWRYIFNYVSSEQRRNKLYLLISLVPVCTFCCLLRMVWPRTALLVSSFGLLHFRLGLFVLVSLMRHLSGGRATLALSLTDKGKLIDFRGPPFCCLLYCLPRANPTEVNLTRLEWIVLQAPIIRV

SEQ ID NO: 122704 - protein, 260 aa, Heterodera glycines
  Homolog annotation: Hit_ID=XP_318694.1; Match level="QueryCoverage =59%, HitCoverage=44%, E-value=3e-16, Identity=36%"; Hit description =ENSANGP00000010291 [Anopheles gambiae]
  Essential gene: C elegans homolog=F59E12.11; Phenotype=Emb
  Coding regions on vcDNA: vcDNA=SeqID_49127; Strand=+; Position=28-807
MGNEHSRGRFGGNGTNKEKGDDDGGQTSPSTSTGIPASFSFLAKKRNSTKSALMGSIVVVNEGASCSSSADPGKDVDLRRIKEIPRFLPLLRGVLPGHRDIPEAQQKIDSKSILSFMHRLQQHFKSCAQTVATEQGRMFARIVEIDQLISSLFKKTSTATKRLDALNNELRKVGTFSSQLEEIQASLLDLSSSANSLNQLLSFDDRLPPLQFAFTPILTRKKLSESAGTMLPQNSDNINSGDRTAIERDLRKVSELRVVD

SEQ ID NO: 122705 - protein, 263 aa, Heterodera glycines
  Homolog annotation: Hit_ID=NP_499264.1; Match level="QueryCoverage =98%, HitCoverage=55%, E-value=1e-128, Identity=85%"; Hit description= citrate synthase (51.5 kD) (3L304) [Caenorhabditis elegans] emb|CAA83004.1| Hypothetical protein T20G5.2
  Gene Ontology: Mol. function=citrate (SI)-synthase activity; Cellular component=mitochondrial matrix; Biological process=TCA intermediate metabolism
  Essential gene: C elegans homolog=T20G5.2; Phenotype=Emb
  Coding regions on vcDNA: vcDNA=SeqID_49128; Strand=+; Position=1-792
LAKLPTIAAMIYRNLYRDGSSVGVLDPNKDWSANFCHMLGYTEREFVELMRLYLVIHSDHEGGNVSAHTCHLVGSALSDPYLSFAASMAGLAGPLHGLANQEVLVFLTKMVADIGHEYSEQQLKEWVWNHLKSGQVVPGYGHAVLRKTDPRYTCQREFALKHLPDDPMFKLVSTLYKVTPDILLEQGKAKNPWPNVDAHSGVLLQHYGMHEMSYYTVLFGVSRALGCLSQLIWARGMGPPLERPKSHSTDGLIKLAAAATAAK

SEQ ID NO: 122706 - protein, 125 aa, Heterodera glycines
  Homolog annotation: Hit_ID=CAE68925.1; Match level="QueryCoverage =100%, HitCoverage=99%, E-value=5e-42, Identity=68%"; Hit description= Hypothetical protein CBG14904 [Caenorhabditis briggsae]
  Gene Ontology: Mol. function=hydrogen-exporting ATPase activity, phosphorylative mechanism; Cellular component=integral to synaptic vesicle membrane; Biological process=hydrogen transport
  Essential gene: C elegans homolog=F46F11.5; Phenotype=Emb
  Coding regions on vcDNA: vcDNA=SeqID_49129; Strand=+; Position=98-475
MASHTAGIQQLLAAEKRAAEKINDARKRKAQRLKQAKQEAQAEIDQYRHEREQRFREFEQNYLGTRDDIEAQIKQETEANLKAMDSNVAKNKQQVIVRLLQLVCDINPELHTNLQLQVKLFGKAA

SEQ ID NO: 122707 - protein, 182 aa, Heterodera glycines
  Homolog annotation: Hit_ID=AAB37628.1; Match level="QueryCoverage =99%, HitCoverage=99%, E-value=4e-66, Identity=65%"; Hit description =Hypothetical protein C43E11.9 [Caenorhabditis elegans] ref|NP _491342.1| nip7p (20.1 kD) (1E836) [Caenorhab
  Gene Ontology: Cellular component=cytosolic large ribosomal subunit (sensu Eukarya); Biological process=cell organization and biogenesis
  Essential gene: C elegans homolog=C43E11.9; Phenotype=Lva
  Coding regions on vcDNA: vcDNA=SeqID_49130; Strand=+; Position=20-568
MRPLTDEETEMLNNKLSNYIGRDNIRLLLEREDGAYAFRVHKDRVYYCSEQLARQAACVTRKKLFSVGTCLGKFTHSGKRFFLHITALDYLAPYAGGRVWLKPQAEQQFLYGNNVVKSGVSRMSDGVEANKGVIVYNMSDIPLGFGIVAKNTSDCRRADPTALVLLHQSDLGEYIRNEAMLT

SEQ ID NO: 122708 - protein, 360 aa, Heterodera glycines
  Homolog annotation: Hit_ID=NP_499741.1; Match level="QueryCoverage =95%, HitCoverage=57%, E-value=1e-122, Identity=61%"; Hit description= phosphomannomutase 45A (66.6 kD) (3O391) [Caenorhabditis elegans] emb|CAA16334.1| Hypothetical protein Y
  Gene Ontology: Biological process=growth
  Essential gene: C elegans homolog=Y43F4B.5a; Phenotype=Emb
  Coding regions on vcDNA: vcDNA=SeqID_49131; Strand=+; Position=2-1081
SFQGECHLLPSQVAPQTSSLRLTYSAFHGVGSKFVRRMFAEFGFPSENISYVKEQDKPDPDFGTVPFPNPEEGHRVLKLCIETANANDSTLLLVNDPDADRLQLAEKEANGEWRVFSGNEMGILLTWWAWTNWRAANPTADSSRVFVLHSAVSSQMVATMAKKEGFKAAHSLTGFKYIGNLAHKLRSEGNTVIAAWEESIGFTPGTTLDKDGVSSAAVFAEMANWLRTQKGVSLREQLFRLFSIYGFHLQRNSYWGVKSTEVTKKLFADLRSDYPETIGQNFDVKFVRDLTTGYDNAQPDDRAILPLSTSSEMVTFTLVDGRAGTLRASGTEPKVKYYIELRTEPGKEEKDLSSVLEQLD

SEQ ID NO: 122709 - protein, 312 aa, Heterodera glycines
  Homolog annotation: Hit_ID=CAE67373.1; Match level="QueryCoverage =54%, HitCoverage=77%, E-value=6e-55, Identity=64%"; Hit description =Hypothetical protein CBG12849 [Caenorhabditis briggsae]
  Gene Ontology: Biological process=body morphogenesis (sensu Nematoda)
  Essential gene: C elegans homolog=B0261.4; Phenotype=Age,Gro,Ste,WT
  Coding regions on vcDNA: vcDNA=SeqID_49132; Strand=+; Position=49-987
MVALFFSKFVVVPSSSSLGVSSSSAILSLVSLLSPVALPHRRSFAVVNNVKIVDPMDVRKDNVSTKKKDDGVAAEVRRKKKVYALAEFLDRPENWGKFGALDPSDRPGRSWTVEELRLKSNSDLHKLWYVLLKERNMLLSMDHAYKVRLRNMPNPERIDRVAESMERLEAVVHERNDAFLHLETGDSASPPKRTVTSFMGFTYDEYATEHYLPAEATGEKQYEQPMLDDQAHLMQVLWREKEQLKKEVALMDEYLYMDPERDGRNDMILTRPKRRYYDRVEDLPQNVVARWRKEREQFQPPTDPYAGKEDEE

SEQ ID NO: 122710 - protein, 143 aa, Heterodera glycines
  Homolog annotation: Hit_ID=CAE57569.1; Match level="QueryCoverage =98%, HitCoverage=99%, E-value=8e-61, Identity=77%"; Hit description =Hypothetical protein CBG00547 [Caenorhabditis briggsae]
  Gene Ontology: Mol. function=structural constituent of ribosome; Cellular component=cytosolic ribosome (sensu Eukarya); Biological process=protein biosynthesis
  Essential gene: C elegans homolog=F28C6.7a; Phenotype=Emb,Lva,Ste
  Coding regions on vcDNA: vcDNA=SeqID_49133; Strand=+; Position=45-476
MKLNPFVSSSARKSRKRHFNAPSHIRRRIMSAPLSKDLRNKHGVRSTPIRIDDEVTVTRGHYKGNAGRIMRVYRKKYVVHVDKITREKANGTTVHVGIHPSNVQITKLKMDKDRRSLLERKAAGRARVTGILKGKHTEETIEE

SEQ ID NO: 122711 - protein, 227 aa, Heterodera glycines
  Essential gene: C elegans homolog=K07B1.6a; Phenotype=Lva
  Coding regions on vcDNA: vcDNA=SeqID_49134; Strand=+; Position=1-684
VLLSSFCFLTSLTIFSSFCAVFIMSDDNCCGSVGARSPTGSISSSGSADYDVALSPTQLLAMAIKKRRHLLEDKQRDYQRELLHSHLIQNLCKFLGEGRARVRRHRRSSSRRKLVRHRRWDDDTSGNGDERGQQVVPDDSRSPSSSPNPSGIVFESTVQSDANFGGDGGGRGPRWLNKRSSHSDDDGPPMKRNRADSSEDGLTFIDLNQPCEVGKFDGEFADGGRIF

SEQ ID NO: 122712 - protein, 246 aa, Heterodera glycines
  Homolog annotation: Hit_ID=CAE71898.1; Match level="QueryCoverage =91%, HitCoverage=91%, E-value=3e-89, Identity=68%"; Hit description =Hypothetical protein CBG18956 [Caenorhabditis briggsae]
  Gene Ontology: Mol. function=arsenate reductase (thioredoxin) activity; Cellular component=mitochondrion; Biological process =electron transport
  Essential gene: C elegans homolog=F46E10.9; Phenotype=Dpy
  Coding regions on vcDNA: vcDNA=SeqID_49135; Strand=+; Position=15-752
MARSPLFLLSIFICTEFVLCAVKSKNLLNLNEENWRNILSGEWMMEFHAPWCPACKDLQKSWNSFADWSRDLNINVAEIDVTTNPGLSGRFLVTALPTIYHVKDGVFRLYAGPRDKNDFISFIEDKRWTSIDPLPSYKHPDSSQMGVVAVFFKLSMAVRDLHGHFVENVGVPAWASYAFFATVTLALGCVLGFIIVCIIDYVFPTGALKKKEAERRKEQTSAKKNAKESAEKANGQKEVLSDEKKS

SEQ ID NO: 122713 - protein, 133 aa, Heterodera glycines
  Homolog annotation: Hit_ID=CAE59649.1; Match level="QueryCoverage =100%, HitCoverage=100%, E-value=3e-40, Identity=58%"; Hit description=Hypothetical protein CBG03063 [Caenorhabditis briggsae]
  Gene Ontology: Mol. function=DNA-directed RNA polymerase activity; Cellular component=DNA-directed RNA polymerase II, holoenzyme; Biological process=transcription from Pol III promoter
  Essential gene: C elegans homolog=C06A1.5; Phenotype=Emb,Ste
  Coding regions on vcDNA: vcDNA=SeqID_49136; Strand=+; Position=29-430
MADDEDYDGGEMDGDEFMEEEPIEDLDAEHQAGEEEEGAENVQVINVSDKVASSNRVTTPFMTKYERARVLGTRALQIAMGAPVMVEIEGESDPLEIARKELKDQKIPIIIRRYLPDGSFEDWGIDELHITDW

SEQ ID NO: 122714 - protein, 262 aa, Heterodera glycines
  Homolog annotation: Hit_ID=NP_508479.1; Match level="QueryCoverage =100%, HitCoverage=39%, E-value=7e-82, Identity=56%"; Hit description= immunoglobulin-like, possibly N-myristoylated (68.5 kD) (XD318) [Caenorhabditis elegans] pir||T16777 hyp
  Essential gene: C elegans homolog=T02C5.3; Phenotype=Unclassified
  Coding regions on vcDNA: vcDNA=SeqID_49137; Strand=+; Position=1-786
GFGPVHIPNQGFRFYVECVRGTDGQCQQSAARRKTLHCAVQANPAANSFRWLKNGGPISGGNGPEFMIGTDMIGHSLQCAANNGLYGEELQSPAVYIDSYTAARLIQDNFQQVQSSAPFQQGNRVEMGQRVQMSCVVEGNPRPAVFWKLRRSNGQVVDAPCPQGLNGQYREVPPTQLPTGAAAVANSLAAQQSNSLIRLQAICDLQVANYSFSGQYWCSACSYVSQGLPECSPGQDAPGDRLLNIQVQGPPQQSETEPSVEQ

SEQ ID NO: 122715 - protein, 242 aa, Heterodera glycines
  Homolog annotation: Hit_ID=CAE61943.1; Match level="QueryCoverage =98%, HitCoverage=62%, E-value=8e-67, Identity=49%"; Hit description =Hypothetical protein CBG05941 [Caenorhabditis briggsae]
  Gene Ontology: Mol. function=structural constituent of ribosome; Cellular component=mitochondrial large ribosomal subunit; Biological process=protein biosynthesis
  Essential gene: C elegans homolog=F33D4.5; Phenotype=Emb,Lva
  Coding regions on vcDNA: vcDNA=SeqID_49138; Strand=+; Position=7-732
MHNQFLPLATALSSIRQYHSPSVYGKSDELLQLRIELNMTTEKATKFVSDSRQLVVLPHPFQHSEKRTILAFAGTKEAQQEVMLNGADIAIGPEMVKKILKGQFNMDDYDFCIAHTDMAKHILPLRGVIKTRFPTKINGGIGDDLNEILESFLSGINLTVRRDPTNKEWGLSEPLIGRLSMSDEQIEENVAVIVDTLCKMRKAVLGPFINRASLITASTGPQQSFFPVDVSPWEALPTEEEI

SEQ ID NO: 122716 - protein, 237 aa, Heterodera glycines
  Homolog annotation: Hit_ID=CAE58656.1; Match level="QueryCoverage =100%, HitCoverage=98%, E-value=7e-68, Identity=51%"; Hit description= Hypothetical protein CBG01825 [Caenorhabditis briggsae]
  Gene Ontology: Mol. function=3'-5' exoribonuclease activity; Cellular component=exosome (RNase complex); Biological process=rRNA processing
  Essential gene: C elegans homolog=B0564.1; Phenotype=Lva
  Coding regions on vcDNA: vcDNA=SeqID_49139; Strand=+; Position=32-742
MKVINEFGYRQDARTPSQIRNIVYQMGVYSHADGSAYIEQGETKVLCAVYGPHECRFRSRAKEDEAIVICQYSQATFSVPDRRNRPRGDRRGNSFSHLLERAFESVIFTNLYPRSQIDIFFELLEADGANLAACVNVASLALADAGIPLRGLLSAVECGSADGLPCADLSSREHSELVPRLTMATVGGKDEIVLMDMKNLLHKNHLPSLLQMGVNACAQVHICLETAVFKHVEASHP

SEQ ID NO: 122717 - protein, 233 aa, Heterodera glycines
  Homolog annotation: Hit_ID=CAE73772.1; Match level="QueryCoverage =77%, HitCoverage=36%, E-value=4e-35, Identity=43%"; Hit description =Hypothetical protein CBG21316 [Caenorhabditis briggsae]
  Gene Ontology: Mol. function=transcriptional repressor activity; Cellular component=nucleus; Biological process=negative regulation of transcription from Pol II promoter
  Essential gene: C elegans homolog=F21H11.3; Phenotype=Gro,Unc
  Coding regions on vcDNA: vcDNA=SeqID_49140; Strand=+; Position=79-780
MEKEEEGEKSMNDLVTASSPTEVRPASPPASSSVSVPPSAAGVPPSLYVRLPQPDDPFYFCALAVGLAAVPPITFGISGPPLHVFVQADGVTDAPKVELEDKQLWEEFHKFGNEMIITTSGRRIFPSMSVKLSGLDEKANYYVVMDIVPRDPNVWEFSDSRWAVARPINPPSAEELLTPLHIHPNSPASGEHWMRVGASFHRVKIATSNETNRAEFVRWLAQATGGGGENGCH

SEQ ID NO: 122718 - protein, 237 aa, Heterodera glycines
  Homolog annotation: Hit_ID=NP_741371.2; Match level="QueryCoverage =98%, HitCoverage=87%, E-value=5e-82, Identity=61%"; Hit description =ribosomal protein L7Ae/L30e/S12e/Gadd45 (30.2 kD) (4F154) [Caenorhabditis elegans] gb|AAK84600.1| Ribosom
  Gene Ontology: Mol. function=structural constituent of ribosome; Cellular component=cytosolic ribosome (sensu Eukarya); Biological process=protein biosynthesis
  Essential gene: C elegans homolog=Y24D9A.4a; Phenotype=Ste
  Coding regions on vcDNA: vcDNA=SeqID_49141; Strand=+; Position=9-719
STLFERRPRNFSIGQDIQPKRDLTRFVRWPKYILLQRQRAVLEKRLKIPPPINQFKFALDKPNTNQLFKLLNKYRPETRQAKKERLRQRAQDRADGKQEKLTKRPPVVHFGIKDVVKAVENKKASLVVIAHDVDPIEIVICLPAICRKFGVPYAIVKGKAFLGQVVYRKTTSAVCLCDVNPEDRNALKNLADVAVTNFNERGDELRKNWGGAIMSQRSQARQAKIEKARQRDVGQKV

SEQ ID NO: 122719 - protein, 225 aa, Heterodera glycines
  Homolog annotation: Hit_ID=NP_495681.3; Match level="QueryCoverage =98%, HitCoverage=52%, E-value=3e-57, Identity=47%"; Hit description =Spliceosome-Associated Protein, and actin related protein (47.5 kD) (sap-49C) [Caenorhabditis elegans] gb
  Gene Ontology: Mol. function=transporter activity; Cellular component= actin filament; Biological process=transport
  Essential gene: C elegans homolog=C08B11.6; Phenotype=Emb
  Coding regions on vcDNA: vcDNA=SeqID_49142; Strand=+; Position=147-821
MLSSQPTLIMDNGAYSIKAGYATDQSARIFPNTVFKSKGERKRIFVADELDQCTDRSALFFVLPFERGYLVNWDTQLQIWNRVFGTEGAGLGVDCQQCRLVLTDPNEVAFAFADNTDEIVFENYRFNAFLRTSASACTAQAHCSANNPCCVVVDSGHSFTHIVPFVGGQIVREGIVRIDIGGKALTNQLKDWISYRQLHMMDETYLVNCCKEDCCFVSTDFQRDM

SEQ ID NO: 122720 - protein, 119 aa, Heterodera glycines
  Homolog annotation: Hit_ID=CAE75361.1; Match level="QueryCoverage =99%, HitCoverage=100%, E-value=2e-49, Identity=79%"; Hit description= Hypothetical protein CBG23345 [Caenorhabditis briggsae]
  Gene Ontology: Mol. function=pre-mRNA splicing factor activity; Cellular component=nucleus; Biological process=mRNA splicing
  Essential gene: C elegans homolog=C52E4.3; Phenotype=Emb,Lva,Unc
  Coding regions on vcDNA: vcDNA=SeqID_49143; Strand=+; Position=74-433
MATAVKPRSEMSAEELAAKEQEEFNLGPLSVLTHSVRNHAQVLINCRNNKKLLGRVKAFDRHCNMVLEDVKEMWTELPKKGKGKKKSKPVARDRFIPKLFLRGDSVILVLKNPLANPDA

SEQ ID NO: 122721 - protein, 113 aa, Heterodera glycines
  Homolog annotation: Hit_ID=P53021; Match level="QueryCoverage=97%, HitCoverage=88%, E-value=2e-27, Identity=52%"; Hit description=Major sperm protein 1 gb|AAA29146.1| major sperm protein
  Essential gene: C elegans homolog=ZK546.6; Phenotype=Emb
  Coding regions on vcDNA: vcDNA=SeqID_49144; Strand=+; Position=1-342
QPFEIHLNSPFNIRTIYNFRLINTGSKRIGFAFKTTKPKRIFLNPPCGTVGVGDTVNVIITVAPFDPNNEDIKNDRVIVEWCNAPGPSDAVFNLDWFTENAVRNVRLNVVYNL

SEQ ID NO: 122722 - protein, 399 aa, Heterodera glycines
  Homolog annotation: Hit_ID=AAM81355.1; Match level="QueryCoverage =100%, HitCoverage=100%, E-value=1e-124, Identity=57%"; Hit description=heat shock protein 40 [Steinernema feltiae]
  Gene Ontology: Mol. function=Hsp70/Hsc70 protein regulator activity; Cellular component=cytosol; Biological process=protein folding
  Essential gene: C elegans homolog=F39B2.10; Phenotype=Emb,Spd
  Coding regions on vcDNA: vcDNA=SeqID_49145; Strand=+; Position=24-1223
MVKDKKYYYILEVNTSATDHDLKKAYRKLALKYHPDKNPNEGERFKLISQAYEVLSNPEKRKVYDEYGEEGLKGGGEGGGMHNPMDIFEMFFGGGGFRGGGEKPTKVRDTVHQLTVSLDKLYNGCTKHLRITRHILCPKCNGVGGAKEGVKQCENCRGRGLEIHNMQIGPGMIQRIQRACSECGGEGEINRNPCKHCGGKKRIKSEETIEVHIEKGMRDGQRLMFYGKGDQQPGLEPGNVIIVLDEEEHPVFTRRGTNLTLNMKLTLTEALCGCTKHVVTLDKRILSFTQLPGEVINHRDFYVIQGEGMPTHRHPDQKGDLIIQFFVDFPDKLPLQMKNMDLLRELLKDHEIEPEPETIGANAQNAIKLVPISEEMLRRRAHDEEASNGEPQAVRCATQ

SEQ ID NO: 122723 - protein, 272 aa, Heterodera glycines
  Homolog annotation: Hit_ID=CAE57911.1; Match level="QueryCoverage =98%, HitCoverage=84%, E-value=2e-93, Identity=63%"; Hit description =Hypothetical protein CBG00961 [Caenorhabditis briggsae]
  Gene Ontology: Mol. function=rRNA (adenine-N6N6-)-dimethyltransferase activity; Cellular component=nucleoplasm; Biological process=rRNA modification
  Essential gene: C elegans homolog=E02H1.1; Phenotype=Lva
  Coding regions on vcDNA: vcDNA=SeqID_49146; Strand=+; Position=38-853
MANKMKKKKKNAVATTTAGPQKDGGKFKQKGIKFNTEKGQHILKNPGVVHAIVEKSAVKGTDTVLEVGPGTGNLSMKLLDRAGRLIAYELDPKMVAELQKRVVGTPVQYKLRIIAGDVIKAAEWPPFDVCVSNLPYQISSPFIFRLLLQRPLPRYAVLMLQKEFADRLLAKPGSKVYCRLSVSVQLLATVEHLMRVKRSEFVPPPKVDSAVIRIQPRNPPPAINYKEWDGMLRIAFMRKNKTLSALFKQKQVVDVLRKNYAVVCGTKGKEVP

SEQ ID NO: 122724 - protein, 280 aa, Heterodera glycines
  misc_feature (255)..(255): Xaa can be any naturally occurring amino acid
  Homolog annotation: Hit_ID=NP_495227.1; Match level="QueryCoverage =89%, HitCoverage=48%, E-value=3e-36, Identity=34%"; Hit description =aRginyl aa-tRNA syntheTase (58.9 kD) (rrt-2) [Caenorhabditis elegans] gb|AAL02449.1| Arginyl aa-trna synt
  Gene Ontology: Mol. function=arginine-tRNA ligase activity; Cellular component=cytoplasm; Biological process=protein biosynthesis
  Essential gene: C elegans homolog=C29H12.1; Phenotype=Gro
  Coding regions on vcDNA: vcDNA=SeqID_49147; Strand=+; Position=15-854
MIQSGLCRLTPYELWAVCQPEVGLGREKITLRKGDGLNLYMNRDLASIYARHRLYNADKYYYLVDYGQTNHFNQLRLLLRIRGDDDLADRMEHVSFGRIIGLSTRNGKNDSVDFLIDQGAREADAYVHASPTMRAEPAELGTICRRLAESTLLFEIVFRHRNSHFTFSFRNSFRPGGTNALLLHEKFSRLRSLEHAQHEHMERIRALNADGEWKLNMEMREPGQKLARRIQEFDTVVLTAMKKMDPNPVAIYLLXLCNEIGTAMAALRVQDETIAVALPR

SEQ ID NO: 122725 - protein, 293 aa, Heterodera glycines
  misc_feature (275)..(275): Xaa can be any naturally occurring amino acid
  Homolog annotation: Hit_ID=NP_509821.1; Match level="QueryCoverage =100%, HitCoverage=67%, E-value=1e-117, Identity=71%"; Hit description=succinyl-coa ligase mitochondrial (47.4 kD) (XL516) [Caenorhabditis elegans] emb|CAA91981.1| Hypothetic
  Gene Ontology: Mol. function=succinate-CoA ligase (ADP-forming) activity; Cellular component=mitochondrion; Biological process =succinyl-CoA pathway
  Essential gene: C elegans homolog=C50F7.4; Phenotype=Sck
  Coding regions on vcDNA: vcDNA=SeqID_49148; Strand=+; Position=2-881
FSPNEVREKASQMIGYHLVTKQTTAEGRLCQAVLVSKRLFTRKEYYFSITLDRSTAGPILIGSSKGGVNIEEVAATDPDAIITIPININTGVTLQIAEDMATRMGFHDECRAQAADTIQRLYDLFIKSDGNLVEINPMVEDAEGNVVCMDCKFVVDPNAEFRQKELFKLKDSSQEDELEVRAQKANLNYIRLDGNIGCMVNGAGLAMATMDIIKLHGGEPANFLDVGGGATVEQVYEAFKIITADEKKVNAILVNIFGGIMRCDVIAQGIIKAAXSELDLKIPIVCRLQGTRV

SEQ ID NO: 122726 - protein, 154 aa, Heterodera glycines
  Homolog annotation: Hit_ID=XP_317466.1; Match level="QueryCoverage =99%, HitCoverage=96%, E-value=2e-44, Identity=58%"; Hit description =ENSANGP00000012302 [Anopheles gambiae] gb|EAA12435.2| ENSANGP00000012302 [Anopheles gambiae str. PEST]
  Gene Ontology: Biological process=cell cycle
  Essential gene: C elegans homolog=H06I04.4a; Phenotype=Ste
  Coding regions on vcDNA: vcDNA=SeqID_49149; Strand=+; Position=43-507
EKMFVKTFSNKTVVFNVDPTELSVEQLKALIAEEEEIAVPDQRLVFAGCQLVDGTLLRTYGVDADSTIHLDLRLLGGGKKRKKKQYTGPKKQKHVRKKVKLAVLKLYKIDDNGKIHRQRLECNSASCGAGIFMAKHKDGRFYCGKCHQTLKEKK

SEQ ID NO: 122727 - protein, 158 aa, Heterodera glycines
  Homolog annotation: Hit_ID=JC4382; Match level="QueryCoverage=100%, HitCoverage=39%, E-value=1e-82, Identity=88%"; Hit description =ribosomal protein L3.e, cytosolic - Toxocara canis gb|AAA92285.1| ribosomal protein L3 sp|P49149|RL3_TOXCA 60
  Gene Ontology: Mol. function=structural constituent of ribosome; Cellular component=cytosolic large ribosomal subunit (sensu Eukarya); Biological process=protein biosynthesis
  Essential gene: C elegans homolog=F13B10.2a; Phenotype=Emb,Ste
  Coding regions on vcDNA: vcDNA=SeqID_49150; Strand=+; Position=1-580
CIGVTRGKGFKGVTSRWHCKKLPRKTHKGLRKVACIGAWHPSRVSFTVARAGQKGYHHRTEINKKIYRIGKSCLTADGKKNGMTDFDITEKNINPMGGFPHYGLVNQDFLMIRGCCIGCKKRPITLRKTLIKQTKRFAFEKINLKFIDTSSKFGHGRF

SEQ ID NO: 122728 - protein, 184 aa, Heterodera glycines
  Homolog annotation: Hit_ID=NP_501220.1; Match level="QueryCoverage =99%, HitCoverage=20%, E-value=3e-29, Identity=35%"; Hit description =aminopeptidase (100.0 kD) (4I310) [Caenorhabditis elegans] gb|AAB03152.1| Puromycin-sensitive aminopeptid
  Gene Ontology: Mol. function=aminopeptidase activity; Cellular component=cytosol
  Essential gene: C elegans homolog=F49E8.3; Phenotype=Emb
  Coding regions on vcDNA: vcDNA=SeqID_49151; Strand=+; Position=2-553
AEDKFIVDEVKSNEWVKVNSNFSSFFRVQYSPNMLQSLLDGVKNRELGVLDRYQLASDLYALVKSSRVSVSHFLALLTVCQEEEDYFVWSAIDSGIGSIAHSLKHLDDERKLLDRFERFVCKMIESVAAKLGWEPKEGETIHVGRLRALLLSRLSHFRHQPTIQMALSKFNALIEKGVDVVPDL

SEQ ID NO: 122729 - protein, 112 aa, Heterodera glycines
  Homolog annotation: Hit_ID=A45618; Match level="QueryCoverage=61%, HitCoverage=14%, E-value=2e-32, Identity=95%"; Hit description =translation elongation factor eEF-1 alpha chain - nematode (Onchocerca volvulus) sp|P27592|EF1A_ONCVO ELONGATI
  Gene Ontology: Mol. function=translation factor activity, nucleic acid binding
  Essential gene: C elegans homolog=R03G5.1a; Phenotype=Emb,Lva,Unc
  Coding regions on vcDNA: vcDNA=SeqID_49152; Strand=+; Position=3-338
VASDSKNDPAKETKSFTAQVIIMNHPGQIAAGYTPVLDCHTAHIACKFAELKEKVDRRSGKKVEDNPKNPLHPFVLSLFFAIPSTSVSIHIVVTLDNVHFFVVVLVGKINLA

SEQ ID NO: 122730 - protein, 167 aa, Heterodera glycines
  Homolog annotation: Hit_ID=EAK89192.1; Match level="QueryCoverage =93%, HitCoverage=3%, E-value=2e-44, Identity=56%"; Hit description =very large probable mucin, 11700 aa long protein with signal peptide and pronounced Thr repeat (308 aa long
  Gene Ontology: Mol. function=cell adhesion receptor activity; Cellular component=cell wall (sensu Fungi); Biological process =agglutination during conjugation with cellular fusion
  Essential gene: C elegans homolog=ZK945.9; Phenotype=Gro
  Coding regions on vcDNA: vcDNA=SeqID_49153; Strand=+; Position=43-543
MFYQTVCLLLLLSASNDVAVFGQEETTTTSTSSTSTSTTSSTSTSTTPTTTSSTSTSTTPSTTTSSTSTSTSTTPTTTSSTSTSTTPTTTSSTSTSTTPTTTSSTSTSTTPSTTTSSTSTSTSTTPTTTSSTSTSTTPTTTSSTSTSTTPTTTSSTSTSTTPTTTSS

SEQ ID NO: 122731 - protein, 49 aa, Heterodera glycines
  misc_feature (21)..(21): Xaa can be any naturally occurring amino acid
  Homolog annotation: Hit_ID=AAH44025.1; Match level="QueryCoverage =97%, HitCoverage=7%, E-value=1e-11, Identity=66%"; Hit description =Atp6a1-prov protein [Xenopus laevis]
  Gene Ontology: Cellular component=proton-transporting two-sector ATPase complex; Biological process=transport
  Essential gene: C elegans homolog=Y49A3A.2; Phenotype=Emb,Ste
  Coding regions on vcDNA: vcDNA=SeqID_49154; Strand=+; Position=3-153
IRDHLGDIIHELSSMKFEDPXKKTEDQIKKDYEELYERMQNKFRALEDE

SEQ ID NO: 122732 - protein, 398 aa, Heterodera glycines
  Homolog annotation: Hit_ID=NP_501972.1; Match level="QueryCoverage =100%, HitCoverage=74%, E-value=1e-108, Identity=48%"; Hit description=flavin-containing monooxygenase (60.1 kD) (fmo-12) [Caenorhabditis elegans] emb|CAA94290.1| Hypothetica
  Gene Ontology: Mol. function=monooxygenase activity; Cellular component=integral to membrane; Biological process=gametogenesis
  Essential gene: C elegans homolog=Y39A1A.19; Phenotype=Ste,Stp
  Coding regions on vcDNA: vcDNA=SeqID_49155; Strand=+; Position=2-1195
YSAHFGLLKHIQFQTEVLNVQRVEEFAQNGKWTVTYRKTEDEEQKVMDDTFDGVMLCTGHHCSERWPNPPFPGQSVFRGQVIHSRAFHTAKPFEDQTVVVVGIGNSGGDIAVELSKVAKKVYLSTRTGSWVINRVWEKGHPTDAVLLNRFAFALRAITPRSVQNRLIERKLNLRLDHERYGLRPSHRFLEAHVTVNDELPNRIASGTVVIKPNIQKLAEKDVTFDDGTTVYGVDTVIFATGYNFFFPQLENGRLISVQDNKTLLYKLMFPHDLSPKNTLAIIGLIQPTGSIMPISEMQARLFCAQLVGDISLPQKAQMEADALAQARRISKEFVNRPRHTIQVQYVDYMDELAKLVGCKPKLVGRIFTDPCLAKVLLFNGLVPYQFRLDGPHRWEGAR

SEQ ID NO: 122733 - protein, 179 aa, Heterodera glycines
  Homolog annotation: Hit_ID=AAR89617.1; Match level="QueryCoverage =98%, HitCoverage=83%, E-value=2e-74, Identity=76%"; Hit description =40S ribosomal protein S5 [Capsicum annuum]
  Gene Ontology: Mol. function=structural constituent of ribosome; Cellular component=cytosolic small ribosomal subunit (sensu Eukarya); Biological process=protein biosynthesis
  Essential gene: C elegans homolog=T05E11.1; Phenotype=Ste
  Coding regions on vcDNA: vcDNA=SeqID_49156; Strand=+; Position=3-539
EVENVKLFNRWSYETIEVKDVSLQDYISVTQHPVYLPHTAGRYQVKRFRKSQCPIVERLACSLMMHGRNNGKKLMAVRIVKHAFEIINLLTDLNPIQVLVDAVQNTGPREDSTRIGSQGTVRRQAVDVSPLPRVNQAGHLLTTGAKEAAFPNVKTIAKCLADELINAAKGSSHSYAIKK

SEQ ID NO: 122734 - protein, 237 aa, Heterodera glycines
  Homolog annotation: Hit_ID=NP_498111.2; Match level="QueryCoverage =100%, HitCoverage=44%, E-value=1e-127, Identity=96%"; Hit description=ATP synthase subunit (57.5 kD) (atp-2) [Caenorhabditis elegans] gb|AAA19068.2| Atp synthase subunit pro
  Gene Ontology: Mol. function=transporter activity; Cellular component= proton-transporting ATP synthase, catalytic core (sensu Eukarya); Biological process=energy pathways
  Essential gene: C elegans homolog=C34E10.6; Phenotype=Emb
  Coding regions on vcDNA: vcDNA=SeqID_49157; Strand=+; Position=3-713
LLAPYSKGGKIGLFGGAGVGKTVLIMELINNVAKAHGGFSVFAGVGERTREGNDLYHEMIEGGVIDLKGKNSKVSLVYGQMNEPPGARARVCLTGLSVAEYFRDKEGQDVLLFIDNIFRFTQAGSEVSALLGRIPSAVGYQPTLATDMGSMQERITTTKKGSITSVQAIYVPADDLTDPAPATTFAHLDATTVLSRGIAELGIYPAVDPLDSTSRIMDPNIVGNRHYDIARGVQKIL

SEQ ID NO: 122735 - protein, 214 aa, Heterodera glycines
  Homolog annotation: Hit_ID=NP_491370.1; Match level="QueryCoverage =95%, HitCoverage=54%, E-value=6e-56, Identity=53%"; Hit description =eukaryotic Initiation Factor (41.0 kD) (eif-3.H) [Caenorhabditis elegans] gb|AAC48137.2| Eukaryotic initi
  Gene Ontology: Mol. function=translation factor activity, nucleic acid binding; Cellular component=eukaryotic translation initiation factor 3 complex; Biological process=positive regulation of growth rate
  Essential gene: C elegans homolog=C41D11.2; Phenotype=Emb,Gro
  Coding regions on vcDNA: vcDNA=SeqID_49158; Strand=+; Position=72-713
MANPSINAKAAVLVDNPRVEFVQLDSLVVMKIVKHGDIEFYAGMSKIAGETCQGILTGLISVEDKRLEVTNCFSITRPDALHESEESAAGPETSLSDENKQGEILDMLKRFRMMNIDYESVGFYQAHPFGACFSHELLGSLVDYQSDISDAVVIVYDPVKTRQGCLTLRAYRLSKKALDLAITCDDSWSPEQTKLAGVNFANFFEELPIVVKTA

SEQ ID NO: 122736 - protein, 178 aa, Heterodera glycines
  Homolog annotation: Hit_ID=CAE63488.1; Match level="QueryCoverage =92%, HitCoverage=28%, E-value=9e-53, Identity=59%"; Hit description =Hypothetical protein CBG07956 [Caenorhabditis briggsae]
  Gene Ontology: Mol. function=pre-mRNA splicing factor activity; Cellular component=nuclear matrix; Biological process=mRNA splicing
  Essential gene: C elegans homolog=F28D9.1; Phenotype=Sck
  Coding regions on vcDNA: vcDNA=SeqID_49159; Strand=+; Position=1-534
FRCLQFIEIDAGFYRGTSSEQDIRFTDKERKLLRQMKFENVLETKVDLAKINLDVIKPWITLKLNEILGMEDDVVVEYVFTQLEEKELNPKKMQINLTGFLNARRAREFMAEMWQMFVEAQDSPEGIPTSLVEKKVQELKASNSNKQPMQTYHKATEVDWNQRYQTLTGGRYGKMDPK

SEQ ID NO: 122737 - protein, 152 aa, Heterodera glycines
  Homolog annotation: Hit_ID=CAE69555.1; Match level="QueryCoverage =78%, HitCoverage=67%, E-value=5e-28, Identity=50%"; Hit description =Hypothetical protein CBG15767 [Caenorhabditis briggsae]
  Gene Ontology: Cellular component=integral to membrane
  Essential gene: C elegans homolog=Y37D8A.10; Phenotype=Emb
  Coding regions on vcDNA: vcDNA=SeqID_49160; Strand=+; Position=97-552
MAPKEKEVGKGWSFAHFFWHLIKKETRNEKERHILANGRLALSFLAVAFAGFALLYDYFFPFPKSKIILAVCSISYFVMIMVLQAYQWYVEKLTFFQAEEKTTDNGEPRHWKWSSDMKRYDDKYVLIAEYSQGTRTGSMKGANRWLLYHGGW

SEQ ID NO: 122738 - protein, 442 aa, Heterodera glycines
  Homolog annotation: Hit_ID=AAO14563.2; Match level="QueryCoverage =100%, HitCoverage=61%, E-value=0.0, Identity=99%"; Hit description =Hsp90 [Heterodera glycines]
  Gene Ontology: Biological process=reproduction
  Essential gene: C elegans homolog=C47E8.5; Phenotype=Emb,Ste
  Coding regions on vcDNA: vcDNA=SeqID_49161; Strand=+; Position=3-1331
KPIWTRNPDDISNEEYAEFYKSLSNDWEDHLAVKHFSVEGQLEFRALLFVPQRAPFDLFENKKSKNAIKLYVRRVFIMENCEELMPEYLNFIKGVVDSEDLPLNISRETLQQSKILKVIRKNLVKKCMDLFEEISEDKDNFKKFYEQFAKNIKLGIHEDSVNRKKLSDFLRYYTSASGEEPCSFKDYVSRMKENQTCIYYITGESKDVVQNSSFVERVKKRGFEVIYMVDPIDEYCVQQLKEYDGKKLVSVTKEGLELPESEEEKKKFEEDKVKFEKLCKVIKDILDKKVQKVSVSNRLVSSPCCIVTGEYGWSANMERIMKAQALRDSSTMGYMASKKNLEINPDHSIIKSLRDRVEKEQDDKTAKDLVVLLYETSLLTSGFSLEDPQQHASRIYRMVKLGLDIPDEEEPAEQQPSTSGEPTIAEKIAGAEEEASRMEEVD

SEQ ID NO: 122739 - protein, 142 aa, Heterodera glycines
  Homolog annotation: Hit_ID=CAE72582.1; Match level="QueryCoverage =80%, HitCoverage=65%, E-value=1e-31, Identity=59%"; Hit description =Hypothetical protein CBG19770 [Caenorhabditis briggsae]
  Gene Ontology: Biological process=positive regulation of growth rate
  Essential gene: C elegans homolog=W09C5.8; Phenotype=Age,Gro,Ste
  Coding regions on vcDNA: vcDNA=SeqID_49162; Strand=+; Position=124-549
MIYHLLDLVRMGILTASKVCTLPRLSSARSMTWWWGPEKNNGRELVGPTFHGDEFYQDRLDRWYPSIRFRKNEEVITPIRHKELGDWKKLSIEEKKLIYRYSFRQTLAEFEALTPYGYLTVTLFFSMLGLTILYASFVRTYV

SEQ ID NO: 122740 - protein, 327 aa, Heterodera glycines
  Homolog annotation: Hit_ID=CAE70646.1; Match level="QueryCoverage =98%, HitCoverage=93%, E-value=2e-52, Identity=34%"; Hit description =Hypothetical protein CBG17349 [Caenorhabditis briggsae]
  Gene Ontology: Mol. function=zinc ion binding; Cellular component =integral peroxisomal membrane; Biological process=peroxisome organization and biogenesis
  Essential gene: C elegans homolog=F08B12.2; Phenotype=Lva,Unclassified
  Coding regions on vcDNA: vcDNA=SeqID_49163; Strand=-; Position=41-1024
MTLPSIFEYLAQESLSGSMKQGIRSVLNLFSHFSGRRLSFVDSHFDELFLLLHLFLENRFLKRFSASFSENFYGMKRVPWRMNASSFSRLGHRFRSLFLIVVLPYIHDKFERLSEQIESERDAIRQKGWRRLFLRFYPSLKALLFLVTLLLQLAFVFSFSSVPSLSLLLAKCRLEKLTLSDVAQFDAEGQLPFHLRRTNVFARLWRSLVSLPSTLGRLFTYALFLVQFLEYFYSDELGRRFGQFVEGRRNIRIPTHPFNNLPTEQQTLCMEVDKCPICRRIRKNDTVLTVSGYVFCHSCIFNFVRIEHCCPITSLPATSSELVKIYN

SEQ ID NO: 122741 - protein, 158 aa, Heterodera glycines
  Homolog annotation: Hit_ID=CAE64104.1; Match level="QueryCoverage =71%, HitCoverage=34%, E-value=1e-25, Identity=56%"; Hit description =Hypothetical protein CBG08713 [Caenorhabditis briggsae]
  Gene Ontology: Mol. function=ATP binding; Biological process=mitotic spindle positioning and orientation
  Essential gene: C elegans homolog=T26E3.3; Phenotype=Emb,Gro
  Coding regions on vcDNA: vcDNA=SeqID_49164; Strand=+; Position=3-479
KGIFISRLVEGGLAESTGLLSVGDEVVEVNGIEVNGKKLDQVADMMVANAHNLIVTIKPANQRNSLQRKGKADQFAVQSQYHQYFTGDGSSSSAVGKIGTFGSGGGGKVYPTGHGSSLYHLGTDRHHHHQMDEFFDDYAEDEDEDEIVDHTKTALKIH

SEQ ID NO: 122742 - protein, 178 aa, Heterodera glycines
  Homolog annotation: Hit_ID=NP_506378.1; Match level="QueryCoverage =96%, HitCoverage=35%, E-value=2e-30, Identity=40%"; Hit description =splicing factor 3a 60kDa like (5O109) [Caenorhabditis elegans] emb|CAB54256.5| Hypothetical protein F53F4
  Gene Ontology: Biological process=protein modification
  Essential gene: C elegans homolog=F53F4.14; Phenotype=Emb
  Coding regions on vcDNA: vcDNA=SeqID_49165; Strand=+; Position=1-534
ISINFFTKSDIESVNFINHLPEKLYFLESDGQVFHNLNDIDDGKLIQLHFRACGGKGGFGSLLRSFRIHKSSNQLMCRNLQGRRLADVREEERLKKYIAKKAEREKEKQKKKDEKIERLKAGRETKHQFEDQKHLRKRDTLLDESEDAVEAGMDALEVKAASSEHEVSETIADTEPVA

SEQ ID NO: 122743 - protein, 186 aa, Heterodera glycines
  Homolog annotation: Hit_ID=CAE62054.1; Match level="QueryCoverage =100%, HitCoverage=35%, E-value=9e-71, Identity=70%"; Hit description= Hypothetical protein CBG06072 [Caenorhabditis briggsae]
  Gene Ontology: Mol. function=glucose-6-phosphate 1-dehydrogenase activity; Cellular component=cytoplasm; Biological process=pentose -phosphate shunt
  Essential gene: C elegans homolog=B0035.5; Phenotype =Emb,Gro,Unclassified
  Coding regions on vcDNA: vcDNA=SeqID_49166; Strand=+; Position=1-558
LVVLRFGNRFISRSWSRDDIASVTISFKENFGTQGRGGYFDKSGIIRDVMQNHLMQILTLVVMEKPATLSAEDIRNEKVKVLKVIKPVELDQTVLGQYIGNPLGKDDDSRKGYLDDPTVPRGSTTPTFATAVLFVHNERWEGVPFFLRCGKALNERKAEVRIQYKDVSGDIFPEDSLKRNELVIRV

SEQ ID NO: 122744 - protein, 103 aa, Heterodera glycines; identical to SEQ ID NO: 119330
  Homolog annotation: Hit_ID=NP_509231.1; Match level="QueryCoverage =100%, HitCoverage=100%, E-value=3e-52, Identity=99%"; Hit description=histone (his-38) [Caenorhabditis elegans] ref|NP _507034.1| histone (his-1) [Caenorhabditis elegans] ref
  Essential gene: C elegans homolog=ZK131.1; Phenotype=Unclassified
  Coding regions on vcDNA: vcDNA=SeqID_49167; Strand=+; Position=38-349

SEQ ID NO: 122745 - protein, 158 aa, Heterodera glycines
  Homolog annotation: Hit_ID=EAK89192.1; Match level="QueryCoverage =93%, HitCoverage=3%, E-value=2e-41, Identity=57%"; Hit description =very large probable mucin, 11700 aa long protein with signal peptide and pronounced Thr repeat (308 aa long
  Gene Ontology: Mol. function=cell adhesion receptor activity; Cellular component=cell wall (sensu Fungi); Biological process =agglutination during conjugation with cellular fusion
  Essential gene: C elegans homolog=ZK945.9; Phenotype=Gro
  Coding regions on vcDNA: vcDNA=SeqID_49168; Strand=+; Position=43-516
MSYQTVCLLLLLSASNDVAVFGQEETTTTSTSSTSTSTTSSTSTSTTPTTTSSTSTSTTPSTTTSSTSTSTSTTPTTTSSTSTSTTPTTTSSTSTSTTPTTTSSTSTSTTPTTTSSTSTSTTPTTTSSTSTSTIPTTTSSTSTSTTPTTTTSTSTSTT

SEQ ID NO: 122746 - protein, 236 aa, Heterodera glycines
  Homolog annotation: Hit_ID=NP_499076.1; Match level="QueryCoverage =81%, HitCoverage=53%, E-value=4e-51, Identity=49%"; Hit description =tyrosine phosphatase (41.1 kD) (3K532) [Caenorhabditis elegans] emb|CAA80156.1| Hypothetical protein F54C
  Gene Ontology: Mol. function=protein tyrosine phosphatase activity; Cellular component=nucleus; Biological process=RNA processing
  Essential gene: C elegans homolog=F54C8.4; Phenotype=Emb
  Coding regions on vcDNA: vcDNA=SeqID_49169; Strand=+; Position=75-782
WSEHLWKIPTDWIKYQPLGASIEGSRIFAFKTPLLPELQTSIPKECRFSTLTLLQQLAFSNRSLGLVINCNNTKRYFCRRDIEGLGICYKEIPCPGRGFLYRTDAVKTFIKTIDDFLELNSDNDLLIAVCCSNGINRSGYLICNYLINRLGWSSHDALNAFESARGYSIERGSYVQALHKVDRERRSKTMPFGLDRSEHEMGNDEALPAKTDQLLPGISDFNPQLTAQMMQQFFNM

SEQ ID NO: 122747 - protein, 215 aa, Heterodera glycines
  Homolog annotation: Hit_ID=AAA82343.2; Match level="QueryCoverage =100%, HitCoverage=50%, E-value=7e-84, Identity=69%"; Hit description= Adaptin or adaptin-related protein protein 7 [Caenorhabditis elegans]
  Gene Ontology: Cellular component=AP-1 adaptor complex; Biological process=ommochrome biosynthesis
  Essential gene: C elegans homolog=F53H8.1; Phenotype=Unclassified
  Coding regions on vcDNA: vcDNA=SeqID_49170; Strand=+; Position=1-648
GHIDCCCKLSGMPDLSMTLSNSRILDDVPFHPCIRFRRWENDRILSFVPPDGNFRLLSYHISHQSVVAIPLYVRHNILLKNGTAGRFELMVSPKQSMGKMLEDVALECQMPKGVQNCNLMASHGKVAFDPTTRLLQWTVGKIEIGKPPTLKGTVSTSGNSAKEQLESPQITAKFKISQLAASGLKVICLDIYGEAYKPFKGVKYVTKAGKFQIRT

SEQ ID NO: 122748 - protein, 95 aa, Heterodera glycines
  Homolog annotation: Hit_ID=CAE71150.1; Match level="QueryCoverage =96%, HitCoverage=42%, E-value=3e-24, Identity=55%"; Hit description =Hypothetical protein CBG18006 [Caenorhabditis briggsae]
  Essential gene: C elegans homolog=T04A8.11; Phenotype=Lva
  Coding regions on vcDNA: vcDNA=SeqID_49171; Strand=+; Position=1-288
HHYETPVRTGRIILELGGYITEQEARSILMHLYLHMPFPVEFVSQELMDKRKGLEMKVRANNRNKFDWDTLIKYNMQNCKAWLSPYDVYWKCRYE

SEQ ID NO: 122749 - protein, 175 aa, Heterodera glycines
  misc_feature (115)..(115): Xaa can be any naturally occurring amino acid
  Homolog annotation: Hit_ID=CAE63488.1; Match level="QueryCoverage =100%, HitCoverage=27%, E-value=2e-48, Identity=54%"; Hit description= Hypothetical protein CBG07956 [Caenorhabditis briggsae]
  Gene Ontology: Mol. function=pre-mRNA splicing factor activity; Cellular component=nuclear matrix; Biological process=mRNA splicing
  Essential gene: C elegans homolog=F28D9.1; Phenotype=Sck
  Coding regions on vcDNA: vcDNA=SeqID_49172; Strand=+; Position=28-552
MDAGFYRGTSSEQDIRLTDKERKLLRQMKFENVLETKVDLAKINLDVIKPWITLKLNEILGMEDDVVVEYVFTQLEEKELNPKKMQINLTGFLNARRAREFMVFFHLLDHLLSFXAEMWQMFVEAQDSPEGIPTSLVEKKVQELKASNSNKQPMQTYHKATEVDWNQRYQTLTGG

SEQ ID NO: 122750 - protein, 184 aa, Heterodera glycines
  Homolog annotation: Hit_ID=CAE67745.1; Match level="QueryCoverage =91%, HitCoverage=55%, E-value=1e-54, Identity=59%"; Hit description =Hypothetical protein CBG13320 [Caenorhabditis briggsae] emb|CAE67740.1| Hypothetical protein CBG13315 [Cae
  Gene Ontology: Mol. function=transcription factor activity; Cellular component=nucleus; Biological process=regulation of transcription, DNA-dependent
  Essential gene: C elegans homolog=Y56A3A.20; Phenotype=Emb
  Coding regions on vcDNA: vcDNA=SeqID_49173; Strand=+; Position=302-853
MTVTSTKNNSFPSSFKDITLHDVWASNLEAEFAKLRDLIDDYPFVAMDTEYPGVIATPVGQFRSKEDFNYQQLRLNVDCLKLIQVGFTLMNEKGQLPPARDIFQFNLHFDPSTDSFAHNSLELLKTAGFDFNKHQNGGHQIGRTLGELLTTSGLVVEPRITWLTFHSCFDFGYLIRAIMLVKLP

SEQ ID NO: 122751 - protein, 140 aa, Heterodera glycines
  Homolog annotation: Hit_ID=NP_495286.1; Match level="QueryCoverage =95%, HitCoverage=80%, E-value=5e-28, Identity=48%"; Hit description =ATP synthase H+ transporting mitochondrial F1 complex (16.9 kD) (2G673) [Caenorhabditis elegans] gb|AAC46
  Gene Ontology: Mol. function=hydrogen-transporting ATP synthase activity, rotational mechanism; Cellular component=proton -transporting ATP synthase, central stalk (sensu Eukarya); Biological process=ATP synthesis coupled proton transport
  Essential gene: C elegans homolog=F58F12.1; Phenotype=Emb,Lva
  Coding regions on vcDNA: vcDNA=SeqID_49174; Strand=+; Position=37-459
MTSIRGLLFTLASPLKAFYANVAVKQIDVTGMSSSVGILPTHVPTIAVLKPGVVKVHELDGNVSKFFASSGTLSMNIDGSCQVLAEELCSLSELNEQAIKNLIDVSQKKASDLNATDVQKAEAGISIEVAEAALRAISEK

SEQ ID NO: 122752 - protein, 205 aa, Heterodera glycines
  misc_feature (205)..(205): Xaa can be any naturally occurring amino acid
  Homolog annotation: Hit_ID=NP_501180.1; Match level="QueryCoverage =98%, HitCoverage=38%, E-value=6e-68, Identity=64%"; Hit description =phosphate (57.5 kD) (4I161) [Caenorhabditis elegans] gb|AAB03157.2| Hypothetical protein C48A7.2 [Caenorh
  Gene Ontology: Mol. function=sodium:phosphate symporter activity; Cellular component=integral to plasma membrane; Biological process =hermaphrodite genital morphogenesis
  Essential gene: C elegans homolog=C48A7.2; Phenotype=Pvl,Stp
  Coding regions on vcDNA: vcDNA=SeqID_49175; Strand=+; Position=81-695
MALLEEGKTEQNGDEPSTKVKMAENGGGGGAEVAQNKFGSSSIRPASSVLSFFRSSKPEDPYASKLFTFLQVLTACFSGFAHGGNDVSNAIAPLVSLYTIYDEGSVHQKGETSVYLLLYGAAGMCVGLWLLGHRVIYTVGENLTRITPPSGFSIEFGAALTVLFASKLGLPISSTQCKVGSVVAVGLVQAHPVVHWTVFRNISLX

SEQ ID NO: 122753 - protein, 112 aa, Heterodera glycines
  misc_feature (31)..(31): Xaa can be any naturally occurring amino acid
  Homolog annotation: Hit_ID=CAE67341.1; Match level="QueryCoverage =99%, HitCoverage=97%, E-value=2e-21, Identity=42%"; Hit description =Hypothetical protein CBG12804 [Caenorhabditis briggsae]
  Gene Ontology: Cellular component=integral to endoplasmic reticulum membrane; Biological process=proteolysis and peptidolysis
  Essential gene: C elegans homolog=C34B2.10; Phenotype=Lva,Lvl,Unc
  Coding regions on vcDNA: vcDNA=SeqID_49176; Strand=+; Position=20-359
MLEVVLEYLPSWIRTLNSFIDYEGQRKSERXFQVILIVHGVLGFFAGYLTQQLSVTMYSVGVGFLISCLIVLPPWPFYRQNPLNWQPNSPVEEDKAANPSSSSGNKNSKKTR

SEQ ID NO: 122754 - protein, 216 aa, Heterodera glycines
  Homolog annotation: Hit_ID=CAB62552.1; Match level="QueryCoverage =100%, HitCoverage=95%, E-value=1e-114, Identity=98%"; Hit description=vacuolar ATPase subunit E [Heterodera schachtii] sp|Q9U1G5|VATE_HETSC Vacuolar ATP synthase subunit E (V
  Gene Ontology: Mol. function=hydrogen-transporting ATPase activity, rotational mechanism; Cellular component=vacuolar membrane (sensu Fungi); Biological process=proton transport
  Essential gene: C elegans homolog=C17H12.14; Phenotype=Emb,Lva
  Coding regions on vcDNA: vcDNA=SeqID_49177; Strand=+; Position=57-704
MGISDNDVQKQLRHMMAFIEQEANEKAEEIDAKAEEEFNIEKGKLVQQQRQKIMEYYEKKEKQVELQRKIQRSNMQNQSRLKCLKARDDHLKNVLEEARANLSKISADRERYPAILKGLLLQGLFQLLESKVVLRCRKKDEEMVARILPECLEEFQRTWGNRSEVKIDNEYFLSPESAGGVELLAKDGKIRVSSTLEARLDLIADKITPQVRTALF

SEQ ID NO: 122755 - protein, 115 aa, Heterodera glycines
  Homolog annotation: Hit_ID=NP_035423.1; Match level="QueryCoverage =99%, HitCoverage=97%, E-value=6e-42, Identity=69%"; Hit description =polymerase (RNA) II (DNA directed) polypeptide J [Mus musculus] sp|O08740|RPBY_MOUSE DNA-directed RNA pol
  Gene Ontology: Mol. function=DNA-directed RNA polymerase activity; Cellular component=DNA-directed RNA polymerase II, core complex; Biological process=transcription from Pol II promoter
  Essential gene: C elegans homolog=W01G7.3; Phenotype=Emb,Gro,Pvl
  Coding regions on vcDNA: vcDNA=SeqID_49178; Strand=+; Position=449-796
MNTPAAYEPFLLADGEKKVVIEKDTKVPNAAVFTFNKEDHTLGNLLKHQLLKDPKVLFAGYRNPHPLEHKILLRVQTNPETTPMEALNNAIEDLVAEFSLLEERFRDAIREKREE

SEQ ID NO: 122756 - protein, 181 aa, Heterodera glycines
  Homolog annotation: Hit_ID=NP_724611.1; Match level="QueryCoverage =99%, HitCoverage=47%, E-value=6e-47, Identity=48%"; Hit description =CG1882-PD, isoform D [Drosophila melanogaster] ref|NP_724610.1| CG1882-PC, isoform C [Drosophila melanoga
  Essential gene: C elegans homolog=C37H5.3a; Phenotype=Unclassified
  Coding regions on vcDNA: vcDNA=SeqID_49179; Strand=+; Position=2-544
FGGYLASSYALEHPSRVRHLVLVDPWGFPERPQIEQLHIPIWMRVFGRLLSLFNPLATLRAAGPFGARLVKKLRSDLGIRYAHQDPDAIYEYIYQCNAMEPTGEIAFGTMSKNFGWAKRPMINRFRGISPSVPVTFIWGGKSRMDPGPAYEIQYRRQDAYADVHIVTRAGHHVYADAPADF

SEQ ID NO: 122757 - protein, 145 aa, Heterodera glycines
  Homolog annotation: Hit_ID=CAE58558.1; Match level="QueryCoverage =100%, HitCoverage=87%, E-value=1e-69, Identity=82%"; Hit description= Hypothetical protein CBG01720 [Caenorhabditis briggsae]
  Gene Ontology: Mol. function=ubiquitin-like conjugating enzyme activity; Cellular component=chromosome; Biological process=growth
  Essential gene: C elegans homolog=F29B9.6; Phenotype =Emb,Gro,Pvl,Stp,Unc
  Coding regions on vcDNA: vcDNA=SeqID_49180; Strand=+; Position=112-546
MAGIAAGRLTEERKAWRKDHPFGFIARQCKKEDGTLDLYNWICAIPGPKSTIWEGGLYKLRMIFKDDFPSTPPKCRFEPPLFHPNVYPSGTVCLSLLDENKDWKPSITVKQLLLGIQELLVSPNPEDPAQAEAYQIYVQNRPEYE

SEQ ID NO: 122758 - protein, 354 aa, Heterodera glycines
  misc_feature (86)..(86): Xaa can be any naturally occurring amino acid
  misc_feature (320)..(320): Xaa can be any naturally occurring amino acid
  Homolog annotation: Hit_ID=NP_495011.1; Match level="QueryCoverage =99%, HitCoverage=58%, E-value=1e-150, Identity=73%"; Hit description= protein kinase C, iota/lambda/zeta type, component of a PDZ-mediated protein complex PAR-6/PAR-3/PKC-3 r
  Gene Ontology: Mol. function=atypical protein kinase C activity; Cellular component=apical cortex; Biological process=signal transduction
  Essential gene: C elegans homolog=F09E5.1; Phenotype=Emb
  Coding regions on vcDNA: vcDNA=SeqID_49181; Strand=+; Position=3-1065
LGIGLEDFELLTVIGRGSYAKVVQAEHKKTGQIYAIKIIKKSLVVTDEEDIGWIQTEKSVFETASNHPFLVGLHSCFQTDSRLFFXVIEFIPGGDLMFHMQRQQKLPEEHARFYSAEIILALHFLHSRGIIYRDLKLDNVLLDAEGHIKLTDFGMCKENIGPGDGTSTFCGTPNYIAPEILMGEEYGFSVDFWALGVLMFEMMAGRSPFHLPTTEEDEQTAEDLLFKMIMEHQIRIPRHLSVRAANVLKGFLNKSPSERLGCKTDLEEGLADIKMNSFFKSNIDWELLEQRQIAPPYNPNVSGDRDLQRFDTSFTNGNPXLTPDSPSFFARIDQSEFEGFEYVNPLIFNKEDAV

SEQ ID NO: 122759 - protein, 182 aa, Heterodera glycines
  Homolog annotation: Hit_ID=NP_496497.1; Match level="QueryCoverage =100%, HitCoverage=24%, E-value=8e-79, Identity=73%"; Hit description= threonyl tRNA Synthetase (84.4 kD) (trs-1) [Caenorhabditis elegans] emb|CAA93762.1| Hypothetical protein
  Gene Ontology: Mol. function=threonine-tRNA ligase activity; Cellular component=cytoplasm; Biological process=tRNA modification
  Essential gene: C elegans homolog=C47D12.6a; Phenotype=Emb,Lva
  Coding regions on vcDNA: vcDNA=SeqID_49182; Strand=+; Position=3-548
NAKLWEQSGHWHHYAENMFRFEIEKEQFGLKPMNCPGHCLMFDYKPHAYNELPIRYADFGVLHRNEMSGALSGLTRVRRFQQDDAHIFCRKDQILSEISGCLDFLNFVYVEVFGFSFRLHLSTRPEEGYLGDLATWEAAETQLKQALDNSGLKWELNPGDGAFYGPKIDIQIKDALGRHWQC

SEQ ID NO: 122760 - protein, 180 aa, Heterodera glycines
  misc_feature (174)..(174): Xaa can be any naturally occurring amino acid
  Homolog annotation: Hit_ID=CAB48391.1; Match level="QueryCoverage =99%, HitCoverage=89%, E-value=2e-78, Identity=76%"; Hit description =peroxiredoxin [Globodera rostochiensis]
  Gene Ontology: Mol. function=thioredoxin peroxidase activity; Cellular component=extracellular space; Biological process=response to oxidative stress
  Essential gene: C elegans homolog=F09E5.15; Phenotype=Sck,Sma
  Coding regions on vcDNA: vcDNA=SeqID_49183; Strand=+; Position=145-684
MSAGRANIGKPAPNFSAEAVVDFDFKTVSLDDYKGKYVVLFFYPEDFSFVCPTEIIAFSDRSNEFANINTQLLACSTDSKFCHFEWVSKPRKQGGLGEMQIPILADRTQRISRDYGVLKEDTGNAYRGLFIIDTKGILRQITINDTPVGRAIDETLRLVQAFQFTDEHGEVCPXNWKPGE

SEQ ID NO: 122761 - protein, 174 aa, Heterodera glycines
  Homolog annotation: Hit_ID=CAE71174.1; Match level="QueryCoverage =93%, HitCoverage=53%, E-value=7e-31, Identity=43%"; Hit description =Hypothetical protein CBG18031 [Caenorhabditis briggsae]
  Gene Ontology: Biological process=embryogenesis and morphogenesis
  Essential gene: C elegans homolog=F02E8.1; Phenotype=Lva
  Coding regions on vcDNA: vcDNA=SeqID_49184; Strand=+; Position=1-522
NPSIFQKIILLNKEIIIMEENFCCFVFGWINIYLFFHTAFRYKFEKYVYKVTRERFGKMKAYIDNELKEAIEFRKTSKEQADSLKAVHENFPTIFQENLALQLEATYRKNVDYAWQEMKRRLDYLQEVQAIKDRFSKEMMVKLITDGVRKQIEMNEGGIRDKYLDQCIEQLRVL

SEQ ID NO: 122762 - protein, 177 aa, Heterodera glycines
  Homolog annotation: Hit_ID=NP_506653.1; Match level="QueryCoverage =97%, HitCoverage=94%, E-value=5e-49, Identity=50%"; Hit description =putative endoplasmic reticulum protein, with a transmembrane domain (5P303) [Caenorhabditis elegans] emb|
  Essential gene: C elegans homolog=W06A7.2; Phenotype=Unc
  Coding regions on vcDNA: vcDNA=SeqID_49185; Strand=+; Position=69-602
MAQYVPWYYKRSPPIFCGVCVPVYLGVWSVRKFIVVLGFLLFLIGVLLLLGLLLICVAIECSAAAGALLPFALVLIIAGLLLLHCGWAAHLLDVGEGMPYGEYSTTKTVSTSTRTKRTAPKGEEEPVFEEIEGKQPPPEIKQGFWQFDEREAWQTVANPYPINYTLKPVIERQPYVP

SEQ ID NO: 122763 - protein, 67 aa, Heterodera glycines
  Homolog annotation: Hit_ID=NP_496957.1; Match level="QueryCoverage =74%, HitCoverage=54%, E-value=6e-16, Identity=78%"; Hit description =ribosomal Protein, Large subunit (10.1 kD) (rpl-43) [Caenorhabditis elegans] emb|CAB54440.1| Hypothetical
  Essential gene: C elegans homolog=Y48B6A.2; Phenotype=Lva
  Coding regions on vcDNA: vcDNA=SeqID_49186; Strand=+; Position=27-230
FAYSQNYHPNCLLHLIHCQSEAMKRVCVGIWNCSKCHKKVAGGAYVYATTTAATVRSTIRRLRETKE

SEQ ID NO: 122764 - protein, 212 aa, Heterodera glycines
  misc_feature (119)..(119): Xaa can be any naturally occurring amino acid
  Homolog annotation: Hit_ID=CAE57581.1; Match level="QueryCoverage =95%, HitCoverage=43%, E-value=2e-38, Identity=39%"; Hit description =Hypothetical protein CBG00560 [Caenorhabditis briggsae]
  Gene Ontology: Mol. function=ATPase activity; Cellular component =mitochondrial inner membrane; Biological process=aerobic respiration
  Essential gene: C elegans homolog=F54C9.6; Phenotype=Gro
  Coding regions on vcDNA: vcDNA=SeqID_49187; Strand=+; Position=3-638
LANAPKGGLFDAFTSNPLFTGGAGLMCVGVLFNYGRKLSTVGASVLRRKYVSTLELSNEDQCVHSRTITIQWGLDFINKQSQRKTNQLSVSSTELISESGKASTQFFFMPGQGHHYMSXGGRLVRVERERTEQMLQRADKRRTPLETVRLTTIGVKPEFWRQMLEKAAKDALSEVETGLAVYTPFGPEWHHFGKPLKKQPLDTIVLDNGIRE

SEQ ID NO: 122765 - protein, 80 aa, Heterodera glycines
  Homolog annotation: Hit_ID=CAE60849.1; Match level="QueryCoverage =98%, HitCoverage=10%, E-value=3e-37, Identity=87%"; Hit description =Hypothetical protein CBG04558 [Caenorhabditis briggsae]
  Gene Ontology: Biological process=cell growth
  Essential gene: C elegans homolog=C47E8.7; Phenotype=Emb
  Coding regions on vcDNA: vcDNA=SeqID_49188; Strand=+; Position=2-244
NGESSKTWRFSGMKKWHVNWEIRHLKIQFDNEDVEFKPLSADCKVVHEFIGGYIFLSMRSKDQNQTLDEEGFHRLTGGWG

SEQ ID NO: 122766 - protein, 123 aa, Heterodera glycines; identical to SEQ ID NO: 121314
  Homolog annotation: Hit_ID=P30757; Match level="QueryCoverage=100%, HitCoverage=100%, E-value=5e-57, Identity=89%"; Hit description =Histone H2B pir||S16084 histone H2B - sipunculid (Sipunculus nudus)
  Gene Ontology: Mol. function=DNA binding; Cellular component =nucleosome; Biological process=nucleosome assembly
  Essential gene: C elegans homolog=H02I12.6; Phenotype=Gro,Pvl,Ste
  Coding regions on vcDNA: vcDNA=SeqID_49189; Strand=+; Position=73-444

SEQ ID NO: 122767 - protein, 195 aa, Heterodera glycines
  Homolog annotation: Hit_ID=AAK60209.1; Match level="QueryCoverage =100%, HitCoverage=90%, E-value=1e-102, Identity=93%"; Hit description=vap-1 [Heterodera glycines]
  Gene Ontology: Cellular component=extracellular space
  Essential gene: C elegans homolog=F49E11.9; Phenotype=Unclassified
  Coding regions on vcDNA: vcDNA=SeqID_49190; Strand=+; Position=73-657
MEHFPSKFVLCLLIAFIAVPCSVLALSAGSRVSMLACHNNYRSQLAKGTADNKSGKMPAGSNLIQQKYDSNIESVAQKWANGCSMSHSGSSGMGENLYMTSSSTISEADALKQACDMWWAELKQFGFQSSLVLDMAQFNKGIGHWSQQAWASTAQIGCAMARCPSSTCKTCVVWHFQAAGNLMNAAVYLKSAACS

SEQ ID NO: 122768 - protein, 146 aa, Heterodera glycines
  misc_feature (14)..(14): Xaa can be any naturally occurring amino acid
  misc_feature (62)..(62): Xaa can be any naturally occurring amino acid
  Homolog annotation: Hit_ID=XP_393173.1; Match level="QueryCoverage =97%, HitCoverage=14%, E-value=5e-57, Identity=82%"; Hit description =similar to Hypothetical protein CBG09037 [Apis mellifera]
  Essential gene: C elegans homolog=F25B5.4a; Phenotype=Emb
  Coding regions on vcDNA: vcDNA=SeqID_49191; Strand=+; Position=106-541
MQIFVKTLTGKTIXTLEVEASDTIENVKAKIQDKEGIPPDQQRLIFAGTSTFKPLQHHFYTXPLFSGKQLEDGRTLADYNIQKESTLHLVLRLRGGMQIFVKTLTGKTITLEVEASDTIENVKAKIQDKEGIPPDQQRLISAGTST

SEQ ID NO: 122769 - protein, 161 aa, Heterodera glycines
  Homolog annotation: Hit_ID=CAB58171.1; Match level="QueryCoverage =100%, HitCoverage=100%, E-value=8e-79, Identity=91%"; Hit description=troponin-like protein [Anisakis simplex]
  Essential gene: C elegans homolog=F54C1.7; Phenotype=Emb,Lvl
  Coding regions on vcDNA: vcDNA=SeqID_49192; Strand=+; Position=129-614
MAENIEEILAEIDGSQIEEYQRFFDMFDRGKNGYIMATQIGQIMNAMEQDFDEKTLRKLIRKFDADGSGKLEFDEFCALVYTVANTVDKDTLRKELREAFRLFDKEGNGYISRPTLKGLLHEIAPDLSDKDLEAAVDEIDEDGSGKIEFEEFWELMAGETD

SEQ ID NO: 122770 - protein, 181 aa, Heterodera glycines
  Homolog annotation: Hit_ID=AAK21961.1; Match level="QueryCoverage =100%, HitCoverage=85%, E-value=1e-107, Identity=96%"; Hit description=secreted venom allergen-like protein vap2 [Heterodera glycines]
  Gene Ontology: Mol. function=trypsin inhibitor activity; Cellular component=extracellular space
  Essential gene: C elegans homolog=F49E11.4; Phenotype=Unclassified
  Coding regions on vcDNA: vcDNA=SeqID_49193; Strand=+; Position=18-560
MHLINLIALFFMLFGPSVQQHTKKPTKEDKEAAVNCHNKFRSQLALGNADNKSGGKKMPKAGNMRKFEWDENLAKLADEWANKCTLSHSWNGWAGENLAMKGGTFSNKDGFEYACGRWWDELNRYGFNPNLIMTGENFSGIGHWTQMAWADTDRIGCAMAQNCPNTNWKTYVVCWYYTGGN

SEQ ID NO: 122771 - protein, 103 aa, Heterodera glycines; identical to SEQ ID NO: 119330
  Homolog annotation: Hit_ID=NP_509231.1; Match level="QueryCoverage =100%, HitCoverage=100%, E-value=3e-52, Identity=99%"; Hit description=histone (his-38) [Caenorhabditis elegans] ref|NP _507034.1| histone (his-1) [Caenorhabditis elegans] ref
  Essential gene: C elegans homolog=ZK131.1; Phenotype=Unclassified
  Coding regions on vcDNA: vcDNA=SeqID_49194; Strand=+; Position=39-350

SEQ ID NO: 122772 - protein, 396 aa, Heterodera glycines
  misc_feature (252)..(252): Xaa can be any naturally occurring amino acid
  Homolog annotation: Hit_ID=CAE56899.1; Match level="QueryCoverage =96%, HitCoverage=98%, E-value=1e-125, Identity=56%"; Hit description= Hypothetical protein CBG24740 [Caenorhabditis briggsae]
  Gene Ontology: Mol. function=acetyl-CoA C-acetyltransferase activity; Cellular component=mitochondrion; Biological process=lipid metabolism
  Essential gene: C elegans homolog=T02G5.7; Phenotype=Bmd,Unc
  Coding regions on vcDNA: vcDNA=SeqID_49195; Strand=+; Position=214 -1405
MSSPPSSVLPQDVFILSAVRTPIASFRSSFASLNAVDLGTFVATEAIQRAGLRPDQVEETVTGCVLSAGSGQNVSRQIAIKSGIPEARQAYTVNKVCSSSLKALILGTQSVQLGQRSMVLVVGVESMSQAPFYLARGDNNYGDIKLLDSIQRDGISDAMLGQPMGVCAEKTVAEFGFTREQQDAYALASYARATRAWAGGAFGAEIVPVKVKQRKGTELMVAEDEEYRRLMPDKVTSLQPAFVKDGTGTITXANASSLNDGAASLVIASGQVEGAKPLAKVIAYAEAGRAPVDFTVAPVDAVKTLLQSVNISIDQIARWEVNEAFSVTALAFIRQLDLDPARVNALGGAVALGHPIGCSGARIVVTLVHQLESREFGIAAICNGGGEATAILVQRI

SEQ ID NO: 122773 - protein, 161 aa, Heterodera glycines
  Homolog annotation: Hit_ID=NP_494764.1; Match level="QueryCoverage =83%, HitCoverage=95%, E-value=2e-21, Identity=37%"; Hit description =prefoldin (16.1 kD) (2E617) [Caenorhabditis elegans] gb|AAF39891.1| Hypothetical protein H20J04.5 [Caenor
  Gene Ontology: Mol. function=chaperone activity; Cellular component =cytosol; Biological process=protein folding
  Essential gene: C elegans homolog=H20J04.5; Phenotype=Emb
  Coding regions on vcDNA: vcDNA=SeqID_49196; Strand=+; Position=23-508
MDFCLNSFSFSPQMASSTASSSSATNEQQKIVNGFQKLRELQQATINELNKIQTEQREHTTVLKTVQSLEPNRKCFRQVGDTLFEFTASELIVLLEETIKRFKQRVDELENQVVKVGEDINAYKEKHNIRFLSNKDVIELQKKQALSKISQLDLGPGGKSQ

SEQ ID NO: 122774 - protein, 114 aa, Heterodera glycines
  Homolog annotation: Hit_ID=XP_221241.2; Match level="QueryCoverage =98%, HitCoverage=39%, E-value=1e-11, Identity=35%"; Hit description =similar to Tceb2 protein [Rattus norvegicus]
  Gene Ontology: Mol. function=protein binding; Biological process=RNA elongation from Pol II promoter
  Essential gene: C elegans homolog=Y41C4A.10; Phenotype=Emb
  Coding regions on vcDNA: vcDNA=SeqID_49197; Strand=+; Position=1-345
LRKKQHLLVQARENWTAKDLKRVVEGILKVPPEKQSLYKPTNEQRTEWEAMDEKQTLHELGFTMKNARADGPAVLALVLPEDGKSPDIVPMTVAPPVPEAMAQNKQSEAEMVEE

SEQ ID NO: 122775 - protein, 206 aa, Heterodera glycines
  Homolog annotation: Hit_ID=CAE59483.1; Match level="QueryCoverage =96%, HitCoverage=14%, E-value=3e-27, Identity=37%"; Hit description =Hypothetical protein CBG02868 [Caenorhabditis briggsae]
  Essential gene: C elegans homolog=Y62F5A.1a; Phenotype=Gro,Stp
  Coding regions on vcDNA: vcDNA=SeqID_49198; Strand=+; Position=2-622
EETEGKLLQIREIFHDLLMSLELQEHVQWADMVQKFCSLAGMFASLQQLMRKPGHNNFDDNVKLMKMTQFVPKNVSLELDPNLTHLTEGRLSNFGHNIVPILLRTKLKPDVEEDELNIERDRSKGDIPKQIKTLNSHIDMLCGKLADFTKLHVVDRREAPSYSQEETVKLVKAICLGRGIYPKAPSSAHPGSADAGRSTSSSQKAK

SEQ ID NO: 122776 - protein, 124 aa, Heterodera glycines
  Homolog annotation: Hit_ID=AAS94231.1; Match level="QueryCoverage =47%, HitCoverage=13%, E-value=1e-12, Identity=55%"; Hit description =legumain-like protease precursor [Ixodes ricinus]
  Essential gene: C elegans homolog=T28H10.3; Phenotype=Emb
  Coding regions on vcDNA: vcDNA=SeqID_49199; Strand=+; Position=3-377
VIVFLFHSRTKAESDEEGAADQNIWAVLVAGSNGWWNYRHQADVCHAWHVLVDHGVSPDRITQTECHNKVMHTFNKICFNFSKSPYVMKYAKTLANLCERRADTAQIVAILKEQCAQMEKMEVH

SEQ ID NO: 122777 - protein, 128 aa, Heterodera glycines
  Homolog annotation: Hit_ID=NP_492119.1; Match level="QueryCoverage =82%, HitCoverage=86%, E-value=3e-35, Identity=62%"; Hit description =NADH dehydrogenase 1 beta subcomplex 7, possibly N-myristoylated (14.4 kD) (1I156) [Caenorhabditis elegan
  Gene Ontology: Mol. function=NADH dehydrogenase (ubiquinone) activity; Cellular component=membrane fraction
  Essential gene: C elegans homolog=D2030.4; Phenotype=Age,Gro,Lva
  Coding regions on vcDNA: vcDNA=SeqID_49200; Strand=+; Position=1-519
VEACYNARPAVVLTYFHPETAPRIDRPPTFDPLYGFPKGRKPREMQASWEELEKMKMPISERDYCAHKMVALRKCVWDRAPFASHYCHGRRHDLGLCLYDDHLMRMKEFEREKRLLMRKARKERAKAA

SEQ ID NO: 122778 - protein, 185 aa, Heterodera glycines
  Homolog annotation: Hit_ID=NP_491519.1; Match level="QueryCoverage =96%, HitCoverage=92%, E-value=4e-39, Identity=40%"; Hit description =CHORD protein, with cysteine and histidine-rich domain, zinc-binding (36.0 kD) (chp-1) [Caenorhabditis el
  Gene Ontology: Biological process=mitotic spindle positioning and orientation
  Essential gene: C elegans homolog=Y110A7A.13; Phenotype=Pvl,Stp
  Coding regions on vcDNA: vcDNA=SeqID_49201; Strand=+; Position=71-628
MIPLNLQIAESALKVLQTKTPGGEIEQSATAGAHCTNNTCKKVFTGPESDAEECVFHPGNAVFHEGLKYWSCCGRKTTDFTTFLDQLGCTRGKHCWKKKEIVTNAREDWFQRGGQVHITIYCKGALPSETSAKSDGLTLEVTINGSTKRYELFGEIAPSESVVIISERKVEIVLKQVAKIGWTNF

SEQ ID NO: 122779 - protein, 138 aa, Heterodera glycines
  Homolog annotation: Hit_ID=AAH51205.1; Match level="QueryCoverage =94%, HitCoverage=94%, E-value=8e-64, Identity=89%"; Hit description =Rps15a protein [Mus musculus]
  Gene Ontology: Mol. function=structural constituent of ribosome; Cellular component=cytosolic small ribosomal subunit (sensu Eukarya); Biological process=reproduction
  Essential gene: C elegans homolog=F53A3.3; Phenotype=Emb,Ste
  Coding regions on vcDNA: vcDNA=SeqID_49202; Strand=+; Position=2-418
IKNKATFTMVRMNVLADALKSINNAEKRGKRQVIIRPSSKVIIRFLTVMMKHGYIGEFEIVDDHRAGKIVVNLTGRINKCQVISPRFDIRMADLEKWTSNLLPSRQFGFLVLTTSAGIMDHEEARRKHVGGKILGFFF

SEQ ID NO: 122780 - protein, 190 aa, Heterodera glycines
  Homolog annotation: Hit_ID=NP_492354.1; Match level="QueryCoverage =95%, HitCoverage=75%, E-value=6e-33, Identity=43%"; Hit description =proteasome Beta Subunit (26.7 kD) (pbs-7) [Caenorhabditis elegans] emb|CAB03081.1| Hypothetical protein F
  Gene Ontology: Mol. function=endopeptidase activity; Cellular component=proteasome core complex (sensu Eukarya); Biological process=locomotory behavior
  Essential gene: C elegans homolog=F39H11.5; Phenotype=Emb,Lva,Unc
  Coding regions on vcDNA: vcDNA=SeqID_49203; Strand=+; Position=12-581
MSLTGGTVIALAYKGGVAMATDRTVFASGVHRFQNNTRQYRLNNYCLISFSGDFAEFQWLQNLLERRQMELQIDAGMDHMKPKMVHAFLTSLFYQRRSKMNPFLNTMVVCGMQPVEFHAGEIKPFIGVIDMRGNAYEVDHVATEIGKYLLRQMLETRQTQANGAEQMSKEEALRMVAAALEVSVSRNSRT

SEQ ID NO: 122781 - protein, 129 aa, Heterodera glycines; identical to SEQ ID NO: 120387
  Homolog annotation: Hit_ID=NP_499867.1; Match level="QueryCoverage =52%, HitCoverage=80%, E-value=7e-11, Identity=45%"; Hit description =putative Golgi protein (10.2 kD) (4A881) [Caenorhabditis elegans] gb|AAC19190.1| Hypothetical protein F29
  Essential gene: C elegans homolog=F29C4.2; Phenotype=Gro
  Coding regions on vcDNA: vcDNA=SeqID_49204; Strand=+; Position=50-439

SEQ ID NO: 122782 - protein, 152 aa, Heterodera glycines
  misc_feature (8)..(8): Xaa can be any naturally occurring amino acid
  Homolog annotation: Hit_ID=NP_502794.1; Match level="QueryCoverage =100%, HitCoverage=98%, E-value=2e-71, Identity=81%"; Hit description= ribosomal Protein, Small subunit (17.8 kD) (rps-18) [Caenorhabditis elegans] emb|CAB16517.1| Hypothetica
  Gene Ontology: Cellular component=mitochondrion
  Essential gene: C elegans homolog=Y57G11C.16; Phenotype=Ste
  Coding regions on vcDNA: vcDNA=SeqID_49205; Strand=+; Position=2-459
LIMPEKFXHIHRVMNTNIDGNRKVPYALTAIKGVGRRYAFLVCRKADIDIHKRAGELSEEDMEKLTTVMLNPQQYKIPSWFLNRQKDIRDGKNQQVLSTNLESKYRDDFERMKKIRLHRGLRHYWGLRVRGQHTKTTGRKGRTVGVSKKKGG

SEQ ID NO: 122783 - protein, 195 aa, Heterodera glycines
  Homolog annotation: Hit_ID=CAE64754.1; Match level="QueryCoverage =100%, HitCoverage=100%, E-value=1e-74, Identity=70%"; Hit description=Hypothetical protein CBG09544 [Caenorhabditis briggsae]
  Gene Ontology: Mol. function=potassium channel regulator activity; Cellular component=plasma membrane; Biological process=small GTPase mediated signal transduction
  Essential gene: C elegans homolog=ZK856.8; Phenotype=Unc
  Coding regions on vcDNA: vcDNA=SeqID_49206; Strand=+; Position=28-615
MGNSSTSLMLQEEEVVGIAKETGFSRNQIVRLYSRFLSLDRQGRGYLDRDDFQRIPELAINPLGDRIVDAFFSEFGDSGAKVELINFRQFVKVLAHFRPLSKSKPNTVNSREEKLKFAFSMYDLNKNGYITRDEFKIILNMMVGTNITADQLDSIADRTITEADADKDGKISFEEFCKAMERTDVDQKMSIRFLN

SEQ ID NO: 122784 - protein, 73 aa, Heterodera glycines; identical to SEQ ID NO: 119375
  Homolog annotation: Hit_ID=NP_491640.1; Match level="QueryCoverage =100%, HitCoverage=100%, E-value=1e-33, Identity=86%"; Hit description=UBiquitin-Like (8.7 kD) (ubl-5) [Caenorhabditis elegans] gb|AAK21382.1| Ubiquitin-like family protein 5
  Essential gene: C elegans homolog=F46F11.4; Phenotype=Gro,Stp,Unc
  Coding regions on vcDNA: vcDNA=SeqID_49207; Strand=+; Position=33-254

SEQ ID NO: 122785 - protein, 158 aa, Heterodera glycines
  Homolog annotation: Hit_ID=AAP02990.1; Match level="QueryCoverage =100%, HitCoverage=100%, E-value=3e-85, Identity=98%"; Hit description=FMRFamide-related peptide precursor [Heterodera glycines]
  Essential gene: C elegans homolog=F07D3.2; Phenotype=Gro
  Coding regions on vcDNA: vcDNA=SeqID_49208; Strand=+; Position=7-483
MAMNTNSIHCSSASSSPSVPMTLSMFCFIFAIFLHPASSSDLLSSSDDAKLQQMLCARFPGLAECQPNDEASRGIMTKRKSAYMRFGRAAAAADPSEEHEMEKRKSAYMRFGKRSPAEEGETYQIWAANEPDAQMEKRKSAYMRFGKRKSAYMRFGRK

SEQ ID NO: 122786 - protein, 112 aa, Heterodera glycines
  Homolog annotation: Hit_ID=BAB84192.1; Match level="QueryCoverage =91%, HitCoverage=72%, E-value=1e-31, Identity=62%"; Hit description =cytochrome b small subunit of succinate-ubiquinone reductase [Ascaris suum]
  Gene Ontology: Mol. function=electron transporter activity; Cellular component=mitochondrial membrane; Biological process=tricarboxylic acid cycle
  Essential gene: C elegans homolog=F33A8.5; Phenotype=Emb
  Coding regions on vcDNA: vcDNA=SeqID_49209; Strand=+; Position=73-411
MASPTKVMGPHAFHYKFERYYAAAIVPLFPLAYFVHAPLVDYALTAAIVLHSHWGVMAVVQDYARPLVIGKTLAKMAPAVPYIASVVLLVGLLMFNYNDVGLTKAFEMVFSL

SEQ ID NO: 122787 - protein, 179 aa, Heterodera glycines
  misc_feature (112)..(112): Xaa can be any naturally occurring amino acid
  misc_feature (163)..(163): Xaa can be any naturally occurring amino acid
  misc_feature (169)..(169): Xaa can be any naturally occurring amino acid
  misc_feature (172)..(172): Xaa can be any naturally occurring amino acid
  Homolog annotation: Hit_ID=NP_506083.1; Match level="QueryCoverage =93%, HitCoverage=27%, E-value=1e-29, Identity=39%"; Hit description =signal recognition particle 68kDa (70.6 kD) (5M770) [Caenorhabditis elegans] emb|CAB01573.1| Hypothetical
  Essential gene: C elegans homolog=F55C5.8; Phenotype=Emb,Lva,Ste
  Coding regions on vcDNA: vcDNA=SeqID_49210; Strand=+; Position=2-542
TESNGPKVLRILEIVKNAQQKHGLRHENYRRYRGYCSRRIERIRKSLKFMHSYKCAPKRTAKFIARNVSAELIGDLRFLQIAVFEVERNWAYAMQMKFEMIDLPLSRKKFHXVQKLRRAVKSAHFLHSLINDNPLVHEVTRVETVSYVSFIFGSLELELKNWXTTIETXTEXESVLPTA

SEQ ID NO: 122788 - protein, 142 aa, Heterodera glycines
  Homolog annotation: Hit_ID=NP_491282.1; Match level="QueryCoverage =100%, HitCoverage=100%, E-value=2e-53, Identity=69%"; Hit description=CalPoNin (cpn-3) [Caenorhabditis elegans] gb|AAB52338.1| Calponin protein 3 [Caenorhabditis elegans] pi
  Gene Ontology: Mol. function=troponin C binding; Biological process =growth
  Essential gene: C elegans homolog=F28H1.2; Phenotype=Emb,Lva
  Coding regions on vcDNA: vcDNA=SeqID_49211; Strand=+; Position=11-439
MSSRATPGGIGFQVVAKQASKFNDQEGKLILDWVKKLSGENFSTDGSRENFYKLLKDGTLLCKLANGIQPGSVKKIQQPTGNFACMENINAFVSFAKAQGVPTEETFQSVDLFEARDLYSVCVTVLSLGRILEKKGKPNPFS

SEQ ID NO: 122789 - protein, 143 aa, Heterodera glycines
  Homolog annotation: Hit_ID=CAE71300.1; Match level="QueryCoverage =97%, HitCoverage=93%, E-value=2e-48, Identity=63%"; Hit description =Hypothetical protein CBG18189 [Caenorhabditis briggsae]
  Gene Ontology: Mol. function=DNA-directed RNA polymerase activity; Cellular component=DNA-directed RNA polymerase II, core complex; Biological process=transcription from Pol I promoter
  Essential gene: C elegans homolog=F26F4.11; Phenotype=Emb
  Coding regions on vcDNA: vcDNA=SeqID_49212; Strand=+; Position=1-432
QDLFTVKNIDPDGKKFDRVSRLFCDSESFKMGLILDVNTQLYAMGINDKFRLMLCTSIRDDGLTEEGEYDKSIENIPRVRMFEYVMYGKIYRIENDEGTAETSRLTAYASFGGLLMRIQGEANNLTGFEQDKNIYLLLKKVPN

SEQ ID NO: 122790 - protein, 186 aa, Heterodera glycines
  Homolog annotation: Hit_ID=CAA70477.2; Match level="QueryCoverage =94%, HitCoverage=94%, E-value=3e-62, Identity=71%"; Hit description =SEC-2 protein [Globodera pallida]
  Essential gene: C elegans homolog=F02A9.2; Phenotype=Bmd,Dpy
  Coding regions on vcDNA: vcDNA=SeqID_49213; Strand=+; Position=11-571
MKGFFALFVFAFTLSVFSAAHLPPLDINQIPAEYRELIPEEVTKFYHELTEDDKKALKEVAERHEEFQTEEQAMEALKEKSEKLYNKAVELRTLVKGKIDQLVPDAKAFVIGMIEKAKGMRPKAGEKPKLEELRTAANELIEKYKALNDEAKESLKSNFPKITSVIQNEKFQTLAKSLLKQEAPAA

SEQ ID NO: 122791 - protein, 136 aa, Heterodera glycines; identical to SEQ ID NO: 120882
  Homolog annotation: Hit_ID=A30033; Match level="QueryCoverage=93%, HitCoverage=97%, E-value=3e-40, Identity=65%"; Hit description =development-specific protein 217 - sea urchin (Tripneustes gratilla) sp|P13732|RL22_TRIGR 60S ribosomal protei
  Gene Ontology: Mol. function=structural constituent of ribosome; Cellular component=cytosolic ribosome (sensu Eukarya); Biological process=protein biosynthesis
  Essential gene: C elegans homolog=C27A2.2a; Phenotype=Emb,Lva
  Coding regions on vcDNA: vcDNA=SeqID_49214; Strand=+; Position=43-453

SEQ ID NO: 122792 - protein, 465 aa, Heterodera glycines
  Homolog annotation: Hit_ID=A45618; Match level="QueryCoverage=100%, HitCoverage=100%, E-value=0.0, Identity=89%"; Hit description =translation elongation factor eEF-1 alpha chain - nematode (Onchocerca volvulus) sp|P27592|EF1A_ONCVO ELONGATI
  Gene Ontology: Mol. function=translation factor activity, nucleic acid binding; Biological process=protein biosynthesis
  Essential gene: C elegans homolog=R03G5.1a; Phenotype=Emb,Lva,Unc
  Coding regions on vcDNA: vcDNA=SeqID_49215; Strand=+; Position=12-1409
MGKEKIHINIVVIGHVDSGKSTTTGHLIYKCGGIDKRTIEKFEKEAQEMGKGSFKYAWVLDKLKAERERGITIDIALWKFETSKYYVTIIDAPGHRDFIKNMITGTSQADCAVLVVACGTGEFEAGISKNGQTREHALLAQTLGVKQLIVACNKMDTTEPPFAEARYTEVMTEVSNFIKKIGYNPATVPFVPISGFNGDNMLEPSDRMPWFKGWAIERKDGNASGKTLLEALDSILPPQRPTDKPLRLPLQDVYKIGGIGTVPVGRVETGVLKPGMVVTFAPQGISTEVKSVEMHHESLPEALPGDNVGFNVKNISVKDIRRGSVASDSKNDPAKETKSFTAQVIIMNHPGQIAAGYTPVLDCHTAHIACKFAELKEKVDRRSGKKVEDNPKALKTGDAGIVDLIPTKPMCVEAFTDYAPLGRFAVRDMRQTVAVGVIKAVEKTEGGGKVTKSAQKAAAPGGKKK

SEQ ID NO: 122793 - protein, 138 aa, Heterodera glycines
  Homolog annotation: Hit_ID=NP_498778.1; Match level="QueryCoverage =92%, HitCoverage=74%, E-value=8e-26, Identity=45%"; Hit description =mitochondrial ribosomal protein L18 (19.4 kD) (3J235) [Caenorhabditis elegans] gb|AAA27999.1| Hypothetica
  Essential gene: C elegans homolog=D2007.4; Phenotype=Lva
  Coding regions on vcDNA: vcDNA=SeqID_49216; Strand=+; Position=2-418
VDFCPTKNAIAARVVHYEDGIVIEASTREKTVQSQLYSQTDVSAANNIGRLLAHRCKMAGIEHCMSSLTENELEGSKKREAFLRALNESGLLLEEPEAIPHTHLNDPNLVWETFPIQHNRADKLDELDLSLEPGKGVC

SEQ ID NO: 122794 - protein, 139 aa, Heterodera glycines
  misc_feature (64)..(64): Xaa can be any naturally occurring amino acid
  Homolog annotation: Hit_ID=CAA82999.1; Match level="QueryCoverage =99%, HitCoverage=96%, E-value=2e-44, Identity=64%"; Hit description =ribosomal protein S19S [Ascaris suum] pir||A54581 ribosomal protein S19.e - pig roundworm sp|P39698|R19S_A
  Gene Ontology: Mol. function=structural constituent of ribosome; Cellular component=cytosolic small ribosomal subunit (sensu Eukarya); Biological process=hemocyte development
  Essential gene: C elegans homolog=T05F1.3; Phenotype=Emb,Lva
  Coding regions on vcDNA: vcDNA=SeqID_49217; Strand=+; Position=17-435
MGKPTSVKDVDQHEIVQSVATFLKKSGKIKLPDWVDLVKSGKNKELAPINPDWYYERVASVHRXGVGSFRNVYGGKNRRGVALSHFTNASGAVIRKALQSLEEIKWVEKDGGTGGRKLTKQGQKDLDRIASQLRYRTEE

SEQ ID NO: 122795 - protein, 215 aa, Heterodera glycines
  Homolog annotation: Hit_ID=NP_079920.1; Match level="QueryCoverage =88%, HitCoverage=93%, E-value=4e-35, Identity=44%"; Hit description =exosome component 1 [Mus musculus] gb|AAH24423.1| Exosome component 1 [Mus musculus] sp|Q9DAA6|CSL4_MOUSE
  Gene Ontology: Mol. function=protein binding; Cellular component =nuclear exosome (RNase complex); Biological process=rRNA processing
  Essential gene: C elegans homolog=Y48A6B.5; Phenotype=Gro
  Coding regions on vcDNA: vcDNA=SeqID_49218; Strand=+; Position=7-651
MEMSTSFLDSLPGFSVVDFNGSHEKRTCAPGEQLFSVSSGYHAGNGCYEFHGSICASLAGFLHVYSLRDSQNTETNIVEVRRNIDERSNVLPSQGKIVTARVERITTTFAKCAIICVEDTPLANEFNSTLRKEDIRDKERDKVELHKFVQPGDIILARVLGYGEAHTSYLLTIAEAELGVVIGRSQNGERLLPENSEIMKVPGSEYRETRKVAQL

SEQ ID NO: 122796 - protein, 244 aa, Heterodera glycines
  Homolog annotation: Hit_ID=NP_499094.1; Match level="QueryCoverage =99%, HitCoverage=94%, E-value=8e-93, Identity=74%"; Hit description =vacuolar H-ATPase (28.8 kD) (3K599) [Caenorhabditis elegans] emb|CAA81600.1| Hypothetical protein F55H2.2
  Gene Ontology: Mol. function=hydrogen-transporting ATPase activity, rotational mechanism; Cellular component=vacuolar membrane (sensu Fungi); Biological process=vacuolar acidification
  Essential gene: C elegans homolog=F55H2.2; Phenotype=Emb
  Coding regions on vcDNA: vcDNA=SeqID_49219; Strand=+; Position=104-838
SLRAQTVMKTRLKGAQKGHSLLKKKADALNMRFREILKKITENKKRMADVLKEAAFSLAEAKFTAGDFSHMVVQNVSSQAQYTVRMKRENVVGVFLPVFEAHRKEGSDGDAYNLTGLGKGGANIGKLKRNYNKAVELLVELATLQTCFITLDEAIKVTNRRVNAIEHVIIPKIENTLTYIVTELDEMEREEFFRMKKIQAKKKRQRDEEKARETENVLTERQPDDGRAPKSLLEDEEEVPVLFA

SEQ ID NO: 122797 - protein, 74 aa, Heterodera glycines
  Homolog annotation: Hit_ID=AAR85527.1; Match level="QueryCoverage =100%, HitCoverage=100%, E-value=7e-17, Identity=71%"; Hit description=14-3-3b protein [Meloidogyne incognita]
  Gene Ontology: Mol. function=protein domain specific binding; Biological process=protein targeting
  Essential gene: C elegans homolog=M117.2; Phenotype=Emb
  Coding regions on vcDNA: vcDNA=SeqID_49220; Strand=+; Position=36-260
MSDNKEELVQRAKLAEQAERYDDMAQSMKKVTELGAELSNEERNLLRDNLTLWTSDTAGDEQEAGGEAGEAGGN

SEQ ID NO: 122798 - protein, 170 aa, Heterodera glycines
  Homolog annotation: Hit_ID=NP_498923.1; Match level="QueryCoverage =98%, HitCoverage=86%, E-value=5e-51, Identity=58%"; Hit description =ribosomal protein L11 and Ribosomal protein L11 (3J807) [Caenorhabditis elegans] gb|AAA27905.1| Hypotheti
  Gene Ontology: Mol. function=RNA binding; Cellular component =mitochondrial large ribosomal subunit; Biological process=protein biosynthesis
  Essential gene: C elegans homolog=B0303.15; Phenotype=Lva
  Coding regions on vcDNA: vcDNA=SeqID_49221; Strand=+; Position=2-514
AQIKAQMASAAPPLGPSLGQRGVNVANFCKEFNNLTSTIRFGTNLPMSIHVKPDRTYEIDISTPTTEWLLQQAAGIRRNRQEEGEIVGMISVKHVYEIAKVKSQDKSLIGVPLKEICQLVIERADSIGIKVQNEDLDPEEYRKFLEHRQEVVQRQLEEIAKQEEAKLART

SEQ ID NO: 122799 - protein, 51 aa, Heterodera glycines
  Homolog annotation: Hit_ID=AAV34853.1; Match level="QueryCoverage =100%, HitCoverage=100%, E-value=9e-20, Identity=86%"; Hit description=ribosomal protein L39 [Bombyx mori] gb|AAK92174.1| ribosomal protein L39 [Spodoptera frugiperda] dbj|BAD
  Essential gene: C elegans homolog=C26F1.9; Phenotype=Emb,Lva
  Coding regions on vcDNA: vcDNA=SeqID_49222; Strand=+; Position=19-174
MAAHKTFIIKRKLAKAAKQNRPLPHWVRMKTGNRIRYNAKRRHWRRTKLKL

SEQ ID NO: 122800 - protein, 198 aa, Heterodera glycines
  Homolog annotation: Hit_ID=NP_492523.1; Match level="QueryCoverage =98%, HitCoverage=98%, E-value=4e-78, Identity=69%"; Hit description =i-35 protein (22.8 kD) (1K80) [Caenorhabditis elegans] emb|CAB03017.2| Hypothetical protein F30A10.9 [Cae
  Gene Ontology: Biological process=gametogenesis
  Essential gene: C elegans homolog=F30A10.9; Phenotype=Lva,Lvl
  Coding regions on vcDNA: vcDNA=SeqID_49223; Strand=+; Position=9-651
MGRHKKTQKFRNKLQKLIKPTDDRIKDEIRVKKPPKEDENALKIKEAPKISAAMFLKYNTQLGPPFHVIIDTNFVNFSIKNRIDIMTGFMDCLYAKVVPYISDCVLGELEKMGRRFKLALKIIKDNRFQRLQCTHKGIYADDCIVQRVTQHKCYIVATCDKDLRQRIRKIPGVPIMYVRDHRYTIERMPDAYGAPKLG

SEQ ID NO: 122801 - protein, 151 aa, Heterodera glycines
  Homolog annotation: Hit_ID=NP_504559.1; Match level="QueryCoverage =96%, HitCoverage=92%, E-value=7e-70, Identity=87%"; Hit description =AdaPTin or adaptin-related protein (18.6 kD) (apt-2C) [Caenorhabditis elegans] gb|AAB65902.1| Adaptin or
  Gene Ontology: Mol. function=protein transporter activity; Cellular component=AP-1 adaptor complex; Biological process=neurotransmitter secretion
  Essential gene: C elegans homolog=F29G9.3; Phenotype=Emb,Lva,Lvl,Unc
  Coding regions on vcDNA: vcDNA=SeqID_49224; Strand=+; Position=1-456
AVLAPGKLRLQKWYVAYPDKAKKKITRELVTTILSRKPKMCAFLEYKDTKVVYKRYASLYFCCAIEQTDNELLCLEVIHRYVELLDRYFGSVCELDIIFNFEKAYFILDEFLLAGEIQETSKKQVLKAISAQDLLQDEETTQGLFEDNRLG

SEQ ID NO: 122802 - protein, 173 aa, Heterodera glycines
  misc_feature (13)..(13): Xaa can be any naturally occurring amino acid
  misc_feature (91)..(91): Xaa can be any naturally occurring amino acid
  Homolog annotation: Hit_ID=CAE65022.1; Match level="QueryCoverage =97%, HitCoverage=98%, E-value=6e-76, Identity=83%"; Hit description =Hypothetical protein CBG09860 [Caenorhabditis briggsae]
  Gene Ontology: Mol. function=structural constituent of muscle; Cellular component=muscle myosin; Biological process=regulation of muscle contraction
  Essential gene: C elegans homolog=C56G7.1; Phenotype=Emb
  Coding regions on vcDNA: vcDNA=SeqID_49225; Strand=+; Position=3-522
AAPKTVARRARPXRATSNVFAMFDQPQIQEFKEAFNMIDQNHDGFIDEHDLKDMFASLGKEVSEKFIENMVNDASGSINFTMFLTLFGEKXLTGTDPEEVIKNAFQCFDEDNSGTIAEDRLRELLTTMGDRYTEEQVDELFRDAPIKNGRFDYVEFTRMLKHGTKEKDEEEKS

SEQ ID NO: 122803 - protein, 203 aa, Heterodera glycines
  Homolog annotation: Hit_ID=NP_491261.1; Match level="QueryCoverage =95%, HitCoverage=95%, E-value=7e-48, Identity=46%"; Hit description =proteasome Beta Subunit (22.8 kD) (pbs-4) [Caenorhabditis elegans] gb|AAB37663.1| Proteasome beta subunit
  Gene Ontology: Mol. function=endopeptidase activity; Cellular component=proteasome core complex (sensu Eukarya); Biological process=sporulation (sensu Saccharomyces)
  Essential gene: C elegans homolog=T20F5.2; Phenotype=Emb
  Coding regions on vcDNA: vcDNA=SeqID_49226; Strand=+; Position=33-644
MAHFMLGIRTDNWVILAADATHFLSGAIKISESHQKEYKLGPLTSMVCFGEAGDVDSFANWAKANCELYSRRNGYELRPKEVHHWLRKNMADNLRSEDMWRVNAIIGGFDSTDKKAYLTMIDYLATNIPPQNFIFYGFPGAFAYSIMDSFYRTDLTEQEGLELVQRMIDQVKRRAMMDLAEYRVVVINSKSSRTIAGLKPKAA

SEQ ID NO: 122804 - protein, 116 aa, Heterodera glycines
  Homolog annotation: Hit_ID=P22085; Match level="QueryCoverage=89%, HitCoverage=64%, E-value=5e-16, Identity=34%"; Hit description =Onchocystatin precursor (Cysteine proteinase inhibitor OV7) pir||A43428 onchocystatin - nematode (Onchocerca v
  Gene Ontology: Biological process=reproduction
  Essential gene: C elegans homolog=R01B10.1a; Phenotype=Ste
  Coding regions on vcDNA: vcDNA=SeqID_49227; Strand=+; Position=87-437
MTDQQNSIVGGWTEQNVNDEKIKSLASRSVAKINSESNDRFSLFPLEVLSAKSQVVAGIQYQLRIKVGRSNCSKNPNLADHANCATEDDQTARKTFLVTIWEKPWEQFEQITYKLE

SEQ ID NO: 122805 - protein, 209 aa, Heterodera glycines
  misc_feature (91)..(91): Xaa can be any naturally occurring amino acid
  Homolog annotation: Hit_ID=CAE59826.1; Match level="QueryCoverage =99%, HitCoverage=99%, E-value=2e-78, Identity=72%"; Hit description =Hypothetical protein CBG03298 [Caenorhabditis briggsae]
  Gene Ontology: Mol. function=transporter activity; Cellular component= integral to membrane; Biological process=proton transport
  Essential gene: C elegans homolog=T01H3.1; Phenotype=Emb,Ste
  Coding regions on vcDNA: vcDNA=SeqID_49228; Strand=+; Position=5-632
MASPALHTFNALLATGASLLTLMAFYYMLTGQGDRFDIAWFLTETSPYMWAGIAIAASLSLSVIGVGWGIFTTGSSILGGGVKAPRIRTKXNLVSIIFCEAVAIFGIIMAFVFAGKLGKFTRETATQEVIVKNLAAGYAIFGGGLTVGFSDLICGLAVGIVGSGAALADAANPVLFVKILIIEIFASAIGLFGMIIGIVQTNKFNIGTT

SEQ ID NO: 122806 - protein, 155 aa, Heterodera glycines
  Homolog annotation: Hit_ID=CAE70903.1; Match level="QueryCoverage =94%, HitCoverage=61%, E-value=1e-44, Identity=52%"; Hit description =Hypothetical protein CBG17700 [Caenorhabditis briggsae]
  Gene Ontology: Biological process=embryogenesis and morphogenesis
  Essential gene: C elegans homolog=F22A3.6a; Phenotype=Emb
  Coding regions on vcDNA: vcDNA=SeqID_49229; Strand=+; Position=60-527
MTVQLSALLLPLLIITLLCNFAMANLIFHNIEFDSDCMKAMCMADSGCEQQGCAEDVFGRLGCGFFRMNIWQYKQCYEPGREIGELSETAWIRCSEDYECASKCIVQVASRFRLKCYGKSDCETIARIHDGGANGCRTGETLPYWFNVKSFCPDC

SEQ ID NO: 122807 - protein, 132 aa, Heterodera glycines
  Homolog annotation: Hit_ID=NP_499915.1; Match level="QueryCoverage =98%, HitCoverage=39%, E-value=9e-46, Identity=64%"; Hit description =ribosomal Protein, Small subunit (rps-24) [Caenorhabditis elegans] gb|AAK39283.2| Ribosomal protein, smal
  Gene Ontology: Cellular component=eukaryotic 48S initiation complex; Biological process=protein biosynthesis
  Essential gene: C elegans homolog=T07A9.11; Phenotype=Lva
  Coding regions on vcDNA: vcDNA=SeqID_49230; Strand=+; Position=1-399
VEGGVITLHTRKVLNNRLLFRKQMVVDILHPNRASVPKSEVRERLAKLYKTTQDVVVAYGFRCQFGGGRSTGFANVYDSLDYAKRFEAKYRLLRQGVGQKAEKGGRKQRKERKNRQKKVRGVKKVKVQAGKK

SEQ ID NO: 122808 - protein, 82 aa, Heterodera glycines
  Homolog annotation: Hit_ID=NP_496838.1; Match level="QueryCoverage =76%, HitCoverage=71%, E-value=8e-10, Identity=48%"; Hit description =ubiquinone-binding protein like (10.6 kD) (2N782) [Caenorhabditis elegans] emb|CAB04384.1| Hypothetical p
  Essential gene: C elegans homolog=F45H10.2; Phenotype=Clr,Gro,Stp
  Coding regions on vcDNA: vcDNA=SeqID_49231; Strand=+; Position=3-251
RASEKHFGNLSKAYGWYYVRIAPVEQKVWKGFFFDAFVKPVKEQLPHWWMFFFPVVTYFLVTDWAKKEYRRLGRIKEFTDEE

SEQ ID NO: 122809 - protein, 149 aa, Heterodera glycines
  misc_feature (102)..(102): Xaa can be any naturally occurring amino acid
  Homolog annotation: Hit_ID=CAE73901.1; Match level="QueryCoverage =98%, HitCoverage=95%, E-value=3e-66, Identity=80%"; Hit description =Hypothetical protein CBG21507 [Caenorhabditis briggsae]
  Gene Ontology: Cellular component=mitochondrion
  Essential gene: C elegans homolog=Y57G11C.16; Phenotype=Ste
  Coding regions on vcDNA: vcDNA=SeqID_49232; Strand=+; Position=3-493
ARKIPHIHRVMNTNIDGNRKVPCALTAIKGVGRRYAFLVCRKADIDIHKRAGELSEEDMEKLTTVMLNPQQYKIPSWFLNRQKDIRDGKNQQGLSTNLESKXRDEFERMKKIRLHRGLRHYWGLRVRGQHTKTTGRKGRTVGVSKKKGG

SEQ ID NO: 122810 - protein, 82 aa, Heterodera glycines
  Homolog annotation: Hit_ID=CAE74051.1; Match level="QueryCoverage =100%, HitCoverage=95%, E-value=1e-28, Identity=67%"; Hit description= Hypothetical protein CBG21703 [Caenorhabditis briggsae]
  Essential gene: C elegans homolog=F49C12.13; Phenotype=Emb,Lva,Lvl
  Coding regions on vcDNA: vcDNA=SeqID_49233; Strand=+; Position=20-268
MSALIPFIIVTLFWAVIGAGGPFLVPSGMNRGIIQTMIVLTAVCCYMFWLIVYLHQLNPLIGPQLPVKTIWWIHNTWGNVKN

SEQ ID NO: 122811 - protein, 204 aa, Heterodera glycines
  Homolog annotation: Hit_ID=CAE69547.1; Match level="QueryCoverage =62%, HitCoverage=73%, E-value=2e-26, Identity=50%"; Hit description =Hypothetical protein CBG15759 [Caenorhabditis briggsae]
  Gene Ontology: Cellular component=mitochondrial ribosome
  Essential gene: C elegans homolog=Y37D8A.18; Phenotype=Lva
  Coding regions on vcDNA: vcDNA=SeqID_49234; Strand=+; Position=66-680
MFVSNSVFLPVSRFFHCRALSPVNLVVHPFVARKCAFLSTPSLSFPFRRQYSSLASATTTGASNDKLNVDKLFEKINFEVRGHDFTVLKSYSLFVMNVCRVLDIDFTSRHRAMINTDHSKSNRPKYQRWFQWLLSAKFAKKKYKLHYETRTYLMEFDVHHLTGSTASAFLEYIERNIPEGVAMKVTYTEMCFLPETIVKTVMDN

SEQ ID NO: 122812 - protein, 174 aa, Heterodera glycines; identical to SEQ ID NO: 119666
  Homolog annotation: Hit_ID=CAE69521.1; Match level="QueryCoverage =63%, HitCoverage=21%, E-value=2e-21, Identity=50%"; Hit description =Hypothetical protein CBG15730 [Caenorhabditis briggsae]
  Gene Ontology: Mol. function=ligand-dependent nuclear receptor activity; Cellular component=nucleus; Biological process =embryogenesis and morphogenesis
  Essential gene: C elegans homolog=H10E21.3a; Phenotype=Emb
  Coding regions on vcDNA: vcDNA=SeqID_49235; Strand=+; Position=105-626

SEQ ID NO: 122813 - protein, 60 aa, Heterodera glycines
  Homolog annotation: Hit_ID=NP_490675.1; Match level="QueryCoverage =70%, HitCoverage=19%, E-value=2e-09, Identity=76%"; Hit description =RAB family member (23.4 kD) (rab-11.1) [Caenorhabditis elegans] gb|AAB54158.1| Rab family protein 11.1 [C
  Essential gene: C elegans homolog=F53G12.1; Phenotype=Emb,Ste
  Coding regions on vcDNA: vcDNA=SeqID_49236; Strand=+; Position=269-451
FIQIRLHFFHQTDEANAYAERNQMAFIETSALDGTNVGAAFTNILTTICRSQSTTAGSTP

SEQ ID NO: 122814 - protein, 83 aa, Heterodera glycines
  misc_feature (39)..(40): Xaa can be any naturally occurring amino acid
  Homolog annotation: Hit_ID=NP_506625.1; Match level="QueryCoverage =92%, HitCoverage=19%, E-value=5e-21, Identity=58%"; Hit description =xap-5 protein (5P164) [Caenorhabditis elegans] pir||T20021 hypothetical protein C47E8.4 - Caenorhabditis
  Gene Ontology: Cellular component=nucleus
  Essential gene: C elegans homolog=C47E8.4; Phenotype=Emb
  Coding regions on vcDNA: vcDNA=SeqID_49237; Strand=+; Position=2-250
ALIPITKKRLGRDPTVDTSFLPDRQRDEQLLRARERIAXXWQEMQESEKNEDITLAFCYWDGSSHRKDSQTNKGTTIAQFLQK

SEQ ID NO: 122815 - protein, 101 aa, Heterodera glycines
  misc_feature (17)..(17): Xaa can be any naturally occurring amino acid
  misc_feature (50)..(50): Xaa can be any naturally occurring amino acid
  Homolog annotation: Hit_ID=NP_492752.1; Match level="QueryCoverage =100%, HitCoverage=38%, E-value=6e-16, Identity=43%"; Hit description= NADH-ubiquinone oxidoreductase, PDSW subunit (31.2 kD) (1L97) [Caenorhabditis elegans] emb|CAB01876.1| H
  Gene Ontology: Biological process=growth
  Essential gene: C elegans homolog=F59C6.5; Phenotype=Emb,Lva
  Coding regions on vcDNA: vcDNA=SeqID_49238; Strand=+; Position=2-304
IDQCDVNERICLVDAEXVFRLDKLADRHIRDILPQRFPKRVRGEGYDHLXQCTKYVDYYENVELNFFIKYVELCSELTVVACYMKYTHPLMWERRHIDIMD

SEQ ID NO: 122816 - protein, 205 aa, Heterodera glycines
  Homolog annotation: Hit_ID=AAS64750.1; Match level="QueryCoverage =97%, HitCoverage=40%, E-value=4e-58, Identity=56%"; Hit description =cyclin L; C52E4.6a [Caenorhabditis elegans] ref|NP_506007.1| cyclin (56.0 kD) (5M472) [Caenorhabditis eleg
  Gene Ontology: Biological process=cell cycle
  Essential gene: C elegans homolog=C52E4.6a; Phenotype=Emb,Lva
  Coding regions on vcDNA: vcDNA=SeqID_49239; Strand=+; Position=3-617
LIAKVRPSSYGQRRNYSSIDISAEKWLMHYDADSLAKLENPPSLADGINRELERDIRYLGCELIQSGAILLRLSQTSAATAQILFQRYYYLKSFVRYNFEHMVQACLLLASKIEEEPRKPRDVLNVYNRLKQIHHRRNAVASQHPEDLQKLSKKFEHLELCSKRYQELKNIVIKAERRLLNVLGFVVHVHHPHKLIYIYLHILDQ

SEQ ID NO: 122817 - protein, 207 aa, Heterodera glycines
  Homolog annotation: Hit_ID=CAE57186.1; Match level="QueryCoverage =95%, HitCoverage=82%, E-value=9e-54, Identity=54%"; Hit description =Hypothetical protein CBG00030 [Caenorhabditis briggsae]
  Essential gene: C elegans homolog=ZK686.4; Phenotype=Unclassified
  Coding regions on vcDNA: vcDNA=SeqID_49240; Strand=+; Position=3-623
SFLQRPPSSVKDHRRTWDRTEYEVKAQERLTTEREALEIKKGNIRPPPKGPKIKREMLKPREFKVDLESKVGRQVVINKTTPSSETGGYYCNICDCVVKDSINFLDHINGKNHQRNLGFSMKVKKSTVEEVRERFSMKKAQKETLRNEDVEEKQRDLKEEEAKMADLKRMQRERQKETSRKRTAAAVTAPPTDEEADAELMKVMGIG

SEQ ID NO: 122818 - protein, 72 aa, Heterodera glycines
  misc_feature (41)..(41): Xaa can be any naturally occurring amino acid
  Homolog annotation: Hit_ID=CAA34603.1; Match level="QueryCoverage =100%, HitCoverage=47%, E-value=1e-17, Identity=59%"; Hit description= unnamed protein product [Brugia pahangi] sp|P62300|RS13_WUCBA 40S ribosomal protein S13 (40S ribosomal pr
  Gene Ontology: Mol. function=structural constituent of ribosome; Cellular component=cytosolic small ribosomal subunit (sensu Eukarya); Biological process=protein biosynthesis
  Essential gene: C elegans homolog=C16A3.9; Phenotype=Emb
  Coding regions on vcDNA: vcDNA=SeqID_49241; Strand=+; Position=2-217
RLHNPGKGISRSAWPYRPSVPTWQKLTNPQVEDYIAKAAPXGLRPTRNGVNLGDTHGAAQFRRLTCNPIGRI

SEQ ID NO: 122819 - protein, 198 aa, Heterodera glycines
  Homolog annotation: Hit_ID=CAE67843.1; Match level="QueryCoverage =67%, HitCoverage=50%, E-value=2e-40, Identity=55%"; Hit description =Hypothetical protein CBG13430 [Caenorhabditis briggsae]
  Gene Ontology: Mol. function=DNA binding; Cellular component =chromatin; Biological process=DNA replication
  Essential gene: C elegans homolog=W03D2.4; Phenotype=Emb,Ste
  Coding regions on vcDNA: vcDNA=SeqID_49242; Strand=+; Position=16-609
MSFLRLITFVLLITLCSLPSLVESGLIGIVGTPVEAAWCGVLGKESSHCPTAGGGQHGGGGGRCDRTIALGLSMGELSKVLKCSKSEDTLMIRFEDSEQDMVTFTFEDTKGRKQDITLKLMDIDNEHLGIPDQKYAAVVEMPSTEFQKVCRDIASFSDSMNITATKSGVVFSGSGDSVTNTIRYSKDKTADDDDDKDR

SEQ ID NO: 122820 - protein, 200 aa, Heterodera glycines
  Homolog annotation: Hit_ID=NP_496176.1; Match level="QueryCoverage =88%, HitCoverage=40%, E-value=1e-41, Identity=45%"; Hit description =esterase A family member (52.5 kD) (2K387) [Caenorhabditis elegans] emb|CAA88435.1| Hypothetical protein
  Essential gene: C elegans homolog=M28.6; Phenotype=Unclassified
  Coding regions on vcDNA: vcDNA=SeqID_49243; Strand=+; Position=1-603
VSRLTFPSFWYQLREFVYDPRVIVVQGVLHLRTRNSLRTRIAENATWIRIDGNTNTFNNPQLFELEQAAALGVSRAKDVAKIFSLMLSGELISRKSLIRLSKPQIINQIDYVMKGKWLFGHPGFGGSSVMMDPEEELVIAYVSNGMKSGMGELTRTFRRLKLAAFDSLKAISDGRTDGKNQTQYNKFNSSKAEGDSPKIR

SEQ ID NO: 122821 - protein, 77 aa, Heterodera glycines
  Homolog annotation: Hit_ID=NP_496967.1; Match level="QueryCoverage =100%, HitCoverage=23%, E-value=2e-12, Identity=46%"; Hit description= mevalonate decarboxylase (2O512) [Caenorhabditis elegans] emb|CAB54447.1| Hypothetical protein Y48B6A.13
  Gene Ontology: Biological process=embryogenesis and morphogenesis
  Essential gene: C elegans homolog=Y48B6A.13a; Phenotype=Emb,Sck
  Coding regions on vcDNA: vcDNA=SeqID_49244; Strand=+; Position=2-232
FPTALGLPSSSARFAALALGLGKILRLTDPDVVRMTRMGSGSSCPIIQGGFVHWTEGAHQHNDSDCLCQKLATTDHW

SEQ ID NO: 122822 - protein, 73 aa, Heterodera glycines
  Homolog annotation: Hit_ID=NP_500629.1; Match level="QueryCoverage =94%, HitCoverage=62%, E-value=8e-11, Identity=49%"; Hit description =ribosomal Protein, Large subunit (12.3 kD) (rpl-20Co) [Caenorhabditis elegans] gb|AAB92035.1| Hypothetica
  Gene Ontology: Cellular component=mitochondrion
  Essential gene: C elegans homolog=E04A4.7; Phenotype=Emb,Lva
  Coding regions on vcDNA: vcDNA=SeqID_49245; Strand=+; Position=2-220
ILERDNERGYKIFPLRCLHCRVIDSTATATGPTLDDLGKTKSVSDRTCYYAAANKIMAVVWDIDTLSEYIVNP

SEQ ID NO: 122823 - protein, 82 aa, Heterodera glycines
  misc_feature (31)..(33): Xaa can be any naturally occurring amino acid
  Homolog annotation: Hit_ID=NP_490842.1; Match level="QueryCoverage =84%, HitCoverage=74%, E-value=3e-22, Identity=76%"; Hit description =SUMO, small ubiquitin-like modifier, SUMO, small ubiquitin-like modifier SMO-1 (10.2 kD) (smo-1) [Caenorh
  Essential gene: C elegans homolog=K12C11.2; Phenotype =Dpy,Emb,Gro,Pvl,Stp
  Coding regions on vcDNA: vcDNA=SeqID_49246; Strand=+; Position=44-288
MADESGTNAGGTGAAGGAQPAEYIKLKVVGXXXSNEVHFRVKYGTSMGKLKKAYAERTGVQVTSLRFLFDGRRVNDDDTPKS

SEQ ID NO: 122824 - protein, 190 aa, Heterodera glycines
  Homolog annotation: Hit_ID=AAA62548.1; Match level="QueryCoverage =97%, HitCoverage=58%, E-value=2e-38, Identity=39%"; Hit description =Hypothetical protein C45G9.5 [Caenorhabditis elegans] ref|NP _498072.1| putative cytoskeletal protein (36.0
  Essential gene: C elegans homolog=C45G9.5; Phenotype=Lva
  Coding regions on vcDNA: vcDNA=SeqID_49247; Strand=+; Position=1-573
KVQSVAISQNGDLYMTKQPTHGTEESAIWRSHIDHPIAWEEFCSTFDECFQSLCVYDNETLAVAVVSSPVNLYSKQCIKWVATKDCRIIGSFSAAGKDNGQIFFPRCLQKHGDSLLILDKTGRIQKFTREGHFVEISAKIDDYIGNGFTIREDEAVIACSGIVKDEEGKTMCDDWVENIRLDGSRWTEEA

SEQ ID NO: 122825 - protein, 192 aa, Heterodera glycines
  Homolog annotation: Hit_ID=NP_741425.1; Match level="QueryCoverage =88%, HitCoverage=34%, E-value=6e-24, Identity=42%"; Hit description =pumilio-family RNA-binding protein like (57.1 kD) (4H187) [Caenorhabditis elegans] gb|AAN63424.1| Hypothe
  Gene Ontology: Mol. function=RNA binding; Biological process =embryogenesis and morphogenesis
  Essential gene: C elegans homolog=Y73B6BL.38; Phenotype=Emb
  Coding regions on vcDNA: vcDNA=SeqID_49248; Strand=+; Position=2-580
ENVVQLVHGTANANNSLEKEISIQILHVLIEPILKNAYSLAQNEFANYLVQFIIKSPYLRRQRCYIIKTHIIRNVYHLSLLKYSSHVVEQAFKHAEDRCNCLAMLFREVLEGYKPSTDGKQRTALYEMLFNQYGNYVVQRMIPIARDVYQSRRPGDPNWLRHIAHCVQTNIEALSRYSSGKKIINSLHPVIF

SEQ ID NO: 122826 - protein, 187 aa, Heterodera glycines
  Homolog annotation: Hit_ID=NP_740774.1; Match level="QueryCoverage =87%, HitCoverage=18%, E-value=4e-15, Identity=34%"; Hit description =NucleOlar Protein 14, part of small ribosomal subunit processosome (1A803) [Caenorhabditis elegans] gb|AA
  Gene Ontology: Biological process=growth
  Essential gene: C elegans homolog=Y48G1A.4; Phenotype=Lva
  Coding regions on vcDNA: vcDNA=SeqID_49249; Strand=+; Position=1-564
RKYGTADESVADAGDQPTNDYGTMRPAFNACFGPFHRICLHLPVANYPAQLADEAARLTQLLAKLMAQNGRVMQMKRISKRGTTTTTNSAIKMLEPRFDERFDPERRNNKNNDSNGMKAREKSWAKRAKNERRGALKELRKGAKGMANAYAERQRKVRRERDEKTKRIMQCLEVQESEHKKLKALKK

SEQ ID NO: 122827 - protein, 200 aa, Heterodera glycines
  Homolog annotation: Hit_ID=AAK92169.1; Match level="QueryCoverage =40%, HitCoverage=50%, E-value=4e-14, Identity=45%"; Hit description =ribosomal protein L35A [Spodoptera frugiperda]
  Essential gene: C elegans homolog=F10E7.7; Phenotype =Clr,Emb,Gro,Sck,Slu,Stp
  Coding regions on vcDNA: vcDNA=SeqID_49250; Strand=+; Position=27-629
MVEAAEQSQQQPIRRRAGPKSARRLYVKAVFTGYKRGHRSQHEDTSLLKLDGVNDKSDASFYLGKRAACMYKGRKTIARGGGPKTSDFLLALFMCLLFVQSACAEESFSMKDLALEYKIKYDFFFAPVTLILAVLSLAMAFSAGFMVVLNRMFSLHMDVQENKNQVKELRKELDENVKNFNTLYSEFVNLKGEVNLLKGK

SEQ ID NO: 122828 - protein, 170 aa, Heterodera glycines
  Homolog annotation: Hit_ID=NP_491519.1; Match level="QueryCoverage =52%, HitCoverage=27%, E-value=1e-12, Identity=39%"; Hit description =CHORD protein, with cysteine and histidine-rich domain, zinc-binding (36.0 kD) (chp-1) [Caenorhabditis el
  Gene Ontology: Biological process=mitotic spindle positioning and orientation
  Essential gene: C elegans homolog=Y110A7A.13; Phenotype=Pvl,Stp
  Coding regions on vcDNA: vcDNA=SeqID_49251; Strand=+; Position=3-515
MNKMLPNGRTMTPIPIQVNKAARKSIDRHTHFGLHRRPSEVPPPVRETVWARDDWFEQFGFVHLSIYGRGALADGTHAESDGLTLNVTVVHAYGAKQSVKQYKLYAEIVPSHSVMLITEKKVELVLKQLNREKWNKLCYDGGEDGAICDGGDDDGAFLLDPADEAAEDDE

SEQ ID NO: 122829 - protein, 207 aa, Heterodera glycines
  Homolog annotation: Hit_ID=NP_500466.1; Match level="QueryCoverage =37%, HitCoverage=29%, E-value=2e-25, Identity=70%"; Hit description =proliferating Cell Nuclear Antigen homolog (29.0 kD) (pcn-1) [Caenorhabditis elegans] pir||T28761 hypothe
  Gene Ontology: Mol. function=DNA binding; Cellular component=delta -DNA polymerase cofactor complex; Biological process=DNA replication
  Essential gene: C elegans homolog=W03D2.4; Phenotype=Emb,Ste
  Coding regions on vcDNA: vcDNA=SeqID_49252; Strand=+; Position=1-621
FEAKFTNAALLKKIVEAIKELVSEAPFDCTENSMCLQAMDGSHVALISLKLDIGLFEVFRCDRTIALGLSMGELSKALFVRFEMIQPNAIAVATHLQCNRPDCTRTFGLDKLGTLRPHICKAHREDHHQGNRKPSLVIGLTIVPPGRTFLFTIYESRAQAVPALIVRFAVSPVSRASYDTALARAQQLLGYEIIPPLAVRRWPKRHT

SEQ ID NO: 122830 - protein, 197 aa, Heterodera glycines
  Homolog annotation: Hit_ID=NP_505803.1; Match level="QueryCoverage =99%, HitCoverage=72%, E-value=3e-73, Identity=66%"; Hit description =putative protein, with 2 coiled coil domains, of eukaryotic origin (31.3 kD) (5L480) [Caenorhabditis eleg
  Gene Ontology: Mol. function=pre-mRNA splicing factor activity; Cellular component=spliceosome complex; Biological process=mRNA splicing
  Essential gene: C elegans homolog=F53B7.3; Phenotype=Emb
  Coding regions on vcDNA: vcDNA=SeqID_49253; Strand=+; Position=30-620
MARNAEKAMTALARWRRMKEQEEKGPIAKRPNDVRECKKLGDAERFRRELIHDISKRITGIQNPGLGEFKIRDLNDEINRLLRIKLAWEGRIKELGGVDHRRIAPRELDRDGREVSSNRGYKYFGAAKDLPGVRELFQQAAEEEGAVPRRSRADLMQFVDADYYGYMDDDDGLLIPLEKTEEQVAIAKINEEWVKRG

SEQ ID NO: 122831 - protein, 194 aa, Heterodera glycines
  Homolog annotation: Hit_ID=AAB88449.1; Match level="QueryCoverage =88%, HitCoverage=57%, E-value=4e-67, Identity=42%"; Hit description =polyadenylate binding protein [Petromyzon marinus]
  Gene Ontology: Mol. function=poly(A) binding; Cellular component =cytoplasm; Biological process=mRNA metabolism
  Essential gene: C elegans homolog=Y106G6H.2a; Phenotype=Gro,Stp
  Coding regions on vcDNA: vcDNA=SeqID_49254; Strand=+; Position=42-623
MAQLAVAAPLPPTTNATAATATPAAPSYPMASLYVGDLHPEVTESLLFEKFSVVGPVLSIRVCRDAISRRSLGYAYVNFQQTSDAEKALNSMNFDCVLGKQIRIMWSQRDPSIRRSGSGNIFIKNLDKDIDTKNFFSTFSAFGRILSCKVATDSDGKSKGYGFIHYASEDDANKAIEKINGIHVDGKTVFAGKF

SEQ ID NO: 122832 - protein, 54 aa, Heterodera glycines
  Homolog annotation: Hit_ID=XP_468271.1; Match level="QueryCoverage =96%, HitCoverage=44%, E-value=6e-18, Identity=78%"; Hit description =putative 60S ribosomal protein L39 [Oryza sativa (japonica cultivar -group)] dbj|BAD19088.1| putative 60S
  Essential gene: C elegans homolog=C26F1.9; Phenotype=Emb,Lva
  Coding regions on vcDNA: vcDNA=SeqID_49255; Strand=+; Position=3-167
ATKMPSNKTFKIKRVLGKKQRQNRPIPQWIRLRTDNTIRYNAKRRNWRRTKLNI

SEQ ID NO: 122833 - protein, 206 aa, Heterodera glycines
  Homolog annotation: Hit_ID=CAE56708.1; Match level="QueryCoverage =100%, HitCoverage=17%, E-value=6e-27, Identity=33%"; Hit description= Hypothetical protein CBG24494 [Caenorhabditis briggsae]
  Gene Ontology: Mol. function=ubiquitin-specific protease activity; Cellular component=nucleus; Biological process=protein deubiquitination
  Essential gene: C elegans homolog=F30A10.10; Phenotype=Pvl,Stp
  Coding regions on vcDNA: vcDNA=SeqID_49256; Strand=+; Position=3-620
AFFAPEPLRDFRCDQCRETNCVTRSSRFTQLPELLIVQLNRYVLASNGNLRKLQNAVHYPRLLTELGGEGIPDYELCAVMIHEGKSTNSGHYYDVIRDPVIDRWFTYNDETVNQKRTAPGYLGRLTQKPRASADTTGCYALIYRRVGSGLRGPVQLPPENIVTEAKKRMEAEFAQQDKEDDLAFKKWKKHINERNHLLQQLWKELE

SEQ ID NO: 122834 - protein, 96 aa, Heterodera glycines
  Homolog annotation: Hit_ID=CAE63509.1; Match level="QueryCoverage =84%, HitCoverage=86%, E-value=2e-17, Identity=46%"; Hit description =Hypothetical protein CBG07988 [Caenorhabditis briggsae]
  Essential gene: C elegans homolog=Y18D10A.16; Phenotype=Gro
  Coding regions on vcDNA: vcDNA=SeqID_49257; Strand=+; Position=20-310
MTFGNSPTQGRKLGEQETQFDETITRTGIACDRIRQQLKKCIKESDCIQIKRKKARECHEELDLPQHCIHLMYSLAECKRNNIDPRARFRGRKGDL

SEQ ID NO: 122835 - protein, 51 aa, Heterodera glycines; identical to SEQ ID NO: 122520
  Homolog annotation: Hit_ID=AAV34853.1; Match level="QueryCoverage =100%, HitCoverage=100%, E-value=3e-19, Identity=84%"; Hit description=ribosomal protein L39 [Bombyx mori] gb|AAK92174.1| ribosomal protein L39 [Spodoptera frugiperda] dbj|BAD
  Essential gene: C elegans homolog=C26F1.9; Phenotype=Emb,Lva
  Coding regions on vcDNA: vcDNA=SeqID_49258; Strand=+; Position=16-171

SEQ ID NO: 122836 - protein, 210 aa, Heterodera glycines
  misc_feature (52)..(52): Xaa can be any naturally occurring amino acid
  misc_feature (64)..(64): Xaa can be any naturally occurring amino acid
  misc_feature (81)..(81): Xaa can be any naturally occurring amino acid
  misc_feature (104)..(104): Xaa can be any naturally occurring amino acid
  misc_feature (129)..(129): Xaa can be any naturally occurring amino acid
  misc_feature (144)..(144): Xaa can be any naturally occurring amino acid
  Homolog annotation: Hit_ID=NP_491868.2; Match level="QueryCoverage =100%, HitCoverage=42%, E-value=1e-45, Identity=46%"; Hit description= RNA lariat DeBRanching enzyme (56.7 kD) (dbr-1) [Caenorhabditis elegans] gb|AAK68279.2| Lariat debranchi
  Gene Ontology: Mol. function=RNA lariat debranching enzyme activity; Cellular component=nucleus; Biological process=mRNA splicing
  Essential gene: C elegans homolog=C55B7.8; Phenotype=Gro,Unclassified
  Coding regions on vcDNA: vcDNA=SeqID_49259; Strand=+; Position=2-631
GNHKSSGFMAELPNRRWGAPNIFYMGYASVGRFAGLPIGGFSGIFKPGDFNXCHFKRPPFREAXLRSSPPYHLRSVDIFRXRHLTDGPPLDIFFSHEWTGGITXFSYWETLSRIKAHFTEDVRNIRMGXPITMDLLHQLTPTHXLDPHLHVHFTVVVPHSSASPTASVTRFLALDIPGENPRRRCIQFLHIPIAEDAPLDHCYDPQWLAI

SEQ ID NO: 122837 - protein, 198 aa, Heterodera glycines
  misc_feature (25)..(25): Xaa can be any naturally occurring amino acid
  misc_feature (41)..(41): Xaa can be any naturally occurring amino acid
  misc_feature (135)..(135): Xaa can be any naturally occurring amino acid
  Homolog annotation: Hit_ID=AAL40720.1; Match level="QueryCoverage =96%, HitCoverage=45%, E-value=5e-54, Identity=51%"; Hit description =calreticulin [Meloidogyne incognita]
  Gene Ontology: Mol. function=calcium ion storage activity; Cellular component=endoplasmic reticulum lumen; Biological process=regulation of transcription, DNA-dependent
  Essential gene: C elegans homolog=Y38A10A.5; Phenotype=Unc
  Coding regions on vcDNA: vcDNA=SeqID_49260; Strand=+; Position=2-595
SLDCLITVHAKFFLHEEFSDDSWHXHLWVTTKSKYDYWKYXLSAWKFFGHLVPDQGLKTIHDARIYTISGEYSNNFIHNGKPLVVRFTVEREHNIDCRGGYLQLMASDCCRDNFRVQTPFHLMYSQDICGPRTNXVHVILGYEGKNSLLNSDLSCQDDDLSHLFTLMLFPDNTYKVLIDGHQVESGQLKADWDPVPAR

SEQ ID NO: 122838 - protein, 186 aa, Heterodera glycines
  misc_feature (14)..(14): Xaa can be any naturally occurring amino acid
  misc_feature (22)..(22): Xaa can be any naturally occurring amino acid
  misc_feature (57)..(57): Xaa can be any naturally occurring amino acid
  misc_feature (79)..(79): Xaa can be any naturally occurring amino acid
  misc_feature (91)..(91): Xaa can be any naturally occurring amino acid
  Homolog annotation: Hit_ID=NP_491233.1; Match level="QueryCoverage =100%, HitCoverage=86%, E-value=6e-72, Identity=78%"; Hit description= RAB family member (23.6 kD) (rab-2) [Caenorhabditis elegans] gb|AAB52431.1| Uncoordinated protein 108 [C
  Gene Ontology: Mol. function=protein transporter activity; Cellular component=endosome; Biological process=two-component signal transduction system (phosphorelay)
  Essential gene: C elegans homolog=F53F10.4; Phenotype=Unc
  Coding regions on vcDNA: vcDNA=SeqID_49261; Strand=+; Position=2-556
KRFRPVHDLTTWSXFGARHDAXIDGKQIILQIWDSAGQESFRSITRSYYRGAAGALXLVYDITRRHTFNHLTSWLGNAXQHSYSNKVIMLXIGNKSDLETRRAVKKEEGEQFARSSGLVFMETSAKTAAYVEEAFIDTAKEIYRKIQDGVFDIYNEANGFKLGPLHPTSSPSSPGGAPLGRASNCC

SEQ ID NO: 122839 - protein, 144 aa, Heterodera glycines
  Homolog annotation: Hit_ID=CAE71615.1; Match level="QueryCoverage =88%, HitCoverage=73%, E-value=1e-60, Identity=84%"; Hit description =Hypothetical protein CBG18577 [Caenorhabditis briggsae]
  Gene Ontology: Mol. function=FK506 binding; Cellular component =histone deacetylase complex; Biological process=protein folding
  Essential gene: C elegans homolog=Y75B12B.2; Phenotype=Emb
  Coding regions on vcDNA: vcDNA=SeqID_49262; Strand=+; Position=80-548
MSTRPKVFFDVMVGGKSTGRIVMELFSDIVPKTAENFRALCTGEKGMGKSGKPLHYKGSKFHRVIPSFMLQGGDFTRGNGTGGESIYGKCEKFPDENFKEKHTVPGLLSMANAGPNTNGSQFFITTVKTEVGRKAYLAIFEIHF

SEQ ID NO: 122840 - protein, 99 aa, Heterodera glycines
  Homolog annotation: Hit_ID=AAV91469.1; Match level="QueryCoverage =95%, HitCoverage=50%, E-value=6e-29, Identity=63%"; Hit description =ribosomal protein 31 [Lonomia obliqua]
  Gene Ontology: Mol. function=structural constituent of ribosome; Cellular component=cytosolic ribosome (sensu Eukarya); Biological process=protein biosynthesis
  Essential gene: C elegans homolog=Y48G8AL.8a; Phenotype=Emb,Lva
  Coding regions on vcDNA: vcDNA=SeqID_49263; Strand=+; Position=2-298
GKIHYCKRPDNSTKSCKARGSDLRVHFKNTHETARAIKHMPLKRAIRFLENVREEEENVPFRHFQRRVGSKAQAQAWGTTQGPWAKKSAQFPLQTSKNA

SEQ ID NO: 122841 - protein, 47 aa, Heterodera glycines
  misc_feature (26)..(26): Xaa can be any naturally occurring amino acid
  Homolog annotation: Hit_ID=NP_495707.1; Match level="QueryCoverage =100%, HitCoverage=21%, E-value=3e-09, Identity=63%"; Hit description= ribosomal Protein, Large subunit (24.7 kD) (rpl-10) [Caenorhabditis elegans] emb|CAA88308.1| Hypothetica
  Essential gene: C elegans homolog=F10B5.1; Phenotype=Lva,Ste
  Coding regions on vcDNA: vcDNA=SeqID_49264; Strand=+; Position=29-169
RGGPDPKILLYDGGTTRTTVDEFPCXVHMLSNGKEHLSSEALQAARI

SEQ ID NO: 122842 - protein, 126 aa, Heterodera glycines
  misc_feature (105)..(105): Xaa can be any naturally occurring amino acid
  Homolog annotation: Hit_ID=AAR85905.1; Match level="QueryCoverage =70%, HitCoverage=23%, E-value=1e-11, Identity=38%"; Hit description =Hypothetical protein F33D4.5 [Caenorhabditis elegans] ref|NP _501257.1| ribosomal protein L1 (42.7 kD) (4I4
  Essential gene: C elegans homolog=F33D4.5; Phenotype=Emb,Lva
  Coding regions on vcDNA: vcDNA=SeqID_49265; Strand=+; Position=68-445
PNKSISLQGIGRYYKTKAEDNSGSGTRQSQSLPFTRHNQWTTNSLPLATALSYISQYHSPSVYGKSDELLLLHIEMNMTSEKTTKFKTDSPQLVDLPHPFQHSEXRTILAFAGTKEAQQEVMLNGA

SEQ ID NO: 122843 - protein, 145 aa, Heterodera glycines
  Homolog annotation: Hit_ID=NP_499734.1; Match level="QueryCoverage =95%, HitCoverage=40%, E-value=1e-13, Identity=38%"; Hit description =cleavage and Polyadenylation Factor (cpf-2) [Caenorhabditis elegans] emb|CAB05746.1| Hypothetical protein
  Gene Ontology: Biological process=embryogenesis and morphogenesis
  Essential gene: C elegans homolog=F56A8.6; Phenotype=Emb
  Coding regions on vcDNA: vcDNA=SeqID_49266; Strand=+; Position=2-439
KPPQLPPQFNIPPPSVPSHQFQMQPPPLVPGQFHHGFPSMGMAPPSLLQQQQQQTPFTQQKPTPIAPLAVPPAATAPQQQQAVSPPPLSQQTQQSNSDNLDEEQQAQMLIRVLQLTDEQIRMLPPTERAQVIELRNQLRSADANA

SEQ ID NO: 122844 - protein, 186 aa, Heterodera glycines
  Homolog annotation: Hit_ID=NP_500841.1; Match level="QueryCoverage =98%, HitCoverage=49%, E-value=2e-83, Identity=75%"; Hit description =constitutive photomorphogenic COP9 SigNalosome subunit, Jun activation domain binding protein (41.0 kD) (
  Gene Ontology: Mol. function=metalloendopeptidase activity; Cellular component=signalosome complex; Biological process=glia cell migration
  Essential gene: C elegans homolog=B0547.1; Phenotype=Emb
  Coding regions on vcDNA: vcDNA=SeqID_49267; Strand=+; Position=41-598
MADSMFKYDQEEQRMIRNVKPWEQDPHYFKEVKISALALVKMVMHARSGGNIEIMGLMQGRVDANTIIVLDAFALPVEGTETRVNAQAQAYEFMTNFSESCEAVGRLEKVVGWYHSHPGYGCWLSGIDVNTQSINQQFQEPFVAIVIDPIRTVSAGKVDIGAFRTYPKGYKPPDEPPSEYQTIPLN

SEQ ID NO: 122845 - protein, 208 aa, Heterodera glycines
  Homolog annotation: Hit_ID=NP_595879.1; Match level="QueryCoverage =99%, HitCoverage=57%, E-value=8e-85, Identity=72%"; Hit description =60s ribosomal protein l2 [Schizosaccharomyces pombe] emb|CAB88236.1| rpl4 [Schizosaccharomyces pombe] sp|
  Gene Ontology: Mol. function=structural constituent of ribosome; Cellular component=cytosolic ribosome (sensu Eukarya); Biological process=protein biosynthesis
  Essential gene: C elegans homolog=B0041.4; Phenotype=Emb,Ste
  Coding regions on vcDNA: vcDNA=SeqID_49268; Strand=+; Position=1-624
YGSETKSSLPLPAVFKAPIRSDVVKAVYKNVAKNKRQAYAVSVKAGHQTSAESWGTGRAVARIPRVGGSGTHRAGQAAFGNMCRGGRMFAPTKVWRRWHVRTNVNEKRFAVVSALAASAIPALVMARGHRINRIAEVPLVIDDSAESFTKTKEAVTLLRKLKAYDDVKKVIHSRKLRAGKGKLRNRRHTQRRGPLVVYANDNGIVRAF

SEQ ID NO: 122846 - protein, 210 aa, Heterodera glycines
  Homolog annotation: Hit_ID=CAE56922.1; Match level="QueryCoverage =98%, HitCoverage=38%, E-value=4e-45, Identity=45%"; Hit description =Hypothetical protein CBG24767 [Caenorhabditis briggsae]
  Essential gene: C elegans homolog=T19H12.11; Phenotype=Gro
  Coding regions on vcDNA: vcDNA=SeqID_49269; Strand=+; Position=3-632
IKEPFKSEMSKGKEGVVFVSMGTIIRSSDLPAKFRRNLLETFAKFSDYHFIMRIEKGDNYSAEIAAKFGNIFLTPWAPQPAILADPRLKLFITHGGYNSLLEATRGGVPVLAMGFFADQHRNARAAERNGWARSFDKLKLVEGTAQFEALLGEMLNNEKYAVGAKRIQNLMSTKPFPAEERLTKSIRFLEQNGGKLPELLSESRNMGTIS

SEQ ID NO: 122847 - protein, 153 aa, Heterodera glycines
  Homolog annotation: Hit_ID=CAE75413.1; Match level="QueryCoverage =66%, HitCoverage=78%, E-value=7e-15, Identity=44%"; Hit description =Hypothetical protein CBG23403 [Caenorhabditis briggsae]
  Essential gene: C elegans homolog=ZK863.6; Phenotype=Dpy,Slu
  Coding regions on vcDNA: vcDNA=SeqID_49270; Strand=+; Position=48-509
MSSSETKLDEKSNEISNNELVGENNAKDGNVKEANNSTDKSAEAEVHTDEAQLGIAAVDPKPTDFSEKPTDIQKGGKPEEQQQQQQEDKGQSTLKSLPTRQYLDMTIVPILLQALSALAKERPSDPIEFVANYLLKEKPRFNGAANASSTNEH

SEQ ID NO: 122848 - protein, 192 aa, Heterodera glycines
  Homolog annotation: Hit_ID=NP_491446.1; Match level="QueryCoverage =94%, HitCoverage=62%, E-value=1e-13, Identity=30%"; Hit description =replication protein A2 32kDa family member (32.0 kD) (1F339) [Caenorhabditis elegans] gb|AAK71380.1| Hypo
  Essential gene: C elegans homolog=M04F3.1; Phenotype=Rup,Stp,Unc
  Coding regions on vcDNA: vcDNA=SeqID_49271; Strand=+; Position=51-626
MDASFDQFGGGGWGDQGEQEFAASQFQKNIYDKVPVPVAIDVLISMTGDEEKYVLGNFSFNTVQLMGKVANVSEVDQCTTYELCDAMATDIRVAKRFTVIRYITADLQPVKDEVFTIGQLVQVIGKLRLYNTRLSAVCFNIREVEIDEIAIHKLECKLAKIYFEKNLTEFSLGIVENDTIFHGKMSNPRAWL

SEQ ID NO: 122849 - protein, 209 aa, Heterodera glycines
  Homolog annotation: Hit_ID=CAE66826.1; Match level="QueryCoverage =99%, HitCoverage=4%, E-value=1e-33, Identity=37%"; Hit description =Hypothetical protein CBG12193 [Caenorhabditis briggsae]
  Gene Ontology: Mol. function=dynein ATPase activity; Cellular component=fusome; Biological process=mitotic spindle assembly
  Essential gene: C elegans homolog=T21E12.4; Phenotype=Emb
  Coding regions on vcDNA: vcDNA=SeqID_49272; Strand=+; Position=1-627
LLSDIRRDLNELLSICHGDQKQNNHSRELIAALVKRKRVPDNWLQFSVPKDVTALEWMRDFVQRMEQLKRLSLSENLRYEEVWLGGMFFPEAYITATRQLIAQTNGWSLEQMYMHITKTEEGQLKSTAFTLTDLRAIGVLCEADEMKLTDEVHVGVPRLQFTWTLEGHSPASVVVPVYLYSNRAKFLFGLNLLPIGFDHSMLSQRGVAF

SEQ ID NO: 122850 - protein, 201 aa, Heterodera glycines
  Homolog annotation: Hit_ID=CAE60852.1; Match level="QueryCoverage =100%, HitCoverage=65%, E-value=5e-51, Identity=53%"; Hit description= Hypothetical protein CBG04561 [Caenorhabditis briggsae]
  Gene Ontology: Cellular component=nucleus
  Essential gene: C elegans homolog=C47E8.4; Phenotype=Emb
  Coding regions on vcDNA: vcDNA=SeqID_49273; Strand=+; Position=32-634
MSQADAGRIIHIGKRRERAKEDIESQRQRLEEERRNLAASIKAKFTTNIDEQEEKFKERTVGLVTLDEVKERQNEIFYSGPSLKFSNEDRPKFEKAIQKRVLSFGAFDDDDDEEDEALIPITKKRHGMDPTVDTSFLPDRERDEQLQRERERIAKEWQEMQEREKNEEITVAFCYWDGSSHRKDSKTKKGTTIAQFLQKAL

SEQ ID NO: 122851 - protein, 104 aa, Heterodera glycines
  Homolog annotation: Hit_ID=NP_502556.1; Match level="QueryCoverage =47%, HitCoverage=33%, E-value=3e-20, Identity=87%"; Hit description =putative protein (15.5 kD) (4O65) [Caenorhabditis elegans] emb|CAC44306.1| Hypothetical protein Y67H2A.5
  Essential gene: C elegans homolog=Y67H2A.5; Phenotype=Sck,Ste
  Coding regions on vcDNA: vcDNA=SeqID_49274; Strand=+; Position=16-327
MCSKPTNVFLFKRLVSPVQICCRSIKGGGLVHPVTGKEPPTLEEFDPLNPGEWQLGAYGKILPRLPEGTRCGGLVMGKYGLYNPKVRALQEECYPKMNGRRADG

SEQ ID NO: 122852 - protein, 127 aa, Heterodera glycines
  misc_feature (121)..(121): Xaa can be any naturally occurring amino acid
  Homolog annotation: Hit_ID=CAE75362.1; Match level="QueryCoverage =99%, HitCoverage=28%, E-value=7e-38, Identity=62%"; Hit description =Hypothetical protein CBG23346 [Caenorhabditis briggsae]
  Gene Ontology: Mol. function=proteasome endopeptidase activity; Cellular component=26S proteasome; Biological process=proteolysis and peptidolysis
  Essential gene: C elegans homolog=C52E4.4; Phenotype=Emb
  Coding regions on vcDNA: vcDNA=SeqID_49275; Strand=+; Position=83-464
MEIAPLRNYNLGPDADHLKQAQKDIDEIQKRINTLCGVKESDTGLAPPILWDIAADKMAMSNEPPLQMARRTLIVKEQGKDTRYLIDVKHFAKFVEGLHENVAPTDIEEGMRAGVDRHIYXLHLPLP

SEQ ID NO: 122853 - protein, 79 aa, Heterodera glycines
  Homolog annotation: Hit_ID=NP_504688.1; Match level="QueryCoverage =98%, HitCoverage=71%, E-value=2e-26, Identity=78%"; Hit description =SyNaptoBrevin related, synaptic vesicle-associated membrane protein (12.0 kD) (snb-1) [Caenorhabditis ele
  Gene Ontology: Mol. function=v-SNARE activity; Cellular component =plasma membrane; Biological process=nonselective vesicle transport
  Essential gene: C elegans homolog=T10H9.4; Phenotype=Rup,Unc
  Coding regions on vcDNA: vcDNA=SeqID_49276; Strand=+; Position=2-238
LQTKAQVDEVLGIMNGNVKKVLERDHKLSPLDDRADALQESASWFQKSAATLNRKYCWKNINMIVIMCAIVFLLIIIIV

SEQ ID NO: 122854 - protein, 211 aa, Heterodera glycines
  Homolog annotation: Hit_ID=NP_502696.1; Match level="QueryCoverage =93%, HitCoverage=16%, E-value=5e-24, Identity=33%"; Hit description =DNA-binding SAP containing protein (4O841) [Caenorhabditis elegans] emb|CAB05201.1| Hypothetical protein
  Essential gene: C elegans homolog=Y37A1B.1a; Phenotype=Gro,Unc
  Coding regions on vcDNA: vcDNA=SeqID_49277; Strand=+; Position=3-638
KKLLSKERINYRDLTDKWVDKEGKVRYVPLPSYENIFQSFSEHAKGHKTSGDLFNSSSQNINEMSDPKLISESEFAYFEGSLINIKQSIERQYALEKERQETVDQNEKLTLQLNNINEQREHLEKKKRRLEDDVDRYKKKLYDSEKLLKKEQEDNSSMKTSLLDCKRYGERMVAVVEKVLPPPSKKEEKEKSSGSDKNGTSGKERTTKLRI

SEQ ID NO: 122855 - protein, 199 aa, Heterodera glycines
  Homolog annotation: Hit_ID=CAE67152.1; Match level="QueryCoverage =76%, HitCoverage=28%, E-value=9e-24, Identity=34%"; Hit description =Hypothetical protein CBG12577 [Caenorhabditis briggsae]
  Gene Ontology: Mol. function=DNA-directed RNA polymerase III activity; Cellular component=DNA-directed RNA polymerase III complex; Biological process=regulation of transcription from Pol III promoter
  Essential gene: C elegans homolog=C48E7.2; Phenotype=Dpy,Lva
  Coding regions on vcDNA: vcDNA=SeqID_49278; Strand=+; Position=3-599
CSRELIVEKEAMLSAKETKEMCCALMDHSFITVRQLARTNDFAPARTFFLYTVSMVQVLNAMISFCTQALNNVIRRRMLEREKHEALLDRQLKMEVILSNIANDPTFDDESRTQQMADVEQSYMTEADRRALERFRRAERRLFSTEIELDKVLFTFQQYDMLRRRWAMEQARQMPHGRRKRQQAAAAAVAATTAQSPNV

SEQ ID NO: 122856 - protein, 196 aa, Heterodera glycines
  Homolog annotation: Hit_ID=CAE60219.1; Match level="QueryCoverage =98%, HitCoverage=60%, E-value=5e-70, Identity=65%"; Hit description =Hypothetical protein CBG03788 [Caenorhabditis briggsae]
  Gene Ontology: Mol. function=ATPase activity; Cellular component =nucleus; Biological process=septin assembly and septum formation
  Essential gene: C elegans homolog=F10G8.6; Phenotype=Gro,Stp
  Coding regions on vcDNA: vcDNA=SeqID_49279; Strand=+; Position=3-590
TVTASLAYAIANLQEGAKPFKVAVLDVDICGPSQARMFGCEENSVQNSDQGWTPIFVQNNLFVMSIAFLLDTRDEAIIWRWPRKNALIKQFLRDVDWGELDFLIIDTPPGTSDEHISIVQMLLQASCLDGAVIVTTPQEISLLDVRKEVNFCVKTKVPVLGVVENMCQFVCPCCSTASQLFPNTTGGAKKMCADLS

SEQ ID NO: 122857 - protein, 126 aa, Heterodera glycines
  misc_feature (34)..(34): Xaa can be any naturally occurring amino acid
  misc_feature (73)..(73): Xaa can be any naturally occurring amino acid
  misc_feature (93)..(93): Xaa can be any naturally occurring amino acid
  misc_feature (105)..(105): Xaa can be any naturally occurring amino acid
  misc_feature (109)..(109): Xaa can be any naturally occurring amino acid
  Homolog annotation: Hit_ID=CAE60901.1; Match level="QueryCoverage =100%, HitCoverage=38%, E-value=2e-25, Identity=45%"; Hit description= Hypothetical protein CBG04617 [Caenorhabditis briggsae]
  Essential gene: C elegans homolog=C15H11.9; Phenotype=Lva
  Coding regions on vcDNA: vcDNA=SeqID_49280; Strand=+; Position=2-379
IWQITPQKLCKMLTCVFFFPNTLMRSPREKPFPXRKEPTNWENFARAKGITNKKDSKVWDKTTHECKPKYGYXRGENQSKERIIEIPDPEDPXLDHFAEKAEEKXERIXKHELPRLTNISRDSNTS

SEQ ID NO: 122858 - protein, 103 aa, Heterodera glycines
  misc_feature (29)..(29): Xaa can be any naturally occurring amino acid
  misc_feature (84)..(84): Xaa can be any naturally occurring amino acid
  Homolog annotation: Hit_ID=CAE58579.1; Match level="QueryCoverage =100%, HitCoverage=56%, E-value=2e-11, Identity=37%"; Hit description= Hypothetical protein CBG01745 [Caenorhabditis briggsae]
  Gene Ontology: Mol. function=structural constituent of ribosome; Cellular component=cytosolic large ribosomal subunit (sensu Eukarya); Biological process=reproduction
  Essential gene: C elegans homolog=E04A4.8; Phenotype=Emb,Gro
  Coding regions on vcDNA: vcDNA=SeqID_49281; Strand=+; Position=2-310
FEKKPVSANIFGVWLRINSGIVYLNMDRXYGDDWAAFGATQCYGDLHPLRSRLTDRMRIIQVQPVHVGVWIRSRVNHCHNSQIXFPLPHFVDCKRRIMTALTT

SEQ ID NO: 122859 - protein, 112 aa, Heterodera glycines
  Homolog annotation: Hit_ID=CAE64898.1; Match level="QueryCoverage =93%, HitCoverage=47%, E-value=3e-16, Identity=40%"; Hit description =Hypothetical protein CBG09713 [Caenorhabditis briggsae]
  Essential gene: C elegans homolog=D1054.14; Phenotype=Emb
  Coding regions on vcDNA: vcDNA=SeqID_49282; Strand=+; Position=26-364
HLFHALKKKRQALEEKDQLELYASALDEDLERLSTDSEDEQETRKARPNIVSRRRSRSRSRGRSRSKSRERRRRSLSTDDRRGGRSAAKDTEREIEENNALRKKLGLAPLER

SEQ ID NO: 122860 - protein, 45 aa, Heterodera glycines
  Homolog annotation: Hit_ID=XP_214621.2; Match level="QueryCoverage =97%, HitCoverage=36%, E-value=1e-09, Identity=70%"; Hit description =similar to Small nuclear ribonucleoprotein Sm D1 (snRNP core protein D1) (Sm-D1) (Sm-D autoantigen) [Ratt
  Gene Ontology: Mol. function=pre-mRNA splicing factor activity; Cellular component=small nuclear ribonucleoprotein complex; Biological process=mRNA splicing
  Essential gene: C elegans homolog=T28D9.10; Phenotype=Emb,Lva
  Coding regions on vcDNA: vcDNA=SeqID_49283; Strand=+; Position=2-136
NLARFEMKLSHESVTIELKNSTRMSGAIQGVHVSMNIHLRSVKMT

SEQ ID NO: 122861 - protein, 89 aa, Heterodera glycines
  misc_feature (64)..(64): Xaa can be any naturally occurring amino acid
  Homolog annotation: Hit_ID=NP_741609.1; Match level="QueryCoverage =100%, HitCoverage=32%, E-value=1e-15, Identity=44%"; Hit description= i-90 protein precursor family member (30.7 kD) (5K464) [Caenorhabditis elegans] emb|CAB02796.1| Hypothet
  Essential gene: C elegans homolog=T05G5.7; Phenotype=Emb
  Coding regions on vcDNA: vcDNA=SeqID_49284; Strand=+; Position=41-307
TKERIQSGNFFMDVLDKVLAINPDEYTLLHMRSRLVLSVASLSWIDRKEATALFGPPPEVSLFXAIIDFSAVLEFASHWVENSLLLAKA

SEQ ID NO: 122862 - protein, 208 aa, Heterodera glycines
  Homolog annotation: Hit_ID=AAR85527.1; Match level="QueryCoverage =94%, HitCoverage=80%, E-value=2e-50, Identity=53%"; Hit description =14-3-3b protein [Meloidogyne incognita]
  Gene Ontology: Mol. function=protein domain specific binding; Biological process=protein kinase C activation
  Essential gene: C elegans homolog=M117.2; Phenotype=Emb
  Coding regions on vcDNA: vcDNA=SeqID_49285; Strand=+; Position=11-634
MESNRELILYRAKLADQAVRYYDMGQLMKKVVELDNVLNEEERNMLSIAYKAVIRPLRFALREISPIEWTQDGTEKQLLMLKRYREKLVKELHDTCNELVELLDKLISRADDPEVKVFYLKMKADVYRYMAAEAIGGVVDKSRQAYQEAFDIAKDKLRPANATRLGLGLNFCIFYYDNLDMEETAIDFAKKVLEDANSDQHGGACNES

SEQ ID NO: 122863 - protein, 154 aa, Heterodera glycines
  Homolog annotation: Hit_ID=CAE59008.1; Match level="QueryCoverage =95%, HitCoverage=32%, E-value=2e-25, Identity=35%"; Hit description =Hypothetical protein CBG02284 [Caenorhabditis briggsae]
  Gene Ontology: Mol. function=RNA binding; Cellular component =nucleolus; Biological process=cytochrome c oxidase biogenesis
  Essential gene: C elegans homolog=ZK546.14a; Phenotype=Lva
  Coding regions on vcDNA: vcDNA=SeqID_49286; Strand=+; Position=6-470
MKAESVDDKPKQQFTFSNFRFVLHEDKCETRRDKRNKFTGRDFRRLLEKAEKRGQRMERIRTQNPQKAQCVEKNVAWERAFRRAAGQKVKDNVDLLKKGVVRKAKNKQRKKRKWEERKQTVETVKERRAEKKRENVEKRKRQQTEKNRGKRKRK

SEQ ID NO: 122864 - protein, 175 aa, Heterodera glycines
  misc_feature (59)..(59): Xaa can be any naturally occurring amino acid
  Homolog annotation: Hit_ID=AAK60209.1; Match level="QueryCoverage =90%, HitCoverage=73%, E-value=2e-34, Identity=43%"; Hit description =vap-1 [Heterodera glycines]
  Gene Ontology: Cellular component=extracellular space
  Essential gene: C elegans homolog=F49E11.9; Phenotype=Unclassified
  Coding regions on vcDNA: vcDNA=SeqID_49287; Strand=+; Position=3-527
SKDEQDYCVKFSNNLRSTVATGNQQNKGGGKLPSATNMLELAYNETIGQTAQAWADFCXFSHSNTAGLGENIYWSTKEGISNTEALNKAFVFWWNEAVTIGIPENLVVDANNFEPIGHFTQMAWHSTTDIGCGVAKCQHAQWKLFVVCNYWPPGNVLGQMTYGPGDSCSACESGW

SEQ ID NO: 122865 - protein, 77 aa, Heterodera glycines
  misc_feature (54)..(54): Xaa can be any naturally occurring amino acid
  Homolog annotation: Hit_ID=NP_740880.1; Match level="QueryCoverage =98%, HitCoverage=24%, E-value=1e-16, Identity=55%"; Hit description =quaking related 5 (33.2 kD) (1H379C) [Caenorhabditis elegans] gb|AAM81088.1| Hypothetical protein E02D9.1
  Essential gene: C elegans homolog=E02D9.1b; Phenotype=Gro,Pvl,Unc
  Coding regions on vcDNA: vcDNA=SeqID_49288; Strand=+; Position=2-232
IRLLATEWTNLENNIDPQWLIVYIHLPIKVSKNVLFPSFRPPKFNFVGKVLGPXRTTLQNIPTSFKCLVIILGLGST

SEQ ID NO: 122866 - protein, 192 aa, Heterodera glycines
  Homolog annotation: Hit_ID=NP_498417.1; Match level="QueryCoverage =91%, HitCoverage=72%, E-value=3e-44, Identity=48%"; Hit description =SET (trithorax/polycomb) domain containing (27.6 kD) (set-1) [Caenorhabditis elegans] gb|AAC77512.1| Set
  Gene Ontology: Mol. function=calcium ion binding; Cellular component =nucleus; Biological process=transcription from Pol II promoter
  Essential gene: C elegans homolog=T26A5.7a; Phenotype=Emb
  Coding regions on vcDNA: vcDNA=SeqID_49289; Strand=+; Position=25-600
MPKKKNGTTDEKGCLLITNYFPIRRSKRITTKELEDIKLKELKELIDTGFNEDHLEVFRCSVKGRSVRASKCFQRGEFVVEYKGDLISVKTAQLREQRYAKDENVGSFMYYFRHRDNVFCIDATDETPYKGRLINHSYLKPNLKTRVADFGCDGFHLVLVAMRDIDNGEELLYDYGERRPSVLAGNPWILGS

SEQ ID NO: 122867 - protein, 89 aa, Heterodera glycines
  Homolog annotation: Hit_ID=CAE59292.1; Match level="QueryCoverage =96%, HitCoverage=13%, E-value=9e-20, Identity=43%"; Hit description =Hypothetical protein CBG02627 [Caenorhabditis briggsae]
  Essential gene: C elegans homolog=C32D5.2; Phenotype=Sma
  Coding regions on vcDNA: vcDNA=SeqID_49290; Strand=+; Position=2-268
SNRCFCNYSPTVCDMEDTWITYTSAASFQAIVLEFNSGTSAIERRHFFGCAPLERGTDASHLTCDAWRYSHSNGRTVACCYQGNFCSPN

SEQ ID NO: 122868 - protein, 140 aa, Heterodera glycines
  Homolog annotation: Hit_ID=NP_498457.1; Match level="QueryCoverage =100%, HitCoverage=41%, E-value=1e-43, Identity=64%"; Hit description= malate dehydrogenase (35.1 kD) (mdh-1) [Caenorhabditis elegans] gb|AAB53985.1| Malate dehydrogenase prot
  Gene Ontology: Mol. function=L-malate dehydrogenase activity; Cellular component=mitochondrion; Biological process=TCA intermediate metabolism
  Essential gene: C elegans homolog=F20H11.3; Phenotype=Emb,Gro
  Coding regions on vcDNA: vcDNA=SeqID_49291; Strand=+; Position=2-421
SVMMKSTSIKVTLICTSGDIGQPLGLLLKKNPSIAHLALYYLVGTPGVADDLSHINTQAKVTGHLGPEQLAAALDGADVDIIPAGVPRKPGMTRDDFFNTNAGIGRDMAEATAKTCHKAFMDIITNPVNSTLPIDCEITK

SEQ ID NO: 122869 - protein, 189 aa, Heterodera glycines
  Homolog annotation: Hit_ID=EAK82415.1; Match level="QueryCoverage =97%, HitCoverage=94%, E-value=9e-71, Identity=72%"; Hit description =hypothetical protein UM01634.1 [Ustilago maydis 521] ref|XP _399249.1| hypothetical protein UM01634.1 [Usti
  Gene Ontology: Cellular component=cytosolic ribosome (sensu Eukarya); Biological process=protein biosynthesis
  Essential gene: C elegans homolog=C09D4.5; Phenotype=Lva,Ste
  Coding regions on vcDNA: vcDNA=SeqID_49292; Strand=+; Position=7-576
MVSLKLQKRLAASVLNCGKRKIWLDPNESSDIGNANSRANIRKLIKDGYIVRKPENAPSRFRVRERLAAKRKGRHTGTGKRRGTSEARMPTAVLWMRRQRVLRRLLRKYREAGKIDRHMYAELYLKSKGNVFKNKRVLMEYIFKVKAEKARTKALEDQAAAHRLKNKAARERKAQRAAEKKAALLGDKQ

SEQ ID NO: 122870 - protein, 162 aa, Heterodera glycines
  Homolog annotation: Hit_ID=AAS45135.1; Match level="QueryCoverage =98%, HitCoverage=29%, E-value=4e-43, Identity=58%"; Hit description =importin alpha 3 [Aplysia californica]
  Gene Ontology: Mol. function=nuclear localization sequence binding; Cellular component=importin, alpha-subunit; Biological process=NLS -bearing substrate-nucleus import
  Essential gene: C elegans homolog=F32E10.4; Phenotype=Emb,Lva,Unc
  Coding regions on vcDNA: vcDNA=SeqID_49293; Strand=+; Position=133-618
MADRQTQYKNIGKDVEALRKNRTEQVVSIRKEKRDDILFKRRNIPTEDATEDASTSNVTGVAVPYDRTNLQEIVVQAQSADPEVQMLAVTQARKLLSSDRNPPIDDLISSGILPILVNCLESPNATLQFEAAWALTNIASGTSDQTRAVVQAGAVPHFLKLL

SEQ ID NO: 122871 - protein, 164 aa, Heterodera glycines
  misc_feature (129)..(129): Xaa can be any naturally occurring amino acid
  Homolog annotation: Hit_ID=CAA65506.1; Match level="QueryCoverage =100%, HitCoverage=92%, E-value=4e-47, Identity=51%"; Hit description= cuticular collagen [Teladorsagia circumcincta]
  Gene Ontology: Mol. function=structural constituent of cuticle; Cellular component=extracellular; Biological process=cuticle biosynthesis (sensu Nematoda)
  Essential gene: C elegans homolog=T07H6.3a; Phenotype=Bmd,Gro,Unc
  Coding regions on vcDNA: vcDNA=SeqID_49294; Strand=+; Position=2-492
KSRQQEAECMRRLAFFGVALSTVATLITVLSVPMVYNYVQHVNSQMVSELDFCKSRSGNIWREVTRTQALHSNKQRVARQADYGYGGGACCGCGVSARGPQGPPGQPGVPGDDGAQGNNGAPGIPAFVXPATNGNPGEQGPAGSPGEPGKPGAPGYPGQNGPRG

SEQ ID NO: 122872 - protein, 183 aa, Heterodera glycines
  Homolog annotation: Hit_ID=CAA92630.1; Match level="QueryCoverage =100%, HitCoverage=100%, E-value=8e-79, Identity=77%"; Hit description=Hypothetical protein ZK792.6 [Caenorhabditis elegans] pir||A36290 let-60 ras protein - Caenorhabditis el
  Gene Ontology: Mol. function=GTPase activity; Cellular component =plasma membrane; Biological process=regulation of cell cycle
  Essential gene: C elegans homolog=ZK792.6; Phenotype=Lva,Lvl,Unc
  Coding regions on vcDNA: vcDNA=SeqID_49295; Strand=+; Position=70-621
MTEYKLVVVGDGGVGKSALTIQLIQGQFIEEYDPTIEDSYRKQVLIDGETCLLDILDTAGQEEYSAMRDQYMRTGEGFLLVFALNEYKSFENIHAYREQIRRVKDSDEVPMVLVGNKCDLAQRAMDQRSIQELARSFGIPFIETSAKTRRHVDEAFHALVREIRKHKDKHREKPKRRKRCAVL

SEQ ID NO: 122873 - protein, 175 aa, Heterodera glycines
  Homolog annotation: Hit_ID=CAE64416.1; Match level="QueryCoverage =95%, HitCoverage=40%, E-value=2e-17, Identity=28%"; Hit description =Hypothetical protein CBG09110 [Caenorhabditis briggsae]
  Essential gene: C elegans homolog=C56G2.3; Phenotype=Gro,Stp
  Coding regions on vcDNA: vcDNA=SeqID_49296; Strand=+; Position=87-611
MQHDPKLKEKVERVQKEYEVYDYFSEFIPKSFDDKEWVRTMECSSVVERVNYWAFLALSQHRKDLDEMKHNQSVEHTDSFFKEQLRLYNAGGMGYSEDAYCLYLNSYQGRNYASRKYRTIEESKKLAQQLTLGESPRILFDCQFLPQMTQRIYGKVAKSAVHAYFKNLHLPSPFP

SEQ ID NO: 122874 - protein, 179 aa, Heterodera glycines
  Homolog annotation: Hit_ID=NP_497846.3; Match level="QueryCoverage =98%, HitCoverage=46%, E-value=1e-78, Identity=80%"; Hit description =mitogen-activated Protein Kinase, plays a role in signal transduction during vulval development, involved
  Gene Ontology: Mol. function=MAP kinase activity; Cellular component =cytoplasm; Biological process=synaptic transmission
  Essential gene: C elegans homolog=F43C1.2a; Phenotype=Ste
  Coding regions on vcDNA: vcDNA=SeqID_49297; Strand=+; Position=1-540
EIMLNSKGYTKSIDVWSVGCILAEMLNNRPLFPGKHYLDQLNLILAVVGSPSQEDLQCIVNDKARAYLLSLQQKIKQPWVRLYPNADPRALDLLDKMLTFNPNKRIGIEEALAHPYLEQYYDPSDEPICERPFTFEMEFDDLPREKLKELIFQETEEFHRRATEAAAASRSETTMNEGT

SEQ ID NO: 122875 - protein, 186 aa, Heterodera glycines
  Homolog annotation: Hit_ID=XP_513093.1; Match level="QueryCoverage =94%, HitCoverage=98%, E-value=5e-41, Identity=47%"; Hit description =PREDICTED: similar to Trafficking protein particle complex subunit 3 (BET3 homolog) [Pan troglodytes] ref
  Gene Ontology: Cellular component=TRAPP; Biological process =intracellular protein transport
  Essential gene: C elegans homolog=ZK1098.5; Phenotype=Dpy
  Coding regions on vcDNA: vcDNA=SeqID_49298; Strand=+; Position=22-579
MSKESTKTGKQQLSGGTDFKMMSSELFILSYGALVVDLVNDLESPEEVNKHLDKIGFNMGLRMADDFLAKNPRIGRCSDMQQIMEIIAKSALKAYLGITAQFVAIGTEGNEFSLTLDSNPLVEFVEVPEEMKGLCYSQVICGCIRGALEALHMEVQAVLVSDVPEPPELRIKVHRVLQESIPGGEE

SEQ ID NO: 122876 - protein, 207 aa, Heterodera glycines
  Homolog annotation: Hit_ID=CAE60599.1; Match level="QueryCoverage =61%, HitCoverage=30%, E-value=3e-41, Identity=61%"; Hit description =Hypothetical protein CBG04236 [Caenorhabditis briggsae]
  Gene Ontology: Mol. function=transcription factor activity; Cellular component=nucleus; Biological process=reproduction
  Essential gene: C elegans homolog=W10C8.2; Phenotype=Emb
  Coding regions on vcDNA: vcDNA=SeqID_49299; Strand=+; Position=9-629
MRTPKREKVERKEKQQREEKKDHIKKPMNAFMLFMKANRHKYLEESVDKRKQSAELNKELGQIWQQMNREAQQPYYEMAQKAKEEHARMHPQWSARENYAIHKRAKKKRVREKSVDNNEQKKCRARFGVDNLTKWCKHCRRKKRCLNVLRDSDSPVQVSSSTNPSTTPLSIGVPSSAHFGSLLNSAHHQRLCSPHSRKDREGHGAPT

SEQ ID NO: 122877 - protein, 67 aa, Heterodera glycines
  Homolog annotation: Hit_ID=CAE71331.1; Match level="QueryCoverage =97%, HitCoverage=39%, E-value=5e-15, Identity=58%"; Hit description =Hypothetical protein CBG18231 [Caenorhabditis briggsae]
  Gene Ontology: Mol. function=RNA binding; Cellular component=small nuclear ribonucleoprotein complex; Biological process=positive regulation of growth rate
  Essential gene: C elegans homolog=Y48A6B.3; Phenotype=Gro
  Coding regions on vcDNA: vcDNA=SeqID_49300; Strand=+; Position=2-202
THGLADVMKSFPENEKGIIGLAGNVSPIGGDSHIPAICEEKGLPYDFSPSREHLGICAGYKRPAFVL

SEQ ID NO: 122878 - protein, 156 aa, Heterodera glycines
  Homolog annotation: Hit_ID=CAE67452.1; Match level="QueryCoverage =89%, HitCoverage=83%, E-value=1e-09, Identity=32%"; Hit description =Hypothetical protein CBG12951 [Caenorhabditis briggsae]
  Essential gene: C elegans homolog=T05A6.1; Phenotype=Unclassified
  Coding regions on vcDNA: vcDNA=SeqID_49301; Strand=+; Position=6-476
MSDSQQSDQRTERVTRRSLFGSGRPNDTDEWLKSLENNAMEEKVRKWSFDFRIGCPLKKAGAESPSSSHVYEAIDEREVPEFYRTKTLRSVPKRRPSSIRSPLKSPLKASESLKSESNLASATKEAANVLETPRKSKRLRKANSTESTPQKKKRNE

SEQ ID NO: 122879 - protein, 185 aa, Heterodera glycines
  Homolog annotation: Hit_ID=CAE71199.1; Match level="QueryCoverage =92%, HitCoverage=24%, E-value=2e-32, Identity=43%"; Hit description =Hypothetical protein CBG18058 [Caenorhabditis briggsae]
  Essential gene: C elegans homolog=F56F3.2a; Phenotype=Bmd,Emb
  Coding regions on vcDNA: vcDNA=SeqID_49302; Strand=+; Position=57-611
MRSLLSVLLCPLLLSLLRPSSTCLLCPLHIPARPKPLDQFRLPSIQKIVHTADTFEWLCQNGSKLATVSAQCRADVSHLFCSLTRLVQSLKTECPGADEGMAQCAECRRKTDILYRENKWVLTWIDSLGKMPSGISDGNYHWLGDYEQCLRLRDDGLFNGQYCLLEFRVPDGVLLNSEHCEDGSE

SEQ ID NO: 122880 - protein, 165 aa, Heterodera glycines
  Homolog annotation: Hit_ID=CAE72609.1; Match level="QueryCoverage =92%, HitCoverage=63%, E-value=1e-28, Identity=42%"; Hit description =Hypothetical protein CBG19800 [Caenorhabditis briggsae]
  Gene Ontology: Biological process=embryogenesis and morphogenesis
  Essential gene: C elegans homolog=Y105E8B.5; Phenotype=Unclassified
  Coding regions on vcDNA: vcDNA=SeqID_49303; Strand=+; Position=50-544
MENGNGIEKRGLVVEDGDGHPLSLFAVPNCYCADLDSVLIPNGMIHDRIRRMADEIQSAIGDRVSFKPNLNFAPFWRFVQPLTLVCLLKGAYRFFTALADCLAQLRLCCASPMQIEFIRAQSYLDQSSTGQLRSDGPSSIDGPLRGAEVLLVDDILDTGLTMTRI

SEQ ID NO: 122881 - protein, 157 aa, Heterodera glycines
  misc_feature (140)..(140): Xaa can be any naturally occurring amino acid
  Homolog annotation: Hit_ID=XP_328593.1; Match level="QueryCoverage =75%, HitCoverage=28%, E-value=2e-54, Identity=83%"; Hit description =hypothetical protein ( (AY027867) small subunit of ribonucleotide reductase [Neurospora crassa] ) gb|AAK1
  Gene Ontology: Mol. function=ribonucleoside-diphosphate reductase activity; Cellular component=cytoplasm; Biological process=DNA replication
  Essential gene: C elegans homolog=C03C10.3; Phenotype=Emb
  Coding regions on vcDNA: vcDNA=SeqID_49304; Strand=+; Position=116-585
MDSVKKAAVSGSLTASGSAAARDDGSSVGRPARTLLSDLELSESILTENKNRFVLFPIKYQDIWQMYKKAEASFWTAEEVDLSKDFHDWENRLNDDERHFISHVLAFFAASDGIVNENLVERFSQEVQVPEARCFYGFQXMIENIHSEMYSLLIDTY

SEQ ID NO: 122882 - protein, 161 aa, Heterodera glycines
  Homolog annotation: Hit_ID=NP_509285.2; Match level="QueryCoverage =97%, HitCoverage=47%, E-value=1e-46, Identity=53%"; Hit description =cytidylyltransferase (XI199) [Caenorhabditis elegans] gb|AAA68722.2| Hypothetical protein F08C6.2 [Caenor
  Gene Ontology: Mol. function=choline-phosphate cytidylyltransferase activity; Cellular component=cytoplasm; Biological process =phosphatidylcholine biosynthesis
  Essential gene: C elegans homolog=F08C6.2; Phenotype=Lva,Unc
  Coding regions on vcDNA: vcDNA=SeqID_49305; Strand=+; Position=3-488
SVDFLKRYKIDFIAHDALPYSAKDEEDLYEKFRRADMFVETQRTEGVSTSDVITRIVRDYHDYVRRNLQRGYTPEELNIGLLQASKYQLQNKFAAIRQKGAKMLKEWTDRSDEFIRNFTSTFNSDGPIGRFLSSRSPTPALEEQEEAAASDDDEDEEHNEA

SEQ ID NO: 122883 - protein, 173 aa, Heterodera glycines
  misc_feature (93)..(93): Xaa can be any naturally occurring amino acid
  misc_feature (106)..(106): Xaa can be any naturally occurring amino acid
  misc_feature (119)..(119): Xaa can be any naturally occurring amino acid
  Homolog annotation: Hit_ID=NP_509886.1; Match level="QueryCoverage =100%, HitCoverage=51%, E-value=3e-53, Identity=58%"; Hit description= u5 snRNP-specific protein (XL916) [Caenorhabditis elegans] emb|CAA91460.1| Hypothetical protein F08G12.2
  Gene Ontology: Mol. function=pre-mRNA splicing factor activity; Cellular component=small nucleolar ribonucleoprotein complex; Biological process=oviposition
  Essential gene: C elegans homolog=C18E3.5; Phenotype=Egl,Sck
  Coding regions on vcDNA: vcDNA=SeqID_49306; Strand=+; Position=2-520
VSLGDSTRTGEQRASGLQWPIMLLTGHEGEIYAAQFSPDGTCRASAGYDQRIFFWNDYGECENFSTLSGHQGAIMDVHFSTDGSFRFSCSTDXTVRVWDMESGKCXRRFRTHTDFVNGXHPARRGPSLVVSGCEGGKIIVHDVRRRCPESTFDSVSDYQRTSVTFNEPARTII

SEQ ID NO: 122884 - protein, 123 aa, Heterodera glycines
  misc_feature (58)..(58): Xaa can be any naturally occurring amino acid
  Homolog annotation: Hit_ID=AAH87725.1; Match level="QueryCoverage =100%, HitCoverage=90%, E-value=1e-42, Identity=73%"; Hit description= H3f3b protein [Rattus norvegicus] ref|NP_446437.1| H3 histone, family 3B [Rattus norvegicus] ref|NP_78889
  Gene Ontology: Mol. function=DNA binding; Cellular component =nucleosome; Biological process=embryogenesis and morphogenesis
  Essential gene: C elegans homolog=F45E1.6; Phenotype=Emb,Gro
  Coding regions on vcDNA: vcDNA=SeqID_49307; Strand=+; Position=2-373
RTKQTVRKSTGGKGPRKPLATKAVPKYAPPMGGVKMPQLYRPVTIALLEISRYSLSNXLLIRELPFQRLVRKIGHDYKTDLGLQSAAIGAVPEASEAYVVDLFEDTNHCVIHAKRVSIMPKDI

SEQ ID NO: 122885 - protein, 84 aa, Heterodera glycines
  misc_feature (59)..(59): Xaa can be any naturally occurring amino acid
  Homolog annotation: Hit_ID=NP_498646.1; Match level="QueryCoverage =100%, HitCoverage=19%, E-value=1e-17, Identity=53%"; Hit description= rna helicase, Conserved Germline Helicase CGH-1 (48.7 kD) (cgh-1) [Caenorhabditis elegans] gb|AAK85443.1
  Gene Ontology: Mol. function=RNA helicase activity; Cellular component=cytoplasm; Biological process=anti-apoptosis
  Essential gene: C elegans homolog=C07H6.5; Phenotype=Emb
  Coding regions on vcDNA: vcDNA=SeqID_49308; Strand=+; Position=2-253
GIALTCSHILTHFLHATGKTGSSCFRCFEKIDPSKEYIRAMILVPTRELALLPSLICVXLTKRLYINIMVTTGSPDLRDNILRL

SEQ ID NO: 122886 - protein, 197 aa, Heterodera glycines
  Homolog annotation: Hit_ID=CAE75362.1; Match level="QueryCoverage =96%, HitCoverage=43%, E-value=2e-67, Identity=63%"; Hit description =Hypothetical protein CBG23346 [Caenorhabditis briggsae]
  Gene Ontology: Mol. function=proteasome endopeptidase activity; Cellular component=26S proteasome; Biological process=proteolysis and peptidolysis
  Essential gene: C elegans homolog=C52E4.4; Phenotype=Emb
  Coding regions on vcDNA: vcDNA=SeqID_49309; Strand=+; Position=32-622
MSSDLVEKKETKPNETDDKTKEIKSLDEDEIAALSNYNMGPYADQLKQAEKDIDEIQKRINTLCGVKESDTGLAPPILWDIAADKMAKSNEPPLRVARCTKIVKEEGKETRYMINVKHFAKFVVGLHENVAPTDIEEGMRVGVDRHNYKIHLPLPDKIDASVTMMQVEDKPDVTYADMGGCEEEIKKVREVVEFPLL

SEQ ID NO: 122887 - protein, 198 aa, Heterodera glycines
  Homolog annotation: Hit_ID=NP_508024.2; Match level="QueryCoverage =97%, HitCoverage=66%, E-value=8e-36, Identity=42%"; Hit description =3' exoribonuclease (33.9 kD) (5V311) [Caenorhabditis elegans] emb|CAB07412.2| Hypothetical protein F31D4.
  Gene Ontology: Mol. function=3'-5' exoribonuclease activity; Cellular component=exosome (RNase complex); Biological process=rRNA processing
  Essential gene: C elegans homolog=F31D4.1; Phenotype=Emb,Lva
  Coding regions on vcDNA: vcDNA=SeqID_49310; Strand=+; Position=2-595
RNDGRSPTDYRPMALETGVLLGSNGSARLQLGATDVLVAVKADLQLVEPSTEAGDIQRVHFFVDISANASPRFAGRGGNDHAEEWAKSLAGAFANTAPSAMPDMAKLMLAPTQLWCLYVDVVVLQFDGNAMDAISLAVKAALADTEICNVVVRPADEGKVHIDLPEVISTWRMDMAGAPLVVGVNKIGDQCVLDADLM

SEQ ID NO: 122888 - protein, 184 aa, Heterodera glycines
  misc_feature (55)..(55): Xaa can be any naturally occurring amino acid
  Homolog annotation: Hit_ID=NP_503036.1; Match level="QueryCoverage =96%, HitCoverage=62%, E-value=2e-82, Identity=77%"; Hit description =auxiliary factor (30.9 kD) (4S62) [Caenorhabditis elegans] emb|CAB55137.1| Hypothetical protein Y116A8C.3
  Gene Ontology: Mol. function=pre-mRNA splicing factor activity; Cellular component=Cajal body; Biological process=mRNA splicing
  Essential gene: C elegans homolog=Y116A8C.35; Phenotype=Ste
  Coding regions on vcDNA: vcDNA=SeqID_49311; Strand=+; Position=41-640
MPRYDATDDLSGAEYLASIYGTEKDKVNCSFFFKIGACRHGDNCLRAHHRPTFSXTVLLKNFYQSPIVNPAQANAFDKVGKKDELEQRHFDEFYEEVFTELQRTYGPVEELNVCENIGEHMIGNVYVKFVYEEDAEKTAQGLENRWFNGQPIYAELSPVSDFREARCRQHEISTCSKGGFCNFM

SEQ ID NO: 122889 - protein, 101 aa, Heterodera glycines
  Homolog annotation: Hit_ID=NP_496176.1; Match level="QueryCoverage =85%, HitCoverage=17%, E-value=4e-15, Identity=46%"; Hit description =esterase A family member (52.5 kD) (2K387) [Caenorhabditis elegans] emb|CAA88435.1| Hypothetical protein
  Essential gene: C elegans homolog=M28.6; Phenotype=Unclassified
  Coding regions on vcDNA: vcDNA=SeqID_49312; Strand=+; Position=138-443
MNAEKTVFGKCSPKFANVEKAFRRHFADGWEREGASLAIYWKGQLVVDLCDGYADKASHERWGEETLTACVLRDERHSLHIIAYMLICTGHVGYSKSIRVF

SEQ ID NO: 122890 - protein, 142 aa, Heterodera glycines
  misc_feature (60)..(60): Xaa can be any naturally occurring amino acid
  Homolog annotation: Hit_ID=CAE56899.1; Match level="QueryCoverage =100%, HitCoverage=36%, E-value=7e-28, Identity=42%"; Hit description= Hypothetical protein CBG24740 [Caenorhabditis briggsae]
  Gene Ontology: Mol. function=acetyl-CoA C-acetyltransferase activity; Cellular component=mitochondrion; Biological process=ergosterol biosynthesis
  Essential gene: C elegans homolog=T02G5.7; Phenotype=Bmd,Unc
  Coding regions on vcDNA: vcDNA=SeqID_49313; Strand=+; Position=2-427
MGVCADKTVAEFGFTREQQDAYALTSYALATRAWAGGSLGAQIVPVKHKNRKGTELMVAXDDEERRLVPDKVPSLQPASVKDGTGTMTGANASSLDDGTTSLVIASGRFAGAETMAIVIAYSEAGGTADNFSVAADDPAKSL

SEQ ID NO: 122891 - protein, 130 aa, Heterodera glycines
  misc_feature (33)..(33): Xaa can be any naturally occurring amino acid
  misc_feature (54)..(54): Xaa can be any naturally occurring amino acid
  Homolog annotation: Hit_ID=NP_493686.2; Match level="QueryCoverage =97%, HitCoverage=40%, E-value=6e-29, Identity=44%"; Hit description =Cystinosin/ERS1p repeat (35.0 kD) (2A514C) [Caenorhabditis elegans] gb|AAK39328.2| Hypothetical protein Y
  Essential gene: C elegans homolog=Y43H11AL.2; Phenotype=Clr,Pch
  Coding regions on vcDNA: vcDNA=SeqID_49314; Strand=+; Position=2-391
GKEHCANGTKWILNVCEDCAETPMKMCGFWVGXVPLFLRLIPVFPELNDDFLNXRCEGLSIFFLMLWVIGDSCNMIGADVTHRQPLQQIIGVYYILPDLALLGQVIYYTRLYSATLRREMVNGTTVIVPV

SEQ ID NO: 122892 - protein, 197 aa, Heterodera glycines
  Homolog annotation: Hit_ID=NP_990387.1; Match level="QueryCoverage =90%, HitCoverage=23%, E-value=1e-44, Identity=50%"; Hit description =CFR-associated protein p70 [Gallus gallus] gb|AAB94317.1| CFR -associated protein p70 [Gallus gallus]
  Gene Ontology: Mol. function=enoyl-CoA hydratase activity; Cellular component=mitochondrion; Biological process=growth
  Essential gene: C elegans homolog=T08B2.7a; Phenotype=Unclassified
  Coding regions on vcDNA: vcDNA=SeqID_49315; Strand=+; Position=32-622
VQKEHTRRGAQNGAFGRSLGARLMGAGIANVSIGKGIHTTLDHTKHEALDRGLKQITAQVDGQLKRKKISATEHSICLSELNPVGDYYDQLHDSDVVIEAVFDDIGLMHLIVLILEKVVPDHCVITANTSALPIRDIASDAQRPERVIGMHYFSPVDKMQLLEIIVSEKTSKEALAVDAKLGLDHKKLIVVVKDGPG

SEQ ID NO: 122893 - protein, 106 aa, Heterodera glycines
  Homolog annotation: Hit_ID=AAH75235.1; Match level="QueryCoverage =99%, HitCoverage=45%, E-value=4e-26, Identity=56%"; Hit description =MGC84447 protein [Xenopus laevis]
  Gene Ontology: Mol. function=RNA binding; Cellular component=nucleus; Biological process=mRNA processing
  Essential gene: C elegans homolog=F43G9.5; Phenotype=Emb,Sck,Stp
  Coding regions on vcDNA: vcDNA=SeqID_49316; Strand=+; Position=2-319
TTGWSANGNRTALNALLSQNNYFHLKRTINLHPLTNYTFGSNEPLSKRDHSVQARFQRLRNEYKKTAMRRIADGLLLAHEDSLAHELLLHVGTTFLRLPGGELNHG

SEQ ID NO: 122894 - protein, 93 aa, Heterodera glycines
  Homolog annotation: Hit_ID=CAE59146.1; Match level="QueryCoverage =98%, HitCoverage=22%, E-value=2e-18, Identity=49%"; Hit description =Hypothetical protein CBG02451 [Caenorhabditis briggsae]
  Essential gene: C elegans homolog=C17G10.2; Phenotype =Emb,Gro,Pvl,Sma,Stp,Unc
  Coding regions on vcDNA: vcDNA=SeqID_49317; Strand=+; Position=2-280
KWGEEIDKHPAFARDLKPTEDGQYSMEMQAIQAMKYDEDDPTECANAYKEEGNRHFEKRNYRWAIDAYTKGIKLRWSDVRLNSVLFANRSAAH

SEQ ID NO: 122895 - protein, 185 aa, Heterodera glycines
  Homolog annotation: Hit_ID=NP_510322.2; Match level="QueryCoverage =100%, HitCoverage=18%, E-value=1e-84, Identity=82%"; Hit description= argonaute (plant)-Like Gene (110.9 kD) (alg-1) [Caenorhabditis elegans] emb|CAA93512.2| Hypothetical pro
  Gene Ontology: Mol. function=translation initiation factor activity; Cellular component=eukaryotic translation initiation factor 2 complex; Biological process=embryonic development
  Essential gene: C elegans homolog=F48F7.1; Phenotype =Gro,Lvl,Prz,Sma,Unc
  Coding regions on vcDNA: vcDNA=SeqID_49318; Strand=+; Position=1-555
IKKLTDNQTSTMIKATARSAPEREKEISELVRRAEFINDPFAHEFGISITPVMTEFKGRVLTAPKLLYGGRNRATALPNQGVWDMRAKQFHTGIEVKTWAIACFAPQQSVKENDLRNFTVQLQRISADAGMPIQGQPCFCKYALGADQVEPMLKYLKQNFPGLQLVCVILPGKTPVYAEVKRVGD

SEQ ID NO: 122896 - protein, 205 aa, Heterodera glycines
  misc_feature (180)..(180): Xaa can be any naturally occurring amino acid
  Homolog annotation: Hit_ID=NP_491363.1; Match level="QueryCoverage =99%, HitCoverage=4%, E-value=7e-65, Identity=58%"; Hit description =dynein heavy chain, LEThal LET-354 (dhc-1) [Caenorhabditis elegans] gb|AAK21472.1| Dynein heavy chain prot
  Gene Ontology: Mol. function=dynein ATPase activity; Cellular component=fusome; Biological process=oocyte cell fate determination (sensu Insecta)
  Essential gene: C elegans homolog=T21E12.4; Phenotype=Emb
  Coding regions on vcDNA: vcDNA=SeqID_49319; Strand=+; Position=2-616
RIAKAPAERARLYFIICWFHAIVQERLRYQPLGWANSYEFTDADFRVACDTLDSTVDMVAQNRANVKPDKLPWLALRTLLSLCIYGGKIDNDFDQVLLDTLLDKLFTSNSFDADFILIDNIGVNALNMPDETNSKDGLINWVINIKALQKPNWIGLPNNAEKVLIAERGQEFIRKMIKMXDDELAYEADDLERNKQAPTWMGQFS

SEQ ID NO: 122897 - protein, 129 aa, Heterodera glycines
  misc_feature (53)..(53): Xaa can be any naturally occurring amino acid
  Homolog annotation: Hit_ID=AAA37170.1; Match level="QueryCoverage =99%, HitCoverage=34%, E-value=2e-42, Identity=67%"; Hit description =A-X actin
  Gene Ontology: Biological process=reproduction
  Essential gene: C elegans homolog=T04C12.6; Phenotype=Ste
  Coding regions on vcDNA: vcDNA=SeqID_49320; Strand=+; Position=11-400
PAALMADNGSGMFKAVFMYDDSPLSAFPSIVGRPRHLDVMVGMGHNDSHLRYXVHSPRGILTLKNTIVFDIVTHWDYMDNIWFLTFYNELRVTPEDHPVLLTEAPLIPEGTREKMTPIMIETLNTPAMY

SEQ ID NO: 122898 - protein, 208 aa, Heterodera glycines
  Homolog annotation: Hit_ID=NP_499317.1; Match level="QueryCoverage =95%, HitCoverage=28%, E-value=5e-61, Identity=57%"; Hit description =vesicle transport-related (3L601) [Caenorhabditis elegans] emb|CAA84704.1| Hypothetical protein F43D9.3 [
  Gene Ontology: Mol. function=SNARE binding; Cellular component=ER -Golgi transport vesicle; Biological process=intracellular protein transport
  Essential gene: C elegans homolog=F43D9.3; Phenotype=Ste
  Coding regions on vcDNA: vcDNA=SeqID_49321; Strand=+; Position=31-654
MASTHNHCYIESLRTRQTASLKQLLNLNQPLNVSLAVEPVWKLLIFDRYCQDIISPLLSVKQLRELGVTLHLSVDSPREILPDVPAVYFVSPTEQNVQTICADLKRAMYDSFYLNMVRPIPRPLLEQLAESAVAGGATQQVQKLTDQFLSFISLEDDLFMLSRYTKSSPFSFYAINDPSITTRSIDAVVADIANGLVAVCVTLGGVPV

SEQ ID NO: 122899 - protein, 184 aa, Heterodera glycines
  Homolog annotation: Hit_ID=NP_740937.1; Match level="QueryCoverage =98%, HitCoverage=20%, E-value=1e-57, Identity=59%"; Hit description =AdaPTin or adaptin-related protein (91.6 kD) (apt-1) [Caenorhabditis elegans] emb|CAD21660.1| Hypothetica
  Gene Ontology: Mol. function=transporter activity; Cellular component= Golgi trans face; Biological process=intracellular protein transport
  Essential gene: C elegans homolog=Y105E8A.9; Phenotype=Emb
  Coding regions on vcDNA: vcDNA=SeqID_49322; Strand=+; Position=2-553
TTVVECLKDADISIKKRALELCFALMNQTNIASMSKEIIIFLETADSDFKAECSSKMYVATERFSPSLVWHLDTMINVLQLAANHVPDEVVSAMIQLISSQQELQHYATVQLFHASKREHIVNAQPLMQIAFWSIGEFGDLLVAPGNTEEANIKVSEDEVVELFQLLMPHPRLTVPTRGVWTNC

SEQ ID NO: 122900 - protein, 64 aa, Heterodera glycines
  misc_feature (37)..(37): Xaa can be any naturally occurring amino acid
  misc_feature (39)..(39): Xaa can be any naturally occurring amino acid
  Homolog annotation: Hit_ID=AAB66305.1; Match level="QueryCoverage =100%, HitCoverage=17%, E-value=5e-18, Identity=73%"; Hit description= cytoplasmic actin CyII [Heliocidaris erythrogramma]
  Gene Ontology: Biological process=reproduction
  Essential gene: C elegans homolog=T25C8.2; Phenotype=Unclassified
  Coding regions on vcDNA: vcDNA=SeqID_49323; Strand=+; Position=2-193
AGFAGYDTIRALFPSIAGRTPHQGFMDSMGLKDSHVXIXAQSKRGILTLKYSTEHRIVTNWDDM

SEQ ID NO: 122901 - protein, 135 aa, Heterodera glycines
  Homolog annotation: Hit_ID=CAA37049.1; Match level="QueryCoverage =100%, HitCoverage=35%, E-value=5e-49, Identity=72%"; Hit description= unnamed protein product [Aplysia californica] sp|P17304|ACTM_APLCA Actin, muscle pir||S12730 actin - Cali
  Gene Ontology: Biological process=reproduction
  Essential gene: C elegans homolog=T04C12.6; Phenotype=Ste
  Coding regions on vcDNA: vcDNA=SeqID_49324; Strand=+; Position=2-406
CDEEVAALVVDNGSGMCKAGFAGDDAPRAVFPSIVGRPRHQGVMVGMGQKDSHVGDEALFKRGILTLKYPTVHGIDTNWDDMETIWHHTFYNELPVPPQGAHQSCSKRTRRNRMATTKNVTQISYRDVQSRRAMY

SEQ ID NO: 122902 - protein, 152 aa, Heterodera glycines
  Homolog annotation: Hit_ID=AAP92328.1; Match level="QueryCoverage =90%, HitCoverage=49%, E-value=4e-27, Identity=44%"; Hit description =leucine zipper protein [Branchiostoma belcheri tsingtaunese]
  Essential gene: C elegans homolog=H38K22.2a; Phenotype=Emb
  Coding regions on vcDNA: vcDNA=SeqID_49325; Strand=+; Position=47-502
MNRLRRDQKEKVQQFVSLTQANEQTAITCLTASNWDLEMACDMFYQNPSYTNQQVGATGGADSRKIEHLFNKYACDPKDKSQKIGPDRIGPNGMVRFLRDLNIEPTSRAVMVLAWKMGAQKQCEFTLQEFRDGISTLIPTGTVEINGLRKAL

SEQ ID NO: 122903 - protein, 97 aa, Heterodera glycines
  Homolog annotation: Hit_ID=AAH85585.1; Match level="QueryCoverage =55%, HitCoverage=25%, E-value=1e-23, Identity=96%"; Hit description =Zgc:103679 [Danio rerio] ref|NP_001007360.1| zgc:103679 [Danio rerio]
  Gene Ontology: Mol. function=RAB small monomeric GTPase activity; Cellular component=Golgi apparatus; Biological process=signal transduction
  Essential gene: C elegans homolog=F53G12.1; Phenotype=Emb,Ste
  Coding regions on vcDNA: vcDNA=SeqID_49326; Strand=+; Position=169-462
LFQVDSKTVKAQIWDTAGQERYRAITSAYYRGAVGALLVYDIAKHVTYENVERWLKGVCVCRTEKNGEIYGGNFWFTRNFLCAKIRHFEKLGHGFSG

SEQ ID NO: 122904 - protein, 107 aa, Heterodera glycines
  misc_feature (52)..(52): Xaa can be any naturally occurring amino acid
  Homolog annotation: Hit_ID=CAE57570.1; Match level="QueryCoverage =99%, HitCoverage=25%, E-value=3e-16, Identity=44%"; Hit description =Hypothetical protein CBG00548 [Caenorhabditis briggsae]
  Gene Ontology: Mol. function=RNA binding; Cellular component=nucleus; Biological process=mRNA cleavage
  Essential gene: C elegans homolog=F28C6.3; Phenotype=Emb,Lva
  Coding regions on vcDNA: vcDNA=SeqID_49327; Strand=+; Position=2-322
AGLDLEVYADDVPTRPEPSLYYTVCLTTLQVPGPEAAVSAYGALVPTGSNDXSLNTLDGDPILSRIDVTLNESGRDAHLPVIQTLYDHLDVTTKTLYHQSLVFLLSS

SEQ ID NO: 122905 - protein, 123 aa, Heterodera glycines
  misc_feature (76)..(76): Xaa can be any naturally occurring amino acid
  Homolog annotation: Hit_ID=CAE66979.1; Match level="QueryCoverage =99%, HitCoverage=73%, E-value=3e-19, Identity=41%"; Hit description =Hypothetical protein CBG12375 [Caenorhabditis briggsae]
  Gene Ontology: Biological process=positive regulation of embryonic development
  Essential gene: C elegans homolog=F36A2.7; Phenotype=Emb,Lva
  Coding regions on vcDNA: vcDNA=SeqID_49328; Strand=+; Position=2-370
HWKYERDYSYDLRYSNPIYNYSRFTRFITLTATGHQQLWALFPLLMLSSSLATGIAFHRLDKIEGWVDRSTSPPPXDCARVRDTYWLFPTDLYDPTGVTHVPLRPMYILHDDLLEAAKERGTR

SEQ ID NO: 122906 - protein, 188 aa, Heterodera glycines
  misc_feature (82)..(82): Xaa can be any naturally occurring amino acid
  Homolog annotation: Hit_ID=CAE64946.1; Match level="QueryCoverage =72%, HitCoverage=86%, E-value=8e-45, Identity=58%"; Hit description =Hypothetical protein CBG09777 [Caenorhabditis briggsae]
  Essential gene: C elegans homolog=M01F1.6; Phenotype=Lva
  Coding regions on vcDNA: vcDNA=SeqID_49329; Strand=+; Position=7-570
MQRLAKRANTGGLLIPLSGTVQTISTRGVLRIPHWENHIRFDPRFGRKRPCQDVLDRFARLNNGLWVRSRQGRNKQVYQKDXIFRKVNMQWDTCTKRECAMLDKLMTPFWLRPKHYVGDPMEPYHTRYGITSPRVDDQKRLVRERPKLLLDDLTSDRFFDRISPAQSKSELLLQGQSSILPKLLQKAM

SEQ ID NO: 122907 - protein, 192 aa, Heterodera glycines
  Homolog annotation: Hit_ID=NP_496176.1; Match level="QueryCoverage =95%, HitCoverage=38%, E-value=1e-60, Identity=57%"; Hit description =esterase A family member (52.5 kD) (2K387) [Caenorhabditis elegans] emb|CAA88435.1| Hypothetical protein
  Essential gene: C elegans homolog=M28.6; Phenotype=Unclassified
  Coding regions on vcDNA: vcDNA=SeqID_49330; Strand=+; Position=55-630
MNAEKTVFGKCSPKFANVEKAFRRHFADGWEREGASLAIYWKGQLVVDLCGGYADKASLKRWGDYTRTVLFSVTKAVAALAVQMLIDRGHIAYSDKISVFWPEFARNGKENITLEDVLLHRAGLAALDETVTMKAARDHVRMAQILEAQTPNWPLGTTRSGYHAVTFGWLIDQIIRRVDPQKRGISQFVREE

SEQ ID NO: 122908 - protein, 64 aa, Heterodera glycines
  Homolog annotation: Hit_ID=NP_508413.1; Match level="QueryCoverage =85%, HitCoverage=28%, E-value=3e-11, Identity=60%"; Hit description =ribosomal Protein, Large subunit (22.8 kD) (rpl-11.2) [Caenorhabditis elegans] gb|AAA83599.1| Ribosomal p
  Gene Ontology: Cellular component=mitochondrion
  Essential gene: C elegans homolog=F07D10.1; Phenotype=Lva
  Coding regions on vcDNA: vcDNA=SeqID_49331; Strand=+; Position=2-193
TKADISPQKKEKKLGSPMRDLKRPKLCLKICIGESGDPITRAANGLKRLTGQSPGLSQAEYTVK

SEQ ID NO: 122909 - protein, 201 aa, Heterodera glycines
  Homolog annotation: Hit_ID=NP_741190.1; Match level="QueryCoverage =46%, HitCoverage=10%, E-value=4e-13, Identity=39%"; Hit description =A kinase anchor protein 1 (96.4 kD) (3H455) [Caenorhabditis elegans] gb|AAM22053.1| Hypothetical protein
  Gene Ontology: Mol. function=RNA binding; Cellular component =extracellular space
  Essential gene: C elegans homolog=C56G2.1a; Phenotype=Emb
  Coding regions on vcDNA: vcDNA=SeqID_49332; Strand=+; Position=44-646
MDDKSPAAIFAREFEHRQARDVDELRRIFHRHIEEESRSDEQQRHEKTAAPMLTTAPAMAAALPSARIVRTPHIGTNVRENGTASLSAITPIAAAFRWCTPLANTPTISVHVNPGHFFVQLPSHPTFSSLALLNQYMLPVYTHNQPGVGAPGLAKPYDVGVLCAAPAYNGWVRAHTLGFHQDQEEMLVRFPQYGGFPPLAR

SEQ ID NO: 122910 - protein, 106 aa, Heterodera glycines
  Homolog annotation: Hit_ID=CAE61651.1; Match level="QueryCoverage =100%, HitCoverage=29%, E-value=1e-16, Identity=37%"; Hit description= Hypothetical protein CBG05585 [Caenorhabditis briggsae]
  Gene Ontology: Biological process=positive regulation of body size
  Essential gene: C elegans homolog=Y59A8B.2; Phenotype=Gro,Sma
  Coding regions on vcDNA: vcDNA=SeqID_49333; Strand=+; Position=2-319
QCNSCNTTSVLFKVISQLSLGLSTNTDDLTLKDCLDAHFSSPTLEDKWDCPKRRSKHPATRITQIWEIPKVLIVHLKRFSLNDGHYVKNNVEVTFDVGEIDLAPFL

SEQ ID NO: 122911 - protein, 186 aa, Heterodera glycines
  Homolog annotation: Hit_ID=CAB88203.1; Match level="QueryCoverage =98%, HitCoverage=90%, E-value=1e-79, Identity=56%"; Hit description =putative cuticular collagen [Globodera pallida]
  Gene Ontology: Mol. function=structural constituent of cuticle; Cellular component=extracellular; Biological process=reproduction
  Essential gene: C elegans homolog=C15A11.6; Phenotype=Emb
  Coding regions on vcDNA: vcDNA=SeqID_49334; Strand=+; Position=3-563
SLYSEMSQMNSKVRDGVEAFRVNTDSAWTDLMDVQVVVTPPSKPRDNPFNSIFRAKRQLPGHCQCAGLQQPSCPPGPPGPSGPPGQPGQPGGAGQPGQPGQPGQPAPPCPPQNGNPGSQGQPGQPGGQGPPGPPGAPGQPGQPGNSGQPGQPGAPGQPGKDSGYCPCPPRSSVLAVKKKMAAAKKA

SEQ ID NO: 122912 - protein, 202 aa, Heterodera glycines
  misc_feature (119)..(119): Xaa can be any naturally occurring amino acid
  Homolog annotation: Hit_ID=CAE59572.1; Match level="QueryCoverage =94%, HitCoverage=40%, E-value=2e-93, Identity=83%"; Hit description =Hypothetical protein CBG02970 [Caenorhabditis briggsae]
  Gene Ontology: Mol. function=NADH dehydrogenase (ubiquinone) activity; Cellular component=mitochondrion; Biological process =energy pathways
  Essential gene: C elegans homolog=C09H10.3; Phenotype=Emb,Lva
  Coding regions on vcDNA: vcDNA=SeqID_49335; Strand=+; Position=36-640
MVSMVAGRVHLLPRAASFGKSFLSSDATKKPDKTSFGNLNDSDRIFTNLYGRHDYRLKGALARGDWFKTKDIILKGPKWILGEISTSGLRGRGGAGFPSGMKWGFMGKPFDGRPKYLVXNADEGEPGTCKDREIMRHDPHKLIEGCLIAGVAMGARAAYIYIRGEFYNEACILQESIHEAYKAGYIGKDCLGTGYNFDIFVH

SEQ ID NO: 122913 - protein, 201 aa, Heterodera glycines
  Homolog annotation: Hit_ID=CAE58535.1; Match level="QueryCoverage =83%, HitCoverage=27%, E-value=5e-14, Identity=28%"; Hit description =Hypothetical protein CBG01692 [Caenorhabditis briggsae]
  Essential gene: C elegans homolog=R08C7.10a; Phenotype=Egl,Emb,Gro,Unc
  Coding regions on vcDNA: vcDNA=SeqID_49336; Strand=+; Position=52-654
MSLLNGKNATGHCQSDGDSSIAMKRGAEEFDFGGSEADGAIGQGGNAPPAAKFQRVQQFSCYAVYSISAQPKSNAIRGQIQDFKHELHYVLTTIFDEKAAENLKSLSLVQLIKKAIIPQFRNFLRTKSVQLEKLFGVLTELSSNSSVFSLSSSCLLYLLARDQKSIPPSENCFRLISELLRQDSQRAKMDEEHKKHTETIW

SEQ ID NO: 122914 - protein, 155 aa, Heterodera glycines
  misc_feature (87)..(87): Xaa can be any naturally occurring amino acid
  Homolog annotation: Hit_ID=CAE62215.1; Match level="QueryCoverage =100%, HitCoverage=39%, E-value=1e-57, Identity=70%"; Hit description= Hypothetical protein CBG06266 [Caenorhabditis briggsae]
  Gene Ontology: Mol. function=mannose-1-phosphate guanylyltransferase activity; Cellular component=cytoplasm; Biological process=protein modification
  Essential gene: C elegans homolog=C42C1.5; Phenotype=Lva
  Coding regions on vcDNA: vcDNA=SeqID_49337; Strand=+; Position=2-467
RPLTITQPKPLVEFANKPMVVHQIEALAAVGVDTVVLAVTARIEDLLAGEMRKEEQRIGIRIVFSVEDEPMGTAGPLALASDLLGDXSPFFVLNSDVICTFPFAEMMHYHRKHGRQGTIAVTKVDEPSKYGVVVFEETNGRIDRFVEKPQEYVGN

SEQ ID NO: 122915 - protein, 212 aa, Heterodera glycines
  Homolog annotation: Hit_ID=NP_509479.1; Match level="QueryCoverage =99%, HitCoverage=43%, E-value=1e-64, Identity=60%"; Hit description =troponin T (tnt-2) [Caenorhabditis elegans] pir||T16441 hypothetical protein F53A9.10 - Caenorhabditis el
  Essential gene: C elegans homolog=F53A9.10a; Phenotype=Gro,Slu
  Coding regions on vcDNA: vcDNA=SeqID_49338; Strand=+; Position=1-636
RKRHLMMAGGFGGFVAADAEGAGKNFVVPEKSEKGAQQGMPGQTSKPRGLSKEQQEEAKRNYMSIVNRPVDVSNMLPNDIKANIKQLHARIVKLEGEKYDLEKRKDRQEYDLKELSERQKQHARAKALETGADPTEVESSGNFPPKVRVASRFDRQTDLRGYGQRRDLFEHPAETPEPKIVHGSGRPPPEWGRKEFEELENIRKNLEPPKYV

SEQ ID NO: 122916 - protein, 122 aa, Heterodera glycines
  Homolog annotation: Hit_ID=AAQ92368.1; Match level="QueryCoverage =100%, HitCoverage=32%, E-value=1e-37, Identity=68%"; Hit description= actin [Haliotis discus hannai]
  Gene Ontology: Biological process=reproduction
  Essential gene: C elegans homolog=T04C12.6; Phenotype=Ste
  Coding regions on vcDNA: vcDNA=SeqID_49339; Strand=+; Position=2-367
CDEEVDALVGGNGSGMSKAGFAGDDAPRAERPTIGGRPRNKGVMVGMGQKDSYVGVEAEWKRGSLRLKKSNEHGSETNRDDREKIWQHTGNNEGGVAPEEQPEQLKEGRGKPKAKREKRTQM

SEQ ID NO: 122917 - protein, 142 aa, Heterodera glycines
  Homolog annotation: Hit_ID=NP_498045.1; Match level="QueryCoverage =59%, HitCoverage=19%, E-value=5e-12, Identity=42%"; Hit description =mitochondrial ribosomal protein L3 (3G25) [Caenorhabditis elegans] gb|AAA21160.2| Hypothetical protein C2
  Essential gene: C elegans homolog=C26E6.6; Phenotype=Lva
  Coding regions on vcDNA: vcDNA=SeqID_49340; Strand=-; Position=115-583
LSNCFGGFRALIEQELSSDSFVHSRKLSLSPYETFHLIPGVSNPPDCTQNQYSFEASKRIGLIGRKIGMTLQWSFRLKDGTRCLCTLIHVPVNHVLSANNPETWYRHSLTGKQKAFRGILTIDQCAPPMWSVSLIKSNCVLP

SEQ ID NO: 122918 - protein, 191 aa, Heterodera glycines
  Homolog annotation: Hit_ID=AAK67238.1; Match level="QueryCoverage =76%, HitCoverage=63%, E-value=2e-60, Identity=72%"; Hit description =Hmg protein 1.2, isoform c [Caenorhabditis elegans]
  Gene Ontology: Mol. function=DNA bending activity; Cellular component= nucleus; Biological process=development
  Essential gene: C elegans homolog=F47D12.4a; Phenotype =Emb,Gro,Pvl,Sma,Stp
  Coding regions on vcDNA: vcDNA=SeqID_49341; Strand=+; Position=61-633
MASLTNMITNSYIVNTPSGQYTIQQQPGMTLQHQPQQIIHHVIPQHRQQSSMHGIQQHHSERPLVRGKTSPYGFFVKMCYEEHKKKYPNECVQVTEISKKCSQKWKTMTDDEKKRFFELAQKDAERYQAEVAAYGGEDVLKRKKRAKKDPNAPKRALSAFFFFSNEKRQEVSGEHPEWKVGQIAQELGVRW

SEQ ID NO: 122919 - protein, 188 aa, Heterodera glycines
  Homolog annotation: Hit_ID=BAA92134.1; Match level="QueryCoverage =100%, HitCoverage=45%, E-value=2e-23, Identity=32%"; Hit description= unnamed protein product [Homo sapiens]
  Essential gene: C elegans homolog=T21C9.2; Phenotype=Unclassified
  Coding regions on vcDNA: vcDNA=SeqID_49342; Strand=+; Position=2-565
GTHRSPVFATIHQQTAKFISKFSEAKRRFFNERIDTEPWQPNRIPYVYQRIVDKFRLSGALSDVEENVEDEHEDDDDEREGNRDYLVLGGSKRFIVVGSATSLLRVLAQYSDLLFLFPQCSMELTMDIVQILKAFNSRTCQLILGAGARQLVGLKMISVKHLALALRSLQFIAQFIPALRQTFLNQLP

SEQ ID NO: 122920 - protein, 128 aa, Heterodera glycines
  Homolog annotation: Hit_ID=BAA88337.1; Match level="QueryCoverage =96%, HitCoverage=12%, E-value=1e-15, Identity=38%"; Hit description =ORF2 [Platemys spixii]
  Essential gene: C elegans homolog=ZK250.3; Phenotype=Clr,Lvl,Sck
  Coding regions on vcDNA: vcDNA=SeqID_49343; Strand=-; Position=250-636
KTIIRMYKTYVRPQLEYAVEIWNPNLKKDIERIEKVQKFFTRKAFKKCGLLHRSYSERLEICQLIELTKRRNIADLTTAFKIMKGFTSLDASKLFTFSDRPTRRPLLLRMRRTTTKSKNNFFNRIAKN

SEQ ID NO: 122921 - protein, 201 aa, Heterodera glycines
  Homolog annotation: Hit_ID=AAN15196.1; Match level="QueryCoverage =100%, HitCoverage=56%, E-value=1e-111, Identity=95%"; Hit description=actin [Globodera rostochiensis] gb|AAN78299.1| actin 1 [Heterodera glycines] gb|AAG47837.2| actin 1 [Het
  Gene Ontology: Biological process=reproduction
  Essential gene: C elegans homolog=T04C12.6; Phenotype=Ste
  Coding regions on vcDNA: vcDNA=SeqID_49344; Strand=+; Position=58-660
MCDEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGDGVTHTVPIYEGYALPHAILRLDLAGRDLTDYLMKILTERGYSFVTTAEREIVR

SEQ ID NO: 122922 - protein, 193 aa, Heterodera glycines
  Homolog annotation: Hit_ID=AAN15196.1; Match level="QueryCoverage =100%, HitCoverage=51%, E-value=1e-94, Identity=87%"; Hit description= actin [Globodera rostochiensis] gb|AAN78299.1| actin 1 [Heterodera glycines] gb|AAG47837.2| actin 1 [Hete
  Gene Ontology: Cellular component=actin filament; Biological process =reproduction
  Essential gene: C elegans homolog=T04C12.6; Phenotype=Ste
  Coding regions on vcDNA: vcDNA=SeqID_49345; Strand=+; Position=2-580
CDEKVAALEVDNGSGMCKAGFSGDDTPRAVFPSIVGRPRHHGVMVGMGQNDSYVGDEAHSKYVILTLKYPIEHGIFTDWDDMEKIWHHTFYNELHVAPQEHPVLLTEAPLNPKANREKMTLIMFETFNTPAMYMAIQAVLSLYTSGHTTRLMLDSGDGVTHTVTIYEGYALTHAILRLDLNSRDLTEYLMKIL

SEQ ID NO: 122923 - protein, 102 aa, Heterodera glycines
  Homolog annotation: Hit_ID=NP_594413.1; Match level="QueryCoverage =100%, HitCoverage=35%, E-value=1e-26, Identity=57%"; Hit description= 40s ribosomal protein s0B [Schizosaccharomyces pombe] emb|CAB92099.1| rpsa-2 [Schizosaccharomyces pombe]
  Gene Ontology: Mol. function=laminin receptor activity; Cellular component=integral to plasma membrane; Biological process=protein biosynthesis
  Essential gene: C elegans homolog=B0393.1; Phenotype=Emb,Ste
  Coding regions on vcDNA: vcDNA=SeqID_49346; Strand=+; Position=2-310
TDDARLKFLVCESNIGTKNMDYQMEHYVWKHLSDGIHIIHIHKTSYKLMLAARAIAAIENPSDVFVVSTHPNSQRDVLQFAAHISATPIVGRFTPGSLTDHI

SEQ ID NO: 122924 - protein, 215 aa, Heterodera glycines
  Homolog annotation: Hit_ID=AAS50826.1; Match level="QueryCoverage =69%, HitCoverage=28%, E-value=2e-17, Identity=39%"; Hit description =ABR056Cp [Ashbya gossypii ATCC 10895] ref|NP_983002.1| ABR056Cp [Eremothecium gossypii]
  Gene Ontology: Mol. function=alpha DNA polymerase activity; Cellular component=alpha DNA polymerase:primase complex; Biological process =DNA replication
  Essential gene: C elegans homolog=W02D9.1; Phenotype=Emb
  Coding regions on vcDNA: vcDNA=SeqID_49347; Strand=+; Position=6-650
MFFGEEITKIPREVGKEDVCKAISHQIEAIDIDQCNLNMYLKPDTGVISLDQFQAMGSKRLTMLRKLEMLKEKFGNANSQDEYKKAFREDIGALMPLVTNLCVNAGLNEARREDRISHFILRLAFCHIPEQSDWFVRLETELFRMRFQNETKKNMALFVASIGIQLNQVDTSEREQLVDELCQALSLSAEEMEGADLYKVDFVDVLELLSSHRIL

SEQ ID NO: 122925 - protein, 175 aa, Heterodera glycines
  Homolog annotation: Hit_ID=NP_505181.1; Match level="QueryCoverage =96%, HitCoverage=55%, E-value=5e-56, Identity=61%"; Hit description =mitochondrial ribosomal protein L4 (34.3 kD) (5I949) [Caenorhabditis elegans] gb|AAB69933.1| Hypothetical
  Gene Ontology: Cellular component=mitochondrion
  Essential gene: C elegans homolog=T23B12.2; Phenotype=Emb,Lva
  Coding regions on vcDNA: vcDNA=SeqID_49348; Strand=+; Position=92-616
LRELWKLDKRNPFQEIPEAWVTSLDDIETKNCGLIQLHPDIFRVKPGLDLLHRNITWQSNYRNLTLLKMLSHDEMPGGGRKPWSQKKMGRHHAGSIPSPHFIRGGFAHGVRGPCTQFYMLPNTVRIHGLRTALTLIHAQDDLVIVDSYDTLNSAEPQFLNDLADARNWGLFRAGC

SEQ ID NO: 122926 - protein, 109 aa, Heterodera glycines
  misc_feature (87)..(87): Xaa can be any naturally occurring amino acid
  misc_feature (101)..(101): Xaa can be any naturally occurring amino acid
  Homolog annotation: Hit_ID=AAN15196.1; Match level="QueryCoverage =100%, HitCoverage=28%, E-value=5e-46, Identity=83%"; Hit description= actin [Globodera rostochiensis] gb|AAN78299.1| actin 1 [Heterodera glycines] gb|AAG47837.2| actin 1 [Hete
  Gene Ontology: Mol. function=structural constituent of cytoskeleton; Cellular component=cytoskeleton; Biological process=actin cytoskeleton organization and biogenesis
  Essential gene: C elegans homolog=T04C12.6; Phenotype=Ste
  Coding regions on vcDNA: vcDNA=SeqID_49349; Strand=+; Position=2-331
PSFISMESVGIHESTYNSIMKCDIDIRNDLYDNNVLSGGTTMYPGIADRMQNEMTALGPSTMENPIIAPSERKYYLWIRGSILTSLXTFQQMWISKQEYYXSGPSIAHR

SEQ ID NO: 122927 - protein, 169 aa, Heterodera glycines
  Essential gene: C elegans homolog=T07H6.3a; Phenotype=Bmd,Gro,Unc
  Coding regions on vcDNA: vcDNA=SeqID_49350; Strand=+; Position=121-627
MFLLIALLLVVFPLFCGAIPALPNSAAALTQQQQRMMQIDAFSAADDAQRKDSDAAGGAAPFAFEPSEQKAFVLKGLRRVKNPSPPAVVPKLTADAKIISLNADDDEWREMGQQQKQQHFQQIGAQMQNEVDFCKMRSGNMWREVNRTQAYSKVSHDSRHKRQAGGCCG

SEQ ID NO: 122928 - protein, 156 aa, Heterodera glycines
  Homolog annotation: Hit_ID=CAE66739.1; Match level="QueryCoverage =95%, HitCoverage=91%, E-value=2e-29, Identity=42%"; Hit description =Hypothetical protein CBG12089 [Caenorhabditis briggsae]
  Essential gene: C elegans homolog=R12E2.12; Phenotype=Lva,Unclassified
  Coding regions on vcDNA: vcDNA=SeqID_49351; Strand=+; Position=2-472
TFFFRPLTKPSLVEAIKRQATLLMDKGAVITKLESLGYRDLPYSRLDRFAKKNVHYANSILMNSSMSVKTMNDARTLFSNDKELLWFGIVNTNSLPDTPDKCDLEQFLQPPAYRQSVEELRKNQKLPFFTSFKIYKRTETEYHNIPKSYFVAPHKR

SEQ ID NO: 122929 - protein, 72 aa, Heterodera glycines
  misc_feature (21)..(21): Xaa can be any naturally occurring amino acid
  misc_feature (41)..(41): Xaa can be any naturally occurring amino acid
  Homolog annotation: Hit_ID=NP_495707.1; Match level="QueryCoverage =95%, HitCoverage=31%, E-value=5e-21, Identity=71%"; Hit description =ribosomal Protein, Large subunit (24.7 kD) (rpl-10) [Caenorhabditis elegans] emb|CAA88308.1| Hypothetical
  Gene Ontology: Mol. function=structural constituent of ribosome; Cellular component=cytosolic large ribosomal subunit (sensu Eukarya); Biological process=ribosomal large subunit assembly and maintenance
  Essential gene: C elegans homolog=F10B5.1; Phenotype=Lva,Ste
  Coding regions on vcDNA: vcDNA=SeqID_49352; Strand=+; Position=2-217
GRRPSRGYRYIMNKPYPKCSXFCPGVPDPKIRMFDSGKKHXTVDEAPCCVHMISNEREHLTTEALEADRNLC

SEQ ID NO: 122930 - protein, 143 aa, Heterodera glycines
  Homolog annotation: Hit_ID=AAR16088.1; Match level="QueryCoverage =99%, HitCoverage=17%, E-value=2e-46, Identity=64%"; Hit description =phosphofructokinase [Ascaris suum]
  Gene Ontology: Mol. function=6-phosphofructokinase activity; Cellular component=6-phosphofructokinase complex; Biological process=glucose metabolism
  Essential gene: C elegans homolog=Y71H10A.1a; Phenotype=Emb
  Coding regions on vcDNA: vcDNA=SeqID_49353; Strand=+; Position=3-434
LIVQSEGASHNYDTTFVQKLFSEEGKGEFSTRINILGHPQQGGKPTPFDRNMGTKLGARALNHLITQINANFDKTTERCNADKPDTATLLGLIGREVVFSPLEELAAETDFEHRLPLKQWWLKFRPLLRILAKHRASYVQEAT

SEQ ID NO: 122931 - protein, 176 aa, Heterodera glycines
  Homolog annotation: Hit_ID=NP_510410.1; Match level="QueryCoverage =74%, HitCoverage=62%, E-value=3e-26, Identity=50%"; Hit description =histone, H1.1 (21.4 kD) (his-24) [Caenorhabditis elegans] emb|CAB01892.1| Hypothetical protein M163.3 [Ca
  Gene Ontology: Mol. function=DNA binding; Cellular component =nucleosome; Biological process=nucleosome assembly
  Essential gene: C elegans homolog=C30G7.1; Phenotype=Egl,Unc
  Coding regions on vcDNA: vcDNA=SeqID_49354; Strand=+; Position=107-634
MTTGSPQQSPQAQQTEATAQQQTAAAAANAGSAGGTPKSQTKKAATKAPKAPKAKAPKAAKKAHAPANHPPYIHMIKKALGELKEKKGASKGAILKYIMSNFDVGGNQLRANMQLKQALKRGVSSGDLKQVRGIGASGSFKLGDGTQPTLAKASPAKKKSPIKKAKKAAPPAPAAV

SEQ ID NO: 122932 - protein, 64 aa, Heterodera glycines
  Homolog annotation: Hit_ID=P12431; Match level="QueryCoverage=100%, HitCoverage=17%, E-value=1e-16, Identity=70%"; Hit description =Actin, muscle
  Gene Ontology: Cellular component=actin filament; Biological process =cytoskeleton organization and biogenesis
  Essential gene: C elegans homolog=T04C12.6; Phenotype=Ste
  Coding regions on vcDNA: vcDNA=SeqID_49355; Strand=+; Position=14-208
VAALGVDNGTGMRNDGCAGDDAPRAEVPSIGGRPRHHGVMGGMGQKDSHAGYYAEPKGDILTLQ

SEQ ID NO: 122933 - protein, 113 aa, Heterodera glycines
  Homolog annotation: Hit_ID=AAQ05016.1; Match level="QueryCoverage =99%, HitCoverage=29%, E-value=8e-26, Identity=50%"; Hit description =beta-actin [Tigriopus japonicus]
  Gene Ontology: Cellular component=actin filament; Biological process =reproduction
  Essential gene: C elegans homolog=T04C12.6; Phenotype=Ste
  Coding regions on vcDNA: vcDNA=SeqID_49356; Strand=+; Position=14-352
VAALVGDNGSGMCKGGFTGYEAPQVGYPPVEGHPRHEGAMGRMGQKVFFLGHYDQTQGGSQTLKCPIEHRFHACWDYVEKNWHCTCYDELRVCPHEYPRVAERGPAEPEGRQR

SEQ ID NO: 122934 - protein, 170 aa, Heterodera glycines
  Homolog annotation: Hit_ID=NP_498661.1; Match level="QueryCoverage =99%, HitCoverage=31%, E-value=2e-50, Identity=55%"; Hit description =pescadillo, LiPid Depleted LPD-7 (61.6 kD) (lpd-7) [Caenorhabditis elegans] gb|AAK84463.1| Lipid depleted
  Gene Ontology: Cellular component=nucleolus; Biological process=growth
  Essential gene: C elegans homolog=R13A5.12; Phenotype=Lpd
  Coding regions on vcDNA: vcDNA=SeqID_49357; Strand=+; Position=126-635
MRIKKKFASGTARVFVSRKKALKKLQLNLRDFRRLCILKGIYPREPSSAKRANKGGSSEHKIFYHLKDINFLAQEPLLEKFREYKAFLKKVTRARAKREHLKLEGLLRAKPTFSYDHLVRERYPTFASALRDLDDALCLCFAFSALTQSKIARPRTIGQCRRAVTEFMHF

SEQ ID NO: 122935 - protein, 204 aa, Heterodera glycines
  misc_feature (72)..(72): Xaa can be any naturally occurring amino acid
  misc_feature (168)..(168): Xaa can be any naturally occurring amino acid
  misc_feature (189)..(189): Xaa can be any naturally occurring amino acid
  Homolog annotation: Hit_ID=NP_506559.1; Match level="QueryCoverage =97%, HitCoverage=32%, E-value=1e-81, Identity=77%"; Hit description =ATP synthase alpha and beta subunits ; ATP synthase ab C terminal (66.5 kD) (5O835Co) [Caenorhabditis ele
  Gene Ontology: Mol. function=hydrogen-transporting ATPase activity, rotational mechanism; Cellular component=proton-transporting two -sector ATPase complex; Biological process=transport
  Essential gene: C elegans homolog=Y49A3A.2; Phenotype=Emb,Ste
  Coding regions on vcDNA: vcDNA=SeqID_49358; Strand=+; Position=2-617
MHIWPVRNPRPTAEKLTANFPLLCGQRVLDALFPRVQGGTTAIPGAFGCGKTVISQTVSKYSNSDAIIYWGXGKRGNKMSEMLRDFPELTMEMDGVTTSIMERTALVDNTSNMPVAAREASIYTAITLDEYFRNMDLNVAMMADSTSRWDEALLENSERVSEMPDDSXYPAYLAEQLAYYYKRALKMRXCVSPERKGSDIMSAQ

SEQ ID NO: 122936 - protein, 134 aa, Heterodera glycines
  misc_feature (73)..(73): Xaa can be any naturally occurring amino acid
  misc_feature (121)..(121): Xaa can be any naturally occurring amino acid
  misc_feature (130)..(130): Xaa can be any naturally occurring amino acid
  Homolog annotation: Hit_ID=AAT70232.1; Match level="QueryCoverage =100%, HitCoverage=35%, E-value=8e-56, Identity=81%"; Hit description= unc-87 [Heterodera glycines]
  Essential gene: C elegans homolog=F08B6.4a; Phenotype=Unc
  Coding regions on vcDNA: vcDNA=SeqID_49359; Strand=+; Position=14-415
MPESENDFDEEAPYATMETLVAGGGAAPNRVRRWTLAQLRQTDGIIPSHVGWNQGDSQKLMTNFGTPRNTTAXVNVENRAEIPEDILLISHGEVRLLSGTNRLASHKGCVSIGTVRDVRRXGVNVNFVPXDLKP

SEQ ID NO: 122937 - protein, 213 aa, Heterodera glycines
  Homolog annotation: Hit_ID=AAH77522.1; Match level="QueryCoverage =93%, HitCoverage=25%, E-value=2e-41, Identity=46%"; Hit description =Cstf3-prov protein [Xenopus laevis]
  Gene Ontology: Mol. function=RNA binding; Cellular component=nucleus; Biological process=embryogenesis and morphogenesis
  Essential gene: C elegans homolog=F28C6.6; Phenotype=Emb
  Coding regions on vcDNA: vcDNA=SeqID_49360; Strand=+; Position=2-640
PDVAKRIFDLGLKSHGSDPDYALAYVEFLSHLNEDNNTRVVFERLLNSENALPPEKSLEIWDKYLEFESQVGDLTSVLKVDQRMKTACLEGEDRQALWLIDRYKFLNLAPCTTDQLKLMGYSPQKFARPSASVPFQNGAFPVSSASVQPNVLQSGRSQQFLTSAAALNIELGGYARADTSQMLPFKPKLPPASYHPVPRGCFSSHRLLSPHCF

SEQ ID NO: 122938 - protein, 172 aa, Heterodera glycines
  misc_feature (80)..(80): Xaa can be any naturally occurring amino acid
  Homolog annotation: Hit_ID=NP_995882.1; Match level="QueryCoverage =100%, HitCoverage=43%, E-value=2e-49, Identity=43%"; Hit description= CG5119-PH, isoform H [Drosophila melanogaster] ref|NP_725754.1| CG5119-PG, isoform G [Drosophila melanog
  Gene Ontology: Mol. function=poly(A) binding; Cellular component =cytoplasm; Biological process=mRNA metabolism
  Essential gene: C elegans homolog=Y106G6H.2a; Phenotype=Gro,Stp
  Coding regions on vcDNA: vcDNA=SeqID_49361; Strand=+; Position=2-520
RALDTLNFDLTLNKPIRIMWPQRDPSIPGSGVGNLFINNLDKEIHTTAIYDTFTMVGSILSCKSATDMEGGSKGDGIIRXDTEETANRAIAKVNGMLMDGKKLIDGKYVPRTAREKQHGDPTSHYNKAYEKNFDEAMESNKLIELYSQHGEIISAKVMKDDSGKSKGLSCVA

SEQ ID NO: 122939 - protein, 137 aa, Heterodera glycines
  misc_feature (69)..(71): Xaa can be any naturally occurring amino acid
  misc_feature (74)..(74): Xaa can be any naturally occurring amino acid
  misc_feature (77)..(77): Xaa can be any naturally occurring amino acid
  misc_feature (79)..(83): Xaa can be any naturally occurring amino acid
  Homolog annotation: Hit_ID=AAL40720.1; Match level="QueryCoverage =39%, HitCoverage=13%, E-value=7e-11, Identity=59%"; Hit description =calreticulin [Meloidogyne incognita]
  Essential gene: C elegans homolog=Y38A10A.5; Phenotype=Unc
  Coding regions on vcDNA: vcDNA=SeqID_49362; Strand=+; Position=59-472
MCAIYGSGAIVKGHHNNATGQKGRRNACRRGGGGRWSRGTPRDYPTLLTFTPKMWWAFCGRRDSLGGFXXXYLXFLXNXXXXXIHIFQVMSGTIFHNILLTYSVEDAKKHAADSFDQLKEAEKKQKEAYAKEERNKF

SEQ ID NO: 122940 - protein, 184 aa, Heterodera glycines
  misc_feature (125)..(125): Xaa can be any naturally occurring amino acid
  Homolog annotation: Hit_ID=AAN15196.1; Match level="QueryCoverage =100%, HitCoverage=48%, E-value=2e-90, Identity=87%"; Hit description= actin [Globodera rostochiensis] gb|AAN78299.1| actin 1 [Heterodera glycines] gb|AAG47837.2| actin 1 [Hete
  Gene Ontology: Cellular component=actin filament; Biological process =reproduction
  Essential gene: C elegans homolog=T04C12.6; Phenotype=Ste
  Coding regions on vcDNA: vcDNA=SeqID_49363; Strand=+; Position=2-553
CDEEVAALVVDNGSGMCKAGFAGDDAPRAEFPSIVGRPRHHGVMVGMGQKDSHVRYEAHCQSGILTLKYPIEHGILTNWDYMENIWHHTFYDELRVAPEEHPVLLTEAPLNPKANREKMTQIMFXTFNTPDMYVAIHGVLSLYSSGRTTGLVLDSGDGVTHTVAIYDGYALPHTILRVDLSGRD

SEQ ID NO: 122941 - protein, 107 aa, Heterodera glycines
  misc_feature (73)..(73): Xaa can be any naturally occurring amino acid
  Homolog annotation: Hit_ID=AAT70232.1; Match level="QueryCoverage =97%, HitCoverage=27%, E-value=3e-24, Identity=55%"; Hit description =unc-87 [Heterodera glycines]
  Essential gene: C elegans homolog=F08B6.4a; Phenotype=Unc
  Coding regions on vcDNA: vcDNA=SeqID_49364; Strand=+; Position=14-334
MSDSQDDFNDEAPHASMETKVGGGVSDPSRGPRWTSFPLFPTDWIFPVKAGWSYGDSLKFMTDFVTARSTTTXCEVANLAEITEDNLLRTAWHVRLQSGSDRIARGL

SEQ ID NO: 122942 - protein, 79 aa, Heterodera glycines
  Homolog annotation: Hit_ID=AAF43421.1; Match level="QueryCoverage =97%, HitCoverage=11%, E-value=8e-23, Identity=64%"; Hit description =epsin-like protein [Drosophila melanogaster]
  Gene Ontology: Mol. function=cytoskeletal adaptor activity; Cellular component=clathrin vesicle coat; Biological process=Golgi to endosome transport
  Essential gene: C elegans homolog=T04C10.2a; Phenotype=Unclassified
  Coding regions on vcDNA: vcDNA=SeqID_49365; Strand=+; Position=2-238
NSYEVRKLGDKVQGYVMNFTETEQKVREATNEDPWGPLCLQMQEIASFTFHYELYTEVMGMLWKRMFQENKLAWRRVYK

SEQ ID NO: 122943 - protein, 107 aa, Heterodera glycines
  Homolog annotation: Hit_ID=NP_491844.1; Match level="QueryCoverage =91%, HitCoverage=48%, E-value=4e-14, Identity=36%"; Hit description =putative protein, with at least 3 transmembrane domains (23.0 kD) (1G981) [Caenorhabditis elegans] gb|AAK
  Gene Ontology: Biological process=locomotion
  Essential gene: C elegans homolog=ZC328.1; Phenotype=Gro,Lvl,Unc
  Coding regions on vcDNA: vcDNA=SeqID_49366; Strand=+; Position=8-328
MNYYAGSRLVGVWAPLLVASVLCIAIGTTISMIYGIRHEQPQMLWPQIYFLKVEICLLMAGAVFSISCMCMGIEATNLIFSHFISVPQMELNFGPIWPFKLAIACLF

SEQ ID NO: 122944 - protein, 83 aa, Heterodera glycines
  Homolog annotation: Hit_ID=NP_505181.1; Match level="QueryCoverage =85%, HitCoverage=23%, E-value=2e-19, Identity=57%"; Hit description =mitochondrial ribosomal protein L4 (34.3 kD) (5I949) [Caenorhabditis elegans] gb|AAB69933.1| Hypothetical
  Gene Ontology: Cellular component=mitochondrion
  Essential gene: C elegans homolog=T23B12.2; Phenotype=Emb,Lva
  Coding regions on vcDNA: vcDNA=SeqID_49367; Strand=+; Position=2-250
KELRELRKLDQRNPFREIPEAWVTSLDDVEHKNCGLIQLHPDIFRVTPRLELFLFNSTWQSQYRNLRLLKMLFRAEMPGGGRK

SEQ ID NO: 122945 - protein, 189 aa, Heterodera glycines
  Homolog annotation: Hit_ID=NP_497231.1; Match level="QueryCoverage =94%, HitCoverage=60%, E-value=2e-75, Identity=76%"; Hit description =CAP-binding protein complex interacting 2 like (32.0 kD) (3B271) [Caenorhabditis elegans] gb|AAA64507.1|
  Essential gene: C elegans homolog=C09F5.2; Phenotype=Ste
  Coding regions on vcDNA: vcDNA=SeqID_49368; Strand=+; Position=53-619
NWVFILTSVVRHRGELSIHEKYRYDLSRAQLKASSRTSALLAGFAMIALVELQYQESTPKPLLIMLGVVTSLLVSVHLLALMMSTCLLPYIEANGCTQDSPHIKLRFYIELSWLFSTCIGLLLFLLEIGVIFFVKFNSIGYTFAAYITTGMLVPVVIVFIIISYLIHRNRFTHSLDRVNEKVADLQKYL

SEQ ID NO: 122946 - protein, 219 aa, Heterodera glycines
  misc_feature (88)..(88): Xaa can be any naturally occurring amino acid
  Homolog annotation: Hit_ID=CAE57844.1; Match level="QueryCoverage =90%, HitCoverage=57%, E-value=2e-31, Identity=33%"; Hit description =Hypothetical protein CBG00873 [Caenorhabditis briggsae]
  Essential gene: C elegans homolog=F42A8.1; Phenotype=Gro
  Coding regions on vcDNA: vcDNA=SeqID_49369; Strand=+; Position=1-655
LGEQKSKWHDEGEKIEAGSIVYECRGAKMVPIGCLDEFGQQIRLNETTVAKGLLMRCSLSRWATDLQLKIIGCVPKGKANETILVGEXWTEKESQTWWECAAEGTTVRARLGGCVDEPSRSRLRIGESVDRGHTTFECQSKGADAAEMVAVGCVTNGGEHRRIGHQWQDGDFLFYCKRKAAGLCEKSCLGCLLQGRRLYDGDRFATGAPFSMRNRPKRH

SEQ ID NO: 122947 - protein, 137 aa, Heterodera glycines
  Homolog annotation: Hit_ID=NP_492635.1; Match level="QueryCoverage =78%, HitCoverage=18%, E-value=3e-18, Identity=40%"; Hit description =more Of MS MOM-5, frizzled homolog (62.9 kD) (mom-5) [Caenorhabditis elegans] emb|CAB03398.1| Hypothetica
  Gene Ontology: Mol. function=receptor activity; Cellular component =integral to plasma membrane; Biological process=locomotory behavior
  Essential gene: C elegans homolog=T23D8.1; Phenotype =Bmd,Egl,Emb,Rol,Unc
  Coding regions on vcDNA: vcDNA=SeqID_49370; Strand=+; Position=1-414
DASDKLSKLMFRIGCFSLVYVLPMAVGIFCAFYQTENIGHWLTNWYSTRCLHVLRSAFGFTHPRAQCPVGDGVQLSRQPDPVLFFLKYLSHFSIGIACVVWTLNGKTVASYGDFLARLFSSRGHRRGRPIRVPTRPH

SEQ ID NO: 122948 - protein, 199 aa, Heterodera glycines
  misc_feature (16)..(16): Xaa can be any naturally occurring amino acid
  misc_feature (39)..(39): Xaa can be any naturally occurring amino acid
  misc_feature (97)..(97): Xaa can be any naturally occurring amino acid
  misc_feature (113)..(113): Xaa can be any naturally occurring amino acid
  misc_feature (139)..(139): Xaa can be any naturally occurring amino acid
  Homolog annotation: Hit_ID=NP_496215.1; Match level="QueryCoverage =96%, HitCoverage=93%, E-value=6e-45, Identity=52%"; Hit description =clp ATP-dependent protease proteolytic (2K590) [Caenorhabditis elegans] emb|CAA88886.1| Hypothetical prot
  Gene Ontology: Mol. function=endopeptidase Clp activity; Cellular component=mitochondrion; Biological process=misfolded or incompletely synthesized protein catabolism
  Essential gene: C elegans homolog=ZK970.2; Phenotype =Emb,Gro,Pvl,Slu,Sma,Stp
  Coding regions on vcDNA: vcDNA=SeqID_49371; Strand=+; Position=2-598
GPTTNPVGIPFMVDNXGKFNAVYDIYSRLLKDRIFCIMXTPLMDFVAVSAITHLLNLQNESGKSSIYMYINCTSGNVTTGLSIYHTLRQMSVPVATXCIDQTSSMPTLLLTKXAKGMSAYLLNARIMVHHWSGGAYSTXSGIVIGAHDINLDGKRLKEIYAMHAGQTEETILPALDMDRFLSALQAQQVRLFDRYGTRS

SEQ ID NO: 122949 - protein, 175 aa, Heterodera glycines
  Homolog annotation: Hit_ID=AAH75222.1; Match level="QueryCoverage =99%, HitCoverage=68%, E-value=2e-32, Identity=46%"; Hit description =MGC84358 protein [Xenopus laevis]
  Gene Ontology: Mol. function=structural constituent of ribosome; Cellular component=cytosolic large ribosomal subunit (sensu Eukarya); Biological process=ribosomal large subunit assembly and maintenance
  Essential gene: C elegans homolog=R151.3; Phenotype=Emb,Lva
  Coding regions on vcDNA: vcDNA=SeqID_49372; Strand=+; Position=2-526
KKANHAQQVKKIVVHKIGRQKNGCQRKVLKKKEPKLLLLVPSVQIKNKNKPKKVQLPESISPGTVLIILAGRHRGKLVIFIKQLPKSGLLLDTGPLKLNATPLRRIAQALVLPTKTKLDISTINVPEHLDDTYFKGQSGKVADTSNGEIFAEGANQQYAVTDQRKGDQKTVDIQV

SEQ ID NO: 122950 - protein, 188 aa, Heterodera glycines
  misc_feature (133)..(133): Xaa can be any naturally occurring amino acid
  misc_feature (168)..(168): Xaa can be any naturally occurring amino acid
  Homolog annotation: Hit_ID=NP_506017.1; Match level="QueryCoverage =100%, HitCoverage=17%, E-value=2e-54, Identity=60%"; Hit description= polymerase delta (120.8 kD) (5M525) [Caenorhabditis elegans] emb|CAB04077.1| Hypothetical protein F10C2.
  Gene Ontology: Mol. function=3'-5' exodeoxyribonuclease activity; Cellular component=delta DNA polymerase complex; Biological process =DNA replication
  Essential gene: C elegans homolog=F10C2.4; Phenotype=Emb
  Coding regions on vcDNA: vcDNA=SeqID_49373; Strand=+; Position=2-565
DAAMQSKQMGNRVNKFFSMDGRIIFYVLQLVLREYKLHSYTLSNDCYFFLGEHKEDVSYTFIPLLQNGSNMDRRRLTLDCMKDAFLPLRLLDILMLVINYIEMARVTGCALNFLFSRGQQCKILYMLMRNTLXHFLVLPDSKMGDGSDCDDVRYDGATVIDPLRVFYXRPCATLDFTSLYPDIMIAHN

SEQ ID NO: 122951 - protein, 165 aa, Heterodera glycines
  Homolog annotation: Hit_ID=NP_689926.1; Match level="QueryCoverage =96%, HitCoverage=22%, E-value=4e-70, Identity=76%"; Hit description =integral membrane protein 1 [Homo sapiens] gb|AAP35764.1| integral membrane protein 1 [Homo sapiens] gb|A
  Gene Ontology: Mol. function=dolichyl-diphospho-oligosaccharide -protein glycosyltransferase activity; Cellular component=integral to plasma membrane; Biological process=protein modification
  Essential gene: C elegans homolog=T12A2.2; Phenotype=Emb
  Coding regions on vcDNA: vcDNA=SeqID_49374; Strand=+; Position=3-500
YPYKQEISLAVTLAMAICLISFVYHSTWVTSEAYSSPSIVLSARSGDGGRIIFDDFREAYYWLRKNTPDDAKVMSWWDYGYRISGMANRTTIVDNNTWNNTHLSRVGQAMASNESHAYEIMHELDVDYVLVLFGGITRYSSDDIQQFLWMVRIGGSTPEGGPFSK

SEQ ID NO: 122952 - protein, 189 aa, Heterodera glycines
  Essential gene: C elegans homolog=C29E4.4; Phenotype=Emb
  Coding regions on vcDNA: vcDNA=SeqID_49375; Strand=+; Position=31-597
MVNLKLFVDSYEVEYPTLVREILADAQKKAVISATVTPFGKCALICGNSIYVWSYSSKESAIPHATRMNLPASGLKYSTQLISIFSRGQSHKSGVCLLAVSPEGNVRFWSELGKPYRDESCLLNNEVAHSVQLISINGTPFCSFFHRTIDAHKDYKKVRISGEVELTGMEVSLCWESVGGVSNCCKYPE

SEQ ID NO: 122953 - protein, 209 aa, Heterodera glycines
  Homolog annotation: Hit_ID=CAE62725.1; Match level="QueryCoverage =88%, HitCoverage=41%, E-value=3e-57, Identity=60%"; Hit description =Hypothetical protein CBG06885 [Caenorhabditis briggsae]
  Gene Ontology: Mol. function=enoyl-CoA hydratase activity; Cellular component=mitochondrial membrane; Biological process=fatty acid beta- oxidation
  Essential gene: C elegans homolog=B0303.3; Phenotype=Emb
  Coding regions on vcDNA: vcDNA=SeqID_49376; Strand=+; Position=2-628
RNFNCSSSRHFSLASVLFQQQKFSAVASSPNKNLNAVLIDAVRTPFLQSNTTFRELLAVDLQRHALKALVERTKIPFDEIGHIICGQVVQECKTSNIAREAAITAGFPDSIPCNTVTLACISSGVSIQNISLMISTGYLKAGIAGGVELLSDFPIRYNRKVRLSLIDLQKAKSFGERFKHLKTVASNWFSPELPAVSEFTTGEVMGNSG

SEQ ID NO: 122954 - protein, 162 aa, Heterodera glycines
  Homolog annotation: Hit_ID=CAB88203.1; Match level="QueryCoverage =100%, HitCoverage=83%, E-value=2e-73, Identity=60%"; Hit description= putative cuticular collagen [Globodera pallida]
  Gene Ontology: Mol. function=structural constituent of cuticle; Cellular component=extracellular; Biological process=cuticle biosynthesis (sensu Nematoda)
  Essential gene: C elegans homolog=C15A11.6; Phenotype=Emb
  Coding regions on vcDNA: vcDNA=SeqID_49377; Strand=+; Position=2-490
TLPSLYSEMSQLNNKVRDGVQAFRVNTDSAWTDLMDVQVVVSPASKDRGNPFSSIFRAKRQLPGHCYCGPPQRPNCPPGPPGPAGPPGQPGQPGGAGLQGQSVAPGQPAPPCSPQNIPVPRCPAGPPGSPGGQGPPGQQVATGQPGAPAPGGGHGPPAASGP

SEQ ID NO: 122955 - protein, 188 aa, Heterodera glycines; identical to SEQ ID NO: 120813
  Homolog annotation: Hit_ID=AAM95790.1; Match level="QueryCoverage =67%, HitCoverage=95%, E-value=3e-24, Identity=46%"; Hit description =histone H3.3 variant; TgH3.3 [Toxoplasma gondii]
  Gene Ontology: Mol. function=DNA binding; Cellular component =nucleosome; Biological process=embryogenesis and morphogenesis
  Essential gene: C elegans homolog=ZK131.7; Phenotype=Emb,Gro
  Coding regions on vcDNA: vcDNA=SeqID_49378; Strand=+; Position=51-617

SEQ ID NO: 122956 - protein, 135 aa, Heterodera glycines
  misc_feature (65)..(65): Xaa can be any naturally occurring amino acid
  misc_feature (111)..(111): Xaa can be any naturally occurring amino acid
  Homolog annotation: Hit_ID=NP_495860.1; Match level="QueryCoverage =100%, HitCoverage=25%, E-value=3e-43, Identity=57%"; Hit description= protein kinase family member (58.5 kD) (2J37) [Caenorhabditis elegans] emb|CAA91283.1| Hypothetical prot
  Gene Ontology: Mol. function=signal transducer activity; Cellular component=nucleus; Biological process=embryogenesis and morphogenesis
  Essential gene: C elegans homolog=K08F8.1a; Phenotype=Emb
  Coding regions on vcDNA: vcDNA=SeqID_49379; Strand=+; Position=2-409
DRNVAHRDIKLENILCSSNAEEKCTFKLADFGFAKRTEKGRLMESPCCTPAYVCPEILNRNHYDXGCDIWALGVANYILLCGYPPIYSMQGLPFSPGMRKRIMEGMFAFPXDEWGTIYHSSRNIIAAMLKTDPTE

SEQ ID NO: 122957 - protein, 207 aa, Heterodera glycines
  Homolog annotation: Hit_ID=NP_496405.1; Match level="QueryCoverage =97%, HitCoverage=51%, E-value=1e-29, Identity=36%"; Hit description =proteasome Regulatory Particle, Non-ATPase-like, S11 (44.2 kD) (rpn -9) [Caenorhabditis elegans] emb|CAA88
  Gene Ontology: Mol. function=endopeptidase activity; Cellular component=proteasome regulatory particle (sensu Eukarya)
  Essential gene: C elegans homolog=T06D8.8; Phenotype=Bmd,Gro,Unc
  Coding regions on vcDNA: vcDNA=SeqID_49380; Strand=+; Position=22-642
MTSQGVENYLKDQTISDIPTIAEGFQNLMNLYINKLWNQLSAEASQLVRNKLFVSTANLFQFYEEFVRDFERRIEPLQLIELITPIAEDIFERDRQSAYTFLDNFDKVIKQDKRAIVRLEDSKIQLRLRDKPTAEAKCCNDPALVRKMLEEAKTMVDQLVEVGSVHAAYYGCSAEYQFQMGDHDRYYEEALHYLGCEDINVKLSTEQ

SEQ ID NO: 122958 - protein, 185 aa, Heterodera glycines
  Homolog annotation: Hit_ID=AAP82284.1; Match level="QueryCoverage =100%, HitCoverage=41%, E-value=7e-67, Identity=66%"; Hit description= Pah [Danio rerio] emb|CAI21098.1| phenylalanine hydroxylase [Danio rerio]
  Gene Ontology: Mol. function=phenylalanine 4-monooxygenase activity; Biological process=phenylalanine catabolism
  Essential gene: C elegans homolog=ZK1290.2a; Phenotype=Emb
  Coding regions on vcDNA: vcDNA=SeqID_49381; Strand=+; Position=2-556
CTGFTLRPVAGLLRSRDFLDGLAFSVFHSTLYILDSSKTQYTPEAEICHELMGRCPLLADPDFAQFSQEFGLASLGASDEMVEKLATLYWFTVEFGICIQNGAKKADGAGLMSSFGELEYALSGQPELAAFNPPETCQNKYPITSYQPTYVVAESFADGQNKLPTGSTSIPRQVPVNYNPFPQRI

SEQ ID NO: 122959 - protein, 182 aa, Heterodera glycines
  Homolog annotation: Hit_ID=NP_477431.1; Match level="QueryCoverage =85%, HitCoverage=36%, E-value=5e-35, Identity=44%"; Hit description =CG14941-PA [Drosophila melanogaster] gb|AAF53124.1| CG14941-PA [Drosophila melanogaster] gb|AAL39941.1| S
  Gene Ontology: Mol. function=protein binding; Cellular component =nuclear chromatin; Biological process=chromatin silencing
  Essential gene: C elegans homolog=C09G4.5a; Phenotype=Lvl,Sck,Stp
  Coding regions on vcDNA: vcDNA=SeqID_49382; Strand=+; Position=24-628
MLYNGKFLNKKNYTITFELAGSFVENHRGTVYSVSFNPFTHSEAPIYFATVGKNRVSVYLCPPEKGFQLVRQFEDQDADEFYYTVTWAYNLEKAQHVLVVGGFRGIIRVISPLNGRLHCALIGHGDSINELCTSPVSPMIVASASKDLTVRIWNVTYSQCLAILGGTNGHRDQVISLDFNSP

SEQ ID NO: 122960 - protein, 208 aa, Heterodera glycines
  Homolog annotation: Hit_ID=NP_502818.1; Match level="QueryCoverage =96%, HitCoverage=20%, E-value=5e-36, Identity=37%"; Hit description =heterogeneous nuclear ribonucleoprotein U B (4P813) [Caenorhabditis elegans] emb|CAB63361.1| Hypothetical
  Gene Ontology: Mol. function=heterogeneous nuclear ribonucleoprotein; Cellular component=nucleus; Biological process=RNA processing
  Essential gene: C elegans homolog=Y41E3.11; Phenotype=Unclassified
  Coding regions on vcDNA: vcDNA=SeqID_49383; Strand=+; Position=1-624
GWSRADSSNLLGEQQNSFAFSSMGNKATNNIFTDFVDPFFVDEVITSVLDVGRAEIRYYKNGQPLGAAFTDIRYQTGDIYFPHVATKNCKVMVNFGTEIPESIEAAKDESGLCLWSMPADEVPEETEWVGNVDRKQMAPSRRPMIDKAHCTIIAMVGLPGVGKTTWVRQYLKEHPNENWILLNTDTILEAMTVDGMPRHRVHQGRWDM

SEQ ID NO: 122961 - protein, 201 aa, Heterodera glycines
  Homolog annotation: Hit_ID=CAE59075.1; Match level="QueryCoverage =94%, HitCoverage=35%, E-value=2e-48, Identity=51%"; Hit description =Hypothetical protein CBG02363 [Caenorhabditis briggsae]
  Essential gene: C elegans homolog=ZK622.3a; Phenotype=Lva,Unc
  Coding regions on vcDNA: vcDNA=SeqID_49384; Strand=+; Position=34-636
MASYHVAIAADERQKYRSFWDQFSGRADNSAMMLNANADQIESLDRENILALLPSVKGKFVVDIGAGIGRFTTVFAQSEASKVVATDFVASFVDKNRQRNGAYANVVEWRVGDATGLQFDEGSVDLVFTNWLLMYLADQEAVQFVANALQWLRPDGYLHLRESCSEPSTKKSADHSTTTTTTSTSSSSSSSLHNNSKPNPT

SEQ ID NO: 122962 - protein, 153 aa, Heterodera glycines
  Homolog annotation: Hit_ID=CAE68285.1; Match level="QueryCoverage =86%, HitCoverage=21%, E-value=2e-26, Identity=50%"; Hit description =Hypothetical protein CBG13969 [Caenorhabditis briggsae]
  Gene Ontology: Mol. function=transcription co-activator activity; Cellular component=nucleus; Biological process=transcription
  Essential gene: C elegans homolog=Y55F3AM.3a; Phenotype =Gro,Pvl,Stp,Unc
  Coding regions on vcDNA: vcDNA=SeqID_49385; Strand=-; Position=140-646
RPPSPSRASARRAAVGWVTRGPAPGTSPVRGGVAPPTRCPCSLFQALILKVCPLRPRDPPPREARMDRASEERDERPVFILQLARQTRPRDLEEFFSSVGHVRDVRVITDTKTRRSKGIDYVEFWEREAVPLVTFFLLKWANPHKEFACIPPT

SEQ ID NO: 122963 - protein, 106 aa, Heterodera glycines
  Homolog annotation: Hit_ID=NP_509262.1; Match level="QueryCoverage =86%, HitCoverage=14%, E-value=9e-12, Identity=41%"; Hit description =COHesin, RADiation sensitivity abnormal/yeast RAD-related RAD-21.2 (coh-1) [Caenorhabditis elegans] gb|AA
  Gene Ontology: Mol. function=damaged DNA binding; Cellular component =nucleus; Biological process=synaptonemal complex formation
  Essential gene: C elegans homolog=K08A8.3; Phenotype=Emb,Him
  Coding regions on vcDNA: vcDNA=SeqID_49386; Strand=+; Position=160-480
MEKRQSARRSRAHEREEENEDEEVFTRRTFNVLQSIATKLRAANTNKIVFEDLFTKGSTRRTAAQKFYALLELKKWQAIEVEQRDAFDTIEISAGALMNETIKLAI

SEQ ID NO: 122964 - protein, 165 aa, Heterodera glycines
  Homolog annotation: Hit_ID=NP_730976.1; Match level="QueryCoverage =100%, HitCoverage=20%, E-value=2e-24, Identity=42%"; Hit description= CG2244-PA, isoform A [Drosophila melanogaster] gb|AAF51980.2| CG2244 -PA, isoform A [Drosophila melanogas
  Gene Ontology: Cellular component=cytoplasm; Biological process =signal transduction
  Essential gene: C elegans homolog=T27C4.4a; Phenotype =Gro,Muv,Pvl,Stp,Unc
  Coding regions on vcDNA: vcDNA=SeqID_49387; Strand=+; Position=69-563
MYRVGDFVYFETFSAAPYQIRRIEELNKTANGAVETKVTCFFRRRDLPNSLLKIADQAGRQSKIASKPRKTLLGKAEPTSSTSNANGEEGPSENGADAMESGGGSSTDAENSRRENDETADDGRAESVGFAGLPAGAERLDAAELSRLRQHELFLSRIVETLPAT

SEQ ID NO: 122965 - protein, 174 aa, Heterodera glycines
  Homolog annotation: Hit_ID=NP_501727.1; Match level="QueryCoverage =97%, HitCoverage=53%, E-value=1e-64, Identity=72%"; Hit description =adenine nucleotide family member (4K472) [Caenorhabditis elegans] emb|CAA92472.1| Hypothetical protein K0
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_49388; Strand=+; Position=2-523
HKKSGGFNTKKFLLDLAYGGTAAAVSKTAVAPIERVKLLLHVQDASIHITANDRYKSIIDVLVRVPIEQGFLSLWRGNLANVIRYFPTRALNFAFKDTYNRVFTQGVDKDKHFLKLFTMNLASGGAAGATSLCYVYPLHFARTPLVSHVAKDDDPEFRGWADCIMKIPKSDRPI

SEQ ID NO: 122966 - protein, 164 aa, Heterodera glycines
  misc_feature (153)..(153): Xaa can be any naturally occurring amino acid
  Homolog annotation: Hit_ID=NP_498698.1; Match level="QueryCoverage =98%, HitCoverage=15%, E-value=5e-35, Identity=45%"; Hit description =eukaryotic Initiation Factor, EGg Laying defective EGL-45 (124.4 kD) (egl-45) [Caenorhabditis elegans] gb
  Gene Ontology: Mol. function=translation factor activity, nucleic acid binding; Cellular component=eukaryotic translation initiation factor 3 complex; Biological process=regulation of translational initiation
  Essential gene: C elegans homolog=C27D11.1; Phenotype=Emb,Ste
  Coding regions on vcDNA: vcDNA=SeqID_49389; Strand=+; Position=104-596
ILFKLKRQIFIYQNQKDADFERILARRKRIELYKETNEQVKREKLQKELAQANKQEEQRRREELKKLQEENKENERRRKLNEQEEIQRKLQSEKLKKYQAHPFFQQLVKEHGEAIFDKVDPDKLIREKRIRFDAERPEQQTKLQNLEKKYDHXVRAFHLEEMAL

SEQ ID NO: 122967 - protein, 207 aa, Heterodera glycines
  Homolog annotation: Hit_ID=CAE67776.1; Match level="QueryCoverage =91%, HitCoverage=16%, E-value=2e-34, Identity=38%"; Hit description =Hypothetical protein CBG13351 [Caenorhabditis briggsae]
  Essential gene: C elegans homolog=C08B11.3; Phenotype=Emb
  Coding regions on vcDNA: vcDNA=SeqID_49390; Strand=+; Position=1-621
DDRLDLDRPTNWRVFNILAVFHNLSFEEANTALMGESHALVRFLLLCSKCRWHLLRKIAYDTLSNIARNIKLVDKLSTVLLNTVQKGLHSDDKCKVMRSMEIVAGLCATPTNESIVCEFFEESQIIPRIFALLSLKDILMCMCAMESVLAISELGRVACEAVARCDRAVEMLVGFLTTDAFSFGTVGLAGMHVVEVHGHPTRPYVAP

SEQ ID NO: 122968 - protein, 152 aa, Heterodera glycines
  misc_feature (29)..(30): Xaa can be any naturally occurring amino acid
  misc_feature (48)..(48): Xaa can be any naturally occurring amino acid
  misc_feature (134)..(134): Xaa can be any naturally occurring amino acid
  Homolog annotation: Hit_ID=XP_313971.1; Match level="QueryCoverage =86%, HitCoverage=35%, E-value=8e-18, Identity=40%"; Hit description =ENSANGP00000009996 [Anopheles gambiae]
  Gene Ontology: Biological process=reproduction
  Essential gene: C elegans homolog=T04C12.6; Phenotype=Ste
  Coding regions on vcDNA: vcDNA=SeqID_49391; Strand=+; Position=6-461
STHSRKALLLIAFAFKTKHQSQPEKMCDXXVAALVVDNGSGMCKAGFXGDDAPPAVFPSLWAPPLFKPSCSHGNKGLYLVTRANQPGFPTLNSPFNPVSPPWDTLEKIWPPSFKKIFFPPKKNPGFFKNPLFPXGAKKKKPPLFFKNKHPPP

SEQ ID NO: 122969 - protein, 216 aa, Heterodera glycines
  Homolog annotation: Hit_ID=NP_498347.2; Match level="QueryCoverage =100%, HitCoverage=32%, E-value=7e-68, Identity=58%"; Hit description= proteasome Regulatory Particle, Non-ATPase-like, S1 (rpn-2) [Caenorhabditis elegans] gb|AAM81115.1| Prot
  Gene Ontology: Mol. function=proteasome endopeptidase activity; Cellular component=proteasome complex (sensu Eukarya); Biological process=proteolysis and peptidolysis
  Essential gene: C elegans homolog=C23G10.4a; Phenotype=Emb
  Coding regions on vcDNA: vcDNA=SeqID_49392; Strand=+; Position=3-650
GTTCDDFLRENLDWISKATNWNKFNAVASLGLIHKGHERDAKKLLEPYLPKGEQDQFCFKEGGSLFAYGLIHANHGSSAIDYLSDQLSRASTSAVRHGACLGLGLAALGTRNERVYEHLRDVLYQNEAVSGEAAGTAMGLIMAGSMNQMAFDEMYQYILDTHHDKIQRGLRTGISMLAYGVAERAEDWIRLLYNSPYAIIRQTGVCMIALAYAGTG

SEQ ID NO: 122970 - protein, 115 aa, Heterodera glycines
  misc_feature (69)..(69): Xaa can be any naturally occurring amino acid
  Homolog annotation: Hit_ID=A48449; Match level="QueryCoverage=99%, HitCoverage=30%, E-value=3e-40, Identity=72%"; Hit description=Actin- 1A - nematode (Onchocerca volvulus)
  Gene Ontology: Biological process=reproduction
  Essential gene: C elegans homolog=T04C12.6; Phenotype=Ste
  Coding regions on vcDNA: vcDNA=SeqID_49393; Strand=+; Position=2-349
CDEEVAALVVDNGSGMCKAGFAGDDAPRAVFPSIVGRPRHPDGMVGMGHKDTKVVFFFQTNRGILTLKXLIARGIVTKWRNMENIWHNTFYNELRVAPQKNSLLHTYARLTPNAK

SEQ ID NO: 122971 - protein, 193 aa, Heterodera glycines
  Homolog annotation: Hit_ID=AAN84839.1; Match level="QueryCoverage =83%, HitCoverage=24%, E-value=6e-22, Identity=32%"; Hit description =Hypothetical protein C43E11.11 [Caenorhabditis elegans] ref|NP _491339.2| putative nuclear protein, with 2
  Essential gene: C elegans homolog=C43E11.11; Phenotype =Gro,Unclassified
  Coding regions on vcDNA: vcDNA=SeqID_49394; Strand=+; Position=13-591
MATNSAFERLDDYIWGRADEGEFLRGVVADERLDTEKLLSRVQNIQREMNSRLRQGVEENYPSLLEQVSTIEQLDSAHFHVQREMDAVVRRADALAKTMEEQVGKIRKDVRAIASLTQLSRMQGDAIRCEELVDAWRAETDLIRRTEHITEVNAIVKANDKLRHLKWLQYRCLFSLSEMNSRTRQDLVVQLRS

SEQ ID NO: 122972 - protein, 212 aa, Heterodera glycines
  misc_feature (75)..(75): Xaa can be any naturally occurring amino acid
  misc_feature (101)..(101): Xaa can be any naturally occurring amino acid
  misc_feature (111)..(111): Xaa can be any naturally occurring amino acid
  misc_feature (182)..(182): Xaa can be any naturally occurring amino acid
  misc_feature (193)..(193): Xaa can be any naturally occurring amino acid
  misc_feature (196)..(196): Xaa can be any naturally occurring amino acid
  Homolog annotation: Hit_ID=CAE64540.1; Match level="QueryCoverage =100%, HitCoverage=28%, E-value=1e-69, Identity=57%"; Hit description= Hypothetical protein CBG09283 [Caenorhabditis briggsae]
  Gene Ontology: Cellular component=spliceosome complex; Biological process=mRNA splicing
  Essential gene: C elegans homolog=M03F8.3; Phenotype=Emb
  Coding regions on vcDNA: vcDNA=SeqID_49395; Strand=+; Position=2-637
YHFGIDHLPTTRTTELFKCLTMHEKKFGERLQIEGVIFSKRRHQYEEQVKENPFNYDAWFNYVRLLMAEDADRAXVEECFDRTISNVPPYVEKRFWRHYIXLWEYYAIYEXLDVDDLRKCPEEWRACLDILPHKHFTFAFTWLMFAQFELRQLNLSSARKILCTAIGKCPKKKLFREYIEMXLHLMELDRCRXTLXKFREFSPDNSVSWMKY

SEQ ID NO: 122973 - protein, 217 aa, Heterodera glycines
  Homolog annotation: Hit_ID=NP_491552.2; Match level="QueryCoverage =99%, HitCoverage=8%, E-value=1e-49, Identity=50%"; Hit description =lethal protein 363, LEThal LET-363 (305.8 kD) (let-363) [Caenorhabditis elegans] gb|AAN84886.1| Lethal pro
  Gene Ontology: Mol. function=inositol/phosphatidylinositol kinase activity; Cellular component=1-phosphatidylinositol 3-kinase complex; Biological process=germ-cell development
  Essential gene: C elegans homolog=B0261.2a; Phenotype=Lva
  Coding regions on vcDNA: vcDNA=SeqID_49396; Strand=+; Position=2-652
FLRAVLAVHNNDFDKAYSCINKVRDMFDSELTAMAAESYERAYGAMVLLQELTELEEAIEYKMIPEREMRIALLWSRRLQGCLLNVEHWRRILMVRSIVFSQTELRPLWIKFAALCRYEGRQVTVSRNVIRSLLEVPPDTPLEKVPIPLPLEKTQLALALCKQLWVDSHRRTALVQLEQLTQTLHRCIERNRTMLTREQLETHARLTAKCYLKLGEW

SEQ ID NO: 122974 - protein, 182 aa, Heterodera glycines
  Homolog annotation: Hit_ID=NP_727048.1; Match level="QueryCoverage =98%, HitCoverage=47%, E-value=2e-87, Identity=86%"; Hit description =CG4027-PA, isoform A [Drosophila melanogaster] ref|NP_511052.1| CG4027-PB, isoform B [Drosophila melanoga
  Gene Ontology: Biological process=reproduction
  Essential gene: C elegans homolog=T04C12.6; Phenotype=Ste
  Coding regions on vcDNA: vcDNA=SeqID_49397; Strand=+; Position=2-547
CDEEVAALVVDNGTGMCKAGFSGDGAPRAEFPSIVGRPLHQGVMVGMGQKDSYGGDEAHSHRGILTLKYPIEHGIPSNWDDMENIWHHTFYNELRVAPDEHPVLLTEAPLNPKVNREKMTLIMFETFNTPAMYLAIQAVLSLYASGRTTGLVLDSGDGVSHTAAIYEGYSRAHAIMQFGLGR

SEQ ID NO: 122975 - protein, 215 aa, Heterodera glycines
  Homolog annotation: Hit_ID=NP_871868.1; Match level="QueryCoverage =100%, HitCoverage=37%, E-value=4e-69, Identity=60%"; Hit description= lipolytic enzyme, G-D-S-L family (1J397) [Caenorhabditis elegans] emb|CAD56582.1| Hypothetical protein F
  Essential gene: C elegans homolog=T19D7.7; Phenotype=Dpy,Unc
  Coding regions on vcDNA: vcDNA=SeqID_49398; Strand=+; Position=1-645
NRKSFSCPKTKSDLLTGTSTANLSPEDIGIIASMGDSLATGAGLWPRTDIEFRGAAFPIGGDATIDGLVTVPNILREFIDSNLLFGVSHGMGQRDQLPENQLNVAVSGASSSSMPGQAVELVRRMKRLRELDVFNTWALIIVTIGTEEVCKNCTGPNTKALVQALDILNRGIHKALVILLGPIHVTSLYQQKFNLLKTRCLCSQNKDDKFMSALS

SEQ ID NO: 122976 - protein, 180 aa, Heterodera glycines
  Homolog annotation: Hit_ID=NP_741145.1; Match level="QueryCoverage =75%, HitCoverage=88%, E-value=2e-57, Identity=79%"; Hit description =myosin light chain (17.1 kD) (mlc-3) [Caenorhabditis elegans] gb|AAA50701.1| Myosin light chain protein 3
  Gene Ontology: Mol. function=structural constituent of muscle; Cellular component=muscle myosin; Biological process=muscle development
  Essential gene: C elegans homolog=F09F7.2a; Phenotype=Egl,Unc
  Coding regions on vcDNA: vcDNA=SeqID_49399; Strand=+; Position=55-597
MPSQGELKEIFNLYDEELEGKIDATQIGDVARACGLKPTNAMVWKAAGEEYKRKGEKKLAFEEWLPIFEQLQKEKEVGTYADFVEGLKVFDKDESGKIMAAELRHVLLALGERLSAEEADELLLGAQDGEGMINYDRKRLLMKLTVSRVPTNDRSPLVFQSSSKRCWPGPTPRIERRNAN

SEQ ID NO: 122977 - protein, 195 aa, Heterodera glycines
  Homolog annotation: Hit_ID=AAH16045.1; Match level="QueryCoverage =97%, HitCoverage=50%, E-value=3e-69, Identity=66%"; Hit description =Beta actin [Homo sapiens]
  Gene Ontology: Cellular component=actin filament; Biological process =reproduction
  Essential gene: C elegans homolog=T04C12.6; Phenotype=Ste
  Coding regions on vcDNA: vcDNA=SeqID_49400; Strand=+; Position=2-586
GHQKIAALLVDHGSRMGKGRFPGDDPPPAVVPSIGGRPPPPGVMVRMGQKDSYLGNQAQSQRGILTLKYPIEHRILTHWDHLEKIWHHPLYHQLRVPPQEHPVLLPKAPLNPKGHRKKMTPILFQNFHTPAIYLALPALLSLYAFGPTTGLLLDFRDGGTHTGPLYQGYPLAHALLRLDLGGPDLTDYPEKIPPE

SEQ ID NO: 122978 - protein, 215 aa, Heterodera glycines
  Homolog annotation: Hit_ID=CAE71853.1; Match level="QueryCoverage =93%, HitCoverage=13%, E-value=1e-63, Identity=56%"; Hit description =Hypothetical protein CBG18897 [Caenorhabditis briggsae]
  Gene Ontology: Mol. function=protein kinase activity; Biological process=actin polymerization and/or depolymerization
  Essential gene: C elegans homolog=K08B12.5; Phenotype=Bmd,Dpy,Gro,Unc
  Coding regions on vcDNA: vcDNA=SeqID_49401; Strand=+; Position=3-647
RYGAECDWWSLGICMYEMIFGETPFYAESLVDTYGKIMNHEEMFEFPEDIDISDEAKDLISRLICARETRLGKNGLADFRDYPFFADIDWENIRSAEAPYKPEVSSPTDTSNFDSSVVANDFTPCETQPPKVTAPFTGLHLPFIGFTFTSGSAFSDATSLLQTIQANSGGGAVGVVPLSSPAVDSAGAKSAILQQQQQAQAASVPAQAQDDEERE

SEQ ID NO: 122979 - protein, 98 aa, Heterodera glycines
  Homolog annotation: Hit_ID=CAE71504.1; Match level="QueryCoverage =100%, HitCoverage=11%, E-value=7e-14, Identity=45%"; Hit description= Hypothetical protein CBG18436 [Caenorhabditis briggsae]
  Gene Ontology: Mol. function=protein binding; Cellular component =chromatin; Biological process=DNA replication
  Essential gene: C elegans homolog=Y17G7B.5a; Phenotype=Emb
  Coding regions on vcDNA: vcDNA=SeqID_49402; Strand=+; Position=2-295
GVYSNGYDGSLNSCHRFPLFHTVIIANHFTRKDPNQSDSLTDEDIKPSPNWQNFRNSSTIFLRGPPTFLGPAKWKQAIVFFFFGGEKKNPPESPPSRG

SEQ ID NO: 122980 - protein, 156 aa, Heterodera glycines
  misc_feature (49)..(49): Xaa can be any naturally occurring amino acid
  misc_feature (74)..(74): Xaa can be any naturally occurring amino acid
  Homolog annotation: Hit_ID=NP_495800.1; Match level="QueryCoverage =100%, HitCoverage=62%, E-value=2e-38, Identity=48%"; Hit description= mitochondrial ribosomal protein S18b like (2I817) [Caenorhabditis elegans] emb|CAA91421.1| Hypothetical
  Essential gene: C elegans homolog=T13H5.5; Phenotype=Lva
  Coding regions on vcDNA: vcDNA=SeqID_49403; Strand=+; Position=1-470
KPPPPLFCIDRHGRFNAGNACTVRLDDYLIFHYTNPRLLEHFLYPGTDXQPLPIIQTGLCQEQYCNLQAQLHRXKEHGTFIFNVPFRHFNYGQWYPKDANALISSDLEDDQPSRDLTNVEYIYPNPQIAFETHNRDKHNAWDEWWMRQERFIKRLK

SEQ ID NO: 122981 - protein, 184 aa, Heterodera glycines
  Homolog annotation: Hit_ID=NP_502519.2; Match level="QueryCoverage =62%, HitCoverage=26%, E-value=1e-25, Identity=46%"; Hit description =cytoplasmic Dynein Light chain, Intermediate type, Dynein Light Intermediate chain (48.4 kD) (dli-1) [Cae
  Gene Ontology: Cellular component=cytoplasmic dynein complex
  Essential gene: C elegans homolog=C39E9.14a; Phenotype=Emb,Pvl,Unc
  Coding regions on vcDNA: vcDNA=SeqID_49404; Strand=+; Position=43-594
MEPIESMHHSTATLAESNATIVAGGGGGMNGTTNDLDSSPLLLPPEKGILEENCGVILIAAINKSDMHSDLSAEQLDRLQYHVRKFCLQHGAALIYTSANDDLNTQLLHKYIAHRIFSLPFTAPAYIVERDRIFVPTGWDSEQKLSIIKEALVGSDLLDVPMLAQQSSDASPFSNYRATGEMEV

SEQ ID NO: 122982 - protein, 61 aa, Heterodera glycines
  Homolog annotation: Hit_ID=CAC28275.1; Match level="QueryCoverage =100%, HitCoverage=22%, E-value=1e-09, Identity=52%"; Hit description= actin [Mucor ramosissimus]
  Gene Ontology: Mol. function=structural constituent of cytoskeleton; Cellular component=cytoskeleton; Biological process=cytoskeleton organization and biogenesis
  Essential gene: C elegans homolog=T04C12.5; Phenotype=Ste
  Coding regions on vcDNA: vcDNA=SeqID_49405; Strand=+; Position=2-187
IQAPDLITDVQAVMLLYTSRHTNDLVLDSRDVVTHTVPIYHAYHTTRAILQKDLPRRDLTD

SEQ ID NO: 122983 - protein, 192 aa, Heterodera glycines
  Homolog annotation: Hit_ID=AAA92672.1; Match level="QueryCoverage =84%, HitCoverage=34%, E-value=2e-30, Identity=48%"; Hit description =HMG CoA synthase
  Gene Ontology: Mol. function=hydroxymethylglutaryl-CoA synthase activity; Cellular component=endoplasmic reticulum; Biological process=ergosterol biosynthesis
  Essential gene: C elegans homolog=F25B4.6; Phenotype=Emb,Lva,Lvl,Unc
  Coding regions on vcDNA: vcDNA=SeqID_49406; Strand=+; Position=2-577
NNHHPTVNGNGFGLTNGTHFADEFSESIKDVGIIGIELYFPKSYVNQEDLEKFDNVTSNKYVLGLGQQEMCFCHDNEDVCSLSLTVAAALMDNYKVNPKDIGFLAVGTETWFDKTKGESRGYGIVCRFRQLDLEGPRRKNPGFGGTQALVIAPQWVGPELPNKKNPCPPVAGANWANFTRWGPPQLTGGSAG

SEQ ID NO: 122984 - protein, 72 aa, Heterodera glycines
  Homolog annotation: Hit_ID=A48449; Match level="QueryCoverage=100%, HitCoverage=19%, E-value=2e-26, Identity=81%"; Hit description=Actin- 1A - nematode (Onchocerca volvulus)
  Gene Ontology: Cellular component=actin filament; Biological process =embryogenesis and morphogenesis
  Essential gene: C elegans homolog=T04C12.6; Phenotype=Ste
  Coding regions on vcDNA: vcDNA=SeqID_49407; Strand=+; Position=2-217
DEEVAALVVDNGSGMCKAGFAGDDAPRAVFPSVGGRPHHRGGMHGMGQKDSYTEYFFLSKRGILTLKYPIKH

SEQ ID NO: 122985 - protein, 147 aa, Heterodera glycines
  misc_feature (64)..(64): Xaa can be any naturally occurring amino acid
  misc_feature (66)..(66): Xaa can be any naturally occurring amino acid
  Homolog annotation: Hit_ID=XP_311177.1; Match level="QueryCoverage =97%, HitCoverage=34%, E-value=6e-66, Identity=84%"; Hit description =ENSANGP00000019055 [Anopheles gambiae]
  Gene Ontology: Biological process=reproduction
  Essential gene: C elegans homolog=T04C12.6; Phenotype=Ste
  Coding regions on vcDNA: vcDNA=SeqID_49408; Strand=+; Position=55-495
KHQSQPEKMCDEEVAALVVDNGSGMCKAGFAGDDAPRAVFPSIVGRPRHQGVMVGMGQKDSYVXIXAQSKRGILTLKYSIEHGIVTNWDDLEKIWHHTFYNDLRVAPEEHPVLLTEASLIPQANRENMTPILLQTFHTPATHVGLPG

SEQ ID NO: 122986 - protein, 217 aa, Heterodera glycines
  misc_feature (196)..(196): Xaa can be any naturally occurring amino acid
  Homolog annotation: Hit_ID=AAQ96867.1; Match level="QueryCoverage =78%, HitCoverage=38%, E-value=4e-40, Identity=44%"; Hit description =unknown [Homo sapiens] gb|AAH07596.1| WIPI49-like protein 2, isoform b [Homo sapiens] ref|NP_057087.2| WIP
  Gene Ontology: Cellular component=cytosol; Biological process =autophagy
  Essential gene: C elegans homolog=F41E6.13a; Phenotype=Gro
  Coding regions on vcDNA: vcDNA=SeqID_49409; Strand=+; Position=9-659
MFSGATEFIANQAFTSALWNIAESGVQRAEYLVHNYLLSPTAENGMDTQKQSPSSKKIYYVSFNQDCTILVVGHDDGYSFYNLRSLERLEKISDSRVPERACIVEKLYSSSLTCVVSMKSTRKLQVFHSKNENEICSHTYASSIIAVRMNRKRVVVCLEDTIHIHNIRDMKIMHMLKDTPPNPNGIVDLSIAESNXFLAFSVFVRTGPGHIFDAENL

SEQ ID NO: 122987 - protein, 74 aa, Heterodera glycines
  Homolog annotation: Hit_ID=AAT70232.1; Match level="QueryCoverage =100%, HitCoverage=19%, E-value=4e-17, Identity=58%"; Hit description= unc-87 [Heterodera glycines]
  Essential gene: C elegans homolog=F08B6.4a; Phenotype=Unc
  Coding regions on vcDNA: vcDNA=SeqID_49410; Strand=+; Position=2-223
RWTLSQVRQTDGIISAQAGWNKGNSNKMMTISGMPSHTTIKFHVENPVHIPDDILLKNTAEVLMLASPTWFSNQ

SEQ ID NO: 122988 - protein, 227 aa, Heterodera glycines
  Homolog annotation: Hit_ID=AAP13778.1; Match level="QueryCoverage =100%, HitCoverage=52%, E-value=1e-117, Identity=89%"; Hit description=Dumpy : shorter than wild-type protein 23, isoform b [Caenorhabditis elegans]
  Gene Ontology: Cellular component=AP-1 adaptor complex; Biological process=intracellular protein transport
  Essential gene: C elegans homolog=R160.1a; Phenotype=Gro,Lvl
  Coding regions on vcDNA: vcDNA=SeqID_49411; Strand=+; Position=2-682
MIGGLFVYNHKGEVLISRIYRDDVNRNAVDAFRVSVIHARQQIRSPVTNIARTSFFHIKRGNVWMCAVSRRNINASMVFEFLNRFADTMQSYFGKLNEENVKNNFVLIYEILDEILDFGYPQNTDPGVLKTFITQQGVRTASKEEQAQITSQVTGQIGWRREGIKYRRNELFLDVIEYVNLLMSQQGQVLSSHVAGKVAMKSYLSGMPECKFGNNDKLTIESQGRTG

SEQ ID NO: 122989 - protein, 218 aa, Heterodera glycines
  Homolog annotation: Hit_ID=CAE58598.1; Match level="QueryCoverage =100%, HitCoverage=21%, E-value=3e-36, Identity=39%"; Hit description= Hypothetical protein CBG01765 [Caenorhabditis briggsae]
  Gene Ontology: Cellular component=Golgi stack; Biological process =nonselective vesicle docking
  Essential gene: C elegans homolog=K09B11.9; Phenotype=Unclassified
  Coding regions on vcDNA: vcDNA=SeqID_49412; Strand=+; Position=1-654
VTFLHTLLEADHLKPQLLRVQLSTAGSQEPQSLLSHLSRMLCNCGPRKLQIRCGLLMLLSVWTNNCTPAIELFLSPFCTNSASDDHNVVHYLVSQLVDQNTEITEAENHLVKGLVAFLVGICLHSWEVPEGKADKKNQLTHLIERRVGRERMAEYIEGISKSEFYIRAAQRPQPLAKGPSDLLLDYQFTKFFKLMEGHLLKFFRPNGELSSSVIHSLK

SEQ ID NO: 122990 - protein, 140 aa, Heterodera glycines
  misc_feature (92)..(92): Xaa can be any naturally occurring amino acid
  Homolog annotation: Hit_ID=AAH86165.1; Match level="QueryCoverage =98%, HitCoverage=16%, E-value=2e-19, Identity=39%"; Hit description =Unknown (protein for MGC:98607) [Xenopus laevis] ref|NP_598677.1| eukaryotic translation initiation factor
  Essential gene: C elegans homolog=Y54E2A.11a; Phenotype=Lva,Ste
  Coding regions on vcDNA: vcDNA=SeqID_49413; Strand=+; Position=2-421
TDNHRFSDPEDFVDDVEDDELIRDLLYEEPRESQYQECCIMVFNIPIISSDRLPKLRNVSSCVFSVRNTYKYNDNSPLDGEGHTKGFCFLEXQTKEAANAVLAICDGHRLDKYHTFAAYPFTAIPSMNEPEKDWQKPERH

SEQ ID NO: 122991 - protein, 103 aa, Heterodera glycines
  misc_feature (48)..(48): Xaa can be any naturally occurring amino acid
  misc_feature (50)..(50): Xaa can be any naturally occurring amino acid
  misc_feature (70)..(70): Xaa can be any naturally occurring amino acid
  Homolog annotation: Hit_ID=XP_321840.1; Match level="QueryCoverage =94%, HitCoverage=31%, E-value=2e-16, Identity=43%"; Hit description =ENSANGP00000020956 [Anopheles gambiae] gb|EAA01785.2| ENSANGP00000020956 [Anopheles gambiae str. PEST]
  Gene Ontology: Mol. function=protein binding; Cellular component =endoplasmic reticulum; Biological process=skeletal development
  Essential gene: C elegans homolog=F19B6.2a; Phenotype=Emb,Lva,Lvl,Unc
  Coding regions on vcDNA: vcDNA=SeqID_49414; Strand=+; Position=95-403
LTNGRPGLQRRTHARVFFFLAEKRQCYLPYWMMVQLDRKEGDIISEQXLXIPIAAYPKDQPMLTDYYHIXNPRAMHEVELRKFSRLTTGDIIAVHHDEQCIDF

SEQ ID NO: 122992 - protein, 164 aa, Heterodera glycines
  Homolog annotation: Hit_ID=AAD40314.1; Match level="QueryCoverage =96%, HitCoverage=42%, E-value=2e-40, Identity=55%"; Hit description =actin [Mytilus galloprovincialis]
  Gene Ontology: Biological process=reproduction
  Essential gene: C elegans homolog=T04C12.6; Phenotype=Ste
  Coding regions on vcDNA: vcDNA=SeqID_49415; Strand=+; Position=2-493
CNKKFAVLWGDKGSGMGKAVFPGNNPPPRVFPSLGGGPRHQAVWAGLEQKNSYFENKAHSNVGILTLKTPMEHGIATNGNTLKKIWPPTFYNKLLVPPKKNRGLLTKAPLTLKATEKKRTQIMLETFTRPAMTVPIQAGLTWNPSGRTTGLLLNSREGAPPPGP

SEQ ID NO: 122993 - protein, 202 aa, Heterodera glycines
  misc_feature (17)..(17): Xaa can be any naturally occurring amino acid
  Homolog annotation: Hit_ID=CAE60169.1; Match level="QueryCoverage =100%, HitCoverage=64%, E-value=1e-73, Identity=69%"; Hit description= Hypothetical protein CBG03723 [Caenorhabditis briggsae]
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_49416; Strand=+; Position=2-607
KKKSGGFNTKKILLDLXSGGTAAAVSKTAAAPIKRVKVLLQVQYASILITADKRYKGIIDFLILVLHDQGFLLEWRGKLANVIRYFPTQALNFAFKDTYKPVFTPGVDKEKHFLKIIAMNLASGGAAGATSLCSVQPLDFARTRLSTHVGQGHARQCKGLPECIINILKSDGSIGLYRGFFVSDQGIVIYRTSYFGCFYTTK

SEQ ID NO: 122994 - protein, 210 aa, Heterodera glycines
  Homolog annotation: Hit_ID=NP_510453.1; Match level="QueryCoverage =77%, HitCoverage=33%, E-value=1e-37, Identity=53%"; Hit description =UNCoordinated locomotion UNC-3, Olf-1/EBF transcription factor (55.0 kD) (unc-3) [Caenorhabditis elegans]
  Gene Ontology: Mol. function=protein binding; Biological process =positive regulation of transcription
  Essential gene: C elegans homolog=Y16B4A.1; Phenotype=Unc
  Coding regions on vcDNA: vcDNA=SeqID_49417; Strand=+; Position=32-661
MAEEMALAPSSSSSTAPPSTTAGGIASSSSSVSSSSVVGTCSSSSGGIVPSIKMIFPGEVWCQSGGTAMIIGEQFHEGMQVMVGGTLTWPEMVTAHAIKVNVPARASPGAVDVVVCSPKGQPKVRSNAIRFSYVSLTEPSIDYGFQRLQKLLPKYPNDPERLPKEVILRRAAELAEALYNRYSSPAEQLSHYAYSFDSDLVADYARVHTS

SEQ ID NO: 122995 - protein, 163 aa, Heterodera glycines
  Homolog annotation: Hit_ID=AAH50688.1; Match level="QueryCoverage =99%, HitCoverage=54%, E-value=1e-40, Identity=53%"; Hit description =Laminin receptor 1 [Homo sapiens]
  Gene Ontology: Mol. function=laminin receptor activity; Cellular component=eukaryotic 48S initiation complex; Biological process=cell adhesion
  Essential gene: C elegans homolog=B0393.1; Phenotype=Emb,Ste
  Coding regions on vcDNA: vcDNA=SeqID_49418; Strand=+; Position=2-490
RLDVFKLTDYDAMKFLVSQSDIATRKRDYQMEHYARNRPSDGIHIINIRKTWEKLLFAARAIAVIENPADVAAGSAHPYAQRAELQLAAPIGATPICGRFTTGSLTNHLLKNCLEPRLLAGSDPEVHQQEGRDASYENTPGIAPTNTDSTLRFVDIAVPANNK

SEQ ID NO: 122996 - protein, 166 aa, Heterodera glycines
  misc_feature (153)..(153): Xaa can be any naturally occurring amino acid
  Homolog annotation: Hit_ID=AAC26138.1; Match level="QueryCoverage =90%, HitCoverage=96%, E-value=3e-85, Identity=99%"; Hit description =cleavage stimulation factor [Heterodera glycines]
  Gene Ontology: Mol. function=RNA binding; Cellular component =nucleosome; Biological process=mRNA cleavage
  Essential gene: C elegans homolog=F28C6.3; Phenotype=Emb,Lva
  Coding regions on vcDNA: vcDNA=SeqID_49419; Strand=+; Position=124-625
EVTCVAFHPRESVLLSGSNDFTLKMFDYSKTAVKRAMKTITEVEPITAVSFHPSGEFFLCATRHPTLRLYSAETQQCFVSTIPKDQHSDSITDVCYSENARMFVTGSRDGNVKVWDGVSNRCIETFTRAHDGAPICSAQFTRNGKYVLTVGMXVCPNYGNCPPIAV

SEQ ID NO: 122997 - protein, 161 aa, Heterodera glycines
  Homolog annotation: Hit_ID=CAE67197.1; Match level="QueryCoverage =96%, HitCoverage=37%, E-value=5e-41, Identity=57%"; Hit description =Hypothetical protein CBG12633 [Caenorhabditis briggsae]
  Gene Ontology: Mol. function=short branched-chain acyl-CoA dehydrogenase activity; Cellular component=mitochondrion; Biological process=electron transport
  Essential gene: C elegans homolog=K06A5.6; Phenotype=Emb
  Coding regions on vcDNA: vcDNA=SeqID_49420; Strand=+; Position=51-533
MHISFVSRQATAFLGVASRNALPRVAAEAPPAPLTYLSEDEVALKQSVKQFSESVIRPLVKEMDLKSEMDRRVIEGVFANGLMGIEIAEKFGGSESSFFNVALTVEELAKVDPSVAVLVDVQNTLVAPLIIENGTEEQKQKYLTLIVKDWIGAFCLSEAGS

SEQ ID NO: 122998 - protein, 67 aa, Heterodera glycines
  Homolog annotation: Hit_ID=A48449; Match level="QueryCoverage=100%, HitCoverage=17%, E-value=1e-22, Identity=77%"; Hit description=Actin- 1A - nematode (Onchocerca volvulus)
  Gene Ontology: Cellular component=actin filament; Biological process =reproduction
  Essential gene: C elegans homolog=T04C12.6; Phenotype=Ste
  Coding regions on vcDNA: vcDNA=SeqID_49421; Strand=+; Position=2-202
CDEEVAALGVDNGPGMCKAGFAGDDAPRAVFPIIAGRPRHLGVMDGMGQNDSFLRDYARSNSGILIL

SEQ ID NO: 122999 - protein, 114 aa, Heterodera glycines
  Homolog annotation: Hit_ID=AAF34686.1; Match level="QueryCoverage =95%, HitCoverage=28%, E-value=2e-57, Identity=97%"; Hit description =actin [Schistosoma japonicum] gb|AAC46966.1| actin sp|P53471|ACT2 _SCHMA ACTIN 2
  Gene Ontology: Biological process=reproduction
  Essential gene: C elegans homolog=T04C12.6; Phenotype=Ste
  Coding regions on vcDNA: vcDNA=SeqID_49422; Strand=+; Position=232-573
STQKFIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVGIQAGVPL

SEQ ID NO: 123000 - protein, 76 aa, Heterodera glycines
  misc_feature (41)..(41): Xaa can be any naturally occurring amino acid
  Homolog annotation: Hit_ID=AAT00789.1; Match level="QueryCoverage =97%, HitCoverage=23%, E-value=5e-13, Identity=47%"; Hit description =cathepsin Z precursor [Onchocerca volvulus]
  Gene Ontology: Biological process=embryogenesis and morphogenesis
  Essential gene: C elegans homolog=F32B5.8; Phenotype=Emb
  Coding regions on vcDNA: vcDNA=SeqID_49423; Strand=+; Position=2-229
SIYNSNKCYRQPSDAERVQKRTSMPLYDFDNYLFDHLPETXHWRDDDAINYASTDRNQHIPQYCASCWPMRVTSSL

SEQ ID NO: 123001 - protein, 152 aa, Heterodera glycines
  Homolog annotation: Hit_ID=NP_498363.1; Match level="QueryCoverage =97%, HitCoverage=33%, E-value=9e-36, Identity=51%"; Hit description =imidazolonepropionase (3H359) [Caenorhabditis elegans] gb|AAC24449.1| Hypothetical protein T12A2.1 [Caeno
  Essential gene: C elegans homolog=T12A2.1; Phenotype=Unclassified
  Coding regions on vcDNA: vcDNA=SeqID_49424; Strand=+; Position=49-504
MKDVLILHNINQIVQVVDDDRTFCLLGDQMGKIKIMESDGHELAILCIEGRIEQIGIFEEISSRFISKELTDVTRVDCGGGSVLPGMADAHSHPVFSGDRVHEFAMKLAGATYMEVQAAGGGIPFTAEKTRESTEEQLLEDFLDIAREMLPS

SEQ ID NO: 123002 - protein, 179 aa, Heterodera glycines
  Homolog annotation: Hit_ID=CAE59751.1; Match level="QueryCoverage =100%, HitCoverage=25%, E-value=2e-57, Identity=55%"; Hit description= Hypothetical protein CBG03197 [Caenorhabditis briggsae]
  Essential gene: C elegans homolog=T14D7.2; Phenotype=Egl,Pvl,Unc
  Coding regions on vcDNA: vcDNA=SeqID_49425; Strand=+; Position=3-539
RVSVTHYHPMWPPTDPAVQCPKHWLENVLFINSLTDNRCLPWTWYIGTEFIFYLLSPVFLLALRHSALYGLSLVGLVSAASALANLIIMLQYNFPPTQMLWKQPSNFSPDFIKHHLVIYIKPWYRIGPYLVGLVLGYVLAVHSVSPQRKRSDGTHSARFVWVGWATAGCAGFWSVFGLY

SEQ ID NO: 123003 - protein, 121 aa, Heterodera glycines
  misc_feature (87)..(87): Xaa can be any naturally occurring amino acid
  Homolog annotation: Hit_ID=P30757; Match level="QueryCoverage=100%, HitCoverage=98%, E-value=9e-38, Identity=66%"; Hit description =Histone H2B pir||S16084 histone H2B - sipunculid (Sipunculus nudus)
  Gene Ontology: Mol. function=DNA binding; Cellular component =nucleosome; Biological process=nucleosome assembly
  Essential gene: C elegans homolog=T10C6.11; Phenotype=Emb,Lva,Unc
  Coding regions on vcDNA: vcDNA=SeqID_49426; Strand=+; Position=2-364
PKPSGMRATKAGKTPKEARTGDRKRSKARKESYSEYIYRMLKWVHPDTGISSEAMAVMYSFVNDAVERVVAGASRLVHYNKRSTISXCEIQTAVRLILPGELDRDSASDGTIAATKYRPSK

SEQ ID NO: 123004 - protein, 74 aa, Heterodera glycines
  misc_feature (38)..(38): Xaa can be any naturally occurring amino acid
  misc_feature (58)..(58): Xaa can be any naturally occurring amino acid
  Homolog annotation: Hit_ID=DNHUPA; Match level="QueryCoverage=94%, HitCoverage=10%, E-value=4e-17, Identity=67%"; Hit description =polyadenylate-binding protein - human emb|CAA68428.1| unnamed protein product [Homo sapiens]
  Gene Ontology: Mol. function=poly(A) binding; Cellular component =cytoplasm; Biological process=mRNA metabolism
  Essential gene: C elegans homolog=Y106G6H.2a; Phenotype=Gro,Stp
  Coding regions on vcDNA: vcDNA=SeqID_49427; Strand=+; Position=2-226
PSYPLASLYVGDLHPDVTEAMLFERVSNAGPVLSIRVXVMQLLSSVRLGYAYVEFSTXPADAERAFWTTNELLT

SEQ ID NO: 123005 - protein, 83 aa, Heterodera glycines
  Homolog annotation: Hit_ID=AAT70232.1; Match level="QueryCoverage =100%, HitCoverage=22%, E-value=1e-33, Identity=85%"; Hit description= unc-87 [Heterodera glycines]
  Essential gene: C elegans homolog=F08B6.4a; Phenotype=Unc
  Coding regions on vcDNA: vcDNA=SeqID_49428; Strand=+; Position=14-262
MPESEHHFHEEAPNASMETKVAGGGAVPKRVGCWTLSWLRQMVSIITSQDGWNKGDSQKLMTNFGTPRNTTTKVKVENLAEIP

SEQ ID NO: 123006 - protein, 137 aa, Heterodera glycines
  Homolog annotation: Hit_ID=NP_496205.1; Match level="QueryCoverage =100%, HitCoverage=9%, E-value=5e-21, Identity=40%"; Hit description =phospholipase C gamma (2K519) [Caenorhabditis elegans] emb|CAA88745.1| Hypothetical protein T01E8.3 [Caen
  Essential gene: C elegans homolog=T01E8.3; Phenotype=Stp
  Coding regions on vcDNA: vcDNA=SeqID_49429; Strand=+; Position=2-412
TTDKTVFVVSLRIDNNLCHFRLKREGRLFMVAQRTFETLCHLEDFYASTPFVRGVSLKFPVNEQTISQYTDQNDGQLHLDCFYIDLNNLDKELLVETIESFDGIIDDCQMSKNDQLKVFPPLSFPIGTQITLLSMDQ

SEQ ID NO: 123007 - protein, 213 aa, Heterodera glycines
  Homolog annotation: Hit_ID=CAE57188.1; Match level="QueryCoverage =58%, HitCoverage=18%, E-value=1e-16, Identity=42%"; Hit description =Hypothetical protein CBG00032 [Caenorhabditis briggsae]
  Gene Ontology: Biological process=nucleobase, nucleoside, nucleotide and nucleic acid metabolism
  Essential gene: C elegans homolog=ZK686.2; Phenotype=Lva
  Coding regions on vcDNA: vcDNA=SeqID_49430; Strand=+; Position=9-647
MDFEVCSTSSGDEFVDLDLEFSSADESIHDFGDSSMDKKPLERLLREIESESQKEVEDADKVAYRRVGLPNVGPTAQPKTLFPVWVTESKRFSAQIGGDTDNEQKGIGLRLDNLRPEFLHVLQKSISFWFPVQRFVLPTLLQMANSVLPPRDLVICSPTGSGKTLCYVLPILNALRICPFSTSSVFALVVAPVRNLAEQIFKEFEKLNLFGAA

SEQ ID NO: 123008 - protein, 216 aa, Heterodera glycines
  Homolog annotation: Hit_ID=CAE67142.1; Match level="QueryCoverage =99%, HitCoverage=26%, E-value=1e-27, Identity=35%"; Hit description =Hypothetical protein CBG12565 [Caenorhabditis briggsae]
  Gene Ontology: Mol. function=RNA binding; Cellular component=nucleus; Biological process=RNA processing
  Essential gene: C elegans homolog=T08B2.5a; Phenotype=Ste
  Coding regions on vcDNA: vcDNA=SeqID_49431; Strand=+; Position=8-655
MSRQQRDSSSSRSSDSWSRKSRSRSRASSPSRSSSSPHDRDWRFRSRSGERNKRRCRHSRQSPPPRKRERSRTPFSRRRFSNETKPSNKVILTSLPNYADKDALNILLAKQGFHPIDIRVVRRNTDSGSVRIFGFVEFSDVETAEDWIRHNQGFLKMDDGFQVRLEYSREELNRERPIYNPLTSDWTCSKCTINNFNRRTNCFKCGTSRKDSEALD

SEQ ID NO: 123009 - protein, 93 aa, Heterodera glycines
  misc_feature (79)..(79): Xaa can be any naturally occurring amino acid
  Homolog annotation: Hit_ID=NP_498534.1; Match level="QueryCoverage =84%, HitCoverage=18%, E-value=5e-21, Identity=60%"; Hit description =UBiquitin Activating enzme related, ectopic membrane RuFfLes in embryo RFL-1, CYtoKinesis defect CYK-5 (r
  Gene Ontology: Mol. function=ubiquitin-like activating enzyme activity; Cellular component=nucleus; Biological process=endomitotic cell cycle
  Essential gene: C elegans homolog=F11H8.1; Phenotype=Emb
  Coding regions on vcDNA: vcDNA=SeqID_49432; Strand=+; Position=12-294
MSSHNTSVIDENRRWSDLRCLTDRASTFANSGFVPGIKNLKEVHKMPVLVVGAGGLGCEILKDLALSGFHDIHIIDMDXIDLSNLNRQFLFRF

SEQ ID NO: 123010 - protein, 191 aa, Heterodera glycines
  Homolog annotation: Hit_ID=AAH54644.1; Match level="QueryCoverage =72%, HitCoverage=69%, E-value=5e-22, Identity=41%"; Hit description =Hypothetical protein MGC64216 [Danio rerio] ref|NP_956717.1| hypothetical protein MGC64216 [Danio rerio]
  Gene Ontology: Cellular component=nucleus; Biological process=signal transduction
  Essential gene: C elegans homolog=W02D3.9; Phenotype=Emb
  Coding regions on vcDNA: vcDNA=SeqID_49433; Strand=+; Position=73-645
GNSSAHHQATVNSVGTVASGQMKPSVKDLLDRVLDEYNHLQQQLHNVRVELEKSQQERDTLHRYSLMYSETFFTLNFEMLKHGEIVKRLSGILSHVIPLLPQEHQAPAVQAIERAKTINQQDVTSIVNGQVQQQQQFASILPGLGSMMNPTAFGNPMGAMMGIKPEDAIQAAAMFNNLLKNPMLGATAAGL

SEQ ID NO: 123011 - protein, 192 aa, Heterodera glycines
  Homolog annotation: Hit_ID=NP_505800.1; Match level="QueryCoverage =98%, HitCoverage=45%, E-value=8e-51, Identity=56%"; Hit description =glutathione S-transferase, C-terminal and Elongation factor 1, gamma chain (44.4 kD) (5L447) [Caenorhabdi
  Gene Ontology: Mol. function=translation elongation factor activity; Cellular component=intracellular; Biological process=translational elongation
  Essential gene: C elegans homolog=F17C11.9a; Phenotype=Gro
  Coding regions on vcDNA: vcDNA=SeqID_49434; Strand=+; Position=1-625
AKLYGNQDNFRVKKVLIAAKLSGKDIKAIPQLPPTNLFPLGQAPAFDDGKVCLFGAEAISKYLLGTGSIYLPQNPELDQWIGWTASSLQPNVLSYVLPCVSAAKIDQNALETAKNELLAQLSLFDQILLPKTFLVGERLSLADISVAIDLLPAYQYVLGEEARKGLVNVNRWFQTVVSQPGIREVLGEFSFI

SEQ ID NO: 123012 - protein, 219 aa, Heterodera glycines
  Homolog annotation: Hit_ID=NP_501800.1; Match level="QueryCoverage =98%, HitCoverage=18%, E-value=6e-67, Identity=56%"; Hit description =UBA (human ubiquitin) related, UBiquitin Activating enzme related (124.1 kD) (uba-1) [Caenorhabditis eleg
  Gene Ontology: Mol. function=ubiquitin activating enzyme activity; Cellular component=cytoplasm; Biological process=reproduction
  Essential gene: C elegans homolog=C47E12.5; Phenotype=Emb
  Coding regions on vcDNA: vcDNA=SeqID_49435; Strand=+; Position=3-659
GSNVFNIGNALAAFSGAVQGPVSRGRVQQVKVPKKMSFKPLSRALAEPDFMIWDFAKFDEPAQLHALWQALYSFEEMKNYSPLPRSDADAKLLKEMLPKDAPEMPDSLLLNFSYQACGNLQPIASLISGLVAQEAMKAVTHHTTPLKQFLYTDSLEALPGADSTFDAAKLEKNDCAPRNNRYDGQAAVFGWAFQEALQQQKWFIVGAGAIGCELLKNMA

SEQ ID NO: 123013 - protein, 144 aa, Heterodera glycines
  Homolog annotation: Hit_ID=AAP20434.1; Match level="QueryCoverage =100%, HitCoverage=32%, E-value=4e-80, Identity=94%"; Hit description= beta-tubulin isotype 1 [Cooperia oncophora]
  Gene Ontology: Mol. function=MHC class I protein binding; Cellular component=tubulin; Biological process=embryogenesis and morphogenesis
  Essential gene: C elegans homolog=C36E8.5; Phenotype=Emb
  Coding regions on vcDNA: vcDNA=SeqID_49436; Strand=-; Position=3-532
MREIVHIQAGQCGNQVGSKFWEVISDEHGIQPDGTYKGDTDLQLERINVYYNEAYGGKYVPRAVLVDLEPGTMDSIRAGPYGQLFRPDNFVFGQSGAGNNWAKGHYTEGAELVDNVLDVVRKEAEGCDCLQGFQLTHSLGGGTG

SEQ ID NO: 123014 - protein, 176 aa, Heterodera glycines
  Homolog annotation: Hit_ID=AAK66762.1; Match level="QueryCoverage =100%, HitCoverage=26%, E-value=1e-100, Identity=99%"; Hit description=proprotein convertase 2 [Heterodera glycines]
  Gene Ontology: Mol. function=subtilase activity; Cellular component =Golgi apparatus; Biological process=proteolysis and peptidolysis
  Essential gene: C elegans homolog=K04F10.4a; Phenotype=Emb,Lvl
  Coding regions on vcDNA: vcDNA=SeqID_49437; Strand=+; Position=48-624
VYKTAPPRFHCEAGTIEMPREIPASGEMVLTLRTDACTGSTTEVNFLEHVQAIVSLNSSRRVDTTLYLISPAGTPSMILSRRPKDDDAKDGFTNWPFMTTHTWGENPRGRWRLVVRFQPGKSTPKGHKYRGTLKKFTLMLHGTKEPPYRGIEPLQGHANSKLSVVQSAHKRMANRR

SEQ ID NO: 123015 - protein, 69 aa, Heterodera glycines
  misc_feature (34)..(34): Xaa can be any naturally occurring amino acid
  Homolog annotation: Hit_ID=NP_501727.1; Match level="QueryCoverage =91%, HitCoverage=20%, E-value=2e-12, Identity=58%"; Hit description =adenine nucleotide family member (4K472) [Caenorhabditis elegans] emb|CAA92472.1| Hypothetical protein K0
  Gene Ontology: Biological process=embryogenesis and morphogenesis
  Essential gene: C elegans homolog=T27E9.1a; Phenotype=Emb
  Coding regions on vcDNA: vcDNA=SeqID_49438; Strand=+; Position=2-208
NKKSGGFNTKNFLLDLISFGTAAAISKTAVAPIXCVQLLMHVQDACIHISDDWPYKSILHILIRVSQEH

SEQ ID NO: 123016 - protein, 78 aa, Heterodera glycines
  Homolog annotation: Hit_ID=CAE65730.1; Match level="QueryCoverage =78%, HitCoverage=24%, E-value=2e-20, Identity=80%"; Hit description =Hypothetical protein CBG10813 [Caenorhabditis briggsae]
  Gene Ontology: Mol. function=endopeptidase activity; Cellular component=26S proteasome; Biological process=ubiquitin-dependent protein catabolism
  Essential gene: C elegans homolog=Y110A7A.14; Phenotype=Emb
  Coding regions on vcDNA: vcDNA=SeqID_49439; Strand=+; Position=65-301
MARRYDTRTTIFSPEGRLYQVEYAMEAIGQAGTCLGIRAPDGIFIAAQKLTANKLLDDRVLNTSHLKQIIATVALKFY

SEQ ID NO: 123017 - protein, 201 aa, Heterodera glycines
  Homolog annotation: Hit_ID=NP_741382.1; Match level="QueryCoverage =89%, HitCoverage=38%, E-value=5e-36, Identity=47%"; Hit description =tYrosinyl tRNA Synthetase (50.1 kD) (yrs-1) [Caenorhabditis elegans] gb|AAB09162.2| Tyrosinyl trna synthe
  Gene Ontology: Mol. function=tyrosine-tRNA ligase activity; Cellular component=mitochondrion; Biological process=amino acid activation
  Essential gene: C elegans homolog=K08F11.4a; Phenotype=Lva
  Coding regions on vcDNA: vcDNA=SeqID_49440; Strand=+; Position=2-648
LLSCTHPEFPYKQQDITAYSSTLPNVLYAGVDPTADSLHLGNLLVLNSLIRASFFGCSPILLIGKATASVGDPSGHKRDRILLLHEFIYANSKALQIQVEKIKANVSSLYGEDISLEIRNNAEWYKEMRILDFFESTKRFRMSDMLKSGPIKSRLDDCETLSYAEFSYQTLQAIDWLKLYEERGCLCQIGGTDQFGNMRAG

SEQ ID NO: 123018 - protein, 128 aa, Heterodera glycines
  misc_feature (73)..(73): Xaa can be any naturally occurring amino acid
  Homolog annotation: Hit_ID=CAE70046.1; Match level="QueryCoverage =99%, HitCoverage=31%, E-value=6e-16, Identity=43%"; Hit description =Hypothetical protein CBG16478 [Caenorhabditis briggsae]
  Gene Ontology: Mol. function=helicase activity; Cellular component =eukaryotic translation initiation factor 4 complex; Biological process=nucleobase, nucleoside, nucleotide and nucleic acid metabolism
  Essential gene: C elegans homolog=F57B9.6; Phenotype=Lva
  Coding regions on vcDNA: vcDNA=SeqID_49441; Strand=+; Position=2-388
IPSAIPLRSISTTCTARNSISQSHSGTGGTATFSICILPRLHNNAPDVPGLLIAPTHYLGAHIRLDIDALGEXPPIKYHARILATSEPDYQRTLERTDPVINGTPGLDDELILLGALLNYYIVMFVLD

SEQ ID NO: 123019 - protein, 168 aa, Heterodera glycines
  misc_feature (88)..(88): Xaa can be any naturally occurring amino acid
  misc_feature (134)..(134): Xaa can be any naturally occurring amino acid
  misc_feature (144)..(144): Xaa can be any naturally occurring amino acid
  misc_feature (151)..(151): Xaa can be any naturally occurring amino acid
  Homolog annotation: Hit_ID=NP_492424.1; Match level="QueryCoverage =100%, HitCoverage=14%, E-value=9e-28, Identity=40%"; Hit description= retinoblastoma binding protein 6 like (1J586) [Caenorhabditis elegans]
  Gene Ontology: Biological process=histogenesis and organogenesis
  Essential gene: C elegans homolog=F36F2.3; Phenotype=Emb
  Coding regions on vcDNA: vcDNA=SeqID_49442; Strand=+; Position=20-523
FEATLQYKTLTFDWLHLGVDELKMASCDKENIRTESFDLVLTNAHSKRECAVGELEPRYSAVVVPPIPRLDAQKLPKVRDTFTNGIGXRHLSTYQLNSAHCYINPEDFAGMSEEHLLVRITRVSPDNYSSTNYXRRTGCIMTGXPPPVTYXCYRCGQSGRWYKGCTLL

SEQ ID NO: 123020 - protein, 164 aa, Heterodera glycines
  misc_feature (52)..(52): Xaa can be any naturally occurring amino acid
  misc_feature (128)..(128): Xaa can be any naturally occurring amino acid
  misc_feature (139)..(139): Xaa can be any naturally occurring amino acid
  Homolog annotation: Hit_ID=AAL78225.1; Match level="QueryCoverage =78%, HitCoverage=99%, E-value=1e-58, Identity=91%"; Hit description =putative pyruvate dehydrogenase [Heterodera glycines]
  Gene Ontology: Mol. function=pyruvate dehydrogenase activity; Cellular component=mitochondrion; Biological process=acetyl-CoA metabolism
  Essential gene: C elegans homolog=T05H10.6a; Phenotype=Emb
  Coding regions on vcDNA: vcDNA=SeqID_49443; Strand=+; Position=15-508
MMELATYRYYGHSMSDPGTSYRTRDEIQEVRKSRDPITSFKDRIVTAGLVTXEELKDIDKKVRQEVDEAVKVALSDEVLPPEALFSDLYANTPPLAVRGTTADATVTQPFVSTAEVLRKMGREPKNYXRTNSQRRIDSXEKHRIINCFIIFIRSKLSEEERDSF

SEQ ID NO: 123021 - protein, 196 aa, Heterodera glycines
  Homolog annotation: Hit_ID=NP_492732.2; Match level="QueryCoverage =97%, HitCoverage=21%, E-value=2e-36, Identity=38%"; Hit description =yeast SEC homolog (sec-8) [Caenorhabditis elegans] emb|CAA21575.2| Hypothetical protein Y106G6H.7 [Caenor
  Essential gene: C elegans homolog=Y106G6H.7; Phenotype =Gro,Pvl,Rup,Sma,Unc
  Coding regions on vcDNA: vcDNA=SeqID_49444; Strand=+; Position=3-590
LINVIRTLTTTVSNDQRQLEKQRIEHGYKQSEQNIDKLLKEHRSDALHCLNTFQSVSKELTSCREQIRNIKSSLSLCKSFLQCRRDDLNKFWLENAQQKKVCDILQQIQQIKETEKNIDVQLASGEYKEVIRVLKDADVLLKGPFEKMDGISQLKFVVSENLQKVFGQIVTDLLQCTFDEPFEIQTLEAVKSGKLI

SEQ ID NO: 123022 - protein, 221 aa, Heterodera glycines
  Homolog annotation: Hit_ID=H89052; Match level="QueryCoverage=96%, HitCoverage=39%, E-value=1e-102, Identity=84%"; Hit description =protein C18C4.10 [imported] - Caenorhabditis elegans
  Essential gene: C elegans homolog=M7.2; Phenotype=Emb
  Coding regions on vcDNA: vcDNA=SeqID_49445; Strand=+; Position=1-663
LRSNEVNTSTTLQELGFGPDEDDDLHNASHFSQPTPANAMAASASAGYDIPQRLKTLHNLVIQYAAQGRYEVAVPLCKQALEDLEKNNGHDHPDVATMLNILALVYRDQRKYKEAAALLNEALAIRERCLGEDHPAVAATLNNLAVLYGKRGKYKEAEPLCKRALEIREKVLGNDHPDVAKQLNNLALICQNQGMYDEVEKYYRRALEIYESKLGPDDSNV

SEQ ID NO: 123023 - protein, 192 aa, Heterodera glycines
  Homolog annotation: Hit_ID=NP_505848.1; Match level="QueryCoverage =98%, HitCoverage=50%, E-value=1e-62, Identity=58%"; Hit description =putative protein, with a coiled coil domain (39.5 kD) (5L703) [Caenorhabditis elegans] emb|CAA98547.1| Hy
  Essential gene: C elegans homolog=T19B10.2; Phenotype=Gro,Rup,Unc
  Coding regions on vcDNA: vcDNA=SeqID_49446; Strand=+; Position=1-579
LAFCAERKPERAGSTSKCLKSPFLGYYQKHCQVLNACDTEAAGAECVETLRTSKASVCECIDEARDDLKRRIAGIAEAIQEAVQGGSRAAPSIGSNSKVDQCVANIKKQLITPTNDWASTIDNALNNCIKNKPSSQNLGIDSLLNVGCRKIIADSSGAAQAQIKTGFEFVNNLIDAMVERSRRFCGGAHCGN

SEQ ID NO: 123024 - protein, 99 aa, Heterodera glycines
  misc_feature (57)..(57): Xaa can be any naturally occurring amino acid
  misc_feature (63)..(63): Xaa can be any naturally occurring amino acid
  misc_feature (79)..(79): Xaa can be any naturally occurring amino acid
  Homolog annotation: Hit_ID=A30097; Match level="QueryCoverage=90%, HitCoverage=59%, E-value=7e-35, Identity=80%"; Hit description =ribosomal protein S14 (clone MCH1) - maize sp|P19950|R141_MAIZE 40S ribosomal protein S14 (Clone MCH1)
  Gene Ontology: Mol. function=structural constituent of ribosome; Cellular component=eukaryotic 48S initiation complex; Biological process=ribosomal small subunit assembly and maintenance
  Essential gene: C elegans homolog=F37C12.9; Phenotype=Emb,Ste
  Coding regions on vcDNA: vcDNA=SeqID_49447; Strand=+; Position=3-300
VFGVAHIFASFNDTFVHVTDLSGRETIVKITGGMRVKADRDEASPYAAMLPAQDVAXRCSRVXINALHVQLRATGGNKXTKTRGPGGQAAPACPSFVRV

SEQ ID NO: 123025 - protein, 212 aa, Heterodera glycines
  Homolog annotation: Hit_ID=CAE57187.1; Match level="QueryCoverage =99%, HitCoverage=62%, E-value=2e-77, Identity=60%"; Hit description =Hypothetical protein CBG00031 [Caenorhabditis briggsae]
  Gene Ontology: Cellular component=membrane; Biological process =protein modification
  Essential gene: C elegans homolog=ZK686.3; Phenotype=Emb
  Coding regions on vcDNA: vcDNA=SeqID_49448; Strand=+; Position=3-638
MLKRPLINLNLEKWKTYVQSSPRNYSMIVMFTVLSASMNCPICKPAYEEYLILANSYRYTFLNSKSLYFALVDYEEAPQVFNLLNLNTAPAIYHFPAKGARRNQDTMDFQRMGIDADAMAKFVQDRTDIQIRVLRPPNYAAPVVVLLLVMLVLGLLYMRRNNLEFLFNRTFWALVCVGIVFAFMSGQMWNHIRGPPFVMTHPQTRETSLVHG

SEQ ID NO: 123026 - protein, 218 aa, Heterodera glycines
  Homolog annotation: Hit_ID=CAE59222.1; Match level="QueryCoverage =98%, HitCoverage=37%, E-value=2e-52, Identity=48%"; Hit description =Hypothetical protein CBG02540 [Caenorhabditis briggsae]
  Gene Ontology: Mol. function=protein serine/threonine kinase activity; Biological process=protein amino acid phosphorylation
  Essential gene: C elegans homolog=F28B12.3; Phenotype=Emb,Gro
  Coding regions on vcDNA: vcDNA=SeqID_49449; Strand=+; Position=3-656
KVPRLHDKAVLVKSGTKFVDGRKQEFVVGKEIGQGGFGRIYEGVQSGSRHAVAIKMEPPSNGPLFTEMHVYMRVLKPEHLDKWKKDKGLKFLGLPHFISNGSFTYEGQQIRYLVIPKFALSLESVRAARTPSAVLSWTEVSAVAKTVVHALAYLHDQNYVHGDVKAANLMMESKSDFSRVVLIDFGLARRLPDALVEKENKKQAHNGTPLFTSCDAHR

SEQ ID NO: 123027 - protein, 110 aa, Heterodera glycines
  Homolog annotation: Hit_ID=CAH04320.1; Match level="QueryCoverage =98%, HitCoverage=51%, E-value=1e-20, Identity=47%"; Hit description =S8e ribosomal protein [Cicindela littoralis]
  Gene Ontology: Cellular component=eukaryotic 48S initiation complex; Biological process=protein biosynthesis
  Essential gene: C elegans homolog=F42C5.8; Phenotype=Lva,Ste
  Coding regions on vcDNA: vcDNA=SeqID_49450; Strand=+; Position=2-331
MTGGKRIPASGVPMFEMGPPVTHTNIGPNHIHLVRRLDGDITCTELLLDTGDFTSPSKRCAHTTRFIFPIYNASNRHLVRTGTSNQGMILSIDGTPFRPWYQAQYALPLS

SEQ ID NO: 123028 - protein, 216 aa, Heterodera glycines
  Homolog annotation: Hit_ID=CAE70363.1; Match level="QueryCoverage =96%, HitCoverage=13%, E-value=4e-59, Identity=53%"; Hit description =Hypothetical protein CBG16921 [Caenorhabditis briggsae]
  Gene Ontology: Mol. function=1-phosphatidylinositol-3-phosphate 5 -kinase activity; Cellular component=vacuolar membrane; Biological process=signal transduction
  Essential gene: C elegans homolog=F55A12.3; Phenotype=Lva,Ste,Unc
  Coding regions on vcDNA: vcDNA=SeqID_49451; Strand=+; Position=1-648
INSISTSSPWYPQGGKSGAVFSRTDDERFVLKTLNRFELDAFKQSALKYIDYISMALMEGKLTALCKIFGAFSVNCTNKQTGHSVKSDLIVMEFLFYRKDIKQIWDLKGSLRNRLASTKNDNNGASSVLLDENYIQNMWRNQIYITTHSKTALSQAIINDSHFLADQGIMDYSLLAGICRGEEDEVIVGIVDYMRTFTFDKKVESAIKNAIPLTNS

SEQ ID NO: 123029 - protein, 195 aa, Heterodera glycines
  misc_feature (113)..(113): Xaa can be any naturally occurring amino acid
  misc_feature (121)..(121): Xaa can be any naturally occurring amino acid
  Homolog annotation: Hit_ID=CAA65506.1; Match level="QueryCoverage =98%, HitCoverage=64%, E-value=3e-39, Identity=48%"; Hit description =cuticular collagen [Teladorsagia circumcincta]
  Gene Ontology: Mol. function=structural constituent of cuticle; Cellular component=extracellular; Biological process=cuticle biosynthesis (sensu Nematoda)
  Essential gene: C elegans homolog=T07H6.3a; Phenotype=Bmd,Gro,Unc
  Coding regions on vcDNA: vcDNA=SeqID_49452; Strand=+; Position=2-586
ADFDKHAAQREAESLRTLAFFGVCLSTVATAINVISVTFAYQHFQQLGTQMQNEVDFCKMCSGNMWCEVTLTQTYSKVWPDSSHKRQARGCCGCRVSPPGPPGPPGPSGQPGXTDNPEAHXQPGSPGQESPLPYPPSGRRVPHCEAAQPGLPGPPGPPGPYGDNGQPGQFGPDRSPERQRAQGAPGHDGQTAHPG

SEQ ID NO: 123030 - protein, 167 aa, Heterodera glycines
  misc_feature (124)..(124): Xaa can be any naturally occurring amino acid
  misc_feature (130)..(130): Xaa can be any naturally occurring amino acid
  Homolog annotation: Hit_ID=CAE73453.1; Match level="QueryCoverage =98%, HitCoverage=24%, E-value=5e-34, Identity=47%"; Hit description =Hypothetical protein CBG20902 [Caenorhabditis briggsae]
  Gene Ontology: Biological process=physiological processes
  Essential gene: C elegans homolog=Y48B6A.1; Phenotype=Lva
  Coding regions on vcDNA: vcDNA=SeqID_49453; Strand=+; Position=2-501
KPLQIEEYDTSDEQDLRNTNGNIPVQWYNDYDHDGYTSSGDKNEKQASIFYESDASLPKEEDSYYRRKVLDRQSGQQMALTDQQVEKLNAIAHNRFPEIRYNTYPPILDIFPSEREIRPISNTXPPRNTXSVPRGDERRNDGRMVPGIKMGLGKKRKKPPQTVKEPG

SEQ ID NO: 123031 - protein, 110 aa, Heterodera glycines
  misc_feature (59)..(59): Xaa can be any naturally occurring amino acid
  Homolog annotation: Hit_ID=AAH82154.1; Match level="QueryCoverage =100%, HitCoverage=49%, E-value=8e-16, Identity=41%"; Hit description= Unknown (protein for MGC:98438) [Xenopus laevis] ref|NP_059071.1| SH3 domain protein 3 [Mus musculus] gb|
  Essential gene: C elegans homolog=Y106G6H.14; Phenotype=Ste
  Coding regions on vcDNA: vcDNA=SeqID_49454; Strand=+; Position=2-331
PPPPMAKPGRIRMFRSLKQFVPTKAGELKLYGEDIVYVKEAPDGTTSCESKSATGYTEXILPKQFVEQHMELIEFPLHGAAMAGDLSFLRECMDYKMCVYGLDRSSSTAL

SEQ ID NO: 123032 - protein, 169 aa, Heterodera glycines
  Homolog annotation: Hit_ID=CAE71097.1; Match level="QueryCoverage =100%, HitCoverage=100%, E-value=4e-78, Identity=82%"; Hit description=Hypothetical protein CBG17948 [Caenorhabditis briggsae]
  Gene Ontology: Mol. function=structural molecule activity; Cellular component=Arp2/3 protein complex; Biological process=actin cortical patch assembly
  Essential gene: C elegans homolog=C35D10.16; Phenotype=Emb
  Coding regions on vcDNA: vcDNA=SeqID_49455; Strand=+; Position=70-579
MSTTLQPYLDAVRRSLEAALCLQQFGSQVVERHNKPEVEVRTSKELLLTPVMVCRNKQEAVLIEPSINSVRMSIRVKQADEIEKILCNKFTRFMCQRADNFIILRRKPMPGFDISFLITATHTQVMYKHKLIDFLIHFMQEIDKEISEMKLALNARARTSAEEFLKRFN

SEQ ID NO: 123033 - protein, 162 aa, Heterodera glycines
  Homolog annotation: Hit_ID=EAL31558.1; Match level="QueryCoverage =99%, HitCoverage=27%, E-value=6e-79, Identity=81%"; Hit description =GA19369-PA [Drosophila pseudoobscura]
  Gene Ontology: Mol. function=transcription co-activator activity; Cellular component=transcription factor complex; Biological process =transcription from Pol II promoter
  Essential gene: C elegans homolog=VC5.4; Phenotype=Rup
  Coding regions on vcDNA: vcDNA=SeqID_49456; Strand=+; Position=3-491
HLPCIYLCEFCLTYLKSQSALARHVKKCNLYYPPGNEIYRKDSISFYEIDGRKNKIYAQNLCLLAKLFLDHKTLYYDTDPFLFYVLTEYDQKGFHIVGYFSKEKESAEEYNVACILVLPPYQKRGYGRLLIEFSYELSKIEGRTGSPEKPLSDLGLLSYRSY

SEQ ID NO: 123034 - protein, 69 aa, Heterodera glycines
  misc_feature (53)..(53): Xaa can be any naturally occurring amino acid
  Homolog annotation: Hit_ID=CAE62748.1; Match level="QueryCoverage =100%, HitCoverage=24%, E-value=8e-15, Identity=57%"; Hit description= Hypothetical protein CBG06912 [Caenorhabditis briggsae]
  Essential gene: C elegans homolog=K02D10.5; Phenotype=Ste
  Coding regions on vcDNA: vcDNA=SeqID_49457; Strand=+; Position=2-208
TQLSRQQLSSSEGLGEYSARQLLEQREKLERAEQNMDTVHHTTQHTQRILNSXKSWLGGLVTNKLSPSP

SEQ ID NO: 123035 - protein, 55 aa, Heterodera glycines
  Homolog annotation: Hit_ID=NP_491857.1; Match level="QueryCoverage =98%, HitCoverage=26%, E-value=2e-14, Identity=70%"; Hit description =RAB family member (22.7 kD) (rab-10) [Caenorhabditis elegans] gb|AAC48200.1| Rab family protein 10 [Caeno
  Gene Ontology: Mol. function=RAB small monomeric GTPase activity; Biological process=negative regulation of FGF receptor signaling pathway
  Essential gene: C elegans homolog=T23H2.5; Phenotype=Unclassified
  Coding regions on vcDNA: vcDNA=SeqID_49458; Strand=+; Position=2-166
AYYLLYKLLLIGHCGMGKTWVLYRFLDDAFNTSFISTIGIDFKIGTIDLRWNKMK

SEQ ID NO: 123036 - protein, 177 aa, Heterodera glycines
  Homolog annotation: Hit_ID=NP_510191.1; Match level="QueryCoverage =99%, HitCoverage=38%, E-value=3e-49, Identity=58%"; Hit description =aspartic protease (49.3 kD) (asp-4) [Caenorhabditis elegans] emb|CAA90633.1| Hypothetical protein R12H7.2
  Gene Ontology: Mol. function=aspartic-type endopeptidase activity; Cellular component=lysosome; Biological process=induction of non -apoptotic programmed cell death
  Essential gene: C elegans homolog=R12H7.2; Phenotype=Ced
  Coding regions on vcDNA: vcDNA=SeqID_49459; Strand=+; Position=2-532
GLASVTLRRMDTVRSRLAAAGSLVQFRKHLRQALRQRLDRLYSDKMARADVAFDTDAAAREGIDEVLRNYMDAQYYGDISIGSPPQNFTVIFDTGSSNLWVPSKKCSFFDLACRYHSKYDHKKSSTYQPDGREVAIEYGTGSMKGFVSKDTVCIMDGMCVEGQEFAEATSEPGDTFV

SEQ ID NO: 123037 - protein, 121 aa, Heterodera glycines
  Homolog annotation: Hit_ID=CAE61909.1; Match level="QueryCoverage =63%, HitCoverage=8%, E-value=2e-21, Identity=66%"; Hit description =Hypothetical protein CBG05905 [Caenorhabditis briggsae]
  Gene Ontology: Mol. function=aminopeptidase activity; Cellular component=cytosol
  Essential gene: C elegans homolog=F49E8.3; Phenotype=Emb
  Coding regions on vcDNA: vcDNA=SeqID_49460; Strand=+; Position=1-366
LKVPIDNPNELEEIYDSITYAKSNSIIRMLFNHLGEATFQKAIRDYLKKHQYANAETNDLWKSLSDASGIDVKALMSRRFAHDGGGRETFLRQLRLLLAAFQLRDGMLNNDGATAGHQRTH

SEQ ID NO: 123038 - protein, 147 aa, Heterodera glycines
  Homolog annotation: Hit_ID=CAE72054.1; Match level="QueryCoverage =92%, HitCoverage=10%, E-value=2e-28, Identity=51%"; Hit description =Hypothetical protein CBG19140 [Caenorhabditis briggsae]
  Essential gene: C elegans homolog=T19A5.1; Phenotype=Gro,Slu
  Coding regions on vcDNA: vcDNA=SeqID_49461; Strand=+; Position=3-527
SDPALDPVLRELDSLPAFQYRHQLTKFYKPEKALRNTLRSLGSSGKVEQIEHVVARLYFAMKSDEVHWALSTLSALYWRVKGDPVNAIKCLRHSLHKSPNIFKDVPLISLANIYHQAGFLHSALIVGRKALEAGVDVVALHFTLANI

SEQ ID NO: 123039 - protein, 74 aa, Heterodera glycines
  Homolog annotation: Hit_ID=NP_498280.1; Match level="QueryCoverage =97%, HitCoverage=28%, E-value=7e-14, Identity=44%"; Hit description =paxillin (3G980) [Caenorhabditis elegans] gb|AAA62294.1| Hypothetical protein C28H8.6a [Caenorhabditis el
  Gene Ontology: Mol. function=protein binding; Cellular component =microtubule associated complex; Biological process=integrin-mediated signaling pathway
  Essential gene: C elegans homolog=C28H8.6a; Phenotype=Lva
  Coding regions on vcDNA: vcDNA=SeqID_49462; Strand=+; Position=2-223
IHSIPNGDCASRNQPLIGPLVITLAKIWRPARFCCAPCGAFLENRNFFERLRKAYCDSYYNAFFSPRSSNCNGP

SEQ ID NO: 123040 - protein, 216 aa, Heterodera glycines
  Homolog annotation: Hit_ID=NP_499472.1; Match level="QueryCoverage =96%, HitCoverage=18%, E-value=2e-35, Identity=41%"; Hit description =sterol regulatory element Binding Protein, Helix Loop Helix containing protein, LiPid Depleted LPD-1 (125
  Gene Ontology: Mol. function=transcription factor activity; Cellular component=nucleus; Biological process=body morphogenesis (sensu Nematoda)
  Essential gene: C elegans homolog=Y47D3B.7; Phenotype=Lpd,Unclassified
  Coding regions on vcDNA: vcDNA=SeqID_49463; Strand=+; Position=3-650
RRMADAAVASGNYKEAQRVLGESLKILQRPLPSGGSVDEWMSLTFSVIRHFLNGLWIGRWFARRRRPSVTHQSVCRSHAETALVYHQLHQLHLLDVDGIRLSSRGALNLALLATNLAESAGSPAIPHSFRAEIYLCAALRSVLCMPKCLRRVVAAYFFRRAKRHLRKSAALEGCRVPNSVQWVFHPLARHFLSCPVRVGTILSQSGVQKTPNFPFS

SEQ ID NO: 123041 - protein, 72 aa, Heterodera glycines
  misc_feature (48)..(48): Xaa can be any naturally occurring amino acid
  Homolog annotation: Hit_ID=CAE61383.1; Match level="QueryCoverage =100%, HitCoverage=43%, E-value=1e-24, Identity=69%"; Hit description= Hypothetical protein CBG05231 [Caenorhabditis briggsae]
  Gene Ontology: Mol. function=ubiquitin-like conjugating enzyme activity; Cellular component=nucleus; Biological process=growth
  Essential gene: C elegans homolog=F29B9.6; Phenotype =Emb,Gro,Pvl,Stp,Unc
  Coding regions on vcDNA: vcDNA=SeqID_49464; Strand=+; Position=2-217
AGIPPGRLTEERIAWRTDHPFGFVARQCKKEDSTLDLNNWICAIPGTXSTIWEGGLVKLRMIFEDDFPSTPP

SEQ ID NO: 123042 - protein, 199 aa, Heterodera glycines
  Homolog annotation: Hit_ID=CAE72661.1; Match level="QueryCoverage =97%, HitCoverage=51%, E-value=1e-26, Identity=38%"; Hit description =Hypothetical protein CBG19874 [Caenorhabditis briggsae]
  Essential gene: C elegans homolog=H35B03.2a; Phenotype=Lva
  Coding regions on vcDNA: vcDNA=SeqID_49465; Strand=+; Position=37-633
MLRKNQFAELNIRHRGNSERTLATVRRAVRMGYESVAINVDIGKFGKESDIIWSDEEDEVVSKKRKRKKQKKLHDRKSGDGNERTSESEIVPDPFLVDESKLDLSAFAVNGKRFRQFSRLTVSIDADSIHHLQHNKKVKLYDIIAVRVPDEQILMTLQRKGDFVDLVSLDATAMEKGRLSWLFKQKIVQSCIAAGLTFE

SEQ ID NO: 123043 - protein, 192 aa, Heterodera glycines
  Homolog annotation: Hit_ID=NP_497919.1; Match level="QueryCoverage =98%, HitCoverage=82%, E-value=1e-58, Identity=56%"; Hit description =mitochondrial ribosomal protein S34 (26.3 kD) (3F630) [Caenorhabditis elegans] emb|CAA84334.2| Hypothetic
  Gene Ontology: Biological process=growth
  Essential gene: C elegans homolog=M88.2; Phenotype=Lva
  Coding regions on vcDNA: vcDNA=SeqID_49466; Strand=+; Position=47-622
MSLRFFGFHDSVSEGKFLWEILTQLRGLGVGRCVTKSEWMRRWPDQPSYMRIVKARPTMDRWLQEGSLWADWTFRGKHLGVYEFGTDLNRSDWVLIHKHEEKKFTENRQQMGTLNIPSTFPVPPLQQLLSKKWAEKCGGSEAAVHHKKRAPLDVCLDPNFEMYRKFIKRVEPKKMSVSIYDEIDPGVFLDLY

SEQ ID NO: 123044 - protein, 215 aa, Heterodera glycines
  Homolog annotation: Hit_ID=AAF43144.1; Match level="QueryCoverage =98%, HitCoverage=39%, E-value=5e-48, Identity=46%"; Hit description =mRNA capping enzyme [Xenopus laevis] pir||JC7198 capping enzyme 1b xCAP1b - African clawed frog
  Gene Ontology: Mol. function=mRNA guanylyltransferase activity; Cellular component=nucleus; Biological process=mRNA capping
  Essential gene: C elegans homolog=C03D6.3a; Phenotype=Unclassified
  Coding regions on vcDNA: vcDNA=SeqID_49467; Strand=+; Position=1-645
RRHVQDKTRLFCGYGSKVFPGSQPVSLEGPQGNNNIEFLAQEPYMVSWKADGVRYLVLIDGKYQVYAFDRDNNPFLIRSMAFIRRPRQKPLEDDDFVHDTLVDAEMVIDQNEGQQIPRLLIYDLVRFQGEDLRQKPFNVRFEMIENELIRPRTEAFKAGLLKREEEPIGVRRKGFWNIESTRRLLEPGFLSCHEVDGLVFQPVNGGYVSGRCDKL

SEQ ID NO: 123045 - protein, 211 aa, Heterodera glycines
  Homolog annotation: Hit_ID=NP_498091.1; Match level="QueryCoverage =99%, HitCoverage=43%, E-value=9e-71, Identity=60%"; Hit description =wd repeat protein (50.6 kD) (3G243) [Caenorhabditis elegans] gb|AAF60780.2| Hypothetical protein Y54H5A.1
  Gene Ontology: Cellular component=nucleolus; Biological process =embryogenesis and morphogenesis
  Essential gene: C elegans homolog=Y54H5A.1; Phenotype=Emb
  Coding regions on vcDNA: vcDNA=SeqID_49468; Strand=+; Position=3-635
SAEGFALAWSPIRLGTLASGDLHNRIFLWRMSEGGQWLVDQRPLAEHQSSVEDLAWSPTEEALLMSCSADHTLRLWDVRASHKDSCVCTVKEAHNGDVNVISWNSGGEPLIVSGGDDAKLNIWSLKTIQYNQPVAQFQHHQKPISSVEWNPHDGTVFMASGEDDQITLWDLALEDDELHGEVEGGEEKTAPNVPSQLLFIHMGQKEVKEVH

SEQ ID NO: 123046 - protein, 147 aa, Heterodera glycines
  Homolog annotation: Hit_ID=XP_223302.1; Match level="QueryCoverage =95%, HitCoverage=89%, E-value=2e-39, Identity=61%"; Hit description =similar to 60S ribosomal protein L23a [Rattus norvegicus]
  Gene Ontology: Mol. function=structural constituent of ribosome; Cellular component=cytosolic large ribosomal subunit (sensu Eukarya); Biological process=ribosomal large subunit assembly and maintenance
  Essential gene: C elegans homolog=F55D10.2; Phenotype=Gro
  Coding regions on vcDNA: vcDNA=SeqID_49469; Strand=+; Position=2-442
PTSKKTRKAVEKAVDAKKKLAKGQHIVRKTNMRTYVHFFRPRTLKLARSPKSPRISLPKQNKLHSFSIIKHSLTTYFFMKKIEDTNSLVFIVDVRANEHQIKSAVNKLYNIEDQKVNTLVTPDHTKQAYVRLAADYDALDVAKHIGI

SEQ ID NO: 123047 - protein, 110 aa, Heterodera glycines
  Homolog annotation: Hit_ID=NP_503027.1; Match level="QueryCoverage =80%, HitCoverage=68%, E-value=7e-30, Identity=70%"; Hit description =small nuclear ribonucleoprotein, small nuclear ribonucleoprotein SNR- 1 (14.8 kD) (snr-1) [Caenorhabditis
  Gene Ontology: Mol. function=pre-mRNA splicing factor activity; Cellular component=nucleus; Biological process=mRNA splicing
  Essential gene: C elegans homolog=Y116A8C.42; Phenotype=Ste
  Coding regions on vcDNA: vcDNA=SeqID_49470; Strand=+; Position=3-335
KLNEAEDNMNCQMSDVTVTLRDGRTQTLDNVFIRGSQIRFLVLPDMLKNAPMFKNIGRAQRGAQGMGQGGAPRGRGSAFRGGGRGGGRGRGGFGRGGRGGGGGGGMQFQG

SEQ ID NO: 123048 - protein, 141 aa, Heterodera glycines
  Homolog annotation: Hit_ID=AAM00924.1; Match level="QueryCoverage =54%, HitCoverage=20%, E-value=1e-13, Identity=45%"; Hit description =bone morphogenetic protein receptor type IB [Sus scrofa]
  Gene Ontology: Mol. function=transforming growth factor-beta receptor activity; Cellular component=extracellular space; Biological process =TGFbeta receptor signaling pathway
  Essential gene: C elegans homolog=C32D5.2; Phenotype=Sma
  Coding regions on vcDNA: vcDNA=SeqID_49471; Strand=+; Position=63-488
MGGQSEQQHFGELEVKTAEKTSRDGEEGKRRTEDRQQKVQREHRENREQREYREHALPFKGMVGNDPSFEQMRQIVCVQKLRPPMETQWNDGANPIMHSLYVLMTECWSEHSLSRHTALKVKKELGALSEQGGDGRGKETN

SEQ ID NO: 123049 - protein, 216 aa, Heterodera glycines
  Homolog annotation: Hit_ID=NP_974402.1; Match level="QueryCoverage =95%, HitCoverage=32%, E-value=2e-55, Identity=48%"; Hit description =expressed protein [Arabidopsis thaliana]
  Essential gene: C elegans homolog=F38A5.1a; Phenotype=Unclassified
  Coding regions on vcDNA: vcDNA=SeqID_49472; Strand=+; Position=6-653
MNEEQISADDAIVSATSDDKLESFSKEMAGLIISPHDGVKIQPKHKYAIVCGKYAYYHYGQQNVDDIGWGCAYRSFQTVCSWLKFQSYIDATKAIPSHQQIQKCLVDIGDKPSNFVGSKKWIGSLELSFCLETMFGINAKILSSKSGADLAEHARALIYHFENGGAPVMIGGGQLAHTILGVDYNVRLGDCQFLVLDPHYTGTENLSEILNGGWCA

SEQ ID NO: 123050 - protein, 203 aa, Heterodera glycines
  Homolog annotation: Hit_ID=AAS72410.1; Match level="QueryCoverage =86%, HitCoverage=26%, E-value=6e-39, Identity=48%"; Hit description =heat shock transcription factor 1 [Caenorhabditis elegans]
  Gene Ontology: Mol. function=transcription co-repressor activity; Cellular component=cytoplasm; Biological process=regulation of transcription, DNA-dependent
  Essential gene: C elegans homolog=Y53C10A.12; Phenotype =Adl,Pvl,Stp,Unc
  Coding regions on vcDNA: vcDNA=SeqID_49473; Strand=+; Position=18-626
MSYYYQQQLKRQALAKNDRNPSISPENHQQQQFINGDVSANTPNSYVTMTYKPYLLREDGEQKIPLFLIKLWNIVEDPSHWEVIRWDESGLSFHIMKPYVFCSDILPYYFKHKNMNSLVRQLNMYGFRKNTPIERSGLARAESDQDHLEFFHPFFRRDHPELLANIHRKVPNSARQQGHHPLPTPQQQQQQLQFVANVSDVIG

SEQ ID NO: 123051 - protein, 177 aa, Heterodera glycines
  Homolog annotation: Hit_ID=NP_498690.1; Match level="QueryCoverage =81%, HitCoverage=21%, E-value=1e-21, Identity=40%"; Hit description =DEAD/DEAH box helicase and helicase, C-terminal (3I854) [Caenorhabditis elegans] pir||S44912 hypothetical
  Essential gene: C elegans homolog=ZK686.2; Phenotype=Lva
  Coding regions on vcDNA: vcDNA=SeqID_49474; Strand=+; Position=3-533
EWLGFVEKYANVPSVCTLNVSSLTDNSYNNWLQRILVSATLSMDVHSLHKWNLRCPILFQAEKEIKVNQQTENSAEPAVLLPNSLTHKLIVCKQNFKPLLLFREIDLNFDKWNRIIVFVNKKQTSRRLSSLMETLSKKKLTVAEFSADLFKSRRKKLLREFQSGAVRVLIACDVLSR

SEQ ID NO: 123052 - protein, 163 aa, Heterodera glycines
  misc_feature (10)..(10): Xaa can be any naturally occurring amino acid
  Homolog annotation: Hit_ID=A48463; Match level="QueryCoverage=98%, HitCoverage=74%, E-value=8e-81, Identity=88%"; Hit description=Ras -like GTP-binding protein - nematode (Brugia malayi) sp|P38542|RAN _BRUMA GTP-binding nuclear protein Ran (G
  Gene Ontology: Mol. function=ATP binding; Cellular component=cytosol; Biological process=embryogenesis and morphogenesis
  Essential gene: C elegans homolog=K01G5.4; Phenotype=Emb
  Coding regions on vcDNA: vcDNA=SeqID_49475; Strand=-; Position=147-637
IRGGQIRFNXWDTPGQEKFGGLRDGYYIQGQCAIVMFDVTARVTYKNVPNWHRDLVRVCENIPIVLVGNKVDVKDRKVKAKSITFHRKKNLQYYDISAKSNYNFEKPFLYLARKLIGDPNLEFVGMPALAPPEVQMDPALAAKYEQEVAEAASAELPDDDEDI

SEQ ID NO: 123053 - protein, 68 aa, Heterodera glycines
  Homolog annotation: Hit_ID=AAC47233.1; Match level="QueryCoverage =100%, HitCoverage=38%, E-value=4e-11, Identity=50%"; Hit description= cyclophilin Ovcyp-2
  Essential gene: C elegans homolog=Y75B12B.2; Phenotype=Emb
  Coding regions on vcDNA: vcDNA=SeqID_49476; Strand=+; Position=2-205
RPQASVSATGGGSSTGFCRVVMELFNDFVPKTADIFPAVCPVNLGMDNSGNPFLYEGSNFHHVIPSLL

SEQ ID NO: 123054 - protein, 163 aa, Heterodera glycines
  misc_feature (120)..(120): Xaa can be any naturally occurring amino acid
  Homolog annotation: Hit_ID=NP_499553.1; Match level="QueryCoverage =98%, HitCoverage=51%, E-value=2e-33, Identity=41%"; Hit description =yeast CCR4-associated Factor, CAF1 family ribonuclease, CCR4-NOT transcription complex subunit (33.8 kD)
  Gene Ontology: Mol. function=transcription factor activity; Cellular component=CCR4-NOT core complex; Biological process=regulation of transcription, DNA-dependent
  Essential gene: C elegans homolog=Y56A3A.20; Phenotype=Emb
  Coding regions on vcDNA: vcDNA=SeqID_49477; Strand=+; Position=2-490
ALALRNVWAHILDDEFPPLSDLLNYYPFLVMDTEYPCVILSPAGHFCILEDFTSQRLWLDVDCLNLILDSFTLMNEKGQLPPARDFFHFSLHLNTDPDSFAHYSLELILTAGFDFCMHLXDGFLLEDFGELLTTSGLVVEPRITWVTFHSCFDFGYLIRAIML

SEQ ID NO: 123055 - protein, 206 aa, Heterodera glycines
  Homolog annotation: Hit_ID=NP_491371.1; Match level="QueryCoverage =71%, HitCoverage=45%, E-value=3e-43, Identity=59%"; Hit description =CED-3 Protease Suppressor CPS-6, similar to endonuclease G (34.5 kD) (cps-6) [Caenorhabditis elegans] gb|
  Gene Ontology: Mol. function=endonuclease activity; Cellular component=extracellular space; Biological process=DNA fragmentation
  Essential gene: C elegans homolog=C41D11.8; Phenotype=Ced
  Coding regions on vcDNA: vcDNA=SeqID_49478; Strand=+; Position=23-640
MVFNRINPIFLAAGTSSAVAFFIGSQCSTKEWLNLVGIKSAHADSSVVVAPPIPSSAAGPKTPYPLRVNEDDALGADVWLKPSRASEIMRFGYPGFDNIRAYEDFVVSYDQRNRTAHWVMEHLSPARMAYNAEVNRGNSIFKEDESIHPYFRSKNEDYKRSGYDRGHLAAAANHRTTQLAMDQTFLLTNMSPQVGKGFNRDKWNDL

SEQ ID NO: 123056 - protein, 193 aa, Heterodera glycines
  Homolog annotation: Hit_ID=S55899; Match level="QueryCoverage=97%, HitCoverage=57%, E-value=4e-19, Identity=29%"; Hit description =transcription elongation factor EF-TfIIS - fruit fly  (Drosophila melanogaster)
  Gene Ontology: Mol. function=transcription factor activity; Cellular component=nucleus; Biological process=regulation of transcription from Pol II promoter
  Essential gene: C elegans homolog=T24H10.1; Phenotype=Clr
  Coding regions on vcDNA: vcDNA=SeqID_49479; Strand=+; Position=52-630
MNVHEEDIVEISRKLTKMTDGSKSMDDAVELVTALENMRVNIDLLSKTRIGAVLNEFRKKIKDEKLAKRCKALIKRWKSLLDEKLSQRSKSPDDRQRSSQEKSATPPPTANAGTKQSTMNNGQGQQSNRMATTTTAIPSQHHQQTMTMSNNRATAGAGGNDVRGKSVQMLANALTSGGMPQGALDATEVAGRV

SEQ ID NO: 123057 - protein, 203 aa, Heterodera glycines
  Homolog annotation: Hit_ID=CAE74210.1; Match level="QueryCoverage =98%, HitCoverage=54%, E-value=2e-64, Identity=56%"; Hit description =Hypothetical protein CBG21892 [Caenorhabditis briggsae]
  Essential gene: C elegans homolog=F13G3.7; Phenotype=Age
  Coding regions on vcDNA: vcDNA=SeqID_49480; Strand=+; Position=15-623
MLDATDVDSQKLRIIEWQHLDLLKFYPMALATSCAVRGFLYPLNVVKARLQLQKQNNVYSGMRHAFVDIVRNEGMVALFRGFWVTMPQLGVSFIYSTIYEKFRNVLHVNANIQSAPVVSALAGGFSSIFTQIIFVPTDIISQHMMIYNNPAKFLGSAKNVAVLDFLRMDGKSGRLTFGLRIVRAVYHIDGIRGFYRGFFSSQM

SEQ ID NO: 123058 - protein, 75 aa, Heterodera glycines
  Essential gene: C elegans homolog=F23H11.5; Phenotype=Emb,Lva
  Coding regions on vcDNA: vcDNA=SeqID_49481; Strand=+; Position=2-226
VHGHHAVYYGPPITYDYPPIPSQPYKRVYKELKYNFIMHLPMSFVFIMFCCYDGYSTDVLGHSAWKLPGSYRNRK

SEQ ID NO: 123059 - protein, 139 aa, Heterodera glycines
  Homolog annotation: Hit_ID=NP_492469.1; Match level="QueryCoverage =93%, HitCoverage=42%, E-value=3e-13, Identity=36%"; Hit description =i-78 protein like, Anterior PHarynx defective APH-1, Presenilin ENhancer (enhancer of sel-12 null) PEN-1
  Gene Ontology: Biological process=locomotory behavior
  Essential gene: C elegans homolog=VF36H2L.1; Phenotype=Unc
  Coding regions on vcDNA: vcDNA=SeqID_49482; Strand=+; Position=2-418
FFAVSLPPHPLRIILFELGAFFWLCSLLLSAGVITMYRQHLLLVALFFSILFQKVARALFYLLLYNTHSNLARLMAADTYPTGSVSTMRLLYSARLILAIVGGLGMGTAAALYHLANLLAAYRNNGIVGLPGAVTANRI

SEQ ID NO: 123060 - protein, 123 aa, Heterodera glycines
  Homolog annotation: Hit_ID=NP_497499.1; Match level="QueryCoverage =100%, HitCoverage=36%, E-value=9e-22, Identity=43%"; Hit description= receptor protein tyrosine phosphatase LAR family member (40.4 kD) (3D189) [Caenorhabditis elegans] gb|AA
  Gene Ontology: Mol. function=transmembrane receptor protein tyrosine phosphatase activity; Cellular component=integral to plasma membrane; Biological process=cell-cell signaling
  Essential gene: C elegans homolog=C55B7.3; Phenotype=Emb
  Coding regions on vcDNA: vcDNA=SeqID_49483; Strand=+; Position=2-370
LERFINDTTPRSVQDLCSEFTKLNAAPRPEPSPEFTRNLECNRYRDVICTEINRVRLHRGRYIHANWITTFDENRFICTQGPLETTCDDFWTMIVQENIEGIVMLCDTIEQNRIKCHQYWPTV

SEQ ID NO: 123061 - protein, 121 aa, Heterodera glycines
  Homolog annotation: Hit_ID=NP_498395.1; Match level="QueryCoverage =99%, HitCoverage=37%, E-value=6e-42, Identity=68%"; Hit description =RNA binding protein like (37.9 kD) (3H469) [Caenorhabditis elegans] gb|AAB47596.1| Hypothetical protein C
  Gene Ontology: Cellular component=nucleolus; Biological process =embryogenesis and morphogenesis
  Essential gene: C elegans homolog=C16A3.6; Phenotype=Emb
  Coding regions on vcDNA: vcDNA=SeqID_49484; Strand=+; Position=1-363
RASCPLANSQYATVREENGVCFLFMKVAERSHFPGKLWEKVKLHRNLAKAVEQISTHLLHWSEYVRKKCKARLMRHHQCVNRMRKMELRGRTAKVIPLHRKVEGGERRMEEEAVAAAKLEQ

SEQ ID NO: 123062 - protein, 153 aa, Heterodera glycines
  misc_feature (32)..(32): Xaa can be any naturally occurring amino acid
  misc_feature (54)..(54): Xaa can be any naturally occurring amino acid
  Homolog annotation: Hit_ID=NP_492006.1; Match level="QueryCoverage =98%, HitCoverage=26%, E-value=3e-20, Identity=37%"; Hit description =asparagiNyl tRNA Synthetase (61.2 kD) (nrs-1) [Caenorhabditis elegans] emb|CAA95808.1| Hypothetical prote
  Gene Ontology: Mol. function=asparagine-tRNA ligase activity; Cellular component=cytoplasm; Biological process=protein biosynthesis
  Essential gene: C elegans homolog=F22D6.3a; Phenotype=Emb,Lva
  Coding regions on vcDNA: vcDNA=SeqID_49485; Strand=+; Position=2-463
HEAKYLEMCPPPMLQTQDECGSTHFSQNYYGXTNFLSRASQLKLQTSMDSLGHXYCISHPYRNDQTCIRGPLAKYSHLDADYQSLPFSDMKGHCGETTCDRDNKSWPHPTNQHLIHEQRFSESQYDVLPPERPSLRMTDAKAIEWLQNNEVIN

SEQ ID NO: 123063 - protein, 126 aa, Heterodera glycines
  Essential gene: C elegans homolog=R08D7.2; Phenotype =Emb,Gro,Pvl,Rup,Stp
  Coding regions on vcDNA: vcDNA=SeqID_49486; Strand=+; Position=8-385
MMKKTLPINDEMISERIEAERERLQQDKLRKRYAYEAICALTDTVNESELQRHLSVLDPTSWCEVVEERFLGRLCGFPLCAKTITVDFRKKHTIVRRLNESTRKEHKMIVPTESEPVKFCSDRCMG

SEQ ID NO: 123064 - protein, 79 aa, Heterodera glycines
  misc_feature (38)..(38): Xaa can be any naturally occurring amino acid
  misc_feature (54)..(54): Xaa can be any naturally occurring amino acid
  Homolog annotation: Hit_ID=AAC79129.1; Match level="QueryCoverage =92%, HitCoverage=22%, E-value=1e-21, Identity=67%"; Hit description =glyceraldehyde-3-phosphate-dehydrogenase [Globodera rostochiensis] sp|O16027|G3P1_GLORO Glyceraldehyde-3-p
  Gene Ontology: Mol. function=glyceraldehyde 3-phosphate dehydrogenase (phosphorylating) activity; Cellular component=cytoplasm; Biological process=glycolysis
  Essential gene: C elegans homolog=K10B3.7; Phenotype=Unclassified
  Coding regions on vcDNA: vcDNA=SeqID_49487; Strand=+; Position=2-241
LKPNVGINGFGRIGRLALCATIEKDPVPMVDVDYPFFXLDYMEYLINYNSTHGXFYGKISSNAGHLVMEKEGKNALTFY

SEQ ID NO: 123065 - protein, 140 aa, Heterodera glycines
  Homolog annotation: Hit_ID=CAA53231.1; Match level="QueryCoverage =99%, HitCoverage=93%, E-value=2e-47, Identity=65%"; Hit description =ribosomal protein S19 [Ascaris suum]
  Gene Ontology: Mol. function=structural constituent of ribosome; Cellular component=eukaryotic 48S initiation complex; Biological process=hemocyte development
  Essential gene: C elegans homolog=T05F1.3; Phenotype=Emb,Lva
  Coding regions on vcDNA: vcDNA=SeqID_49488; Strand=+; Position=2-421
GKPTSVKDVDQHDIVQSVATFLKKSGKIKLPDWVDLVKLGKNIELAPINPDWYYVRVASLARRLDIRSPAGVSSFRNGYGGKSRRGVAPRHFSKASGAAIPNVLQSLEEIRWADKDRSTGGRKLTKQGRKDLDRIASQLR

SEQ ID NO: 123066 - protein, 113 aa, Heterodera glycines
  Homolog annotation: Hit_ID=NP_496500.1; Match level="QueryCoverage =100%, HitCoverage=28%, E-value=4e-14, Identity=39%"; Hit description= Malate/L-lactate dehydrogenase (42.8 kD) (2M3) [Caenorhabditis elegans] emb|CAA88951.1| Hypothetical pro
  Essential gene: C elegans homolog=F36A2.3; Phenotype=Egl,Unc
  Coding regions on vcDNA: vcDNA=SeqID_49489; Strand=+; Position=2-340
SPDEFVAPVGDVHASVVKCMQKVSTYGEHAAQLPEILLDADIGPHYSHGTNRLCIYIEDVPTGGKGYGEQNAFKKNEATPWVDGCYLLDTDVRNFSTEMAMKSVLRAHNTAGW

SEQ ID NO: 123067 - protein, 210 aa, Heterodera glycines
  Homolog annotation: Hit_ID=NP_498822.1; Match level="QueryCoverage =98%, HitCoverage=30%, E-value=9e-47, Identity=44%"; Hit description =abnormal cell MIGration MIG-10, amyloid beta protein-binding family B member 1 interacting protein like (
  Gene Ontology: Mol. function=SH3/SH2 adaptor protein activity; Cellular component=cytosol; Biological process=EGF receptor signaling pathway
  Essential gene: C elegans homolog=F10E9.6a; Phenotype=Emb
  Coding regions on vcDNA: vcDNA=SeqID_49490; Strand=+; Position=3-632
SCRENLEDWTSESPNKLHFIRQPQKWALFRHPQHFLIADRNRNNEFPPVESIGEWDTEQKQRLLNAFLREDGGTRVPELEGWLMLKADGKKSWRRHFFVLRSSGLYYVPKAGKPRGPARDLNCLMSVFNNQVYMCTDWRKKYKAPTEFGFAIKHPRIQLKTSKYIKYICCDDEFTFRQWLTALRITKNGCPALYKDFRAAQSRERPLVGP

SEQ ID NO: 123068 - protein, 205 aa, Heterodera glycines
  Homolog annotation: Hit_ID=CAE59122.1; Match level="QueryCoverage =94%, HitCoverage=40%, E-value=7e-27, Identity=37%"; Hit description =Hypothetical protein CBG02417 [Caenorhabditis briggsae]
  Gene Ontology: Mol. function=enzyme activator activity; Cellular component=nucleoplasm; Biological process=cyclin catabolism
  Essential gene: C elegans homolog=ZK177.6; Phenotype=Emb
  Coding regions on vcDNA: vcDNA=SeqID_49491; Strand=+; Position=2-616
IAKKLEANENTNNLNTSTSCPTSPASKLEQQTKKQMMRVKSDNAVNSLADFDQVCAFRKGLAPLAKFGHKQQVNVLFSCVQPTSSCVKRSRRYVAKDPERMLDAPDLLDDFYSNLIDWSKTNCVAVGLGSKIFQWNAGTGAVDEIKDFSETHSHPTLVKWSCEGQYLAVGFNDGQLKLLDSATKKVLRTIHTTANMRLACATWTH

SEQ ID NO: 123069 - protein, 140 aa, Heterodera glycines
  Homolog annotation: Hit_ID=CAE66268.1; Match level="QueryCoverage =79%, HitCoverage=14%, E-value=1e-15, Identity=40%"; Hit description =Hypothetical protein CBG11512 [Caenorhabditis briggsae]
  Gene Ontology: Biological process=embryogenesis and morphogenesis
  Essential gene: C elegans homolog=H37A05.1; Phenotype=Emb
  Coding regions on vcDNA: vcDNA=SeqID_49492; Strand=+; Position=2-424
GQPFFAGFGNRETDVKSYLAVQIPPERIMIIDPQGSLRRADNKAGGYVSDYPTLAMDSVDYVFPPRVDMDGIDIRTKEDGILSEFVAWRTDAEQFDALVDAELEQYEERSKRAKAIVAGTTDGRGADGKKKMYRNGRRAK

SEQ ID NO: 123070 - protein, 175 aa, Heterodera glycines
  Homolog annotation: Hit_ID=AAO25691.1; Match level="QueryCoverage =64%, HitCoverage=84%, E-value=1e-13, Identity=37%"; Hit description =ankyrin repeat protein E4_2 [synthetic construct]
  Gene Ontology: Mol. function=structural constituent of cytoskeleton; Cellular component=membrane; Biological process=induction of apoptosis
  Essential gene: C elegans homolog=F35D6.1a; Phenotype=Stp
  Coding regions on vcDNA: vcDNA=SeqID_49493; Strand=+; Position=72-599
MADDVAPPAPSVAVDDFAQRTGQFFDFIRQGNIDRLRALIDSLSVDELNTLLQMRYNEQQFALLVAVMEGHPEIAALLLDKGADVHQTTVGRVNNVTMAVMPLWIAVNMRHLEMCRVLIAHGADVDLGSDSSFTPLLLACAKGSTAIVTLLVESGANVNLGDSEGVTPIMITSRF

SEQ ID NO: 123071 - protein, 213 aa, Heterodera glycines
  Homolog annotation: Hit_ID=NP_501551.2; Match level="QueryCoverage =93%, HitCoverage=41%, E-value=3e-32, Identity=39%"; Hit description =putative nuclear protein of eukaryotic origin (53.7 kD) (4J693) [Caenorhabditis elegans] emb|CAA92294.2|
  Gene Ontology: Mol. function=RNA binding; Cellular component=nucleus; Biological process=mRNA processing
  Essential gene: C elegans homolog=D1046.1; Phenotype=Slu,Stp
  Coding regions on vcDNA: vcDNA=SeqID_49494; Strand=+; Position=2-640
DEALNLNDLDEKEVLGDDEEDQHQNQHTTKEEVEDLYDEAMAPSGALSEKRESAEVISSLPSSIQHKSSFAMPMMIKSEPGIAGGSQSGKRYCCYIGNMTWWTTDDQLQKLIQTLGVDDMIDVKFYENRNNGQSKGFALAVFASEPSVKAVMEKLPSKKLHEQSLAVLPYTKQSLAKLEEATKRYDQKSQKDDKVVNIGTVRIGTNGAPVPQL

SEQ ID NO: 123072 - protein, 106 aa, Heterodera glycines
  misc_feature (15)..(15): Xaa can be any naturally occurring amino acid
  Homolog annotation: Hit_ID=A48449; Match level="QueryCoverage=100%, HitCoverage=28%, E-value=1e-46, Identity=83%"; Hit description=Actin- 1A - nematode (Onchocerca volvulus)
  Gene Ontology: Biological process=reproduction
  Essential gene: C elegans homolog=T04C12.6; Phenotype=Ste
  Coding regions on vcDNA: vcDNA=SeqID_49495; Strand=+; Position=2-322
CDEEVAALLADNGSXMCNAGFPVDDAPRAVFPSIVGRPRHQGVMVRMGHKDSYVGHEAQSNRGILTLNYPIDHCILTHWDDMENIWHHTFYHELRVAPEEQPVLLT

SEQ ID NO: 123073 - protein, 208 aa, Heterodera glycines
  Homolog annotation: Hit_ID=NP_871864.1; Match level="QueryCoverage =90%, HitCoverage=42%, E-value=7e-57, Identity=54%"; Hit description =innexin, putative gap junction protein, OPUs gap junctional protein (inx-19) [Caenorhabditis elegans] gb|
  Essential gene: C elegans homolog=T16H5.1a; Phenotype=Sck,Sma
  Coding regions on vcDNA: vcDNA=SeqID_49496; Strand=+; Position=2-625
RSVIDADERERVVGAVARTFVEMLDLREIQNRPHPYASSLARFNPIRLMNGHLVCSLYLFTKVCYSVNIMLQFALLNAALTSKDHFLFGFQVLSDLYEGKPWTKSGHFPRVTLCDFEVRYLANLNRYTVQCALIINIINEKVFAFFWLWYCLLLCATTCSALFWLSNILLHIARVDYVLKFMQIAEHSEQQRSSGRTPKLSQQKWAMV

SEQ ID NO: 123074 - protein, 217 aa, Heterodera glycines
  Homolog annotation: Hit_ID=NP_990861.1; Match level="QueryCoverage =100%, HitCoverage=60%, E-value=2e-67, Identity=58%"; Hit description= replication factor C/activator 1 subunit [Gallus gallus] sp|P53033|RFC2_CHICK Activator 1 40 kDa subunit
  Gene Ontology: Mol. function=ATP binding; Cellular component=DNA replication factor C complex; Biological process=DNA replication
  Essential gene: C elegans homolog=F58F6.4; Phenotype=Emb,Stp,Unc
  Coding regions on vcDNA: vcDNA=SeqID_49497; Strand=+; Position=3-653
LPENTHKIVILDEADSMTEGAQQALRRIMEVFSSTTRFAFACNQSDKIIEPLQSRCAFIKYGKLTDQQILERLVCVCKKESVQYNAEGLNAILYTAQGDMRQALNNLQCTAAGYGTITKDYVYRVCDEPHPEKMCNIFDCCINGRTQEAFDLIDELCCLGYSVDDLVGVMFKTAKIADIPEILRLEFITEIGKCHALVVQGVATRLQLAGLLARLSQ

SEQ ID NO: 123075 - protein, 208 aa, Heterodera glycines
  Homolog annotation: Hit_ID=CAE63741.1; Match level="QueryCoverage =99%, HitCoverage=25%, E-value=1e-20, Identity=32%"; Hit description =Hypothetical protein CBG08270 [Caenorhabditis briggsae]
  Gene Ontology: Cellular component=mitochondrion
  Essential gene: C elegans homolog=C01B10.1; Phenotype=Rde
  Coding regions on vcDNA: vcDNA=SeqID_49498; Strand=+; Position=1-624
LVVTSVAEEGVNIAACNLIIKYNNVGSERQMIQRRGRARQKHSLSILLALDTGIEQQEFSNMRKEAMMMRCIEDMQEQDEQTLRKSIEEKAFELAELRNDEKMKVESKRAQLMGKRFDLKCACGTVICCSDRVRSVMGTLFVCCDPKVWRRSKHTLTRAPTKEKFYTNCARWECANCGEHWGQIVKFSNVFLPEIRVRAFILERVDEQ

SEQ ID NO: 123076 - protein, 210 aa, Heterodera glycines
  Homolog annotation: Hit_ID=NP_504637.1; Match level="QueryCoverage =100%, HitCoverage=47%, E-value=2e-82, Identity=72%"; Hit description= eukaryotic factor (49.2 kD) (5G915) [Caenorhabditis elegans] gb|AAB66012.1| Hypothetical protein T05H4.6
  Gene Ontology: Biological process=protein biosynthesis
  Essential gene: C elegans homolog=T05H4.6a; Phenotype=Emb,Lva,Unc
  Coding regions on vcDNA: vcDNA=SeqID_49499; Strand=+; Position=3-632
LVLAGSADFKNELAQSDMFDQRLQAKIIKTVDISYGGENGFNQAIDLAADALADVKFIKEKKLISAFFDEISQDTNKAIYGVKETLTALEMGAIETLICWENLDLIRYAFRTTNGEKVVNLKPDEKDRSNFVDPETGTDYEIESSTPLLEWLANNYKRFGAALEIVTDKSQEGAQFVRGFGGLGGVLRYSVDIPQLDELENGVDEIDLSE

SEQ ID NO: 123077 - protein, 89 aa, Heterodera glycines
  misc_feature (72)..(72): Xaa can be any naturally occurring amino acid
  Homolog annotation: Hit_ID=NP_497231.1; Match level="QueryCoverage =95%, HitCoverage=29%, E-value=2e-20, Identity=61%"; Hit description =CAP-binding protein complex interacting 2 like (32.0 kD) (3B271) [Caenorhabditis elegans] gb|AAA64507.1|
  Essential gene: C elegans homolog=C09F5.2; Phenotype=Ste
  Coding regions on vcDNA: vcDNA=SeqID_49500; Strand=+; Position=26-292
TNRDDLARADLKASSRTSTLLAGFSMIDLMELRYHESTPQSPLIMLVEVTYLILCVHLLAQMMTTWQLPYIXGEGWTQDSPQLQLPFYI

SEQ ID NO: 123078 - protein, 137 aa, Heterodera glycines
  Homolog annotation: Hit_ID=AAN46118.1; Match level="QueryCoverage =79%, HitCoverage=19%, E-value=4e-52, Identity=94%"; Hit description =intermediate filament protein HG-IF1 [Heterodera glycines]
  Gene Ontology: Mol. function=structural molecule activity; Cellular component=lamin filament; Biological process=nuclear envelope reassembly
  Essential gene: C elegans homolog=F38B2.1a; Phenotype=Lvl,Unclassified
  Coding regions on vcDNA: vcDNA=SeqID_49501; Strand=+; Position=99-509
ILQLLYSQSVKFLKKFFFLTGRRGANYISGGNGGMSPFGAQVRDSRDREKKELSDLNDRLANYIEKVRFLEAQNRKLKADLDMPQGRRGKDTITIKTMYESEIQTAKKLIEDTGRSKHELEQDVAKLQRDLDEQRRK

SEQ ID NO: 123079 - protein, 187 aa, Heterodera glycines
  misc_feature (56)..(56): Xaa can be any naturally occurring amino acid
  misc_feature (84)..(84): Xaa can be any naturally occurring amino acid
  misc_feature (101)..(101): Xaa can be any naturally occurring amino acid
  Homolog annotation: Hit_ID=AAC79129.1; Match level="QueryCoverage =99%, HitCoverage=57%, E-value=2e-74, Identity=76%"; Hit description =glyceraldehyde-3-phosphate-dehydrogenase [Globodera rostochiensis] sp|O16027|G3P1_GLORO Glyceraldehyde-3-p
  Gene Ontology: Mol. function=glyceraldehyde 3-phosphate dehydrogenase (phosphorylating) activity; Cellular component=cytoplasm; Biological process=glycolysis
  Essential gene: C elegans homolog=K10B3.7; Phenotype=Unclassified
  Coding regions on vcDNA: vcDNA=SeqID_49502; Strand=+; Position=2-562
AKPKVGINSIGRIVRLPLLAAIEKDTVQVVAANDPFIELDYVVYMFNYDSTHGRFXGKISTNTGNLVAEKDGNIAHTIQEPNLXDPGEIRWRESSTEYVIXSTRVFTTIEKASAHLKCRVKKVVISTPSADAPMYVMCLYEDKYDPAHDNVISYASCTTNCLAPLAKVINYELGIIQRLMTTVHGLT

SEQ ID NO: 123080 - protein, 114 aa, Heterodera glycines
  Homolog annotation: Hit_ID=AAC47163.1; Match level="QueryCoverage =90%, HitCoverage=22%, E-value=1e-13, Identity=37%"; Hit description =hormone receptor 3
  Gene Ontology: Mol. function=ligand-dependent nuclear receptor activity; Cellular component=nucleus; Biological process=signal transduction
  Essential gene: C elegans homolog=C01H6.5a; Phenotype=Bmd,Let,Lva,Mlt
  Coding regions on vcDNA: vcDNA=SeqID_49503; Strand=+; Position=87-428
MPSPPPLLQLHHHHQHHHHLQHQQHQQEQHQRALSSESALRLGIMPPGNDPSMAMHQPMRPGSEMRAQIEVIPCKVCGDQSFGGHYRVITCQRLKGFFPRSQNAPGELQCPPQK

SEQ ID NO: 123081 - protein, 196 aa, Heterodera glycines
  Homolog annotation: Hit_ID=AAQ74770.1; Match level="QueryCoverage =86%, HitCoverage=31%, E-value=8e-23, Identity=33%"; Hit description =WD40 repeat protein 26 [Homo sapiens] gb|AAH52301.2| WD repeat domain 26 [Homo sapiens] ref|NP_079436.3| W
  Essential gene: C elegans homolog=Y39H10A.6; Phenotype=Emb,Ste
  Coding regions on vcDNA: vcDNA=SeqID_49504; Strand=+; Position=1-591
RVISPTQVHIHQNIHILQEIVGISSLSWSQDSRYLAVTSTEQANGVGCFIYFVPRGRLVKEYVHYTGDAFTTVAFFKDGSHKLACAGEKGHFHVYDIHRPEDSAKMFEGFRIRCLYACMDGKTVLAADTHNRIRAYDFETMHEQTLIQEASQIITFCVDRKEKYCLVTTKTEGIRLWDLRTNDLVRSFFGSNTTNL

SEQ ID NO: 123082 - protein, 60 aa, Heterodera glycines
  Homolog annotation: Hit_ID=AAA68776.1; Match level="QueryCoverage =98%, HitCoverage=36%, E-value=9e-12, Identity=57%"; Hit description =Inhibitor of cell death protein 1 [Caenorhabditis elegans] ref|NP _495336.1| transcription factor btf3 (17.
  Essential gene: C elegans homolog=C56C10.8; Phenotype=Emb,Gro,Stp,Unc
  Coding regions on vcDNA: vcDNA=SeqID_49505; Strand=+; Position=2-181
NKMKKLQQNAEHAPTGGNGTARRNNKVMHITTAMDDEQLLTNLTKLSQTNIPGIDDVDMI

SEQ ID NO: 123083 - protein, 205 aa, Heterodera glycines
  Homolog annotation: Hit_ID=CAE64300.1; Match level="QueryCoverage =100%, HitCoverage=40%, E-value=1e-32, Identity=40%"; Hit description= Hypothetical protein CBG08976 [Caenorhabditis briggsae]
  Gene Ontology: Mol. function=peptidase activity; Cellular component =mitochondrial inner membrane; Biological process=electron transport
  Essential gene: C elegans homolog=F56D2.1; Phenotype=Emb
  Coding regions on vcDNA: vcDNA=SeqID_49506; Strand=+; Position=2-616
KVVELLADALLNQNFDASKIEEQRAEALDRLHKAEKGDIRGSVLDNLHATAFQGTPLRLSPLGTTKALNSLTKESVSEFADDILKASGMVLTAVGGVDHEKMSDLAEKHFGHLGNSYNREVPPHVASVNNIGHEQIRPKGYRFTAGEFLYRDDHYPLMHGAIAEEGIGRNHLDYIAMLVGNAYVGTWDRSFAASLNAPKSTVQKM

SEQ ID NO: 123084 - protein, 52 aa, Heterodera glycines
  misc_feature (10)..(10): Xaa can be any naturally occurring amino acid
  Homolog annotation: Hit_ID=AAO14563.2; Match level="QueryCoverage =100%, HitCoverage=7%, E-value=2e-09, Identity=65%"; Hit description =Hsp90 [Heterodera glycines]
  Essential gene: C elegans homolog=C47E8.5; Phenotype=Emb,Ste
  Coding regions on vcDNA: vcDNA=SeqID_49507; Strand=+; Position=2-157
AHDKSRNQAXTDPAQRERGKERSNKSAPNKADKTLTNNDTGTGKTKADPANN

SEQ ID NO: 123085 - protein, 195 aa, Heterodera glycines
  Homolog annotation: Hit_ID=CAE72836.1; Match level="QueryCoverage =94%, HitCoverage=23%, E-value=5e-26, Identity=37%"; Hit description =Hypothetical protein CBG20126 [Caenorhabditis briggsae]
  Gene Ontology: Mol. function=transcriptional repressor activity; Cellular component=nucleus; Biological process=gametogenesis
  Essential gene: C elegans homolog=Y111B2A.11; Phenotype=Lva,Unc
  Coding regions on vcDNA: vcDNA=SeqID_49508; Strand=+; Position=1-585
QKATSAGDTVENHVIPTPQVSTISDDDYNGIYQDRQLPKGKRLITFDDHVSFFLLQGSYNADSEDEEWMSINRNVNIDDFEHIIERLENASRTDIIHLRNARALLQRFDPGLVDDVYDYWLQKRKLAASRKSKCTALIPILCTEQRRDEKTLVNPYIAFRRRLDKVQTRKKLKTDVLTYEKMLQLNLALKRSIVL

SEQ ID NO: 123086 - protein, 162 aa, Heterodera glycines
  Homolog annotation: Hit_ID=CAE71361.1; Match level="QueryCoverage =96%, HitCoverage=31%, E-value=2e-62, Identity=74%"; Hit description =Hypothetical protein CBG18265 [Caenorhabditis briggsae]
  Gene Ontology: Mol. function=UTP-glucose-1-phosphate uridylyltransferase activity; Biological process=embryogenesis and morphogenesis
  Essential gene: C elegans homolog=K08E3.5a; Phenotype=Emb
  Coding regions on vcDNA: vcDNA=SeqID_49509; Strand=+; Position=1-580
GNFYESLINSGLLDNFLSEGKKHVFLSNIDNLGATVDPNILNYMVARKAEFIMEVTDKTRADVKGGTLIEYEGKLMLLEIAQVPPDYVDEFKSISKFRIFNTNNLWAELEAIKRVVLNKELNMEVIVNPKHLDRGANVIQLETAAGAACKCFRGACGKIHSY

SEQ ID NO: 123087 - protein, 202 aa, Heterodera glycines
  misc_feature (124)..(124): Xaa can be any naturally occurring amino acid
  Homolog annotation: Hit_ID=CAA65506.1; Match level="QueryCoverage =80%, HitCoverage=92%, E-value=4e-41, Identity=46%"; Hit description =cuticular collagen [Teladorsagia circumcincta]
  Gene Ontology: Mol. function=structural constituent of cuticle; Cellular component=extracellular; Biological process=cuticle biosynthesis (sensu Nematoda)
  Essential gene: C elegans homolog=T07H6.3a; Phenotype=Bmd,Gro,Unc
  Coding regions on vcDNA: vcDNA=SeqID_49510; Strand=+; Position=2-608
FFGVCLSTVATVIAVLSVPFAYQHFQQIGAQMQNEVDFCKMRSGNMWREVTRTQAYSKVSHDSRHKRQAGGCCGCGVSPPGPPGPPGPSGQPGQPGQSAPPASPGRPGPQGPPGPDGQPGNPGXSGQPGPARETHPGTAPSVDQRGPIENPWGSLGRTWEKGHIPARSGEKPRAAREYSERNDREDPQHKEQVDFEQETIVK

SEQ ID NO: 123088 - protein, 175 aa, Heterodera glycines
  Homolog annotation: Hit_ID=CAE67177.1; Match level="QueryCoverage =98%, HitCoverage=20%, E-value=6e-55, Identity=63%"; Hit description =Hypothetical protein CBG12609 [Caenorhabditis briggsae]
  Gene Ontology: Biological process=chromosome segregation
  Essential gene: C elegans homolog=ZC308.1a; Phenotype=Emb
  Coding regions on vcDNA: vcDNA=SeqID_49511; Strand=+; Position=2-526
ANLILAKVSILRIKFIGTFHHMTDDLNVNNSVAIRNTHLMWYYSSFDWRVRPLVMEVKERAKRHGINDSGCSSFTSHSLELMGIHYLQCGAQAPVLPNLQEMYPKRFNVRADVRTLNESLPLKPIPSEMGWDVKDDATLNELLLGFLRYYAFQFDFDADAISIPMGKKGNRAHVA

SEQ ID NO: 123089 - protein, 180 aa, Heterodera glycines
  Homolog annotation: Hit_ID=NP_491206.1; Match level="QueryCoverage =86%, HitCoverage=11%, E-value=1e-40, Identity=50%"; Hit description =abnormal cell LINeage LIN-59, similar to mouse chromatin remodeling factor and Drosophila absent/ small/
  Gene Ontology: Mol. function=histone methyltransferase activity; Cellular component=tight junction; Biological process=cell-cell signaling
  Essential gene: C elegans homolog=T12F5.4; Phenotype=Stp,Unc
  Coding regions on vcDNA: vcDNA=SeqID_49512; Strand=+; Position=23-562
MGMTPVGSEGTNPTGNNGTQPFRFHRRDLRVFRIERLFCSPNGHRFIFGYYYARPHETFCDSSRTFYRNELFWTPLFDTLPLDSVDERCLVLEPQIWAMGRPKSPRYLEDDVFVCEYQIDRNQRSFEKIPPKNRYYINTEPFVFNFFEKKLTMKRDFTPFKITASSTRKQTSSSSTASRD

SEQ ID NO: 123090 - protein, 206 aa, Heterodera glycines
  Homolog annotation: Hit_ID=AAH60429.1; Match level="QueryCoverage =94%, HitCoverage=59%, E-value=1e-47, Identity=46%"; Hit description =MGC68713 protein [Xenopus laevis]
  Gene Ontology: Mol. function=protein binding; Cellular component =nucleosome; Biological process=signal transduction
  Essential gene: C elegans homolog=C10H11.8; Phenotype=Gro
  Coding regions on vcDNA: vcDNA=SeqID_49513; Strand=+; Position=1-618
PRAEFGTRDIFTMGMTRPMLVSAAMDATIRIWDVASQKQLEALPYKESQVNNICITPDGAQLLVGAWQNIRFYDLQCPTAQGLHTFSVHEKNVTSVGFQVDGAWMYTGGEDCMAKIWDMRNNQLNCQRIFQVNTPVHSVVLHPNQVELIVADSTGAIYLWDLRSDRDDSLITEVDMSEFVVHVDIDQVGRQCAAVTNRGNLFLWDV

SEQ ID NO: 123091 - protein, 127 aa, Heterodera glycines
  Homolog annotation: Hit_ID=NP_491997.1; Match level="QueryCoverage =74%, HitCoverage=50%, E-value=1e-41, Identity=71%"; Hit description =SEx Muscle abnormal SEM-4, zinc-finger transcription factor, controls neuronal and mesodermal cell develo
  Gene Ontology: Mol. function=transcription factor activity; Cellular component=nucleus; Biological process=organogenesis
  Essential gene: C elegans homolog=F15C11.1; Phenotype=Egl
  Coding regions on vcDNA: vcDNA=SeqID_49514; Strand=+; Position=261-641
MPNFDMKPNCASPQTTQQNEEDDWEAMMEISNTDEQEKIRELAGENALPTTDPNQCIICRRVLSCKSALQMHYRTHTGERPFKCRICQRAFTTKGNLKTHMGVHRSKAPLRHQMHHLLNNGMPKAEN

SEQ ID NO: 123092 - protein, 166 aa, Heterodera glycines
  misc_feature (84)..(84): Xaa can be any naturally occurring amino acid
  misc_feature (134)..(134): Xaa can be any naturally occurring amino acid
  Homolog annotation: Hit_ID=CAD60932.1; Match level="QueryCoverage =98%, HitCoverage=43%, E-value=4e-55, Identity=68%"; Hit description =beta actin [Dicentrarchus labrax]
  Gene Ontology: Biological process=embryogenesis and morphogenesis
  Essential gene: C elegans homolog=T04C12.6; Phenotype=Ste
  Coding regions on vcDNA: vcDNA=SeqID_49515; Strand=+; Position=2-499
CREEEIAALVVDDGFGMCNAGLAGDDAPRAGLPPIVGRPRLQGDVSGMGHKDSYVGDNAQPKRAIVTLNYPIGHGIDTIWDHMXNIWHHAFYNELPVVPEEDPVLLTDAPLNTTANIEETTQIMVKTVNTPAMXWLNHAGLSLGVPGHTDGRVVDSGDGVNDTVLI

SEQ ID NO: 123093 - protein, 204 aa, Heterodera glycines
  Homolog annotation: Hit_ID=NP_498735.1; Match level="QueryCoverage =99%, HitCoverage=48%, E-value=8e-23, Identity=31%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
  Coding regions on vcDNA: vcDNA=SeqID_49516; Strand=-; Position=24-638
VSLMDGLALDIARKLEVKPVRYAVRKTMMKSMFISQGRYEFTANMFMDQIPRRVTMGLVANTDYVGTILRSPFNFQPFNVREISILANGRSYPQAPYDLDYRNGKYVRPFNDMNEAVGFANSSESNGITFAQYGKTHCIYVFNLTNSGDDQAALFDLIKNGTTAVSIKFNQPVPVGGIMLVVMGECDSLVMLDKNRSISSDTTI

SEQ ID NO: 123094 - protein, 218 aa, Heterodera glycines
  Homolog annotation: Hit_ID=XP_414775.1; Match level="QueryCoverage =99%, HitCoverage=14%, E-value=9e-42, Identity=41%"; Hit description =PREDICTED: similar to Eukaryotic translation initiation factor 3 subunit 9 (eIF-3 eta) (eIF3 p116) (eIF3
  Gene Ontology: Mol. function=translation initiation factor activity; Cellular component=eukaryotic 48S initiation complex; Biological process=translational initiation
  Essential gene: C elegans homolog=Y54E2A.11a; Phenotype=Lva,Ste
  Coding regions on vcDNA: vcDNA=SeqID_49517; Strand=+; Position=2-655
FNIPIISSDRLPKLRNVLAGVFSIQNTYKYNDNYPLDGEGNTKGFCFLEYQTKEAANAVLAICDGHRLDKNHTFSAYPFTAIRSMKEPEKDWKKPERQPYVDLGDPWSWLQNPKCLDQFGLLYESGQGGTLRLDVFWNVRNGEPTPVDNASRENWSNDLFKWSPHGTYLATMNNDKRNQRLGAVIWGGEKFDRFQRFSHEGVNYLDFSPNEKFLVTYA

SEQ ID NO: 123095 - protein, 162 aa, Heterodera glycines
  misc_feature (77)..(77): Xaa can be any naturally occurring amino acid
  Homolog annotation: Hit_ID=NP_500944.1; Match level="QueryCoverage =100%, HitCoverage=48%, E-value=4e-15, Identity=31%"; Hit description= putative cytoplasmic protein family member (4H15) [Caenorhabditis elegans] gb|AAC48087.1| Hypothetical p
  Essential gene: C elegans homolog=F19G12.2; Phenotype=Unclassified
  Coding regions on vcDNA: vcDNA=SeqID_49518; Strand=+; Position=1-488
IGLVSNQNYIGHNQKNPFYFNHHNVSGKWQLLVNQIIQVRDIELTASGRTYPQYPYNLDYKNNRYARAYHDAQEHLXHGVQTESNGISYSMFKTAYCLYVFQMTNAQEDSPGFELIKEGCTAVNIRFTEAVPNEGVTLIAYGEADGLILIDRNRSITSDLTV

SEQ ID NO: 123096 - protein, 153 aa, Heterodera glycines
  Homolog annotation: Hit_ID=NP_508033.2; Match level="QueryCoverage =98%, HitCoverage=3%, E-value=4e-27, Identity=45%"; Hit description =putative protein, with at least 9 transmembrane domains, 2 coiled coil-4 domains, of bilaterial origin (5V
  Essential gene: C elegans homolog=F25C8.3a; Phenotype=Slu
  Coding regions on vcDNA: vcDNA=SeqID_49519; Strand=+; Position=112-570
ISCSTICAFAPESRRAHQMLLCMQSMLPHLVRHMEEETNQRQQQAANALAALKLELSAYATLSVELRALVNSCDVLARGPTRSFDLAASGGGGGTAGGASLAPSSANRPHATDPRRGRSLGGGGADSPQFFDPPTIVEDEMSRQQQSTASAKT

SEQ ID NO: 123097 - protein, 192 aa, Heterodera glycines
  misc_feature (44)..(44): Xaa can be any naturally occurring amino acid
  misc_feature (130)..(130): Xaa can be any naturally occurring amino acid
  Homolog annotation: Hit_ID=CAE64130.1; Match level="QueryCoverage =100%, HitCoverage=20%, E-value=6e-48, Identity=49%"; Hit description= Hypothetical protein CBG08746 [Caenorhabditis briggsae]
  Gene Ontology: Mol. function=transporter activity; Cellular component= membrane; Biological process=vitamin B12 transport
  Essential gene: C elegans homolog=C15A11.3; Phenotype=Unclassified
  Coding regions on vcDNA: vcDNA=SeqID_49520; Strand=+; Position=3-580
SNLAARYCGTVAPNVQISLHNLMVLVFHSRVGRSTDRDFRSRRXFEFISEAPFLPGSPLPGGPKGCAFLIEPNGANDGTGVILSPTYPGVYPINLQCLFLLRGLDHQRIRLFFRNFDVYFGGKHCPYDSXTIYDGASTSDPIIRKLCGLQQRLELFSFGHELLLEFNTTEVEGKVGDRGFHIEYQFSDKFVD

SEQ ID NO: 123098 - protein, 147 aa, Heterodera glycines
  misc_feature (101)..(101): Xaa can be any naturally occurring amino acid
  Homolog annotation: Hit_ID=CAE63921.1; Match level="QueryCoverage =100%, HitCoverage=33%, E-value=9e-17, Identity=34%"; Hit description= Hypothetical protein CBG08493 [Caenorhabditis briggsae]
  Essential gene: C elegans homolog=Y48G8AL.5; Phenotype=Ste
  Coding regions on vcDNA: vcDNA=SeqID_49521; Strand=+; Position=41-481
MPSTLHVQRSLPERDCRVNFLEQHFCKQIASIAATSDSDRDGIHRAKSVPFVPYAYQTRMPRSMVRRHPILDEYHELLVNDTELENLTIHDTSILDAPLLXDDRPHRQVLDACAVPGGKTMQIIELMHEHCRYPKCLALGNDSHYKQ

SEQ ID NO: 123099 - protein, 84 aa, Heterodera glycines
  misc_feature (2)..(2): Xaa can be any naturally occurring amino acid
  misc_feature (9)..(9): Xaa can be any naturally occurring amino acid
  misc_feature (11)..(11): Xaa can be any naturally occurring amino acid
  misc_feature (17)..(17): Xaa can be any naturally occurring amino acid
  misc_feature (36)..(36): Xaa can be any naturally occurring amino acid
  misc_feature (38)..(38): Xaa can be any naturally occurring amino acid
  misc_feature (50)..(50): Xaa can be any naturally occurring amino acid
  misc_feature (59)..(60): Xaa can be any naturally occurring amino acid
  Homolog annotation: Hit_ID=S43306; Match level="QueryCoverage=96%, HitCoverage=84%, E-value=2e-11, Identity=49%"; Hit description =polyubiquitin 6 - Geodia cydonium
  Essential gene: C elegans homolog=F25B5.4a; Phenotype=Emb
  Coding regions on vcDNA: vcDNA=SeqID_49522; Strand=+; Position=2-253
IXPGKRRTXEXEASDTXEKAKAKREDKEGRQPEQKXRXGAGKEREEGRNXADNNRQKEXXKQPGQGKGGFLKIFERTLSGKMIT

SEQ ID NO: 123100 - protein, 128 aa, Heterodera glycines
  Homolog annotation: Hit_ID=AAL40718.1; Match level="QueryCoverage =100%, HitCoverage=73%, E-value=6e-21, Identity=42%"; Hit description= myosin regulatory light chain [Meloidogyne incognita]
  Essential gene: C elegans homolog=C36E6.3; Phenotype=Gro,Unc
  Coding regions on vcDNA: vcDNA=SeqID_49523; Strand=+; Position=2-385
MDLDEHSEIRNQDLKGLNATLANVAMDSPVDNLLEEDPGTLDDADFHTLLAQQLCGPDPDATYIEAYTVPDKSDCERIAEKMFEVVLHTRRRDPLTVDELKRMFKRDPLINAGNADYDGFARFISTGA

SEQ ID NO: 123101 - protein, 166 aa, Heterodera glycines
  Homolog annotation: Hit_ID=CAG08501.1; Match level="QueryCoverage =63%, HitCoverage=11%, E-value=2e-17, Identity=41%"; Hit description =unnamed protein product [Tetraodon nigroviridis]
  Gene Ontology: Mol. function=RNA binding; Cellular component =nucleolus; Biological process=nucleobase, nucleoside, nucleotide and nucleic acid metabolism
  Essential gene: C elegans homolog=B0035.12; Phenotype=Emb,Gro,Unc
  Coding regions on vcDNA: vcDNA=SeqID_49524; Strand=+; Position=143-640
MNTTSSIPMGPVLPCIGQNNKKYEVMKKKKEKNDEKMTLETNKMAGEKRKRPPSLSEKSFPYNAGLERNKLFVKKLDWSCTGEELKKFFEKFGTVVDARIVTKWDGRSKGCAYVDFADEQSASAALMGADGTEIRGRKISIFLSNPPTKRMKKNSDESDKLKLGAQ

SEQ ID NO: 123102 - protein, 122 aa, Heterodera glycines
  misc_feature (17)..(17): Xaa can be any naturally occurring amino acid
  Homolog annotation: Hit_ID=CAA28192.1; Match level="QueryCoverage =100%, HitCoverage=32%, E-value=2e-27, Identity=51%"; Hit description= actin A3 [Bombyx mori]
  Gene Ontology: Biological process=reproduction
  Essential gene: C elegans homolog=T04C12.6; Phenotype=Ste
  Coding regions on vcDNA: vcDNA=SeqID_49525; Strand=+; Position=2-367
CAQEDAALWVDNGAGMXIDLFSCDEAPHSALPTNAGRPLYQGLMGGMGQKDSGMRDKAHPKHGILTLNHPIEDGLVTTCHYLENIWYPTVYDQLRVTLEEHRLLFANVPLIPNAHRDKRMRI

SEQ ID NO: 123103 - protein, 45 aa, Heterodera glycines
  Homolog annotation: Hit_ID=AAH12854.1; Match level="QueryCoverage =88%, HitCoverage=11%, E-value=1e-10, Identity=70%"; Hit description =ACTB protein [Homo sapiens]
  Gene Ontology: Mol. function=structural constituent of cytoskeleton; Cellular component=cytoskeleton; Biological process=actin cytoskeleton organization and biogenesis
  Essential gene: C elegans homolog=T04C12.6; Phenotype=Ste
  Coding regions on vcDNA: vcDNA=SeqID_49526; Strand=+; Position=2-136
GKKRGEMEKIWHGTMYNELRGTPEKNPVVITQVPLNPKANIEKMT

SEQ ID NO: 123104 - protein, 122 aa, Heterodera glycines
  Homolog annotation: Hit_ID=NP_496376.1; Match level="QueryCoverage =100%, HitCoverage=25%, E-value=8e-53, Identity=78%"; Hit description= NADH ubiquinone oxidoreductase (52.5 kD) (nuo-1) [Caenorhabditis elegans] emb|CAA90435.1| Hypothetical p
  Gene Ontology: Mol. function=NADH dehydrogenase (ubiquinone) activity; Cellular component=mitochondrion; Biological process =energy pathways
  Essential gene: C elegans homolog=C09H10.3; Phenotype=Emb,Lva
  Coding regions on vcDNA: vcDNA=SeqID_49527; Strand=+; Position=2-367
SDATKKAEKISFGNLNDSDRIFTNLYGRYDYRLKGALARGDWFKTKEIILIFFKWILGEISTSGLRGRGGAGFPSGKKWGFMGKPFDGRPKYLGVNGNEGESGTCKDREMMRREPHKMIEGC

SEQ ID NO: 123105 - protein, 159 aa, Heterodera glycines
  misc_feature (60)..(60): Xaa can be any naturally occurring amino acid
  Homolog annotation: Hit_ID=NP_741323.1; Match level="QueryCoverage =94%, HitCoverage=97%, E-value=3e-39, Identity=53%"; Hit description =CCHC type  zinc finger containing protein (15.6 kD) (4C475) [Caenorhabditis elegans] gb|AAK84542.1| Hypot
  Gene Ontology: Mol. function=RNA helicase activity; Cellular component=cytoplasm; Biological process=post-embryonic development
  Essential gene: C elegans homolog=K08D12.3a; Phenotype=Unc
  Coding regions on vcDNA: vcDNA=SeqID_49528; Strand=+; Position=3-483
GHIGRDCPNSGGGGRGGGGDSVCYNCNEPGHFSRECPQGRGGGGGGSRGGGGDIVCYNCXESGHFSRDCTQPRGGGGGGSRGGGGDSVCFNCNKPGHFSRECPNGRSGGGGGRGSRGGGGGSVCYNCNKPGHFSRECPEELVSGEGEEEKAMALVELFC

SEQ ID NO: 123106 - protein, 178 aa, Heterodera glycines
  Essential gene: C elegans homolog=E01A2.6; Phenotype=Emb
  Coding regions on vcDNA: vcDNA=SeqID_49529; Strand=+; Position=112-645
MTCGLAVKRPLDLGQDGSLVDVKRPRHGGASPQCSPFRPQLGILATSLMQSVPPKVPSPPAFTGTASAGVGPIGNPSSPFADVSGRCRLSSTQLDSYLRAEIQALKRRRLIPRRQGNFPEEGFPLSTTNVVVNANKGTATAVAAPTGGIVGTPVSSTSGNAFRKATSPSSSNSSDSEG

SEQ ID NO: 123107 - protein, 208 aa, Heterodera glycines
  Homolog annotation: Hit_ID=NP_495222.2; Match level="QueryCoverage =98%, HitCoverage=42%, E-value=3e-39, Identity=40%"; Hit description =trp-asp repeats containing protein (51.3 kD) (2G389) [Caenorhabditis elegans] gb|AAC46713.4| Hypothetical
  Essential gene: C elegans homolog=F21H12.1; Phenotype=Emb
  Coding regions on vcDNA: vcDNA=SeqID_49530; Strand=+; Position=28-651
MMNGDFLGKNFALAYPEERECCLDSNGAAATCCKFNRFGTLIAVGSTDGRLFIYDFITKSAVKTWNAHVKPVVSLCWSRNGKRLLSSGVDGSVKVWTVLDTAQPVHHFQFGIGCTAQQALFNPRNDNQLLVYLVLVSANSCSSPIVKSLEDGTEARLQLNHGNIPEESVSAAAYDRRGEYIITGSNRGLIVVYCARTLKPVSYCRQNT

SEQ ID NO: 123108 - protein, 59 aa, Heterodera glycines
  Homolog annotation: Hit_ID=XP_213040.2; Match level="QueryCoverage =100%, HitCoverage=36%, E-value=1e-11, Identity=55%"; Hit description= similar to 60S ribosomal protein L21 [Rattus norvegicus]
  Essential gene: C elegans homolog=C14B9.7; Phenotype=Emb
  Coding regions on vcDNA: vcDNA=SeqID_49531; Strand=+; Position=2-178
SNGYRPGTRYMFLRPFGKDRVYPLSTFYRVNNRCDIVTMDGNGTFTIGMPFKVYHGKTG

SEQ ID NO: 123109 - protein, 99 aa, Heterodera glycines
  misc_feature (71)..(71): Xaa can be any naturally occurring amino acid
  Homolog annotation: Hit_ID=NP_492678.1; Match level="QueryCoverage =92%, HitCoverage=29%, E-value=2e-12, Identity=40%"; Hit description =fatty acid hydroxylase (36.3 kD) (1K755) [Caenorhabditis elegans] emb|CAB02759.1| Hypothetical protein C2
  Gene Ontology: Biological process=positive regulation of body size
  Essential gene: C elegans homolog=C25A1.5; Phenotype=Sck,Sma
  Coding regions on vcDNA: vcDNA=SeqID_49532; Strand=+; Position=2-298
GANKDSSIDSASELLGLMHITSTAAYGILARSSLDQQSNTDPLDDSKAPMLSRVGELREHYCTWIHQHYYXLLPLFQTHLLEQMTPTEWRLIPLICLPI

SEQ ID NO: 123110 - protein, 172 aa, Heterodera glycines
  Homolog annotation: Hit_ID=CAE65708.1; Match level="QueryCoverage =94%, HitCoverage=51%, E-value=4e-21, Identity=39%"; Hit description =Hypothetical protein CBG10785 [Caenorhabditis briggsae]
  Gene Ontology: Mol. function=ATP binding; Cellular component=nucleus; Biological process=organogenesis
  Essential gene: C elegans homolog=F15C11.1; Phenotype=Egl
  Coding regions on vcDNA: vcDNA=SeqID_49533; Strand=+; Position=1-519
SALVIHSRTHTGDRPFKCEECGRAFTTRGNLKVHMGTHSAPQNPSRRGRRIFDMEEVLLPAFRSISSSAHHLRDSPSDPSPHLSPESPDASCAPAFLATDPSALAAQIAMFGPQLFLQQLLLQWGAQLAPGASTAEEAAQFSAENAGGVTEDAAESPAEDARETVARMTTAA

SEQ ID NO: 123111 - protein, 86 aa, Heterodera glycines
  misc_feature (8)..(8): Xaa can be any naturally occurring amino acid
  misc_feature (67)..(67): Xaa can be any naturally occurring amino acid
  Homolog annotation: Hit_ID=NP_594438.1; Match level="QueryCoverage =94%, HitCoverage=72%, E-value=1e-21, Identity=56%"; Hit description =60S ribosomal protein L34 [Schizosaccharomyces pombe] emb|CAA16982.1| SPAC23A1.08c [Schizosaccharomyces p
  Gene Ontology: Mol. function=structural constituent of ribosome; Cellular component=cytosolic large ribosomal subunit (sensu Eukarya); Biological process=protein biosynthesis
  Essential gene: C elegans homolog=C42C1.14; Phenotype=Lva
  Coding regions on vcDNA: vcDNA=SeqID_49534; Strand=+; Position=20-281
MPERLTYXRPLCYNTKSNKTKVVKTPGGRNVFHYRNKLGSIPKCGDTGVPLKGIKAVRSRQLAKMTXRKKTVSCAYGGCLSGARCP

SEQ ID NO: 123112 - protein, 180 aa, Heterodera glycines
  Homolog annotation: Hit_ID=CAE58442.1; Match level="QueryCoverage =96%, HitCoverage=9%, E-value=3e-18, Identity=34%"; Hit description =Hypothetical protein CBG01578 [Caenorhabditis briggsae]
  Essential gene: C elegans homolog=C04F6.1; Phenotype=Emb,Gro
  Coding regions on vcDNA: vcDNA=SeqID_49535; Strand=+; Position=3-542
QFSLKSRAQCIVDGRNVDTFDGFAFTAPLSSNCFSVLAKHCSSPMEEQHQQQPQFVVMLKKVPGKQNANKSAQKADKVLKVITAEQQIECQPKTAQGKKGQMICKVNGQPISGDEQCQDELQHQQCVQFNDPRQTDVTIRTGPIAVRFNGRKAWLKVSQAYKNAQCGLCGHYDDADEQEQ

SEQ ID NO: 123113 - protein, 136 aa, Heterodera glycines
  misc_feature (61)..(61): Xaa can be any naturally occurring amino acid
  misc_feature (82)..(82): Xaa can be any naturally occurring amino acid
  misc_feature (113)..(113): Xaa can be any naturally occurring amino acid
  Homolog annotation: Hit_ID=NP_492767.1; Match level="QueryCoverage =99%, HitCoverage=75%, E-value=4e-19, Identity=38%"; Hit description =translationally controlled tumor protein homolog like (20.5 kD) (1L147) [Caenorhabditis elegans] emb|CAB0
  Essential gene: C elegans homolog=F25H2.11; Phenotype=Gro,Stp,Unc
  Coding regions on vcDNA: vcDNA=SeqID_49536; Strand=+; Position=2-409
NGANPSAEELVDGTEQAVEPAIDFVLNPLLHEMNCFQNLPTFLGYLQDFCDNIIAHVDKEXHQLTNVLPSLIRSPGWRCLIXLSTHRFLNLAFFIGDNLADVEGERHACIVEXRPVNGEERTTMMLMEDELFVDKC

SEQ ID NO: 123114 - protein, 135 aa, Heterodera glycines
  Homolog annotation: Hit_ID=CAE58579.1; Match level="QueryCoverage =98%, HitCoverage=73%, E-value=6e-42, Identity=58%"; Hit description =Hypothetical protein CBG01745 [Caenorhabditis briggsae]
  Gene Ontology: Mol. function=structural constituent of ribosome; Cellular component=cytosolic large ribosomal subunit (sensu Eukarya); Biological process=reproduction
  Essential gene: C elegans homolog=E04A4.8; Phenotype=Emb,Gro
  Coding regions on vcDNA: vcDNA=SeqID_49537; Strand=+; Position=2-406
SGKTLRKHLDVGRKLPTDNDPNPTLHEKMICASNHLDAKARFWYFTTVLHPVKKTHGEIISCQEAFHKKPGSVKNFGIWLHYNARTGHHNMYRQYRDDCEAGADTQCYHDMGARHRALADRIPIVIVQTIDAADC

SEQ ID NO: 123115 - protein, 108 aa, Heterodera glycines
  Homolog annotation: Hit_ID=NP_495707.1; Match level="QueryCoverage =100%, HitCoverage=50%, E-value=2e-39, Identity=71%"; Hit description= ribosomal Protein, Large subunit (24.7 kD) (rpl-10) [Caenorhabditis elegans] emb|CAA88308.1| Hypothetica
  Gene Ontology: Mol. function=structural constituent of ribosome; Cellular component=cytosolic large ribosomal subunit (sensu Eukarya); Biological process=protein biosynthesis
  Essential gene: C elegans homolog=F10B5.1; Phenotype=Lva,Ste
  Coding regions on vcDNA: vcDNA=SeqID_49538; Strand=+; Position=292-615
RIRDHPFHVTFVLQMLSCAGADRLQTGMRGAFGKPQGLVARVGIGDMLMSVRVRDQHQAHALEAFRQAKFKFPGRQYIVISRKWGFTPFDREVYEKHRKEGRVIPDGV

SEQ ID NO: 123116 - protein, 191 aa, Heterodera glycines
  misc_feature (4)..(4): Xaa can be any naturally occurring amino acid
  Homolog annotation: Hit_ID=AAV34822.1; Match level="QueryCoverage =98%, HitCoverage=95%, E-value=2e-86, Identity=85%"; Hit description =ribosomal protein L11 [Bombyx mori]
  Gene Ontology: Mol. function=structural constituent of ribosome; Cellular component=cytosolic ribosome (sensu Eukarya); Biological process=protein biosynthesis
  Essential gene: C elegans homolog=T22F3.4; Phenotype=Emb,Gro,Pvl,Stp
  Coding regions on vcDNA: vcDNA=SeqID_49539; Strand=+; Position=7-582
KCPXGKNDAPEKGSGKPDKSKNIMRIVRIRKLCLNICVGESGDRLTRAAKVLEQLTGQPPVFSKARYTVRSFGIRRNEKIAVHCTVRGPKAEEILERGLKVREYELRKDNFSDTGNFGFGIQEHIDLGIKYDPSIGIYGLDFFTVLGRPGFNVSQRKRKKAKVGAPHRLTKEDAMKWFQQKYDGIILPSKK

SEQ ID NO: 123117 - protein, 51 aa, Heterodera glycines
  Homolog annotation: Hit_ID=NP_500630.1; Match level="QueryCoverage =100%, HitCoverage=28%, E-value=3e-16, Identity=76%"; Hit description= ribosomal Protein, Large subunit (21.0 kD) (rpl-20Co) [Caenorhabditis elegans] gb|AAB92041.2| Ribosomal
  Gene Ontology: Mol. function=structural constituent of ribosome; Cellular component=cytosolic large ribosomal subunit (sensu Eukarya); Biological process=reproduction
  Essential gene: C elegans homolog=E04A4.8; Phenotype=Emb,Gro
  Coding regions on vcDNA: vcDNA=SeqID_49540; Strand=+; Position=2-157
NCGMWLRYDSRTGHHDMYREYHDVCEAGAVTQRYRDMGAHHRAQADRILIV

SEQ ID NO: 123118 - protein, 181 aa, Heterodera glycines
  Homolog annotation: Hit_ID=CAC00543.1; Match level="QueryCoverage =96%, HitCoverage=38%, E-value=5e-60, Identity=65%"; Hit description =necepsin II [Necator americanus]
  Gene Ontology: Mol. function=aspartic-type endopeptidase activity; Cellular component=lysosome; Biological process=induction of non -apoptotic programmed cell death
  Essential gene: C elegans homolog=R12H7.2; Phenotype=Ced
  Coding regions on vcDNA: vcDNA=SeqID_49541; Strand=+; Position=2-544
KNRPPIRPDGREVAIEYGTGSMKGFVSKDTVCIMDGMCVEGQEFAEATSEPGDTFVNTKADGILGMAYPGISVQKLSTVFNNLVEQKEVEEPVFAFWLNRDPSYEFGGQMTVGGMDKRRFVEPINYVPVTRQTYWQFKMDSVTGGQNGKSKIACRNGCQAIADTGTSLITGPQKDVEAIHK

SEQ ID NO: 123119 - protein, 166 aa, Heterodera glycines
  Homolog annotation: Hit_ID=AAB47548.1; Match level="QueryCoverage =83%, HitCoverage=92%, E-value=2e-21, Identity=40%"; Hit description =similar to nonmuscle myosin essential light chain encoded by GenBank Accession Number U25057 [Toxocara can
  Gene Ontology: Mol. function=calcium ion binding
  Essential gene: C elegans homolog=T12D8.6; Phenotype=Emb
  Coding regions on vcDNA: vcDNA=SeqID_49542; Strand=+; Position=14-514
MSVDIHESDCLDDIKEVVDFYDTKGDGRIRVDQLGTCLRCLDLCPTEAQIVQLSQQWTDPSNRLTVENIAPIVKDLRKEGVRDRSEAELCGFLENFDWDNSGFVSTADLRHLLTRCGEPLSGEQYEQLIREERAEEGRVNIAELVRTICGKAEERAHKEQRREGGE

SEQ ID NO: 123120 - protein, 170 aa, Heterodera glycines
  Homolog annotation: Hit_ID=NP_495494.1; Match level="QueryCoverage =98%, HitCoverage=55%, E-value=1e-50, Identity=57%"; Hit description =MaoC-like dehydratase (32.7 kD) (2H487) [Caenorhabditis elegans] gb|AAA68358.1| Hypothetical protein E04F
  Gene Ontology: Mol. function=sterol transporter activity; Cellular component=peroxisome; Biological process=protein targeting
  Essential gene: C elegans homolog=E04F6.3; Phenotype=Unclassified
  Coding regions on vcDNA: vcDNA=SeqID_49543; Strand=+; Position=1-510
ARQHIPEPAIFTYASKDAILYALGIGANTAEDLHYVYEGHPDFQVFPTFAVVPGMVAVSLSDWPGIQFDLSRVLHGEQYIELYAPFPADGARLRSEIRVADLLDKGANAVIISEVTTFDDQSGEKLCIQQFAIFQGGAGGFGGIRTSPSERKVPPVPQGREPDAVLEQRT

SEQ ID NO: 123121 - protein, 62 aa, Heterodera glycines
  Homolog annotation: Hit_ID=CAE58579.1; Match level="QueryCoverage =96%, HitCoverage=36%, E-value=1e-13, Identity=60%"; Hit description =Hypothetical protein CBG01745 [Caenorhabditis briggsae]
  Gene Ontology: Mol. function=structural constituent of ribosome; Cellular component=cytosolic large ribosomal subunit (sensu Eukarya); Biological process=reproduction
  Essential gene: C elegans homolog=E04A4.8; Phenotype=Emb,Gro
  Coding regions on vcDNA: vcDNA=SeqID_49544; Strand=+; Position=2-190
MFREAGAGTQCYLDLGARHRAQTDLILIILVQTISVADCKPAGVKQFQNSKIKFPLPQRVNS

SEQ ID NO: 123122 - protein, 204 aa, Heterodera glycines
  Homolog annotation: Hit_ID=EAL25231.1; Match level="QueryCoverage =92%, HitCoverage=50%, E-value=6e-39, Identity=44%"; Hit description =GA21281-PA [Drosophila pseudoobscura]
  Gene Ontology: Mol. function=structural molecule activity; Cellular component=nuclear pore; Biological process=NLS-bearing substrate -nucleus import
  Essential gene: C elegans homolog=Y43F4B.4; Phenotype=Him
  Coding regions on vcDNA: vcDNA=SeqID_49545; Strand=+; Position=3-614
MLPFEVQHFSTGTADTAPSFHADTIHHVEFDFYGQRVATVSSDKTVCIWDKDTQNGAWRKSASWKKHGGAVWKVRFAHPEYGQVLATCSFDNTIQIFDKDAADLSEIRPITGADSSNGWACRTVLRQSNASASITDIQFAPHYLGLQLAACTSSGRLIIYEAEDIMALDNWNVLHDYEVTKNRLSSLSWSTNRFDPPHIVVASD

SEQ ID NO: 123123 - protein, 188 aa, Heterodera glycines
  Homolog annotation: Hit_ID=CAE60645.1; Match level="QueryCoverage =78%, HitCoverage=18%, E-value=8e-54, Identity=66%"; Hit description =Hypothetical protein CBG04291 [Caenorhabditis briggsae]
  Gene Ontology: Cellular component=nucleolus; Biological process=RNA processing
  Essential gene: C elegans homolog=F10G7.1; Phenotype=Gro,Pch,Unc
  Coding regions on vcDNA: vcDNA=SeqID_49546; Strand=+; Position=1-567
QNTNGQKFKLERFMPSQGAFCATLFAPVTYPPTNVTVFLAHNSQPAELVAYGILLNVNPDRIVLKRTVLSGHPYKVNKRTAVVRYMFYNREDIEWFKPVELYTHEGRRGRIKQPLGTHGLVKCVFDQPLSVQDSVLMNLYKRVFPKWDYDDRLEGTNATNSDGRNSNFEEEEEKGGKRGGKTVTFLEK

SEQ ID NO: 123124 - protein, 83 aa, Heterodera glycines
  misc_feature (17)..(17): Xaa can be any naturally occurring amino acid
  Homolog annotation: Hit_ID=XP_314557.1; Match level="QueryCoverage =100%, HitCoverage=42%, E-value=1e-22, Identity=67%"; Hit description= ENSANGP00000016949 [Anopheles gambiae] gb|EAA09923.2| ENSANGP00000016949 [Anopheles gambiae str. PEST]
  Gene Ontology: Mol. function=structural constituent of ribosome; Cellular component=eukaryotic 48S initiation complex; Biological process=morphogenesis
  Essential gene: C elegans homolog=ZC434.2; Phenotype=Lva
  Coding regions on vcDNA: vcDNA=SeqID_49547; Strand=+; Position=2-250
RELQNNMIGCPVIFIAXRRILPNPRLGKNRKPLGQKRPRSRALTAVHDSLLADVVFPAEVVGKRTRVKLDGKQIIKVHLDKAQ

SEQ ID NO: 123125 - protein, 198 aa, Heterodera glycines
  Homolog annotation: Hit_ID=NP_611539.1; Match level="QueryCoverage =97%, HitCoverage=65%, E-value=7e-48, Identity=52%"; Hit description =CG10540-PA [Drosophila melanogaster] gb|AAF46660.1| CG10540-PA [Drosophila melanogaster] gb|AAL39229.1| G
  Gene Ontology: Mol. function=F-actin capping activity; Cellular component=actin cortical patch (sensu Saccharomyces); Biological process=cell motility
  Essential gene: C elegans homolog=D2024.6; Phenotype=Ste
  Coding regions on vcDNA: vcDNA=SeqID_49548; Strand=+; Position=39-632
MIGEELTDVDKARIASDILLQSPPGEFNEVFNDVRTLLQNDALLEKGVCLEAVRRYNKAQFVPVNPEPGAEHPTLITEHNELPDGRFVDPKTGRVFKYDHLRKEAADAQPSGPKEIDEKLEPWRKALQKELDEYIYEHFHLTGVATVFTPLQHQKEPKLILCIESHQFQPKNYWNGRWRSEWHFPNFDGSSKTAGTLQ

SEQ ID NO: 123126 - protein, 76 aa, Heterodera glycines
  Homolog annotation: Hit_ID=NP_741153.1; Match level="QueryCoverage =98%, HitCoverage=13%, E-value=1e-12, Identity=53%"; Hit description =chaperonin Containing TCP-1 (58.9 kD) (cct-6) [Caenorhabditis elegans] gb|AAC46642.1| Chaperonin containi
  Gene Ontology: Mol. function=chaperone activity; Cellular component =cytoplasm; Biological process=protein folding
  Essential gene: C elegans homolog=F01F1.8a; Phenotype=Emb
  Coding regions on vcDNA: vcDNA=SeqID_49549; Strand=+; Position=2-232
SITCSTPKADLDPYASALEIILGRAKRLSDVINTQLRPIGTLKMLGSCSGYLDLTDDGHALLPEMKIQRPTASLIP

SEQ ID NO: 123127 - protein, 91 aa, Heterodera glycines
  Homolog annotation: Hit_ID=NP_497978.1; Match level="QueryCoverage =100%, HitCoverage=32%, E-value=2e-22, Identity=53%"; Hit description= ribosomal Protein, Small subunit (30.7 kD) (rps-0) [Caenorhabditis elegans] emb|CAA86061.1| Hypothetical
  Gene Ontology: Mol. function=structural constituent of ribosome; Cellular component=cytosolic small ribosomal subunit (sensu Eukarya); Biological process=ribosomal small subunit assembly and maintenance
  Essential gene: C elegans homolog=B0393.1; Phenotype=Emb,Ste
  Coding regions on vcDNA: vcDNA=SeqID_49550; Strand=+; Position=29-301
VLVVSAQLYAQSCMLYFAAHISATPIWGRFTPGSLTYQILKNFLEPHLLMIANPQLDHTGVRQASYMNTPVIAVANSDSPTKIVDLAIPVN

SEQ ID NO: 123128 - protein, 152 aa, Heterodera glycines
  misc_feature (37)..(37): Xaa can be any naturally occurring amino acid
  misc_feature (47)..(47): Xaa can be any naturally occurring amino acid
  misc_feature (60)..(60): Xaa can be any naturally occurring amino acid
  Homolog annotation: Hit_ID=AAN78300.1; Match level="QueryCoverage =100%, HitCoverage=23%, E-value=4e-70, Identity=87%"; Hit description= heat shock protein 70 A [Heterodera glycines]
  Gene Ontology: Mol. function=non-chaperonin molecular chaperone ATPase activity; Cellular component=intracellular; Biological process=reproduction
  Essential gene: C elegans homolog=F26D10.3; Phenotype=Lva,Ste
  Coding regions on vcDNA: vcDNA=SeqID_49551; Strand=+; Position=14-472
MPSKANAIGIYLGSTYSCVVFFHHSKVYIITNHQGQXTTPSYVPFTXTQRLIGDATNNQXAMNPSNTVFDAKRLIGRKFNNPAVQSDMKHWPFKVVQGEGARPKVMVEVKGEDKAFFPEEVSSMVLIKMKETAEAFLGQTVTDAVVTVPAYF

SEQ ID NO: 123129 - protein, 164 aa, Heterodera glycines
  Homolog annotation: Hit_ID=CAE66494.1; Match level="QueryCoverage =81%, HitCoverage=97%, E-value=2e-35, Identity=58%"; Hit description =Hypothetical protein CBG11774 [Caenorhabditis briggsae]
  Gene Ontology: Mol. function=thiol-disulfide exchange intermediate activity; Cellular component=mitochondrion; Biological process =response to oxidative stress
  Essential gene: C elegans homolog=Y49E10.2; Phenotype=Gro,Lon
  Coding regions on vcDNA: vcDNA=SeqID_49552; Strand=+; Position=21-515
MASLFRPFALAQRLAVLGRRSLHISASFNALDEAARARISECVNSAPVVVFMKGSQLEPKCGFSRNVKLVLDLHHVPFRDFDVLEDEALRHDVKEFSDWPTIPQVYVNGKFVGGSDIVVQMHKDGEIDKFFDEEGISSRFSQKFKQQTEGGEEGGGGQPEKSNK

SEQ ID NO: 123130 - protein, 114 aa, Heterodera glycines
  Homolog annotation: Hit_ID=NP_741153.1; Match level="QueryCoverage =99%, HitCoverage=20%, E-value=6e-22, Identity=53%"; Hit description =chaperonin Containing TCP-1 (58.9 kD) (cct-6) [Caenorhabditis elegans] gb|AAC46642.1| Chaperonin containi
  Gene Ontology: Mol. function=chaperone activity; Cellular component =cytoplasm; Biological process=protein folding
  Essential gene: C elegans homolog=F01F1.8a; Phenotype=Emb
  Coding regions on vcDNA: vcDNA=SeqID_49553; Strand=+; Position=29-370
TAQTNGTGDGTTTTVQLIGELLTQAENYDSEGDHPHLVTEGIQLAHDHWPQRWAASKKTVPIDRPLLIEVGRTTWRTKWNQKWADHGTECRGDAVMGIPRGENDAEADLHMREN

SEQ ID NO: 123131 - protein, 95 aa, Heterodera glycines
  Homolog annotation: Hit_ID=NP_506079.1; Match level="QueryCoverage =98%, HitCoverage=28%, E-value=2e-12, Identity=38%"; Hit description =putative mitochondrial translation elongation factor Ts, with ubiquitin associated domain (34.1 kD) (5M75
  Gene Ontology: Cellular component=mitochondrion
  Essential gene: C elegans homolog=F55C5.5; Phenotype=Lva
  Coding regions on vcDNA: vcDNA=SeqID_49554; Strand=+; Position=2-286
DGRTADEAIVATVSKVGENIQLARASVISSSPATKLLGQTHPKEEFNGVQLRRFISLVSLGHKSDDSVSDFTTAQLGQVTCHHIIGMAPERLGEP

SEQ ID NO: 123132 - protein, 124 aa, Heterodera glycines
  misc_feature (35)..(35): Xaa can be any naturally occurring amino acid
  misc_feature (53)..(53): Xaa can be any naturally occurring amino acid
  misc_feature (70)..(70): Xaa can be any naturally occurring amino acid
  Homolog annotation: Hit_ID=NP_071963.1; Match level="QueryCoverage =96%, HitCoverage=65%, E-value=1e-17, Identity=45%"; Hit description =ADP-ribosylation factor 1 [Rattus norvegicus] ref|NP_031502.1| ADP -ribosylation factor 1 [Mus musculus] r
  Gene Ontology: Mol. function=ARF small monomeric GTPase activity; Cellular component=cytoplasmic vesicle; Biological process=ER to Golgi transport
  Essential gene: C elegans homolog=B0336.2; Phenotype=Emb
  Coding regions on vcDNA: vcDNA=SeqID_49555; Strand=+; Position=2-376
NLFVGFFLKKEMPFLLVGVDPDAHTTVVHKVKTVXTVTTMATIGIEMDTDVQXKHVQRRVCYLCGQDKIXRYTTPRSINTLGLIVVVHSNVRYPAHYARDEMMQMFVENHLRNSVLLGFAYTPR

SEQ ID NO: 123133 - protein, 80 aa, Heterodera glycines
  Homolog annotation: Hit_ID=NP_504688.1; Match level="QueryCoverage =82%, HitCoverage=60%, E-value=5e-13, Identity=54%"; Hit description =SyNaptoBrevin related, synaptic vesicle-associated membrane protein (12.0 kD) (snb-1) [Caenorhabditis ele
  Gene Ontology: Cellular component=integral to membrane
  Essential gene: C elegans homolog=T10H9.4; Phenotype=Rup,Unc
  Coding regions on vcDNA: vcDNA=SeqID_49556; Strand=+; Position=2-241
RTQVDEVAGVMNANVGKLIDRDQKLSQKEDPADALKQRAFFFKKTTTTIKRKCWGKNITMITVMRAKSIPVMRSRAMRAG

SEQ ID NO: 123134 - protein, 161 aa, Heterodera glycines
  Homolog annotation: Hit_ID=AAL78223.1; Match level="QueryCoverage =100%, HitCoverage=64%, E-value=7e-37, Identity=49%"; Hit description= hypothetical protein Hgg-29 [Heterodera glycines]
  Essential gene: C elegans homolog=ZC373.5; Phenotype=Unc
  Coding regions on vcDNA: vcDNA=SeqID_49557; Strand=+; Position=2-484
AQLIRHFYALGWMRDNGAGMAARFRCPKTGESLIYNSSNSLAKEIFAENEHFVMKASGTVVKRPSDPDRTPTAPFYLLRDNPDLVCIIHTHTKWANLITQLISGDEFMISGQEMIQGCENRQTKRRMENIDTVVVPIIETEISEFVLCPQLMKVLQKYPES

SEQ ID NO: 123135 - protein, 104 aa, Heterodera glycines
  misc_feature (21)..(21): Xaa can be any naturally occurring amino acid
  misc_feature (74)..(75): Xaa can be any naturally occurring amino acid
  misc_feature (104)..(104): Xaa can be any naturally occurring amino acid
  Homolog annotation: Hit_ID=CAE60169.1; Match level="QueryCoverage =96%, HitCoverage=31%, E-value=3e-31, Identity=72%"; Hit description =Hypothetical protein CBG03723 [Caenorhabditis briggsae]
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_49558; Strand=+; Position=1-313
KISPKVVSAKKKSGGFNTKKXMLDLASGGTAAAVSKTAVAPIERVKLLLQVQDASIHITADKRYKGIIDVLVRXXFFFGFLSLWRGNLINFIRSFPTQALNFPX

SEQ ID NO: 123136 - protein, 63 aa, Heterodera glycines
  Homolog annotation: Hit_ID=XP_319221.1; Match level="QueryCoverage =96%, HitCoverage=29%, E-value=2e-10, Identity=52%"; Hit description =ENSANGP00000006082 [Anopheles gambiae] gb|EAA43596.1| ENSANGP00000006082 [Anopheles gambiae str. PEST]
  Gene Ontology: Biological process=embryogenesis and morphogenesis
  Essential gene: C elegans homolog=H27M09.2; Phenotype=Emb
  Coding regions on vcDNA: vcDNA=SeqID_49559; Strand=+; Position=2-190
ADDDAETIDLRRVRNTVLQMWPNRGCLDTRDEGDQTLDRFKDQFGHRPGKRWPGMGELTFLVG

SEQ ID NO: 123137 - protein, 74 aa, Heterodera glycines
  Homolog annotation: Hit_ID=XP_396561.1; Match level="QueryCoverage =100%, HitCoverage=35%, E-value=1e-14, Identity=54%"; Hit description= similar to ENSANGP00000006082 [Apis mellifera]
  Gene Ontology: Biological process=embryogenesis and morphogenesis
  Essential gene: C elegans homolog=H27M09.2; Phenotype=Emb
  Coding regions on vcDNA: vcDNA=SeqID_49560; Strand=+; Position=2-223
MQMCHDRRHLVTQDHLDRWLAQLKGQFRYRRSGQRPFRCELSILARLNDYPTDQMLLCLPDEPKRCCKTIKQMC

SEQ ID NO: 123138 - protein, 77 aa, Heterodera glycines
  Homolog annotation: Hit_ID=CAE56899.1; Match level="QueryCoverage =98%, HitCoverage=19%, E-value=1e-14, Identity=48%"; Hit description =Hypothetical protein CBG24740 [Caenorhabditis briggsae]
  Gene Ontology: Mol. function=acetyl-CoA C-acetyltransferase activity; Cellular component=cytosol; Biological process=ergosterol biosynthesis
  Essential gene: C elegans homolog=T02G5.7; Phenotype=Bmd,Unc
  Coding regions on vcDNA: vcDNA=SeqID_49561; Strand=+; Position=349-579
MSQAPCYWARADNNYGDTKLLDSIQRDGISTAMLGQPMGVCAEKTGAEFGFTREQQDAYALASYARATRAWAGGAFG

SEQ ID NO: 123139 - protein, 94 aa, Heterodera glycines
  Homolog annotation: Hit_ID=NP_572215.1; Match level="QueryCoverage =81%, HitCoverage=17%, E-value=8e-10, Identity=42%"; Hit description =CG4202-PA [Drosophila melanogaster] gb|AAG22407.2| CG4202-PA [Drosophila melanogaster] gb|AAK77307.1| GH0
  Essential gene: C elegans homolog=T01B7.5; Phenotype=Lva
  Coding regions on vcDNA: vcDNA=SeqID_49562; Strand=+; Position=1-285
ETSTDGGNFDDGGPCVSKEMRRKINYEIRKNKGIRKDKGRRKAKQRHSRVMKRTQYEKALIKRKSQVPNMRREMERYDGEKRGIRISTIRSTKF

SEQ ID NO: 123140 - protein, 114 aa, Heterodera glycines
  misc_feature (5)..(5): Xaa can be any naturally occurring amino acid
  misc_feature (60)..(60): Xaa can be any naturally occurring amino acid
  Homolog annotation: Hit_ID=NP_498349.1; Match level="QueryCoverage =90%, HitCoverage=41%, E-value=1e-29, Identity=66%"; Hit description =ribosomal Protein, Small subunit (27.3 kD) (rps-3) [Caenorhabditis elegans] gb|AAF99870.1| Ribosomal prot
  Gene Ontology: Mol. function=structural constituent of ribosome; Cellular component=cytosolic small ribosomal subunit (sensu Eukarya); Biological process=protein biosynthesis
  Essential gene: C elegans homolog=C23G10.3; Phenotype=Emb
  Coding regions on vcDNA: vcDNA=SeqID_49563; Strand=+; Position=2-343
ITRRXKAVQDGIFKAELNNFLMKELAEDGYSGVEVRRAPSRTEVIIMATRTQSVLVFFFXRIRELTALVQKSVSCSAGQIELYAEKVSCRGLGAVGQCECFEFYFGRWGALVRR

SEQ ID NO: 123141 - protein, 210 aa, Heterodera glycines
  Homolog annotation: Hit_ID=CAE68546.1; Match level="QueryCoverage =67%, HitCoverage=39%, E-value=2e-26, Identity=50%"; Hit description =Hypothetical protein CBG14378 [Caenorhabditis briggsae]
  Gene Ontology: Mol. function=general RNA polymerase II transcription factor activity; Cellular component=transcription factor TFIID complex; Biological process=regulation of transcription, DNA -dependent
  Essential gene: C elegans homolog=F43D9.5; Phenotype=Gro
  Coding regions on vcDNA: vcDNA=SeqID_49564; Strand=+; Position=6-635
MSNKKIETVDFDQAFDLLEDARDQQQSVEEEPFPSTSTDPSTIDLTIQKHVHSIVEEQSEQIYLSKTNFETDKMVSAYESEEIEVKRRKIVVEEDESEESIPTLPPKLDEESELSRLKLQLLLSNFSQEQLDRYEAMRRASLPKSIIRRLIHQFTGVTVNQNVVIAIAGMAKVFTGELIEEALDIQKAEREANTDKNNGSRERQNGAAED

SEQ ID NO: 123142 - protein, 174 aa, Heterodera glycines
  Homolog annotation: Hit_ID=CAE59767.1; Match level="QueryCoverage =100%, HitCoverage=71%, E-value=2e-30, Identity=43%"; Hit description= Hypothetical protein CBG03219 [Caenorhabditis briggsae]
  Essential gene: C elegans homolog=C18E9.10; Phenotype=Lva
  Coding regions on vcDNA: vcDNA=SeqID_49565; Strand=+; Position=127-648
MSSLADFVNEQRSKANSSSGRQAYFNVATLGSKVSNSFTDFFKPRNSNGIDDVQRLTEDADAAQNGQLPSNKNRKYSWMSFSSVSASVSPDSNPCGLTRFQRIAAFFLCIFAAGFCFTTAMMLIPVLVLQTRKFAALNTLGSVFFIVSFGFLWGPLAYCQFLFSEPRRVVTAVY

SEQ ID NO: 123143 - protein, 188 aa, Heterodera glycines
  Homolog annotation: Hit_ID=NP_741416.1; Match level="QueryCoverage =86%, HitCoverage=45%, E-value=2e-70, Identity=77%"; Hit description =methionine adenosyltransferase family member (38.4 kD) (4H42) [Caenorhabditis elegans] gb|AAM97949.1| Tem
  Gene Ontology: Mol. function=methionine adenosyltransferase activity; Cellular component=cytoplasm; Biological process=amino acid metabolism
  Essential gene: C elegans homolog=T13A10.11a; Phenotype=Gro,Unc
  Coding regions on vcDNA: vcDNA=SeqID_49566; Strand=+; Position=3-569
SPIYYLNPCGSFHVGGPKSDAGLTGRKIIVDTYGGWGAHGGGAFSGKDPTKVDRSGAYGARWVAKSLVKAGVCRRCLVQVSYAIAISKPLSITVISYGTSPLTEQELLQIVNDNFDLRPGVIIEELGLKRAIYSRTAANGHFGHADFPWEKAKPLEIRPELMEKLIAYRKSEHIPNGCFKGTHIHAHH

SEQ ID NO: 123144 - protein, 53 aa, Heterodera glycines
  misc_feature (19)..(19): Xaa can be any naturally occurring amino acid
  Homolog annotation: Hit_ID=AAT92172.1; Match level="QueryCoverage =94%, HitCoverage=33%, E-value=3e-14, Identity=72%"; Hit description =ribosomal protein S14 [Ixodes pacificus]
  Gene Ontology: Cellular component=eukaryotic 48S initiation complex; Biological process=protein biosynthesis
  Essential gene: C elegans homolog=F37C12.9; Phenotype=Emb,Ste
  Coding regions on vcDNA: vcDNA=SeqID_49567; Strand=+; Position=2-160
KVFEHQPAVALGPQVQEGXNVFGVAHIFSSFNDTLLHVTDLSGRETIIKIRGG

SEQ ID NO: 123145 - protein, 202 aa, Heterodera glycines
  Homolog annotation: Hit_ID=NP_505114.1; Match level="QueryCoverage =99%, HitCoverage=34%, E-value=7e-40, Identity=42%"; Hit description =carboxylesterase precursor family member (64.2 kD) (5I685) [Caenorhabditis elegans] gb|AAA96175.1| Hypoth
  Gene Ontology: Mol. function=carboxylesterase activity; Cellular component=endoplasmic reticulum; Biological process=acyl-CoA metabolism
  Essential gene: C elegans homolog=K07C11.4; Phenotype=Gro
  Coding regions on vcDNA: vcDNA=SeqID_49568; Strand=+; Position=1-606
IHGGAYEIGSSARYTKYEVIGQRFVTDANSRGIVFVSIQYRLGVMGFATTGDEELPGNLGIWDQISALQFVKDNIAEFGGDPSRVTVFGYSAGSGSTALLSISPKSRDLFQQAIRMSGTPFSVSGSGTFVAEETKKLAKAMGCAANRTKQCLSEKSVEQIFDGIDKIGPAPLSVYIAKFSPHRLDRELFPQDYPEMIATAPP

SEQ ID NO: 123146 - protein, 196 aa, Heterodera glycines
  Homolog annotation: Hit_ID=NP_492113.1; Match level="QueryCoverage =100%, HitCoverage=13%, E-value=3e-51, Identity=54%"; Hit description= chitin synthase (chi-1Co) [Caenorhabditis elegans] emb|CAA96688.1| Hypothetical protein T25G3.2 [Caenorh
  Gene Ontology: Biological process=reproduction
  Essential gene: C elegans homolog=T25G3.2; Phenotype=Emb,Ste
  Coding regions on vcDNA: vcDNA=SeqID_49569; Strand=+; Position=2-589
QVAAFAVDSTRVLFYNAVPVCGFILCCFTMDSSVQLTYAKIASVIYAFIMLAVLIATTNQIVLETVFSPTSMFVLGMVLIFFFASCIHPKEFTSIIYGSIFFLMIPSTYVFLSLYSLINLNVINWGTREAVSKATGQATFRENIANRVLRRVANLNDDDSFLTRFLTRVRSGEEPSEEIRTLERKFERTERLLMSM

SEQ ID NO: 123147 - protein, 80 aa, Heterodera glycines
  Homolog annotation: Hit_ID=NP_498349.1; Match level="QueryCoverage =97%, HitCoverage=31%, E-value=3e-11, Identity=46%"; Hit description =ribosomal Protein, Small subunit (27.3 kD) (rps-3) [Caenorhabditis elegans] gb|AAF99870.1| Ribosomal prot
  Essential gene: C elegans homolog=C23G10.3; Phenotype=Emb
  Coding regions on vcDNA: vcDNA=SeqID_49570; Strand=+; Position=2-241
WGKDGYSRDILRRAPSLTEVIVMRTRTHSVLGELFVHSRKLIALRQNYFGYSAGQIGHNADKESNRGLCAMAHCEYKRIK

SEQ ID NO: 123148 - protein, 64 aa, Heterodera glycines
  misc_feature (56)..(56): Xaa can be any naturally occurring amino acid
  Homolog annotation: Hit_ID=NP_491526.1; Match level="QueryCoverage =96%, HitCoverage=7%, E-value=7e-15, Identity=58%"; Hit description =cell Division Cycle related, Metaphase-to-Anaphase Transition defect MAT-1, Metaphase-to-Anaphase Transiti
  Gene Ontology: Cellular component=centrosome; Biological process =embryonic cleavage
  Essential gene: C elegans homolog=Y110A7A.17a; Phenotype=Emb
  Coding regions on vcDNA: vcDNA=SeqID_49571; Strand=+; Position=23-214
AGLLFDIGKYEAASAELEELRVLSPDEAHVFFLLGRVNRKLGNMHMALLNFSWAAXIDPRGEQN

SEQ ID NO: 123149 - protein, 157 aa, Heterodera glycines
  Homolog annotation: Hit_ID=NP_492799.1; Match level="QueryCoverage =91%, HitCoverage=83%, E-value=5e-37, Identity=52%"; Hit description =genes associated with retinoid-IFN-induced mortality 19 like (20.1 kD) (1L262) [Caenorhabditis elegans] g
  Gene Ontology: Biological process=positive regulation of embryonic development
  Essential gene: C elegans homolog=C34B2.8; Phenotype=Emb,Lva
  Coding regions on vcDNA: vcDNA=SeqID_49572; Strand=+; Position=33-506
MSEKFRQDMPPQGGYPSFHVHRTLPKSFLSPGRIMLFGVVLPTFYGYFKNFYHDQAAIGNDAFEEQDLINALEPFLMAERDRSVLRIMKRNRELENEVMKDVPGWKTGTWYGEPVYFTLGDKWIEPNAMEVSPHLSFRDSAFNHYYRLNTLRPQRKC

SEQ ID NO: 123150 - protein, 115 aa, Heterodera glycines
  Homolog annotation: Hit_ID=CAE60550.1; Match level="QueryCoverage =99%, HitCoverage=20%, E-value=2e-26, Identity=52%"; Hit description =Hypothetical protein CBG04177 [Caenorhabditis briggsae]
  Gene Ontology: Biological process=positive regulation of growth rate
  Essential gene: C elegans homolog=K09H9.6; Phenotype=Lpd
  Coding regions on vcDNA: vcDNA=SeqID_49573; Strand=+; Position=3-347
TLLLNYDTEDGLMEFRQYSIKSVPAGVSRSAKKLMQSKVPYLSKYKDISDFMLKPEQLSDSEFEGEQTELELTHDFGGRGKKRGQQTKLRLMEIGPRMTLRLMKIEEGVDAGTAL

SEQ ID NO: 123151 - protein, 207 aa, Heterodera glycines
  Homolog annotation: Hit_ID=AAD47356.1; Match level="QueryCoverage =55%, HitCoverage=47%, E-value=2e-31, Identity=54%"; Hit description =homeobox protein Optx2 [Xenopus laevis]
  Gene Ontology: Mol. function=transcriptional repressor activity; Cellular component=nucleus; Biological process=brain development
  Essential gene: C elegans homolog=W05E10.3; Phenotype=Emb,Lva,Unc
  Coding regions on vcDNA: vcDNA=SeqID_49574; Strand=+; Position=9-629
MQNYLHKMFYAITHQQVSSDNNCPTKLLNNNSRTTAISPGTASAMVATERGNAATSSSLLPPPSAIFAPPNSANNGHLPPLPANGLFPGGIPFPVFGINIDQILKTCEQLEDSKNYDQLAHFLNKMPLAVQMNVAMHETVLRARALISFHTGNFKEMYAILESHKFSQDSHSMLQKIWWDAHYQEAERMRGRTLGPVDKYRVRKKYP

SEQ ID NO: 123152 - protein, 212 aa, Heterodera glycines
  Homolog annotation: Hit_ID=CAE72182.1; Match level="QueryCoverage =98%, HitCoverage=38%, E-value=9e-65, Identity=60%"; Hit description =Hypothetical protein CBG19289 [Caenorhabditis briggsae]
  Gene Ontology: Cellular component=mitochondrion
  Essential gene: C elegans homolog=AH10.1; Phenotype=Unclassified
  Coding regions on vcDNA: vcDNA=SeqID_49575; Strand=+; Position=3-638
YDLSSLKLIMTGAAPVGTDLLDKVRRRIPSLKQICQGYGMTEQSMCSHLSVFGSDDSKTVGRLISNFEMKVVDIESRKPLGVLQKGEICTRSPTTMLGYLNRAEATAETIDEDGWLRTGDIGFFDENGRTFVVDRLKELIKVKGFQVAPAELEDLLLSHAGIKDCAVVGVADKLAGEVPKAFVVRADQTLTESELKRFVREKVASYKQLGSV

SEQ ID NO: 123153 - protein, 138 aa, Heterodera glycines
  Homolog annotation: Hit_ID=NP_504649.1; Match level="QueryCoverage =95%, HitCoverage=36%, E-value=6e-26, Identity=40%"; Hit description =diacylglycerol O-acyltransferase 2 (5G979) [Caenorhabditis elegans] gb|AAB04969.1| Hypothetical protein W
  Gene Ontology: Mol. function=diacylglycerol O-acyltransferase activity; Cellular component=integral to membrane; Biological process=triacylglycerol biosynthesis
  Essential gene: C elegans homolog=W01A11.2; Phenotype=Emb
  Coding regions on vcDNA: vcDNA=SeqID_49576; Strand=+; Position=2-415
LLPHLLLYFCWFFWDFATPSRGCHFWPFFYKSPVWRHLASYFPISVIQTADLSADRNYLFSAHPHGIVGSSSFIFFATNGANFASLFPGLRMHSVTLDLNFWFPLRTEMIMASGMIPSDSKSIEWVLSRPGGGFAVGI

SEQ ID NO: 123154 - protein, 155 aa, Heterodera glycines
  Homolog annotation: Hit_ID=EAL24777.1; Match level="QueryCoverage =95%, HitCoverage=10%, E-value=4e-51, Identity=60%"; Hit description =GA14940-PA [Drosophila pseudoobscura]
  Gene Ontology: Cellular component=nucleus
  Essential gene: C elegans homolog=F42A9.2; Phenotype=Unc
  Coding regions on vcDNA: vcDNA=SeqID_49577; Strand=+; Position=1-468
EDLAWLQLANERRQKIGVPPIDDDTLEKAIDMLEKESHFQFTQDEHGTGLAYLTMIDNDAPCCICNDGEDSNANQIIFCDICNIAVHQECYGVPYIPEGQWLCRKCQMSPSIPVNCALCPCSSGAFKQTSDGRWAHVLCAIWLNEVFFCAIFSFP

SEQ ID NO: 123155 - protein, 110 aa, Heterodera glycines
  Homolog annotation: Hit_ID=NP_113897.1; Match level="QueryCoverage =92%, HitCoverage=90%, E-value=9e-25, Identity=47%"; Hit description =ribosomal protein S12 [Rattus norvegicus] gb|AAA42077.1| ribosomal protein S12
  Gene Ontology: Mol. function=structural constituent of ribosome; Cellular component=eukaryotic 48S initiation complex; Biological process=protein biosynthesis
  Essential gene: C elegans homolog=F54E7.2; Phenotype=Emb,Ste
  Coding regions on vcDNA: vcDNA=SeqID_49578; Strand=+; Position=35-367
MIETLETSEVLKRVLKSALIVDGVARGLNEAAQTLDKREAHFCVLAKSCDEASFEKLDKAELGQMVGQCKYDKDGKARKIVGCSVAVVKDYGRDEEAKNDLQEVLKKISD

SEQ ID NO: 123156 - protein, 193 aa, Heterodera glycines
  Homolog annotation: Hit_ID=AAL26582.1; Match level="QueryCoverage =100%, HitCoverage=77%, E-value=1e-91, Identity=84%"; Hit description= ribosomal protein S6 [Spodoptera frugiperda] sp|Q95V32|RS6_SPOFR 40S ribosomal protein S6
  Gene Ontology: Cellular component=eukaryotic 48S initiation complex; Biological process=protein biosynthesis
  Essential gene: C elegans homolog=Y71A12B.1; Phenotype=Ste
  Coding regions on vcDNA: vcDNA=SeqID_49579; Strand=+; Position=67-645
MKLNVAFPATGAQKLFEVVDEHKLRIFYEKRMGAEVEADLLGDEWKGYVVRITGGNDKQGFPMKQGILSNVRVRLLLSKGHSCYRPRRDGERKRKSVRGCIVDSNLSVLSLVVVRKGEQEIPGLTDKSIPRRLGPKRASKIRKLFNLTKLDDVRQYVIKRPLPQKEGKKQRFKAPKIQRLITPLALQRKRHML

SEQ ID NO: 123157 - protein, 210 aa, Heterodera glycines
  Homolog annotation: Hit_ID=CAE62748.1; Match level="QueryCoverage =94%, HitCoverage=62%, E-value=4e-31, Identity=43%"; Hit description =Hypothetical protein CBG06912 [Caenorhabditis briggsae]
  Essential gene: C elegans homolog=K02D10.5; Phenotype=Ste
  Coding regions on vcDNA: vcDNA=SeqID_49580; Strand=+; Position=3-632
FNGFVTEKAIMANPFDDDSDEFIRKIRAGRGIEPTKSFTTPAASQNIEDQIAADEKAIERYLQASLDSTQRSRQQLSSSEGLAESTARELLEQREKLERAEQNLDTIHHTTQHTQRSLNSLKSWFGGLVRNKLSRAPKGLGTANVNANNQQQQQEQTVQQQHQQRPLHAHLVQSSADEFAGAIGGGGGGVQPPQQHSLNSSSRAYIQGTR

SEQ ID NO: 123158 - protein, 174 aa, Heterodera glycines
  Homolog annotation: Hit_ID=AAA82334.1; Match level="QueryCoverage =68%, HitCoverage=82%, E-value=8e-54, Identity=54%"; Hit description =Uncoordinated protein 97 [Caenorhabditis elegans] gb|AAD09435.1| UNC- 97 [Caenorhabditis elegans] pir||T160
  Gene Ontology: Mol. function=protein binding; Cellular component =focal adhesion; Biological process=cell aging
  Essential gene: C elegans homolog=F14D12.2; Phenotype=Unclassified
  Coding regions on vcDNA: vcDNA=SeqID_49581; Strand=+; Position=111-632
MLHNSERNPLYKYSYQIPGQERSYTYSVPAEEFQQKEHDKVTNGYFPTNGSAEAVLPHHFEHSVKLDDLICVRCNEGFTLNEQIVNSGGQVWHAECFVCVQCFQPFSDGIYFEFEGRKYCEHDFHVLYAPCCNKCNEFIIGRVIKAMNANWHPECFTCELCNKQLADIGFLRNA

SEQ ID NO: 123159 - protein, 88 aa, Heterodera glycines
  Homolog annotation: Hit_ID=NP_504688.1; Match level="QueryCoverage =98%, HitCoverage=79%, E-value=4e-12, Identity=43%"; Hit description =SyNaptoBrevin related, synaptic vesicle-associated membrane protein (12.0 kD) (snb-1) [Caenorhabditis ele
  Essential gene: C elegans homolog=T10H9.4; Phenotype=Rup,Unc
  Coding regions on vcDNA: vcDNA=SeqID_49582; Strand=+; Position=2-265
SRPSINRLHVTLVHVDEICCIVIVSGEMVSDLDHELSPFDDLADAHLDSSSQFKKSAFTLTTQCCWNNFTIVVFLCAIVILLILSLSL

SEQ ID NO: 123160 - protein, 203 aa, Heterodera glycines
  misc_feature (201)..(201): Xaa can be any naturally occurring amino acid
  Homolog annotation: Hit_ID=XP_393534.1; Match level="QueryCoverage =50%, HitCoverage=21%, E-value=8e-39, Identity=74%"; Hit description =similar to ENSANGP00000003194 [Apis mellifera]
  Gene Ontology: Mol. function=1-phosphatidylinositol 4-kinase activity; Cellular component=plasma membrane; Biological process =actin filament organization
  Essential gene: C elegans homolog=C56A3.8; Phenotype=Let,Ste
  Coding regions on vcDNA: vcDNA=SeqID_49583; Strand=+; Position=35-643
MRDKQKAKAAVITEQHRIPTKVTATEEETENGSDNDETTALIKEPQTSKKTERIPLLGNSVNAHSDRESSTSARVTTDCQPSDEEMHRIFNEQYGSTSGEDFAACLVEAIRAINRGINPERIPQGSSGSYFVKNLQGEVIGVFKPKNEEPYGSLNPKWVKWAHKLLCPCCFGRSCLVPNQGYLSEAGASLVDQKLGLDIVXRT

SEQ ID NO: 123161 - protein, 131 aa, Heterodera glycines
  Homolog annotation: Hit_ID=NP_506005.1; Match level="QueryCoverage =100%, HitCoverage=30%, E-value=6e-56, Identity=76%"; Hit description= proteasome Regulatory Particle, ATPase-like, S7 (48.6 kD) (rpt-1) [Caenorhabditis elegans] emb|CAB01414.
  Gene Ontology: Mol. function=proteasome endopeptidase activity; Cellular component=proteasome regulatory particle (sensu Eukarya); Biological process=proteolysis and peptidolysis
  Essential gene: C elegans homolog=C52E4.4; Phenotype=Emb
  Coding regions on vcDNA: vcDNA=SeqID_49584; Strand=+; Position=1-396
VNQLDGFDSRGAIKVLMATNRPDTLDPALVRPGRIDRRIEFSLPDVKARKNILQIHTKRMSIERNIRYELIARLCPNTTGADLRSVCTEAGMFALRARRKVITEQDFLKAVQKVVKGYAKFSSTPSYLTHN

SEQ ID NO: 123162 - protein, 94 aa, Heterodera glycines
  misc_feature (74)..(74): Xaa can be any naturally occurring amino acid
  Homolog annotation: Hit_ID=XP_312618.1; Match level="QueryCoverage =100%, HitCoverage=57%, E-value=6e-14, Identity=51%"; Hit description= ENSANGP00000015417 [Anopheles gambiae]
  Gene Ontology: Mol. function=structural constituent of ribosome; Cellular component=cytosolic small ribosomal subunit (sensu Eukarya); Biological process=protein biosynthesis
  Essential gene: C elegans homolog=F37C12.9; Phenotype=Emb,Ste
  Coding regions on vcDNA: vcDNA=SeqID_49585; Strand=+; Position=2-283
VSLDPPVRQGEDGFGAPHMYLHSFNDTFDSGDPCGRHCKPLSESPRGMLVLVHRYDASPYSAMLAAHDVAERCXHVGINARLVKLRATRGTNSK

SEQ ID NO: 123163 - protein, 209 aa, Heterodera glycines
  Homolog annotation: Hit_ID=NP_501632.1; Match level="QueryCoverage =91%, HitCoverage=46%, E-value=2e-59, Identity=57%"; Hit description =proteasome Regulatory Particle, Non-ATPase-like, S10a (47.6 kD) (rpn- 7) [Caenorhabditis elegans] emb|CAA9
  Gene Ontology: Mol. function=ATPase activity; Cellular component=26S proteasome; Biological process=ATP-dependent proteolysis
  Essential gene: C elegans homolog=F49C12.8; Phenotype=Emb
  Coding regions on vcDNA: vcDNA=SeqID_49586; Strand=+; Position=1-627
QKFFLCKENKKDVATIFLELLKSITDNEMAPFYEYAAPQLGVPIDKAKLQTLKALNEQKLDEFDRKIKDAEENLGESEVRQSHLAKAEYLCKIGDKERALAAFQLTFDKTVGIGYRIDLVFNVIRLGFFFMDHQIITENIEKAKSLMEKGGDWDRKNRLRSYEALYKMAIREMRGAALLFLEAVPTFDAYELMSYEDLTFYTVICCVYA

SEQ ID NO: 123164 - protein, 175 aa, Heterodera glycines
  misc_feature (160)..(160): Xaa can be any naturally occurring amino acid
  misc_feature (163)..(163): Xaa can be any naturally occurring amino acid
  Homolog annotation: Hit_ID=CAE63933.1; Match level="QueryCoverage =100%, HitCoverage=94%, E-value=2e-65, Identity=66%"; Hit description= Hypothetical protein CBG08510 [Caenorhabditis briggsae]
  Gene Ontology: Mol. function=structural constituent of ribosome; Cellular component=cytosolic ribosome (sensu Eukarya); Biological process=protein biosynthesis
  Essential gene: C elegans homolog=Y48G8AL.8a; Phenotype=Emb,Lva
  Coding regions on vcDNA: vcDNA=SeqID_49587; Strand=+; Position=2-526
YCKRPDNSSKSCKTRGSDLRVHFKNTHETARAIKHMPLNRAIRFLENVRENKEIVPFRHFNCGVGRKVQAQAWGTTHGRWPKKSAEFLLQLLKNADSNAEVKGLDVHHLVIDHILVQAPAEMRRRTYRAHGRINPHMSSPCHIQVSLTQKKDLIAKPAGXIPXVKKESNKKLRRQ

SEQ ID NO: 123165 - protein, 76 aa, Heterodera glycines
  misc_feature (69)..(69): Xaa can be any naturally occurring amino acid
  Homolog annotation: Hit_ID=EAL32152.1; Match level="QueryCoverage =100%, HitCoverage=22%, E-value=6e-16, Identity=51%"; Hit description= GA17684-PA [Drosophila pseudoobscura]
  Gene Ontology: Mol. function=pre-mRNA splicing factor activity; Cellular component=spliceosome complex; Biological process=mRNA splicing
  Essential gene: C elegans homolog=C08B11.5; Phenotype=Emb
  Coding regions on vcDNA: vcDNA=SeqID_49588; Strand=+; Position=2-233
ELFIHAGPVTNLDLPNDHITDAPGASALWSFLTEEDADYALTILNLIKLVIKPISLNIASANEKNMDVXPDLFVGN

SEQ ID NO: 123166 - protein, 209 aa, Heterodera glycines
  Homolog annotation: Hit_ID=AAK94490.1; Match level="QueryCoverage =99%, HitCoverage=19%, E-value=3e-11, Identity=24%"; Hit description =PAZ/Piwi domain protein [Heterodera glycines]
  Essential gene: C elegans homolog=F55A12.1; Phenotype=Emb
  Coding regions on vcDNA: vcDNA=SeqID_49589; Strand=+; Position=3-629
LDYPNLPLIAMNSRFANEKRVNYYPIEVLDIIDNQRVTTQQQTPTMIQQSIKKCAIPPLVFKRQVHNTAKSIHLWDSEYLDEAGIKLTTEPIALRAHQLNHPEVKAGDGNMQRPMVEGSAAWRINSVLVPQSVFADGTYSWMLACFVQLGGRGLSEPDLHKFIQLLEDQAKRRSLKLPALPRDHLRLVNFRSKEDISALFQEASQSGIA

SEQ ID NO: 123167 - protein, 202 aa, Heterodera glycines
  Homolog annotation: Hit_ID=S65469; Match level="QueryCoverage=100%, HitCoverage=27%, E-value=2e-74, Identity=68%"; Hit description=DNA topoisomerase (EC 5.99.1.2) - Caenorhabditis elegans
  Gene Ontology: Mol. function=DNA topoisomerase type I activity; Cellular component=chromatin; Biological process=chromatin assembly/disassembly
  Essential gene: C elegans homolog=M01E5.5a; Phenotype=Lva,Unc
  Coding regions on vcDNA: vcDNA=SeqID_49590; Strand=+; Position=3-608
CCSLRCEHIKLHDDMDDLKYVVEFDFLGKDSIRYYNRVPVEKQVFKNLKLFMEEKDPGDDLFDRLDTSSLNQYLKELMDGLTAKVFRTYNASITLQEQLDKLTNPSDSVHEKMLSYNRANRQVAILCNHQRAVPKTHEKSMENLENKIKEKKQEYKELKDQLKKSKSVDEKMAKKYERLKEQIAKLNTQRTDKDENKQIALG

SEQ ID NO: 123168 - protein, 169 aa, Heterodera glycines
  misc_feature (94)..(94): Xaa can be any naturally occurring amino acid
  Homolog annotation: Hit_ID=CAE62916.1; Match level="QueryCoverage =88%, HitCoverage=25%, E-value=8e-29, Identity=47%"; Hit description =Hypothetical protein CBG07110 [Caenorhabditis briggsae]
  Gene Ontology: Mol. function=1-pyrroline-5-carboxylate dehydrogenase activity; Cellular component=mitochondrion; Biological process =glutamate biosynthesis
  Essential gene: C elegans homolog=F56D12.1a; Phenotype=Gro,Slu,Stp,Unc
  Coding regions on vcDNA: vcDNA=SeqID_49591; Strand=+; Position=2-508
MLFRSLPFGRSFPPCLLRGNASSFTGLTSENFMNSPTNESVLKYRKGSAESDALEKELQKLWAEPMEVPLAIGGEKTFRKEKAIIQPMASAFEXPFDHNRPIALINHATTEDIQNAIQIGLAARHQWERLPLIKRADIFLHASDLMAGKYRMLINAATMLGQAKNIQQA

SEQ ID NO: 123169 - protein, 68 aa, Heterodera glycines
  Homolog annotation: Hit_ID=NP_492765.1; Match level="QueryCoverage =100%, HitCoverage=27%, E-value=7e-14, Identity=58%"; Hit description= proteasome Alpha Subunit (27.2 kD) (pas-5) [Caenorhabditis elegans] emb|CAB02097.1| Hypothetical protein
  Gene Ontology: Mol. function=endopeptidase activity; Cellular component=proteasome core complex (sensu Eukarya); Biological process=sporulation (sensu Saccharomyces)
  Essential gene: C elegans homolog=F25H2.9; Phenotype=Emb,Lva
  Coding regions on vcDNA: vcDNA=SeqID_49592; Strand=+; Position=2-205
VNTFSPEGHSFQDEYAIDTVKVGYTRIRIHTKEGILLAAERPSMSKLVVDNSLIACSDVEKHIGVDLA

SEQ ID NO: 123170 - protein, 156 aa, Heterodera glycines
  Homolog annotation: Hit_ID=NP_493569.1; Match level="QueryCoverage =92%, HitCoverage=46%, E-value=5e-37, Identity=45%"; Hit description =metaxin 1 (1P348) [Caenorhabditis elegans] emb|CAB07391.1| Hypothetical protein F39B2.11 [Caenorhabditis
  Gene Ontology: Cellular component=integral to membrane
  Essential gene: C elegans homolog=F39B2.11; Phenotype=Ste
  Coding regions on vcDNA: vcDNA=SeqID_49593; Strand=+; Position=6-473
MHLHVWPGEFGLPSVDIECLQFMAAAKFCAAPIAFHASTQPWKSPKGELPFFNNNGEEQITDFGEFVEFLRNSRQDVVLDNDLVPSQLCEFEAYNCLLKQKLLPALNHLFWVDKCNYGTIVHPLYAQQVTFPYNIYYMERRRRRMDTTVRAIRKNQ

SEQ ID NO: 123171 - protein, 99 aa, Heterodera glycines
  Homolog annotation: Hit_ID=AAT70232.1; Match level="QueryCoverage =76%, HitCoverage=94%, E-value=8e-34, Identity=75%"; Hit description =unc-87 [Heterodera glycines]
  Essential gene: C elegans homolog=F08B6.4a; Phenotype=Unc
  Coding regions on vcDNA: vcDNA=SeqID_49594; Strand=+; Position=194-493
MEMPTPPTNASHRKSAEGIGTTLQAGMGYGTQQAEAGELPYEDMKKSEAIIPSQAGWNKGDSQKLMTNFGTPRDVKGKHLKRIWELEYPEEAEVSLDRL

SEQ ID NO: 123172 - protein, 196 aa, Heterodera glycines
  Homolog annotation: Hit_ID=NP_492721.1; Match level="QueryCoverage =98%, HitCoverage=78%, E-value=5e-74, Identity=63%"; Hit description =der1-like domain containing protein (28.5 kD) (1K976) [Caenorhabditis elegans] emb|CAB01696.1| Hypothetic
  Gene Ontology: Cellular component=membrane; Biological process =gametogenesis
  Essential gene: C elegans homolog=F25D7.1; Phenotype=Stp
  Coding regions on vcDNA: vcDNA=SeqID_49595; Strand=+; Position=52-639
MGDFGEWYRSIPLITRYWFTGSTVIPLLGRLGIFHPYLMLLSWELFFYKLQLWRPLSALFYYPVTPQTGFHWMLMCYFLYNYSKDLETSQFDGRPADFLFMLIFNWICCTIVCFVAEIYFLLEPMVLSVLYVWCQFNKDRTVQFWFGMQFKAIYLPWILVAFSMVLRGGGINELVGILVGHTYYFLAFQYALDYGG

SEQ ID NO: 123173 - protein, 162 aa, Heterodera glycines
  misc_feature (72)..(72): Xaa can be any naturally occurring amino acid
  misc_feature (91)..(91): Xaa can be any naturally occurring amino acid
  misc_feature (121)..(121): Xaa can be any naturally occurring amino acid
  misc_feature (128)..(128): Xaa can be any naturally occurring amino acid
  misc_feature (146)..(146): Xaa can be any naturally occurring amino acid
  Homolog annotation: Hit_ID=NP_491593.1; Match level="QueryCoverage =96%, HitCoverage=75%, E-value=5e-24, Identity=39%"; Hit description =ATP synthase mitochondrial (22.4 kD) (1F996) [Caenorhabditis elegans] gb|AAB37654.1| Hypothetical protein
  Gene Ontology: Cellular component=mitochondrion; Biological process =growth
  Essential gene: C elegans homolog=F27C1.7a; Phenotype=Emb,Lva
  Coding regions on vcDNA: vcDNA=SeqID_49596; Strand=+; Position=1-486
INLKASMLIKRAFSFSSRALQQHSVVRPPVQVTGIEGKYASALYSSGIKEEKLENIEKEVRQVKELYDPTKXLSPFMTPQSEISKKKGGLXDVLKKQASHHRFKNSFGLLAENGRNHKMNXVVSPLEXIKARHRGEILLKNSSGEXLDKKNKKTLKHPLVKI

SEQ ID NO: 123174 - protein, 134 aa, Heterodera glycines
  misc_feature (72)..(72): Xaa can be any naturally occurring amino acid
  misc_feature (81)..(81): Xaa can be any naturally occurring amino acid
  Homolog annotation: Hit_ID=CAE57015.1; Match level="QueryCoverage =99%, HitCoverage=33%, E-value=2e-17, Identity=35%"; Hit description =Hypothetical protein CBG24890 [Caenorhabditis briggsae]
  Essential gene: C elegans homolog=Y44F5A.1; Phenotype=Gro,Pvl,Stp
  Coding regions on vcDNA: vcDNA=SeqID_49597; Strand=+; Position=2-403
RSVRAMQISDDGTSFYATMSNRAACLYDVETAKRVRCILEGHIKSGPSVMALLPGERPHFATGAENGEIKAXTLDSPSRTXHTFGKQADIINAMHIWRKNMLAASGNSTLDGYDTHKGKVRIQSETMHRELLSL

SEQ ID NO: 123175 - protein, 143 aa, Heterodera glycines
  Homolog annotation: Hit_ID=CAG04432.1; Match level="QueryCoverage =68%, HitCoverage=86%, E-value=4e-14, Identity=43%"; Hit description =unnamed protein product [Tetraodon nigroviridis]
  Gene Ontology: Mol. function=apoptosis inhibitor activity; Cellular component=cytoplasm; Biological process=embryogenesis and morphogenesis
  Essential gene: C elegans homolog=C50B8.2; Phenotype=Emb
  Coding regions on vcDNA: vcDNA=SeqID_49598; Strand=+; Position=11-442
MIDRNSPLHMFVFANRLATFEGRWNYKEGCTAEKMARAGFFCTEKRKKPSDAAKCYICLHEMYWDPEDEPWLFQEEHKKHRPDCPLVTIGKQNEEEFTVREVLLLLAYEHSTKMYPVADASMKELDVLMKQLLADTQKAVEGI

SEQ ID NO: 123176 - protein, 151 aa, Heterodera glycines
  misc_feature (17)..(17): Xaa can be any naturally occurring amino acid
  misc_feature (114)..(114): Xaa can be any naturally occurring amino acid
  Homolog annotation: Hit_ID=CAB88203.1; Match level="QueryCoverage =100%, HitCoverage=50%, E-value=7e-60, Identity=71%"; Hit description= putative cuticular collagen [Globodera pallida]
  Gene Ontology: Cellular component=extracellular space; Biological process=positive regulation of body size
  Essential gene: C elegans homolog=C29E4.1; Phenotype=Dpy
  Coding regions on vcDNA: vcDNA=SeqID_49599; Strand=+; Position=6-458
MQQTHIILGIASVCSLXAIIATAVTLPSQPSDMSQMDSKVHHGVEAFRVNTDSTCTDLMDVQVVVTPPSKPLDNPFNSIFRAKPQLPGHCHCAGLQQPSCPPGPPGPSGPPGTXGQPEGAGQPGHAEQAGQPAPPCPPQNIPWPPCPAGPP

SEQ ID NO: 123177 - protein, 146 aa, Heterodera glycines
  Homolog annotation: Hit_ID=XP_395236.1; Match level="QueryCoverage =95%, HitCoverage=13%, E-value=6e-48, Identity=71%"; Hit description =similar to ENSANGP00000022750 [Apis mellifera]
  Gene Ontology: Mol. function=kinesin motor activity; Cellular component=kinesin complex; Biological process=microtubule-based movement
  Essential gene: C elegans homolog=R05D3.7; Phenotype=Dpy,Gro,Rup,Unc
  Coding regions on vcDNA: vcDNA=SeqID_49600; Strand=+; Position=3-440
QTLHNLRKVFVQDLAQRMKKTPTGPEGDEEFLSSPIQKQKIIFLENNLEQLTSVHKQLVRDNAELRCELPKLEKRYRASSERIKSLEVALRETKENAMKDRKKYQYEMERIKEAVRQRNLARRGLQIAKPIRPGQHYGTARPVNAS

SEQ ID NO: 123178 - protein, 81 aa, Heterodera glycines
  Homolog annotation: Hit_ID=NP_594413.1; Match level="QueryCoverage =100%, HitCoverage=28%, E-value=8e-15, Identity=50%"; Hit description= 40s ribosomal protein s0B [Schizosaccharomyces pombe] emb|CAB92099.1| rpsa-2 [Schizosaccharomyces pombe]
  Gene Ontology: Mol. function=laminin receptor activity; Cellular component=eukaryotic 48S initiation complex; Biological process =protein biosynthesis
  Essential gene: C elegans homolog=B0393.1; Phenotype=Emb,Ste
  Coding regions on vcDNA: vcDNA=SeqID_49601; Strand=+; Position=2-244
TDDDSMKFLVCKSRIMTKKMYYHMQHYVWKRRSDSVHIINIPNTSNKLMFAARAIAAIENPSDDWDVSAQTDAQMAVLKFA

SEQ ID NO: 123179 - protein, 196 aa, Heterodera glycines
  misc_feature (19)..(19): Xaa can be any naturally occurring amino acid
  misc_feature (110)..(110): Xaa can be any naturally occurring amino acid
  misc_feature (122)..(122): Xaa can be any naturally occurring amino acid
  misc_feature (136)..(136): Xaa can be any naturally occurring amino acid
  Homolog annotation: Hit_ID=NP_498349.1; Match level="QueryCoverage =100%, HitCoverage=79%, E-value=7e-71, Identity=66%"; Hit description= ribosomal Protein, Small subunit (27.3 kD) (rps-3) [Caenorhabditis elegans] gb|AAF99870.1| Ribosomal pro
  Gene Ontology: Mol. function=structural constituent of ribosome; Cellular component=cytosolic small ribosomal subunit (sensu Eukarya); Biological process=protein biosynthesis
  Essential gene: C elegans homolog=C23G10.3; Phenotype=Emb
  Coding regions on vcDNA: vcDNA=SeqID_49602; Strand=+; Position=2-589
AQQQAITNKRKAVQDGIFXAELNNFLMKELAEDGYSGVKWRRAPSRTEVIIMATHTQSVLSERGKRIRELTALVQKRFGYSAGQIELYAEKVSSRGLCAVAQCETLHYKXVGGLAVRTASYXALRFVIESNARGCXIVVSGKMRGQRGSAMKLVDGGLIHSGNPVTEYIREGGRHLQMRHGVLDIKAKIMLSHDPK

SEQ ID NO: 123180 - protein, 101 aa, Heterodera glycines
  misc_feature (81)..(81): Xaa can be any naturally occurring amino acid
  Homolog annotation: Hit_ID=NP_492601.1; Match level="QueryCoverage =100%, HitCoverage=76%, E-value=2e-23, Identity=47%"; Hit description= cytochrome C Oxidase, subunit Vb, LiPid Depleted LPD-4 (lpd-4) [Caenorhabditis elegans] emb|CAB03002.1|
  Gene Ontology: Biological process=negative regulation of FGF receptor signaling pathway
  Essential gene: C elegans homolog=F26E4.9; Phenotype=Lpd
  Coding regions on vcDNA: vcDNA=SeqID_49603; Strand=+; Position=2-304
DADPDDYGYFPDPFEHSCGLERKMLIARVNGDDRYEPNVSFCSEHTTQDYPNLLPVALQDEHLPWLCGADSHYANYCAFKXSLMKRSYCGHWLKGVQADPD

SEQ ID NO: 123181 - protein, 209 aa, Heterodera glycines
  Homolog annotation: Hit_ID=CAE67200.1; Match level="QueryCoverage =76%, HitCoverage=25%, E-value=2e-33, Identity=43%"; Hit description =Hypothetical protein CBG12636 [Caenorhabditis briggsae]
  Gene Ontology: Mol. function=protein tyrosine phosphatase activity; Cellular component=mitotic chromosome; Biological process=meiotic spindle assembly
  Essential gene: C elegans homolog=F16B4.8; Phenotype=Bmd,Emb,Lvl
  Coding regions on vcDNA: vcDNA=SeqID_49604; Strand=+; Position=4-630
MESYVQVEDQDSRDSGISLAQSTTSQQSCFAKIYFPTLFDFGFKVRELYSLDTVERPQVPHKAFRSINADTMANLLGFLTEEQFQRRFILIDCRYPYEYDAGHIWYSLNLWETTSIEKLFYPEEEERFGEIIVRTPIFYCEYSQKRGPKMALALREFDRVRNESRYPYVDYKEIYLLDRGYRYFFKERKFGKYCTPQAYVQMWDSAYTE

SEQ ID NO: 123182 - protein, 201 aa, Heterodera glycines
  misc_feature (56)..(56): Xaa can be any naturally occurring amino acid
  misc_feature (72)..(72): Xaa can be any naturally occurring amino acid
  misc_feature (106)..(106): Xaa can be any naturally occurring amino acid
  Homolog annotation: Hit_ID=NP_498047.1; Match level="QueryCoverage =88%, HitCoverage=14%, E-value=2e-59, Identity=65%"; Hit description =RNA polymerase II subunit (3G33) [Caenorhabditis elegans] gb|AAA21158.1| Hypothetical protein C26E6.4 [Ca
  Gene Ontology: Mol. function=DNA-directed RNA polymerase activity; Cellular component=DNA-directed RNA polymerase II, core complex; Biological process=transcription from Pol II promoter
  Essential gene: C elegans homolog=C26E6.4; Phenotype=Emb
  Coding regions on vcDNA: vcDNA=SeqID_49605; Strand=+; Position=2-604
KIALPEVEDEWEASTTRYSKKDASTTLRSNETGVGDHVMANVNAKGNRFYKILVRXIQRPQIGDKFASRLGXKGTMVMMYTQKDMPFTCEGITSDIIINTHAVPSXMTIGHLIECLQGKLSDNKGENGDATPFNDPVNVQKISALLEGYGYPLRGYEIMYHEFTGAKVEHPGGFWGPTLLPTGLRHHGRRTKILLRRRPEG

SEQ ID NO: 123183 - protein, 178 aa, Heterodera glycines
  misc_feature (43)..(43): Xaa can be any naturally occurring amino acid
  misc_feature (61)..(61): Xaa can be any naturally occurring amino acid
  Homolog annotation: Hit_ID=NP_508413.1; Match level="QueryCoverage =99%, HitCoverage=89%, E-value=3e-63, Identity=67%"; Hit description =ribosomal Protein, Large subunit (22.8 kD) (rpl-11.2) [Caenorhabditis elegans] gb|AAA83599.1| Ribosomal p
  Gene Ontology: Mol. function=structural constituent of ribosome; Cellular component=mitochondrion; Biological process=protein biosynthesis
  Essential gene: C elegans homolog=F07D10.1; Phenotype=Lva
  Coding regions on vcDNA: vcDNA=SeqID_49606; Strand=+; Position=2-535
DKKLGNPMSGVKIRKLCLNICVRESGDRLTPAAKVLPTIDLAXTSALLSKARYTVRSPGIXRNELFSVYCTVRAPEPEEIIDRGLKAKEYELYRENFSDTGNFGFGIQEHINLGIKYDPSIGIYSMDFYVVLGRAGLRVAKRPRIQGRIAASPPVQNEEAVKWIQQKYDCVILPPKPN

SEQ ID NO: 123184 - protein, 123 aa, Heterodera glycines
  Homolog annotation: Hit_ID=CAG10389.1; Match level="QueryCoverage =100%, HitCoverage=7%, E-value=4e-18, Identity=43%"; Hit description =unnamed protein product [Tetraodon nigroviridis]
  Essential gene: C elegans homolog=Y80D3A.2; Phenotype=Bmd
  Coding regions on vcDNA: vcDNA=SeqID_49607; Strand=+; Position=2-521
VNFVLAERQRLLEQVELLREAVDETGDVSYSCETAGYFFRYTVCKTWEYFMEQVQTMQKQHQQNALPKEFVAEHFPFSKFFENRRHQSNLLPLKFELRDFEEDLTIALDGWERIKDIFKKLEE

SEQ ID NO: 123185 - protein, 92 aa, Heterodera glycines
  Homolog annotation: Hit_ID=AAH70716.1; Match level="QueryCoverage =81%, HitCoverage=24%, E-value=3e-16, Identity=42%"; Hit description =LOC397826 protein [Xenopus laevis] dbj|BAA96456.1| paxillin [Xenopus laevis]
  Gene Ontology: Mol. function=protein binding; Cellular component =focal adhesion; Biological process=cell adhesion
  Essential gene: C elegans homolog=C28H8.6a; Phenotype=Lva
  Coding regions on vcDNA: vcDNA=SeqID_49608; Strand=+; Position=2-277
CASRNQAVIGPVVIAHAKMWHPEHFCCTHCGDSIDNRNFFQRQRKAYCANDYRDLLSTHCSYCTQPLKEHCATPLGGKEFSRGSILDCTECD

SEQ ID NO: 123186 - protein, 124 aa, Heterodera glycines
  Homolog annotation: Hit_ID=NP_501727.1; Match level="QueryCoverage =96%, HitCoverage=38%, E-value=6e-43, Identity=72%"; Hit description =adenine nucleotide family member (4K472) [Caenorhabditis elegans] emb|CAA92472.1| Hypothetical protein K0
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_49609; Strand=+; Position=2-373
NTSGGFSTNKFLLDLESRGTAAALSKTADAPIECVKMLLQAPDASIHITADKRYKGIIDVLNRDPKEHGFLSSWRGNLANVIRYFPTHALNFAFQDTYKRVFSQGLDKEKQFLKFFPLNLASGG

SEQ ID NO: 123187 - protein, 98 aa, Heterodera glycines
  misc_feature (79)..(79): Xaa can be any naturally occurring amino acid
  Homolog annotation: Hit_ID=NP_595618.1; Match level="QueryCoverage =100%, HitCoverage=26%, E-value=2e-16, Identity=46%"; Hit description= actin [Schizosaccharomyces pombe] emb|CAA68501.1| unnamed protein product [Schizosaccharomyces pombe] em
  Gene Ontology: Cellular component=actin filament; Biological process =cytoskeleton organization and biogenesis
  Essential gene: C elegans homolog=T25C8.2; Phenotype=Unclassified
  Coding regions on vcDNA: vcDNA=SeqID_49610; Strand=+; Position=2-298
LLSDSAMGMGCARFASHDTTRPALPFLAVRPPPHVVVAWMGWNDSNLTYETQSKPGILTLNYPIEFSIVSYWDDMKKIXYRTFYYKMSCAPHEKTALL

SEQ ID NO: 123188 - protein, 188 aa, Heterodera glycines
  misc_feature (43)..(43): Xaa can be any naturally occurring amino acid
  misc_feature (122)..(122): Xaa can be any naturally occurring amino acid
  Homolog annotation: Hit_ID=AAT70232.1; Match level="QueryCoverage =99%, HitCoverage=89%, E-value=4e-76, Identity=63%"; Hit description =unc-87 [Heterodera glycines]
  Essential gene: C elegans homolog=F08B6.4a; Phenotype=Unc
  Coding regions on vcDNA: vcDNA=SeqID_49611; Strand=+; Position=2-565
RPTTTMETKVAGCGAVPKLVRCWTVSLLRQTDGIIPSHAGWNXGDSQKLMTNFGTPRFFFTKGKVENLAEIPEDILLKSHGEVRLQSGTNRFASQKGFVSFCTKRDVCPEGVNVNILPVDLXPLPEDNIRASDRIVRLQAGTTQFDSQNGMTLFGTRRPETTTMSDNQNREVSHELQFDKTEIPLQIG

SEQ ID NO: 123189 - protein, 105 aa, Heterodera glycines
  misc_feature (67)..(67): Xaa can be any naturally occurring amino acid
  misc_feature (86)..(86): Xaa can be any naturally occurring amino acid
  Homolog annotation: Hit_ID=AAD43790.1; Match level="QueryCoverage =100%, HitCoverage=54%, E-value=7e-44, Identity=77%"; Hit description= CDC42 protein [Drosophila melanogaster]
  Gene Ontology: Mol. function=signal transducer activity; Cellular component=shmoo tip; Biological process=signal transduction
  Essential gene: C elegans homolog=R07G3.1; Phenotype=Emb
  Coding regions on vcDNA: vcDNA=SeqID_49612; Strand=+; Position=23-337
GKTCLLISYTINKFPNQYVPTVIHNYAVTVMIRGEPYTLGLFDTEGHEDYDRLRPISYPQTDVFLIXISLVTPASFENIKKKWVPXITQHCSKTPFLLGETPMDL

SEQ ID NO: 123190 - protein, 97 aa, Heterodera glycines
  misc_feature (25)..(25): Xaa can be any naturally occurring amino acid
  misc_feature (34)..(34): Xaa can be any naturally occurring amino acid
  Homolog annotation: Hit_ID=CAE56899.1; Match level="QueryCoverage =89%, HitCoverage=22%, E-value=4e-14, Identity=44%"; Hit description =Hypothetical protein CBG24740 [Caenorhabditis briggsae]
  Essential gene: C elegans homolog=T02G5.7; Phenotype=Bmd,Unc
  Coding regions on vcDNA: vcDNA=SeqID_49613; Strand=+; Position=5-295
MTGCSTNVSGQNESHQIAIKSGIPXARQAYTVNXECSSSLKALILCNQSWQLGQRYMVLVVGVESMNQAPFYLARGDDNYRDIKLLDSVRLNGISEP

SEQ ID NO: 123191 - protein, 157 aa, Heterodera glycines
  Homolog annotation: Hit_ID=CAE66385.1; Match level="QueryCoverage =78%, HitCoverage=14%, E-value=6e-25, Identity=39%"; Hit description =Hypothetical protein CBG11647 [Caenorhabditis briggsae]
  Gene Ontology: Mol. function=zinc ion binding; Cellular component =nucleus; Biological process=Wnt receptor signaling pathway
  Essential gene: C elegans homolog=R11E3.6; Phenotype=Let
  Coding regions on vcDNA: vcDNA=SeqID_49614; Strand=+; Position=4-474
MGSEQNDAATKDERAVSLAASHNQFLNCPHCSFQTRRGPLHLKRHEAVVHSRNVLYVCNVCQFECRWNREFYEHMRRLHFPGPPYSCDSCTYDVDRLTVLLTHRLTHTDEKPFKCSECTFRTRNRANLVVHHRLHTGEKPFQCEICGKRFVLKRTLE

SEQ ID NO: 123192 - protein, 210 aa, Heterodera glycines
  misc_feature (178)..(178): Xaa can be any naturally occurring amino acid
  Homolog annotation: Hit_ID=NP_505933.1; Match level="QueryCoverage =93%, HitCoverage=21%, E-value=2e-23, Identity=32%"; Hit description =post Meiotic Segregation related (pms-2) [Caenorhabditis elegans] emb|CAA98478.1| Hypothetical protein H1
  Gene Ontology: Mol. function=DNA binding; Cellular component=nucleus; Biological process=mismatch repair
  Essential gene: C elegans homolog=H12C20.2a; Phenotype=Emb
  Coding regions on vcDNA: vcDNA=SeqID_49615; Strand=+; Position=9-638
MTQQFIYDEEHDEFGDEIDDNDDEAATALSSSSSFRPQQIVHVDMDVLRTNFAHRCEQQRRQRREHNNLLRQSCGGNDDGGTRLHVVTTSAGIMSSGSQEEEREEDNASVEQRLSMMLNKADFARMRLIGQFNNAFLIVRLRSDVFIIDQHAADEKYNFERLLAHNVIKSQTLIRPKXLRLGNVNAALMRDNLHVFPAHGFDFQSYNGSD

SEQ ID NO: 123193 - protein, 102 aa, Heterodera glycines
  Homolog annotation: Hit_ID=NP_502187.1; Match level="QueryCoverage =92%, HitCoverage=26%, E-value=2e-22, Identity=56%"; Hit description =rag protein (4M368) [Caenorhabditis elegans] emb|CAB60290.1| Hypothetical protein Y24F12A.2 [Caenorhabdit
  Gene Ontology: Biological process=signal transduction
  Essential gene: C elegans homolog=Y24F12A.2; Phenotype=Emb
  Coding regions on vcDNA: vcDNA=SeqID_49616; Strand=+; Position=3-311
YELCCDMIDVTIDISSIYGHRNEQKNFRPIGFDQDSSAVITLRTRQVIFLRQINVYLALVCVIKEDNFEKQGLIDFNFNVFKQGVEDVFELGKRRLPSLAVG

SEQ ID NO: 123194 - protein, 182 aa, Heterodera glycines
  Homolog annotation: Hit_ID=CAE57068.1; Match level="QueryCoverage =96%, HitCoverage=60%, E-value=3e-30, Identity=40%"; Hit description =Hypothetical protein CBG24962 [Caenorhabditis briggsae]
  Gene Ontology: Biological process=positive regulation of growth rate
  Essential gene: C elegans homolog=ZK265.5; Phenotype=Lva
  Coding regions on vcDNA: vcDNA=SeqID_49617; Strand=+; Position=3-551
LLHHESKLKAGFDLFRLLVATALWYTFTNCFVKFELHTGKCHGSVESARVNCYENGGKWIPGFDISGHAFLLIYSILIICEESTSFQNWPSKPRVTIHHVPSRKEFELFQRNTKIIQWLFVSLMLLHLLWDLQLLITSLYYHEFWQKLIGASIGVFSWFVTYRFWFVVGFPFLPIRRHIKSF

SEQ ID NO: 123195 - protein, 113 aa, Heterodera glycines
  Homolog annotation: Hit_ID=NP_495899.1; Match level="QueryCoverage =92%, HitCoverage=35%, E-value=5e-31, Identity=58%"; Hit description =mitochondrial ribosomal protein L50 like (32.9 kD) (2J221) [Caenorhabditis elegans] emb|CAA92691.1| Hypot
  Essential gene: C elegans homolog=T21B10.1; Phenotype=Lva
  Coding regions on vcDNA: vcDNA=SeqID_49618; Strand=+; Position=1-342
NITKYAEMARSCGDQMPKNLAIMEHQRRFHPNDKTAPHGGITAFPGEGGKVLGLRNKRLLREYRPKKHWYEFEDVVFDYDVNCSKGMPWDPEVAKRMDSYTEVKFVKDHLKKY

SEQ ID NO: 123196 - protein, 148 aa, Heterodera glycines
  misc_feature (12)..(12): Xaa can be any naturally occurring amino acid
  misc_feature (56)..(56): Xaa can be any naturally occurring amino acid
  misc_feature (87)..(87): Xaa can be any naturally occurring amino acid
  misc_feature (111)..(111): Xaa can be any naturally occurring amino acid
  misc_feature (117)..(117): Xaa can be any naturally occurring amino acid
  Homolog annotation: Hit_ID=NP_608425.1; Match level="QueryCoverage =100%, HitCoverage=20%, E-value=8e-61, Identity=75%"; Hit description= CG1518-PA [Drosophila melanogaster] gb|AAF50861.1| CG1518-PA [Drosophila melanogaster]
  Gene Ontology: Mol. function=dolichyl-diphospho-oligosaccharide -protein glycosyltransferase activity; Cellular component=integral to plasma membrane; Biological process=N-linked glycosylation
  Essential gene: C elegans homolog=T12A2.2; Phenotype=Emb
  Coding regions on vcDNA: vcDNA=SeqID_49619; Strand=+; Position=3-441
NTPDDAKVMSWXWDYGYQISAMANRTTIVDNNTWNNTHISRVGQAMASNESHAYEXMHELDVDYVLVIFGGVTGYSSDDINKFLWMXVRIGGSTPEGRHIHENDYYTKNGXEFALTXRGSSTMLNCLMYKLCYHRFGTVYTEHGRATG

SEQ ID NO: 123197 - protein, 150 aa, Heterodera glycines
  Homolog annotation: Hit_ID=XP_392645.1; Match level="QueryCoverage =100%, HitCoverage=100%, E-value=2e-29, Identity=45%"; Hit description=similar to ENSANGP00000023074 [Apis mellifera]
  Gene Ontology: Mol. function=nucleic acid binding; Cellular component= nucleus
  Essential gene: C elegans homolog=R05D11.7; Phenotype=Egl,Gro
  Coding regions on vcDNA: vcDNA=SeqID_49620; Strand=+; Position=29-481
MAYSRSPSPNRERSHRSTRKRSRDRSNERRHKAPRSSHKERHRDRDRRGDRDRDRDRERERHSSGGDKNREHRSKKKDNVAHATKSNPINEIVDVDEDMMRMMGFSNFDTTKNKHVEGNASGESKINRARKYRQYMNRRGGFNRPLDYVA

SEQ ID NO: 123198 - protein, 206 aa, Heterodera glycines
  Homolog annotation: Hit_ID=NP_492363.1; Match level="QueryCoverage =100%, HitCoverage=41%, E-value=7e-81, Identity=63%"; Hit description= pre-mRNA factor (55.9 kD) (1J310) [Caenorhabditis elegans] emb|CAB02270.1| Hypothetical protein C36B1.5
  Gene Ontology: Mol. function=pre-mRNA splicing factor activity; Cellular component=small nuclear ribonucleoprotein complex; Biological process=mRNA splicing
  Essential gene: C elegans homolog=C36B1.5; Phenotype=Emb,Lva
  Coding regions on vcDNA: vcDNA=SeqID_49621; Strand=+; Position=3-620
EEPLARLERHEDRVPRVAFHPSGHFLATACFDSSWRLFDLETLQELLYQEGHSKSVFDLDFHADGSLMLTGGLDCYGRVWDLRTGRCIMFLEGHQKGIHTVCWHQNGFLMVTGSADNTCKVWDVRMRRQLYTMPAHQNLVSRVRMDPSGEFLVTGSYDNTMKLWTCQGWQPLRVFDAHNMKVTCVDVSPDENWIVSACYDRTFKLW

SEQ ID NO: 123199 - protein, 213 aa, Heterodera glycines
  Homolog annotation: Hit_ID=NP_496966.1; Match level="QueryCoverage =95%, HitCoverage=55%, E-value=1e-47, Identity=43%"; Hit description =mevalonate decarboxylase (41.5 kD) (2O512) [Caenorhabditis elegans] emb|CAB54454.1| Hypothetical protein
  Gene Ontology: Mol. function=diphosphomevalonate decarboxylase activity; Cellular component=cytosol; Biological process =embryogenesis and morphogenesis
  Essential gene: C elegans homolog=Y48B6A.13a; Phenotype=Emb,Sck
  Coding regions on vcDNA: vcDNA=SeqID_49622; Strand=+; Position=1-639
MNRGGGFHITIQAPVNIALIKYWGKRNEELVLPLNDSIAITIDELSATTHITIGPDVSTDSVTLNGVGIDIAGSSRFRNVFQQIREYSNRKRKLKGEHASKGWHTKIESSTNFPTSAGLASSAAGFAAIAFGLGKIFRLPERDIVRMARMGSGSACRSIQGGFVHWKAGTHQQNDSDCLCEKLAPTAHWPQLRALVIVVSSGHKKVGSSVGMR

SEQ ID NO: 123200 - protein, 128 aa, Heterodera glycines
  misc_feature (63)..(63): Xaa can be any naturally occurring amino acid
  misc_feature (106)..(106): Xaa can be any naturally occurring amino acid
  Homolog annotation: Hit_ID=NP_496447.1; Match level="QueryCoverage =97%, HitCoverage=40%, E-value=2e-22, Identity=41%"; Hit description =mitochondrial solute carrier (34.1 kD) (2L760) [Caenorhabditis elegans] emb|CAA91399.1| Hypothetical prot
  Gene Ontology: Biological process=embryogenesis and morphogenesis
  Essential gene: C elegans homolog=W02B12.9; Phenotype=Emb
  Coding regions on vcDNA: vcDNA=SeqID_49623; Strand=+; Position=2-388
MFPQDGDRPHLQSLRPCPEYTGATPIHGVGSMCRTEGYWQTVHGVQGLAVGSMPAHDLYFPDXMEFMSSLTGKPHGHTNALSYSSAGMAATVDHDIAMTSAEEAQXRKQMLYESVGGSLDRVRSICQK

SEQ ID NO: 123201 - protein, 116 aa, Heterodera glycines
  misc_feature (38)..(38): Xaa can be any naturally occurring amino acid
  misc_feature (56)..(56): Xaa can be any naturally occurring amino acid
  Homolog annotation: Hit_ID=NP_492761.1; Match level="QueryCoverage =99%, HitCoverage=75%, E-value=3e-35, Identity=61%"; Hit description =nucleoside diphosphate kinase (1L130) [Caenorhabditis elegans] emb|CAB02101.1| Hypothetical protein F25H2
  Gene Ontology: Mol. function=ATP binding; Cellular component=nucleus; Biological process=negative regulation of cell proliferation
  Essential gene: C elegans homolog=F25H2.5; Phenotype=Pvl,Stp
  Coding regions on vcDNA: vcDNA=SeqID_49624; Strand=+; Position=2-349
VKPDLVHRGLGAKIIRRFKHRGYKLAALRVAQATVPHXEVLFRDLKDKPFFAGLVXFMASGPIVTMDWECLYVVKQGRGLLGATNPMVFVLGSIRGNFCIEMGRNICHGSDLVASG

SEQ ID NO: 123202 - protein, 98 aa, Heterodera glycines
  Homolog annotation: Hit_ID=CAA48558.1; Match level="QueryCoverage =100%, HitCoverage=36%, E-value=7e-25, Identity=57%"; Hit description= KRP-A [Aplysia californica] pir||S43541 ribosomal protein S3a, cytosolic - California sea hare sp|P49395|
  Gene Ontology: Mol. function=structural constituent of ribosome; Cellular component=cytosolic small ribosomal subunit (sensu Eukarya); Biological process=protein biosynthesis
  Essential gene: C elegans homolog=F56F3.5; Phenotype=Emb,Ste
  Coding regions on vcDNA: vcDNA=SeqID_49625; Strand=+; Position=23-316
SFNLGKLCSIVKKWHTLVEGNVAQNTTDGFLLQLFGIGFTKPNADKIKKTTYAKTSQELMIPANVVVIMKKEVSSRDLKDAVNKLIADSIGKDIEKEC

SEQ ID NO: 123203 - protein, 194 aa, Heterodera glycines
  Homolog annotation: Hit_ID=CAE56377.1; Match level="QueryCoverage =91%, HitCoverage=19%, E-value=3e-38, Identity=42%"; Hit description =Hypothetical protein CBG24054 [Caenorhabditis briggsae]
  Essential gene: C elegans homolog=C33D9.1a; Phenotype=Unc
  Coding regions on vcDNA: vcDNA=SeqID_49626; Strand=+; Position=3-584
ARLWKCTAASASGSTKTEERWLFVFNDLLLLASDRSAFIRGTTGAGKCKLRAIFAAKHTQICEGDSLEREHSFYLRGSDSPQGPQRCVELCCASQAEKDALFDIVWKVIHQETNSKNSAETLAKNTNNNSSNTEQQQQNKSCAHCDTDFGWYTRPLVCQRCQQRFCKRCFGQRRKEQKMCLDCLRTAEGYRSFS

SEQ ID NO: 123204 - protein, 91 aa, Heterodera glycines
  misc_feature (42)..(42): Xaa can be any naturally occurring amino acid
  Homolog annotation: Hit_ID=CAE65142.1; Match level="QueryCoverage =96%, HitCoverage=44%, E-value=3e-14, Identity=44%"; Hit description =Hypothetical protein CBG10008 [Caenorhabditis briggsae]
  Gene Ontology: Mol. function=translation initiation factor activity; Cellular component=ribosome; Biological process=translational initiation
  Essential gene: C elegans homolog=T05G5.10; Phenotype=Emb
  Coding regions on vcDNA: vcDNA=SeqID_49627; Strand=+; Position=2-277
TYVNMITSDNEKTRHALAHLDFLDIFPLQTMHTICPGTPHLXLPLFDRDEYQLLSTHQDCFIYLMDLHTCDTKDDLHLPEGEIGDQIIQAY

SEQ ID NO: 123205 - protein, 100 aa, Heterodera glycines
  Homolog annotation: Hit_ID=CAE70201.1; Match level="QueryCoverage =92%, HitCoverage=54%, E-value=9e-20, Identity=50%"; Hit description =Hypothetical protein CBG16676 [Caenorhabditis briggsae]
  Essential gene: C elegans homolog=D2007.4; Phenotype=Lva
  Coding regions on vcDNA: vcDNA=SeqID_49628; Strand=+; Position=2-301
VRFLQRFVNNNPRNLERVRLQGKPSGWEFEKNRAQHNFIYRVDFCPTKNAIAARVVHYQDGIVIEASTREKTGQSQLYSQTDVSAAYNIGRTVGSSMQNG

SEQ ID NO: 123206 - protein, 92 aa, Heterodera glycines
  Essential gene: C elegans homolog=F22D6.4; Phenotype=Gro
  Coding regions on vcDNA: vcDNA=SeqID_49629; Strand=+; Position=16-291
MFSSSKSAAVLRMRGATGAMARRWKGGDEQKNVPVPSPKEMAQRPAEFDELTHTGQAWDIFYWRRSRFEYMPKQVNPSIAAHLIAELAPVPS

SEQ ID NO: 123207 - protein, 126 aa, Heterodera glycines
  Homolog annotation: Hit_ID=NP_496488.1; Match level="QueryCoverage =82%, HitCoverage=29%, E-value=4e-12, Identity=36%"; Hit description =protein RAD23 repair 23 (2L942) [Caenorhabditis elegans] emb|CAA93780.1| Hypothetical protein ZK20.3 [Cae
  Gene Ontology: Cellular component=nucleotide excision repair complex; Biological process=reproduction
  Essential gene: C elegans homolog=ZK20.3; Phenotype=Sck,Ste
  Coding regions on vcDNA: vcDNA=SeqID_49630; Strand=+; Position=49-426
MPELLFKTITQQSFTIEVEETATIGEVKRKIQQVKGAEYPAENQKLIFFVRMLEDAMLVSELNFAAPKFIVIMVMRKPAQASSTVRSATSSASPQKNTSTADGQAPKSAENKATGATSNTSVAQPG

SEQ ID NO: 123208 - protein, 137 aa, Heterodera glycines
  misc_feature (53)..(53): Xaa can be any naturally occurring amino acid
  misc_feature (96)..(96): Xaa can be any naturally occurring amino acid
  Homolog annotation: Hit_ID=CAE65023.1; Match level="QueryCoverage =81%, HitCoverage=45%, E-value=1e-20, Identity=46%"; Hit description =Hypothetical protein CBG09861 [Caenorhabditis briggsae]
  Essential gene: C elegans homolog=F59A2.3; Phenotype=Rup
  Coding regions on vcDNA: vcDNA=SeqID_49631; Strand=+; Position=5-415
MARTATEYGHRAFSTSGAAQELSSALDEEIKAEKELLQDKLGGTSAPSVPGFXITTKGAEVRLSKTHGNQKIGVILNENHSIDIEEDEEYEDQPQXEMETESVSVSLPRFALNITKNNQSMLFDLEMAKTEDGGFNF

SEQ ID NO: 123209 - protein, 195 aa, Heterodera glycines
  Homolog annotation: Hit_ID=NP_501789.1; Match level="QueryCoverage =81%, HitCoverage=57%, E-value=2e-27, Identity=39%"; Hit description =RNaseIII (4K696) [Caenorhabditis elegans] emb|CAA93284.1| Hypothetical protein F25H8.1 [Caenorhabditis el
  Gene Ontology: Mol. function=tRNA (guanine) methyltransferase activity; Biological process=tRNA modification
  Essential gene: C elegans homolog=F25H8.1; Phenotype=Unclassified
  Coding regions on vcDNA: vcDNA=SeqID_49632; Strand=+; Position=26-610
MSSSNTILLDCSDDSGVVVGFEQCATSEGGGAAEPQQKLTKNQQKKRARMERFNAGKAEWRRKQRERHKERKRARKADGQTAKMNESKCRVRVAVDMAYDDLMDERSVRKTVSQLRHCYASNRRAADPLQFYVVNLDEKAKKVLDGITGWQQWDVHLLAQPLAKLWDDREIVYLTADSENVLSALDEQKVYVIGG

SEQ ID NO: 123210 - protein, 177 aa, Heterodera glycines
  Homolog annotation: Hit_ID=CAE56867.1; Match level="QueryCoverage =61%, HitCoverage=46%, E-value=4e-29, Identity=59%"; Hit description =Hypothetical protein CBG24700 [Caenorhabditis briggsae]
  Gene Ontology: Mol. function=protein binding; Cellular component =mitochondrion; Biological process=growth
  Essential gene: C elegans homolog=R10H10.1; Phenotype=Lpd
  Coding regions on vcDNA: vcDNA=SeqID_49633; Strand=+; Position=24-554
MFKFRAVLSNLSLCCSSSLLQIQRHFVTASILRKCPSSTKQFANAHRCISRTRSLFMFIQVQETPNPLSLKFLPGQKVLSEPGRTYEFTSARDAAKSSPLARQLLRIEGVRSVFFGEDFISIQKQSVEEEWALLKPHIFAAIMDHLQSGKPVVVVTGADAEAAEANAQPTDTTILPE

SEQ ID NO: 123211 - protein, 187 aa, Heterodera glycines
  Homolog annotation: Hit_ID=CAE71253.1; Match level="QueryCoverage =95%, HitCoverage=23%, E-value=1e-41, Identity=49%"; Hit description =Hypothetical protein CBG18133 [Caenorhabditis briggsae]
  Gene Ontology: Mol. function=ATP binding; Cellular component=nucleus; Biological process=protein folding
  Essential gene: C elegans homolog=C30C11.4; Phenotype=Bmd,Gro
  Coding regions on vcDNA: vcDNA=SeqID_49634; Strand=+; Position=1-561
TRIDFGNLTCYMAVARNKGIEIVENDYSLHATPSCVSFGQFARMMGLGAKQQLNINYGNSVVNFKHILGRTFNDKVVQTFRQHIPCGLMGKFTDDQIEIKVTHLGTTRVLSPEQVVACLLTHLRVQLSCSLGTDVTECVINVPFFYEENQRRALLNAGRIAGLSLRLITDPAALAYCYGMYNGANLP

SEQ ID NO: 123212 - protein, 193 aa, Heterodera glycines
  Homolog annotation: Hit_ID=NP_497274.1; Match level="QueryCoverage =99%, HitCoverage=27%, E-value=1e-79, Identity=74%"; Hit description =solute carrier family 25 member 13 (3B467) [Caenorhabditis elegans] gb|AAK21421.1| Hypothetical protein K
  Gene Ontology: Mol. function=solute:cation symporter activity; Cellular component=integral to plasma membrane; Biological process =transport
  Essential gene: C elegans homolog=K02F3.2; Phenotype=Ste
  Coding regions on vcDNA: vcDNA=SeqID_49635; Strand=+; Position=3-581
EVKIRLQTAGEIINGPKVNVFTVLRELGFGGLYRGAQACFLRDIPFSAIYFPVYAHMKMKTADEQGYNRPWSLFVSAFIAGAPAAALVTPADVIKTRLQVAARTGQTTYNGLIDCSRKILREEGPSAFWKGAAARVCRSSPQFAVTLLTYELLQRIFYVDFGGTRPSGSEVSTHTTILDQASENPHHIGGYKL

SEQ ID NO: 123213 - protein, 123 aa, Heterodera glycines
  misc_feature (45)..(45): Xaa can be any naturally occurring amino acid
  misc_feature (75)..(75): Xaa can be any naturally occurring amino acid
  Homolog annotation: Hit_ID=NP_001004372.1; Match level="QueryCoverage= 93%, HitCoverage=68%, E-value=5e-17, Identity=43%"; Hit description =hydrogen carrier protein [Gallus gallus] dbj|BAA14314.1| H-protein [Gallus gallus] sp|P11183|GCSH_CHIC
  Gene Ontology: Cellular component=mitochondrion; Biological process =embryogenesis and morphogenesis
  Essential gene: C elegans homolog=F52A8.5; Phenotype=Emb
  Coding regions on vcDNA: vcDNA=SeqID_49636; Strand=+; Position=17-385
MFAYILYTDKLDWLSLNEAKSVGTVGITNHAQKSLGHDVYVKMPXIVKKLYSDNTTCAIHSVIAASDLIAPVAGXVFGTEHHELEDQPALTHNDCYRKEWLYKMKVINLKESDQLMSEPRYNN

SEQ ID NO: 123214 - protein, 203 aa, Heterodera glycines
  misc_feature (176)..(176): Xaa can be any naturally occurring amino acid
  Homolog annotation: Hit_ID=NP_508479.1; Match level="QueryCoverage =84%, HitCoverage=27%, E-value=6e-53, Identity=61%"; Hit description =immunoglobulin-like, possibly N-myristoylated (68.5 kD) (XD318) [Caenorhabditis elegans] pir||T16777 hypo
  Essential gene: C elegans homolog=T02C5.3; Phenotype=Unclassified
  Coding regions on vcDNA: vcDNA=SeqID_49637; Strand=+; Position=10-617
MPPLSPPQLFFPAFLLLGHFLPPFAHGQLPSAMLPAPSTSQLQVKISNLPVHVATAQHLPQLVWRVVGRQATERVFCVSEAPVSQLRFVCVDCVQKNITDLVDYLNTAQDSTRIATSPAVELPPVDANPSWTGATIICQAAVNGGTKDSPPSVVDVQYLRGVHVVDSNGQGPVHIXNQGFRFYVECVRGNDGQCQQSAARRKT

SEQ ID NO: 123215 - protein, 191 aa, Heterodera glycines
  misc_feature (153)..(153): Xaa can be any naturally occurring amino acid
  Homolog annotation: Hit_ID=NP_741088.1; Match level="QueryCoverage =98%, HitCoverage=62%, E-value=1e-65, Identity=65%"; Hit description =actin related protein 2 3 complex 34kDa (34.5 kD) (3B481) [Caenorhabditis elegans] gb|AAL32261.1| Hypothe
  Gene Ontology: Mol. function=structural constituent of cytoskeleton; Cellular component=focal adhesion; Biological process=cell motility
  Essential gene: C elegans homolog=Y6D11A.2; Phenotype=Emb
  Coding regions on vcDNA: vcDNA=SeqID_49638; Strand=+; Position=2-574
IILEQNNRVIAELLEMKFTNARTNSKFDTVYVVFADFDGILYHASNPDGGDKSKLMLSISLKFYKELQEHGADELIRSIYGKFLWESPHAGYSVSLVYDVADIPENFTALVEHASYLKRNCFASVFEKYFQFLESGQEGENRAVIHYREDETXFIEAKSDRVTVIFSTLIEDPDDVVICKVFLQEFREVTR

SEQ ID NO: 123216 - protein, 93 aa, Heterodera glycines
  Homolog annotation: Hit_ID=XP_307517.1; Match level="QueryCoverage =100%, HitCoverage=11%, E-value=5e-26, Identity=52%"; Hit description= ENSANGP00000002151 [Anopheles gambiae]
  Gene Ontology: Mol. function=ribonuclease P activity; Cellular component=nucleolar ribonuclease P complex; Biological process=tRNA catabolism
  Essential gene: C elegans homolog=C05D11.9; Phenotype=Bmd,Gro
  Coding regions on vcDNA: vcDNA=SeqID_49639; Strand=+; Position=2-280
RRRAMSHNVKRLPRALRPIAARHTQRTAQRKKAPSRKWRRRPTRMLKRWVREQRKNVWLETHIWHVKRFHMTELWGYKLPMKSCQRGFRPNYR

SEQ ID NO: 123217 - protein, 117 aa, Heterodera glycines
  Homolog annotation: Hit_ID=AAL62472.1; Match level="QueryCoverage =100%, HitCoverage=56%, E-value=4e-17, Identity=40%"; Hit description= ribosomal protein S8 [Spodoptera frugiperda] sp|Q8WQI5|RS8_SPOFR 40S ribosomal protein S8
  Gene Ontology: Cellular component=eukaryotic 48S initiation complex; Biological process=protein biosynthesis
  Essential gene: C elegans homolog=F42C5.8; Phenotype=Lva,Ste
  Coding regions on vcDNA: vcDNA=SeqID_49640; Strand=+; Position=2-352
RTIGGKRTPLLKTRNFIVGPPLMKTKSCPKQIHFARLHDATILRHGLHNDTGNFALSSERFPHPSAIIAIINNASNDELLHTLTLVMGVLDALDLIPVPPWGEAHYSMPLAPPMGQK

SEQ ID NO: 123218 - protein, 169 aa, Heterodera glycines
  Homolog annotation: Hit_ID=NP_501283.1; Match level="QueryCoverage =68%, HitCoverage=17%, E-value=4e-41, Identity=66%"; Hit description =component of rsec6 8 secretory complex p71 (4I544) [Caenorhabditis elegans] gb|AAA82266.1| Hypothetical p
  Gene Ontology: Cellular component=exocyst; Biological process=post -Golgi transport
  Essential gene: C elegans homolog=C33H5.9; Phenotype =Gro,Rup,Sma,Stp,Unc
  Coding regions on vcDNA: vcDNA=SeqID_49641; Strand=+; Position=34-540
MTQQPYFATYIQDLEQDPFDVIDFVERLAWRMSTGKDCVDAAYLKNKFEEEIGSLQLLSDQFQSKLNTLEQQQNKDKTDYLDSLQRLHDKNGDSLDQLKQLDLTMQTVAARVVHLGDQLESVHEPRARAFEALQLMRHFDEFLADQPLNSALFTDPDRVIKRNKTKITI

SEQ ID NO: 123219 - protein, 131 aa, Heterodera glycines
  Homolog annotation: Hit_ID=CAE64300.1; Match level="QueryCoverage =100%, HitCoverage=27%, E-value=5e-29, Identity=48%"; Hit description= Hypothetical protein CBG08976 [Caenorhabditis briggsae]
  Gene Ontology: Mol. function=peptidase activity; Cellular component =mitochondrial inner membrane; Biological process=electron transport
  Essential gene: C elegans homolog=F56D2.1; Phenotype=Emb
  Coding regions on vcDNA: vcDNA=SeqID_49642; Strand=+; Position=3-398
LFGFYIVMKGHSDEVTGEATRAVLHAWKHLAMGITDEEVDAAKNALKARLFLGLENNSQIATHIASEVLSSGKITPFDQLERRIHFINANAVREAVSRHVYDREIAVAAIGRIEAFTSYFELRYGMSWWRL

SEQ ID NO: 123220 - protein, 85 aa, Heterodera glycines
  Homolog annotation: Hit_ID=AAK59928.1; Match level="QueryCoverage =89%, HitCoverage=51%, E-value=2e-17, Identity=60%"; Hit description =ribosomal protein S11 [Heliothis virescens]
  Gene Ontology: Biological process=reproduction
  Essential gene: C elegans homolog=F40F11.1; Phenotype=Ste
  Coding regions on vcDNA: vcDNA=SeqID_49643; Strand=+; Position=50-304
TQVQLLRWKEGGRRTSLLEQFGLGFTTPLEAIEGIYIDKKCPLTENVSIPRLILIGVSIDDNMQRTIVIRRDYLHFLPKHPRYEN

SEQ ID NO: 123221 - protein, 159 aa, Heterodera glycines
  misc_feature (25)..(25): Xaa can be any naturally occurring amino acid
  misc_feature (48)..(48): Xaa can be any naturally occurring amino acid
  misc_feature (65)..(65): Xaa can be any naturally occurring amino acid
  misc_feature (98)..(98): Xaa can be any naturally occurring amino acid
  Homolog annotation: Hit_ID=NP_491370.1; Match level="QueryCoverage =100%, HitCoverage=41%, E-value=5e-30, Identity=43%"; Hit description= eukaryotic Initiation Factor (41.0 kD) (eif-3.H) [Caenorhabditis elegans] gb|AAC48137.2| Eukaryotic init
  Gene Ontology: Mol. function=translation factor activity, nucleic acid binding; Cellular component=eukaryotic translation initiation factor 3 complex; Biological process=positive regulation of growth rate
  Essential gene: C elegans homolog=C41D11.2; Phenotype=Emb,Gro
  Coding regions on vcDNA: vcDNA=SeqID_49644; Strand=+; Position=2-478
QFYAGMTKIAGETCQGILTGLISVXDKRLEVTNCFSISRPDALHKSEXSAAGPETSRSDDNKQGXILDMLKRFRMMNIHYESVGFNQAHPFCTWITHXLLGSLMHYQSDMSHSVVIGYDAVNTRQGCLTLRAYRLSKNALDLVITCDDSWSPEQTTLAG

SEQ ID NO: 123222 - protein, 132 aa, Heterodera glycines
  misc_feature (93)..(93): Xaa can be any naturally occurring amino acid
  Homolog annotation: Hit_ID=NP_491926.1; Match level="QueryCoverage =100%, HitCoverage=95%, E-value=7e-23, Identity=44%"; Hit description= lipid Binding Protein LBP-6, adipocyte P2 family member (15.6 kD) (lbp-6) [Caenorhabditis elegans] gb|AA
  Gene Ontology: Mol. function=fatty acid binding; Cellular component =cytoplasm
  Essential gene: C elegans homolog=W02D3.7; Phenotype=Unc
  Coding regions on vcDNA: vcDNA=SeqID_49645; Strand=+; Position=2-397
SDKFVGKWNLESSEKFYYFVKEVGVNFLTRKGAGCVKPVLEFEVFNAGDHWKMTSTSTITTCNCEFYLNKEFEGKTDDGRTVKTIFAYEDGGXPHKQSKLKDDDQDSYYQRYIDESGKLFITMEVGSVNARR

SEQ ID NO: 123223 - protein, 142 aa, Heterodera glycines
  misc_feature (45)..(45): Xaa can be any naturally occurring amino acid
  misc_feature (76)..(76): Xaa can be any naturally occurring amino acid
  misc_feature (95)..(95): Xaa can be any naturally occurring amino acid
  Homolog annotation: Hit_ID=CAB88203.1; Match level="QueryCoverage =99%, HitCoverage=47%, E-value=2e-45, Identity=61%"; Hit description =putative cuticular collagen [Globodera pallida]
  Essential gene: C elegans homolog=C29E4.1; Phenotype=Dpy
  Coding regions on vcDNA: vcDNA=SeqID_49646; Strand=+; Position=2-433
IASGCSLLGIITTPLTLPSLYSEMTHMNSQVHYGDEAFRVYTDSXWTDLMDVQVVLTPSSNPRDNPFHSIFRSPRXLRGLCHCAGLQQPSCPPGXPRPTGPPGQTGHPAGARHPGQAGLPGQPTPDCSAEMLHCPRLPVSPA

SEQ ID NO: 123224 - protein, 219 aa, Heterodera glycines
  Homolog annotation: Hit_ID=NP_494905.1; Match level="QueryCoverage =79%, HitCoverage=28%, E-value=3e-27, Identity=37%"; Hit description =putative nuclear protein, with 2 coiled coil-4 domains, of bilaterial origin (2F230) [Caenorhabditis eleg
  Gene Ontology: Mol. function=vitamin D receptor binding; Cellular component=mediator complex; Biological process=transcription from Pol II promoter
  Essential gene: C elegans homolog=ZK546.13; Phenotype=Egl,Pch,Rup
  Coding regions on vcDNA: vcDNA=SeqID_49647; Strand=+; Position=1-657
VGLKEQLLDVTAALESLTKQILQNLFSDGKAKAQDKSFDEQLKALVESFNDKQSEFVVLIRKVPSHQQRQRHIHILEENVKKRDEIIGRLADQIKNIKGAVVEGTFQAEKKLKSVKQSEMNRVFSEEVIRFAHQISKNHSVASSVYWQQGDPSRPYPTEANFAVSNLLLSRTQPNVPLSFAAQATPGGMLKSVFNVPGMPQKAFSPSPRSAMFVSNLGA

SEQ ID NO: 123225 - protein, 145 aa, Heterodera glycines
  Homolog annotation: Hit_ID=CAE67544.1; Match level="QueryCoverage =90%, HitCoverage=86%, E-value=1e-11, Identity=29%"; Hit description =Hypothetical protein CBG13069 [Caenorhabditis briggsae]
  Essential gene: C elegans homolog=F10E7.6; Phenotype=Clr,Gro,Sck
  Coding regions on vcDNA: vcDNA=SeqID_49648; Strand=-; Position=104-541
RFSETSAFHGRGSGGRTTGGESDEDAFSNPFYIASYYDSKRFEAIRGVSIFASISLLLIYVAWFREPNEVDELWDYDMRLVYFVAKKRVLKDQIEQAKKSGQSTVNLETDLIDIEVQEEKIREEEEKKAKKVAAKKKAEQKRTTA

SEQ ID NO: 123226 - protein, 98 aa, Heterodera glycines
  misc_feature (21)..(21): Xaa can be any naturally occurring amino acid
  misc_feature (27)..(27): Xaa can be any naturally occurring amino acid
  misc_feature (30)..(30): Xaa can be any naturally occurring amino acid
  misc_feature (40)..(40): Xaa can be any naturally occurring amino acid
  misc_feature (51)..(51): Xaa can be any naturally occurring amino acid
  Homolog annotation: Hit_ID=NP_493644.1; Match level="QueryCoverage =97%, HitCoverage=23%, E-value=6e-14, Identity=48%"; Hit description =proteasome Regulatory Particle, ATPase-like, S10b (rpt-4) [Caenorhabditis elegans] gb|AAB70326.2| Proteas
  Gene Ontology: Mol. function=proteasome endopeptidase activity; Cellular component=proteasome regulatory particle (sensu Eukarya); Biological process=proteolysis and peptidolysis
  Essential gene: C elegans homolog=F23F1.8; Phenotype=Emb
  Coding regions on vcDNA: vcDNA=SeqID_49649; Strand=+; Position=2-295
GDRQRGGRKTHRRKGAEEKEXEKGPKXRRXKERESHKAGXKGEKEMKPRQXDGQREGEGGKQGREEIFFFKATNGPRYVVVCGRSIEKEKLKEGTGVG

SEQ ID NO: 123227 - protein, 152 aa, Heterodera glycines
  Homolog annotation: Hit_ID=XP_331531.1; Match level="QueryCoverage =90%, HitCoverage=24%, E-value=1e-16, Identity=38%"; Hit description =hypothetical protein [Neurospora crassa] gb|EAA29675.1| hypothetical protein [Neurospora crassa]
  Essential gene: C elegans homolog=K07H8.1; Phenotype=Emb
  Coding regions on vcDNA: vcDNA=SeqID_49650; Strand=+; Position=25-480
MSAVEINQRVVLNGSKGVVRYLGPVEGTAGQWVGVDWDDPTRGKHDGKTRDGRRYFTATAASSASFVREQCLHTGDELFSAICAKYATEGDDDDKCQNETIEAGDKKRWQLVNMDKVRRAQRDVFRLRCIVLSWSLVSHLDVSKLGDRTFAN

SEQ ID NO: 123228 - protein, 183 aa, Heterodera glycines
  Homolog annotation: Hit_ID=NP_509342.1; Match level="QueryCoverage =100%, HitCoverage=78%, E-value=6e-64, Identity=67%"; Hit description= adaptor protein required for cell signalling, in particular during sex myoblast migration; functionally
  Gene Ontology: Mol. function=protein tyrosine kinase activity; Cellular component=extrinsic to plasma membrane; Biological process =regulation of cell shape
  Essential gene: C elegans homolog=C14F5.5; Phenotype=Gro,Lvl,Pvl,Unc
  Coding regions on vcDNA: vcDNA=SeqID_49651; Strand=+; Position=104-652
MEAVAEHDFNAGEPDELSFKRGQILKVLNKDEDPHWYKAEINGVEGLIPSNYILMMEHSWYLGSISRSDSELLLLKNGNPDGAFLVRRSESTPGEFSISVRFENAVQHFKVLRDTKVGQYYLWAKRFNSLNELINYHRANSISKTHNILLRSMDSGFSNKHGLVQALFHFTPQEPGELRFSRG

SEQ ID NO: 123229 - protein, 109 aa, Heterodera glycines
  Homolog annotation: Hit_ID=NP_491989.1; Match level="QueryCoverage =92%, HitCoverage=27%, E-value=1e-38, Identity=75%"; Hit description =isocitrate dehydrogenase (1H553) [Caenorhabditis elegans] gb|AAK85453.1| Hypothetical protein C30F12.7 [C
  Gene Ontology: Mol. function=isocitrate dehydrogenase (NAD+) activity; Cellular component=mitochondrion; Biological process =hermaphrodite genital morphogenesis
  Essential gene: C elegans homolog=F35G12.2; Phenotype=Stp
  Coding regions on vcDNA: vcDNA=SeqID_49652; Strand=+; Position=2-331
NIACGLVGGPGLVSGMNIGEEYAVFETGTRNTGTSLAGKDIANPTAFIRASIDMLRYLELHDYADKLSDALYKALTEQRTHTPDIGGTNHSTEVVQAVINNYSETISNA

SEQ ID NO: 123230 - protein, 178 aa, Heterodera glycines
  misc_feature (63)..(63): Xaa can be any naturally occurring amino acid
  Homolog annotation: Hit_ID=NP_497407.1; Match level="QueryCoverage =94%, HitCoverage=29%, E-value=1e-32, Identity=42%"; Hit description =solute carrier family 22 member (64.6 kD) (3C510) [Caenorhabditis elegans] gb|AAK26156.1| Hypothetical pr
  Gene Ontology: Mol. function=organic cation transporter activity; Cellular component=integral to plasma membrane; Biological process =organic cation transport
  Essential gene: C elegans homolog=Y82E9BR.16a; Phenotype=Emb,Lva
  Coding regions on vcDNA: vcDNA=SeqID_49653; Strand=-; Position=2-536
PQFTVIKGMELVGPSKRKIASLFTGVFFAVGQVLLGLLAFFIRNYQYLHASIAAFATIFLFYXGASFNPSLLSIVYSPNLPFLLRVVPESPRWLVSQKRYVEADQILRNAARINKRELPDKWWDDIEEEANGGGEKRADECTAQKRTTRKHNYTDLLRTPKIRRISFTAFFCWSAFNF

SEQ ID NO: 123231 - protein, 69 aa, Heterodera glycines
  Homolog annotation: Hit_ID=NP_493465.1; Match level="QueryCoverage =97%, HitCoverage=57%, E-value=9e-14, Identity=50%"; Hit description =nadh dehydrogenase (1O705) [Caenorhabditis elegans] emb|CAA21708.1| Hypothetical protein Y63D3A.7 [Caenor
  Gene Ontology: Biological process=growth
  Essential gene: C elegans homolog=Y63D3A.7; Phenotype=Lva
  Coding regions on vcDNA: vcDNA=SeqID_49654; Strand=+; Position=3-212
GVREFIQKDYVDLKQNNRDFPILVRECSGITPRIWARYEHGVETSVSVENQPRQKIMEVIKEMATKKID

SEQ ID NO: 123232 - protein, 162 aa, Heterodera glycines
  Homolog annotation: Hit_ID=XP_311466.1; Match level="QueryCoverage =51%, HitCoverage=34%, E-value=2e-15, Identity=40%"; Hit description =ENSANGP00000013744 [Anopheles gambiae]
  Gene Ontology: Biological process=physiological processes
  Essential gene: C elegans homolog=Y69H2.6; Phenotype=Sck
  Coding regions on vcDNA: vcDNA=SeqID_49655; Strand=+; Position=3-591
SCRIRHEDKGDDAVNDTDLELEFSNKLDDLENDNKAEGIIGHEKNTAESRGLENAPHSQQQINGFLQISQEQRLFHYIFREFEAVAKNPIEGIYVTPGAESLLVWFGLLIDRTGIFYGGIFRFILTVPDNFPNSESLPVVQFEEPLFHPLVNSKTNCVDLSR

SEQ ID NO: 123233 - protein, 142 aa, Heterodera glycines
  misc_feature (62)..(62): Xaa can be any naturally occurring amino acid
  Homolog annotation: Hit_ID=CAE57569.1; Match level="QueryCoverage =99%, HitCoverage=98%, E-value=1e-44, Identity=61%"; Hit description =Hypothetical protein CBG00547 [Caenorhabditis briggsae]
  Gene Ontology: Mol. function=structural constituent of ribosome; Cellular component=cytosolic ribosome (sensu Eukarya); Biological process=protein biosynthesis
  Essential gene: C elegans homolog=F28C6.7a; Phenotype=Emb,Lva,Ste
  Coding regions on vcDNA: vcDNA=SeqID_49656; Strand=+; Position=2-427
KLNPFVSSSARKSRKRYFNAPSYIHHLIMSAPLSKDLRSKHRVCSTPIPIDDEVTVARSHYXGNAGSIMRVYQKKYVLHDDNTCTQDKANGTTVHGGIHPSNVQITQLKMDKDRRSLLERKAVGTARVTGILKGKHTEDTIE

SEQ ID NO: 123234 - protein, 170 aa, Heterodera glycines
  misc_feature (34)..(34): Xaa can be any naturally occurring amino acid
  misc_feature (124)..(124): Xaa can be any naturally occurring amino acid
  Homolog annotation: Hit_ID=NP_498660.1; Match level="QueryCoverage =100%, HitCoverage=89%, E-value=8e-51, Identity=59%"; Hit description= ribosomal Protein, Large subunit (21.5 kD) (rpl-9) [Caenorhabditis elegans] gb|AAK84469.1| Ribosomal pro
  Gene Ontology: Mol. function=structural constituent of ribosome; Cellular component=cytosolic large ribosomal subunit (sensu Eukarya); Biological process=reproduction
  Essential gene: C elegans homolog=R13A5.8; Phenotype=Emb,Ste
  Coding regions on vcDNA: vcDNA=SeqID_49657; Strand=+; Position=2-511
KLIESSERGDFPDCDTFSLNKRVVTVKGPRGTLXRDFLHLNIEIMRENPKLLRVLKWFGIRKYLAAIRTVCSHIENLIKRVTVGFLHKMRSDYAHFPINITLQENNTVDQILKFLGEKFVRHVXLPQRVNAVMSTKQKDDLIIDGTNIQEVSHDAARIQQSTTVKNNDIR

SEQ ID NO: 123235 - protein, 128 aa, Heterodera glycines
  misc_feature (20)..(20): Xaa can be any naturally occurring amino acid
  misc_feature (64)..(64): Xaa can be any naturally occurring amino acid
  misc_feature (79)..(79): Xaa can be any naturally occurring amino acid
  Homolog annotation: Hit_ID=NP_502365.1; Match level="QueryCoverage =99%, HitCoverage=88%, E-value=8e-39, Identity=62%"; Hit description =ribosomal Protein, Small subunit (15.9 kD) (rps-23) [Caenorhabditis elegans] emb|CAA94601.1| Hypothetical
  Gene Ontology: Cellular component=eukaryotic 48S initiation complex; Biological process=protein biosynthesis
  Essential gene: C elegans homolog=F28D1.7; Phenotype=Ste
  Coding regions on vcDNA: vcDNA=SeqID_49658; Strand=+; Position=2-385
VRILKKPRQEQRWNDKRFKXPVLLTRWKDDPFCGGCMDKGIGLEKIGVEPQQPHSAIRKCVRVXLIENTNKITAFGPNXGCLNFIDEHHQVLVSGLGQSGHAAGQIPGDRFRVLKGAKTIVVRTYCGK

SEQ ID NO: 123236 - protein, 113 aa, Heterodera glycines
  Homolog annotation: Hit_ID=NP_501615.1; Match level="QueryCoverage =100%, HitCoverage=38%, E-value=6e-30, Identity=54%"; Hit description= putative endoplasmic reticulum protein, with at least 4 transmembrane domains, of bilaterial origin (4K1
  Essential gene: C elegans homolog=Y11D7A.9; Phenotype=Unclassified
  Coding regions on vcDNA: vcDNA=SeqID_49659; Strand=+; Position=2-340
LLGATATIARALLLHNDEIKKYKWQCGRARLPSLSRIVNLPMERIFWQITFLFHIPLRALKIAVGFFRYGRLPSVHWKWPRLYSLCPHFYLWLGSLELIFLDALSEVREREFI

SEQ ID NO: 123237 - protein, 90 aa, Heterodera glycines
  misc_feature (25)..(25): Xaa can be any naturally occurring amino acid
  misc_feature (43)..(43): Xaa can be any naturally occurring amino acid
  misc_feature (72)..(72): Xaa can be any naturally occurring amino acid
  Homolog annotation: Hit_ID=CAE73690.1; Match level="QueryCoverage =98%, HitCoverage=29%, E-value=2e-15, Identity=49%"; Hit description =Hypothetical protein CBG21201 [Caenorhabditis briggsae]
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_49660; Strand=+; Position=20-292
LVNLMVHVLNASIHVTCDQRYKGFXTFLVRAPQRTGLSADWAXNLPFVVPYSPTHALNFAFMDTYTPDFTPXLDMDKTVLKLFSMNLASG

SEQ ID NO: 123238 - protein, 44 aa, Heterodera glycines
  Homolog annotation: Hit_ID=NP_500630.1; Match level="QueryCoverage =97%, HitCoverage=23%, E-value=6e-11, Identity=60%"; Hit description =ribosomal Protein, Large subunit (21.0 kD) (rpl-20Co) [Caenorhabditis elegans] gb|AAB92041.2| Ribosomal p
  Gene Ontology: Mol. function=structural constituent of ribosome; Cellular component=cytosolic large ribosomal subunit (sensu Eukarya); Biological process=reproduction
  Essential gene: C elegans homolog=E04A4.8; Phenotype=Emb,Gro
  Coding regions on vcDNA: vcDNA=SeqID_49661; Strand=+; Position=2-133
YKKKPGSAKNFGIWLRYYSRTGHHNMYRKHRNVCEEGAETQCYH

SEQ ID NO: 123239 - protein, 175 aa, Heterodera glycines
  Homolog annotation: Hit_ID=CAE66268.1; Match level="QueryCoverage =88%, HitCoverage=20%, E-value=4e-53, Identity=66%"; Hit description =Hypothetical protein CBG11512 [Caenorhabditis briggsae]
  Gene Ontology: Cellular component=nucleus; Biological process =embryogenesis and morphogenesis
  Essential gene: C elegans homolog=H37A05.1; Phenotype=Emb
  Coding regions on vcDNA: vcDNA=SeqID_49662; Strand=+; Position=115-639
MSFSPVLTISEENLASEFAKGNVTIADRRPSNAMDFELFEEKAKEKRSLRLSRDQLDLLNLNYGSNDARFSITTKYQGTAWCSCHIYLLKWYDKLVISDIDGTITKSDVLGHVIPAIGGTWAHSGVAELYTGIKKNGYQMVYLSSRAIGQSHYTKTYLQNFAQGSRTLPDGPVLL

SEQ ID NO: 123240 - protein, 158 aa, Heterodera glycines
  misc_feature (34)..(34): Xaa can be any naturally occurring amino acid
  misc_feature (80)..(80): Xaa can be any naturally occurring amino acid
  Homolog annotation: Hit_ID=NP_502087.1; Match level="QueryCoverage =98%, HitCoverage=45%, E-value=5e-47, Identity=57%"; Hit description =phosphate carrier protein, mitochondrial precursor (36.7 kD) (4L912) [Caenorhabditis elegans] emb|CAA9743
  Gene Ontology: Mol. function=phosphate carrier activity; Cellular component=integral to plasma membrane; Biological process=transport
  Essential gene: C elegans homolog=F01G4.6; Phenotype=Emb,Lva
  Coding regions on vcDNA: vcDNA=SeqID_49663; Strand=+; Position=134-607
RLCSIREIPSCGVTPTAIGPQDLGKCSIQDDPAXYNGIIAGFKFTLRDDGVHGLDKGWAHSAVGYTMHGLGKFRVYNMFXNVYAGMIGEELAYSCRTYLYFGGWDRAEFFTNMMLVPMEATKVRIQTSPGAPPTLHGCAPFIYRTEGVMGLYNGLPPM

SEQ ID NO: 123241 - protein, 191 aa, Heterodera glycines
  Homolog annotation: Hit_ID=NP_495598.1; Match level="QueryCoverage =99%, HitCoverage=99%, E-value=1e-97, Identity=89%"; Hit description =cell Division Cycle related, Rho GTPase cdc42 (21.2 kD) (cdc-42) [Caenorhabditis elegans] gb|AAK31543.1|
  Gene Ontology: Mol. function=signal transducer activity; Cellular component=shmoo tip; Biological process=signal transduction during conjugation with cellular fusion
  Essential gene: C elegans homolog=R07G3.1; Phenotype=Emb
  Coding regions on vcDNA: vcDNA=SeqID_49664; Strand=+; Position=54-626
MMQTIKCVVVGDGAVGKTCLLISYTTNKFPNEYVPTVFDNYAVTVMIGGEPYTLGLFDTAGQEDYDRLRPLSYPQTDVFLVCFSVVTPASFENIKEKWVPEITHHCSKTPFLLVGTQVDLREDAGTCEKLAKNKMRPISAETGEKLAKELKAVKYVECSALTQKGLKNVFDEAILAALEPPQLERKRKCSI

SEQ ID NO: 123242 - protein, 191 aa, Heterodera glycines
  Homolog annotation: Hit_ID=CAB81621.1; Match level="QueryCoverage =77%, HitCoverage=29%, E-value=1e-45, Identity=62%"; Hit description =OTTHUMP00000060161 [Homo sapiens]
  Gene Ontology: Biological process=gametogenesis
  Essential gene: C elegans homolog=T19B10.6; Phenotype=Ste,Stp
  Coding regions on vcDNA: vcDNA=SeqID_49665; Strand=+; Position=21-593
MDNPGPSNGIDLIELGDSDDERMEKFAFGGNDTLSLISLKTDFERPPKEEAMLNLVDASFELIDPNPNVHELFVTFDHQFFSGTLNSNACVVEWSKTMTSCAGICRFSVGNRLCSIRLSEPLLKLRPRRDLVETLLHEMIHAYQFVTDGIQDRDGHGPDFRLHMHRINKLAGTSISVYHSFHAEVAHYKRH

SEQ ID NO: 123243 - protein, 214 aa, Heterodera glycines
  Homolog annotation: Hit_ID=AAA93233.1; Match level="QueryCoverage =100%, HitCoverage=40%, E-value=2e-85, Identity=73%"; Hit description= CCT-2
  Gene Ontology: Mol. function=chaperone activity; Cellular component =cytoplasm; Biological process=regulation of cell cycle
  Essential gene: C elegans homolog=T21B10.7; Phenotype=Emb,Lva,Ste
  Coding regions on vcDNA: vcDNA=SeqID_49666; Strand=+; Position=1-642
LIYNYPEQLFADRKVMAIEHADFEGIERLALVLGGEIASTFDSPSEVKLGSCKLIEEVTVGEDTLLRFSGVPLGNACSVVLRGSTQQIIDEAERSLHDALCVLSTHVKDQRVVPGAGASEMLMAMAVMGESQKVAGKESIAMEAFARALAKLPTIICDNAGLDSAEIISHVRAEHSKGNRQFGIDVENGRMADVYELGVLESYNVKLGVLCSGA

SEQ ID NO: 123244 - protein, 101 aa, Heterodera glycines
  misc_feature (83)..(83): Xaa can be any naturally occurring amino acid
  Homolog annotation: Hit_ID=CAE56899.1; Match level="QueryCoverage =99%, HitCoverage=25%, E-value=4e-13, Identity=39%"; Hit description =Hypothetical protein CBG24740 [Caenorhabditis briggsae]
  Essential gene: C elegans homolog=T02G5.7; Phenotype=Bmd,Unc
  Coding regions on vcDNA: vcDNA=SeqID_49667; Strand=+; Position=2-304
SSKINALILRTPSAQVGQRCMVSVVGDQTMTHAPTYLARGDNNYRDIKLLDSIQRDGISDPVLGQPTGVCAEKTVAEFGFPRXQQDADALASLASANPSWP

SEQ ID NO: 123245 - protein, 185 aa, Heterodera glycines
  Homolog annotation: Hit_ID=CAE62849.1; Match level="QueryCoverage =76%, HitCoverage=45%, E-value=1e-41, Identity=54%"; Hit description =Hypothetical protein CBG07028 [Caenorhabditis briggsae]
  Gene Ontology: Cellular component=cytoplasm
  Essential gene: C elegans homolog=Y43H11AL.2; Phenotype=Clr,Pch
  Coding regions on vcDNA: vcDNA=SeqID_49668; Strand=+; Position=12-566
MLFRYFPLLNEYSAHKLFLTLFPSTGSEMVRGNPHLPIIVGKEHCSNGTKWILNVFGDCVDTPMKMCGFWVGLMSLFLWLIPLFPQLYENFRNKRCEGLSIFFLMFWFIGDSCNMIGAVLTHQQPLQQIIGVYYILQDLALLGQFIYYTRLYSATRRREMLNGPSVIVPVFLFGFVGLFTLFSSS

SEQ ID NO: 123246 - protein, 78 aa, Heterodera glycines
  Homolog annotation: Hit_ID=JC4382; Match level="QueryCoverage=100%, HitCoverage=19%, E-value=2e-29, Identity=73%"; Hit description =ribosomal protein L3.e, cytosolic - Toxocara canis gb|AAA92285.1| ribosomal protein L3 sp|P49149|RL3_TOXCA 60
  Gene Ontology: Mol. function=structural constituent of ribosome; Cellular component=ribosome; Biological process=protein biosynthesis
  Essential gene: C elegans homolog=F13B10.2a; Phenotype=Emb,Ste
  Coding regions on vcDNA: vcDNA=SeqID_49669; Strand=+; Position=2-235
HFDKQVPVQQVFEQDDMIDCLRVAKRNGFQGVTPLWHCNKLPRNTHEGLRKVACIGAWHPSRVSFTVARAGHKGYHHQ

SEQ ID NO: 123247 - protein, 161 aa, Heterodera glycines
  Homolog annotation: Hit_ID=NP_495732.1; Match level="QueryCoverage =98%, HitCoverage=39%, E-value=1e-53, Identity=62%"; Hit description =disabled homolog 1 (44.0 kD) (2I519) [Caenorhabditis elegans] pir||T23752 hypothetical protein M110.5c -
  Gene Ontology: Mol. function=signal transducer activity; Cellular component=cytoplasm; Biological process=apoptosis
  Essential gene: C elegans homolog=M110.5a; Phenotype=Emb,Gro,Slu
  Coding regions on vcDNA: vcDNA=SeqID_49670; Strand=+; Position=9-491
MLRKSAHKAKTVTNGNANDPFRFQGSGVDFKAKFIGERDVAEARGDVLCAEAMRLAKMSVKASGSHKPRVVLNISLDGLMLLDEKSGAVLYNFPVAKISFIARDTTDARAFGFIFGTADGKHKFYGVKTAQTADHAVLSIRDMFQVVFEMKKKQLEEEKKK

SEQ ID NO: 123248 - protein, 182 aa, Heterodera glycines
  Homolog annotation: Hit_ID=CAE71204.1; Match level="QueryCoverage =95%, HitCoverage=94%, E-value=3e-11, Identity=28%"; Hit description =Hypothetical protein CBG18066 [Caenorhabditis briggsae]
  Gene Ontology: Biological process=morphogenesis of an epithelium
  Essential gene: C elegans homolog=R07E5.7; Phenotype=Dpy
  Coding regions on vcDNA: vcDNA=SeqID_49671; Strand=+; Position=18-563
MSSNSATTTTSTDNGISLVEADERGAEGGEGDDQLTINSLSSSLSSSTATTDTEGESGAGDGGRKRKKRRGDGSSSRGSSAKEIEQFDEDEAAEDALLDDEAPPYAAKTRDRAIGRLIVFSCILFTVPLTLMYITYRFFFIGHYHLAHDRAVLYAGIVAAATGYLLLALVAWIAYRSRDETE

SEQ ID NO: 123249 - protein, 194 aa, Heterodera glycines
  Homolog annotation: Hit_ID=AAP92328.1; Match level="QueryCoverage =100%, HitCoverage=69%, E-value=5e-34, Identity=40%"; Hit description= leucine zipper protein [Branchiostoma belcheri tsingtaunese]
  Essential gene: C elegans homolog=H38K22.2a; Phenotype=Emb
  Coding regions on vcDNA: vcDNA=SeqID_49672; Strand=+; Position=30-611
MNRLRRDQKEKVQQFVSFTQANEQTAITCLTASNWNLEMAGDMFYQNPSYTNQQVGGGTGGGADSRKIDHLFNKYASDAKDKAQKIGPDRIGPNGMVRFLRDLNIEPTSRAVMVLAWKMGAQKQCEFTVQEFRDGISTLIPTGTVDINGLRNALLKAEKDTVAERKAFRELYQFIFKYVKSAGQSSLELDTAVA

SEQ ID NO: 123250 - protein, 177 aa, Heterodera glycines
  Homolog annotation: Hit_ID=CAE60550.1; Match level="QueryCoverage =71%, HitCoverage=21%, E-value=1e-27, Identity=46%"; Hit description =Hypothetical protein CBG04177 [Caenorhabditis briggsae]
  Gene Ontology: Cellular component=nucleolus; Biological process =positive regulation of growth rate
  Essential gene: C elegans homolog=K09H9.6; Phenotype=Lpd
  Coding regions on vcDNA: vcDNA=SeqID_49673; Strand=+; Position=121-651
MGRARRKKGKTARRARQGLLGFTRIAREGKKPKQFEKRVNQRLDRKDDVRTEEILRENIAGQKTQEEPRTPHAFVIHSAGVGRYVRQLEMDLRRVMSPNTSKALRVLKRNKLKDFVVHSQFLGVSHLIILSRTELSTHLRIIRNPQGPTLHFRVEKYSLGRDVLSVQKRPVIYEELF

SEQ ID NO: 123251 - protein, 122 aa, Heterodera glycines
  Homolog annotation: Hit_ID=AAK54349.1; Match level="QueryCoverage =60%, HitCoverage=18%, E-value=1e-09, Identity=44%"; Hit description =hepatocellular carcinoma related protein 1 [Homo sapiens]
  Essential gene: C elegans homolog=CD4.4; Phenotype=Emb,Lva,Unc
  Coding regions on vcDNA: vcDNA=SeqID_49674; Strand=+; Position=2-370
FEVAEARSLDSVCVSLKNLAQNAEDESETAAELFYKGAMEIDDFIKKFTEKRVIGHTRRLKAEKLAELLRQQCQYQPQHPSPSALGMTTQTQYSSQGVAASMYPVLGQAYTSPANFRHSYMS

SEQ ID NO: 123252 - protein, 46 aa, Heterodera glycines
  Homolog annotation: Hit_ID=AAH57215.1; Match level="QueryCoverage =97%, HitCoverage=50%, E-value=3e-11, Identity=66%"; Hit description =MGC68763 protein [Xenopus laevis] gb|AAH68877.1| Unknown (protein for MGC:82329) [Xenopus laevis]
  Essential gene: C elegans homolog=T26A5.9; Phenotype=Emb
  Coding regions on vcDNA: vcDNA=SeqID_49675; Strand=+; Position=2-139
NEMHQEAIEGATHALEKDNVDKDLAAFFLNEFDKKFNRTWHCITGR

SEQ ID NO: 123253 - protein, 116 aa, Heterodera glycines
  misc_feature (30)..(30): Xaa can be any naturally occurring amino acid
  Homolog annotation: Hit_ID=NP_498984.1; Match level="QueryCoverage =99%, HitCoverage=20%, E-value=2e-25, Identity=50%"; Hit description =eukaryotic Initiation Factor (64.3 kD) (eif-3.D) [Caenorhabditis elegans] emb|CAA78049.1| Hypothetical pr
  Essential gene: C elegans homolog=R08D7.3; Phenotype=Emb
  Coding regions on vcDNA: vcDNA=SeqID_49676; Strand=+; Position=2-352
GLPDRPFNGCDRIGRIVYWSGDKRFFLKGXTRDRYNERVYGSSATAGAQFDYIHYNEESNFQLVDSSRPQKPQRPFRRQIPFRQLAHREQERREYEKYNVSTKMKRTILNEQQNAY

SEQ ID NO: 123254 - protein, 85 aa, Heterodera glycines
  misc_feature (52)..(52): Xaa can be any naturally occurring amino acid
  Homolog annotation: Hit_ID=XP_317628.1; Match level="QueryCoverage =96%, HitCoverage=29%, E-value=7e-25, Identity=63%"; Hit description =ENSANGP00000019124 [Anopheles gambiae] gb|EAA12157.2| ENSANGP00000019124 [Anopheles gambiae str. PEST]
  Gene Ontology: Mol. function=F-actin capping activity; Cellular component=F-actin capping protein complex; Biological process=cell organization and biogenesis
  Essential gene: C elegans homolog=M106.5; Phenotype =Bmd,Dpy,Emb,Gro,Lvl
  Coding regions on vcDNA: vcDNA=SeqID_49677; Strand=+; Position=100-354
MSGELRLDSSLDLMRRLPPQNCEKHLTDLVALAPDLCESLLTAVDQPLICAXDETTGREYLLCDYHPHGESYRAPGTSAYNPPLE

SEQ ID NO: 123255 - protein, 158 aa, Heterodera glycines
  Homolog annotation: Hit_ID=NP_491114.1; Match level="QueryCoverage =98%, HitCoverage=63%, E-value=5e-40, Identity=52%"; Hit description =mitochondrial ribosomal protein L17 (1D731) [Caenorhabditis elegans] gb|AAF60758.1| Hypothetical protein
  Essential gene: C elegans homolog=Y54E10A.7; Phenotype=Gro
  Coding regions on vcDNA: vcDNA=SeqID_49678; Strand=+; Position=7-480
MSTHRLLPSLPRLKVPIGHRPQRLKLPYIPNPRGHLELVRKLVNRVIREERCELKYNRAEECRQYVERLIQLGIYRGPNCAYTAEMFQWWFIEQDLVDKMWSILVPRFSHYPIDQSYTEIYRLPTIRLKSKVNKETEFWNRYSIAVLELKENPFPPMD

SEQ ID NO: 123256 - protein, 105 aa, Heterodera glycines
  misc_feature (85)..(85): Xaa can be any naturally occurring amino acid
  Homolog annotation: Hit_ID=NP_492523.1; Match level="QueryCoverage =100%, HitCoverage=53%, E-value=4e-28, Identity=58%"; Hit description= i-35 protein (22.8 kD) (1K80) [Caenorhabditis elegans] emb|CAB03017.2| Hypothetical protein F30A10.9 [Ca
  Gene Ontology: Biological process=gametogenesis
  Essential gene: C elegans homolog=F30A10.9; Phenotype=Lva,Lvl
  Coding regions on vcDNA: vcDNA=SeqID_49679; Strand=+; Position=2-316
KLIKPTEDGIQDEIRGKKPPKEDENALKIKEAPKISAAMFLKYNTQLGPPFHVIIDTFFVNFSIRNRIDIMTGFMDWLEAKVVAXISDCVLGRLEKMGRRVEVAV

SEQ ID NO: 123257 - protein, 126 aa, Heterodera glycines
  misc_feature (18)..(18): Xaa can be any naturally occurring amino acid
  misc_feature (84)..(84): Xaa can be any naturally occurring amino acid
  Homolog annotation: Hit_ID=NP_740781.1; Match level="QueryCoverage =98%, HitCoverage=65%, E-value=1e-22, Identity=44%"; Hit description =ribosomal protein L22/L17 (1B631) [Caenorhabditis elegans] gb|AAK29902.1| Ribosomal protein, large subuni
  Gene Ontology: Mol. function=structural constituent of ribosome; Cellular component=cytosolic large ribosomal subunit (sensu Eukarya); Biological process=protein biosynthesis
  Essential gene: C elegans homolog=Y48G8AL.8a; Phenotype=Emb,Lva
  Coding regions on vcDNA: vcDNA=SeqID_49680; Strand=+; Position=23-400
ALGSELLVHLDNTHETVXAIKYMTVEASHPLLWRVQRDKKDIVPFRQFTSGTRRRLQGPAWGPTQGLWTIKSPEILLQLLPNEXINGQVNGEDFDHLVIDHIHMQSVANMHLIIHHAHGFINPYKN

SEQ ID NO: 123258 - protein, 187 aa, Heterodera glycines
  misc_feature (176)..(176): Xaa can be any naturally occurring amino acid
  Homolog annotation: Hit_ID=CAB48391.1; Match level="QueryCoverage =100%, HitCoverage=93%, E-value=2e-80, Identity=77%"; Hit description= peroxiredoxin [Globodera rostochiensis]
  Gene Ontology: Mol. function=thioredoxin peroxidase activity; Cellular component=extracellular space; Biological process=response to oxidative stress
  Essential gene: C elegans homolog=F09E5.15; Phenotype=Sck,Sma
  Coding regions on vcDNA: vcDNA=SeqID_49681; Strand=+; Position=2-565
SSSSKCFFGMTAPNFMVDAVVNGNFTTISLEQFKWQYVVLFFYPLDFTFVCPTKIIAFSYKAGKFKKIGVPLLGCSTDSKLCHLEWIPTPRKQGGLGEMNIPVLADTRHKISRDYSVLMEEAGIAYRGLFIIDDKGVLRQITVNDLPVGRSVDETLRLLQAFRYTDKHGEACPVNXQPGTDTIKPDP

SEQ ID NO: 123259 - protein, 215 aa, Heterodera glycines
  Homolog annotation: Hit_ID=XP_309874.1; Match level="QueryCoverage =94%, HitCoverage=29%, E-value=1e-74, Identity=62%"; Hit description =ENSANGP00000018264 [Anopheles gambiae]
  Gene Ontology: Mol. function=cysteine-type endopeptidase activity; Cellular component=intracellular; Biological process=proteolysis and peptidolysis
  Essential gene: C elegans homolog=T04A8.16; Phenotype=Unclassified
  Coding regions on vcDNA: vcDNA=SeqID_49682; Strand=+; Position=3-647
LLEKAYMKVMGGYDFPGSNSSIDLNALTGWIPERIPIRPKESSFEADKTFERLFSHFHQGHCLITLATGKIDEAEQERTGLVDAHAYAVLDLRKVDGKRVFLLKNPWTHLRWKGRFSEKDVVSWSPELCAKLDYNPKDAQQFDDGIFWIDYASICAFFDVFYVNWSPALFPFRYALHSSWDAGKGPVKDLYTVGDNPQYVLEVNNRDGVASVGIL

SEQ ID NO: 123260 - protein, 126 aa, Heterodera glycines
  Homolog annotation: Hit_ID=AAQ89579.1; Match level="QueryCoverage =100%, HitCoverage=19%, E-value=2e-40, Identity=66%"; Hit description= heat shock protein 70-C [Heterodera glycines] gb|AAM93256.1| heat shock protein 70-C [Heterodera glycines
  Gene Ontology: Mol. function=Hsp70/Hsp90 organizing protein activity; Cellular component=endoplasmic reticulum; Biological process=cell organization and biogenesis
  Essential gene: C elegans homolog=C15H9.6; Phenotype=Dpy,Lva
  Coding regions on vcDNA: vcDNA=SeqID_49683; Strand=+; Position=32-409
TLARAKSNDLIMDLLQGTLTPEPKVLEDANLKKDDIHEAVLVGWSSRVPPLHDLRDDFFNEKEPARCITPDDTASYGAAVLAGVVSGEESSQIVLVDVIPLSMGIETVGGVMTQLITHHTVIPTNK

SEQ ID NO: 123261 - protein, 86 aa, Heterodera glycines
  Homolog annotation: Hit_ID=NP_510144.1; Match level="QueryCoverage =98%, HitCoverage=20%, E-value=2e-20, Identity=52%"; Hit description =branched-chain amino acid aminotransferase, cytosolic, ECA39 (47.3 kD) (eca-39) [Caenorhabditis elegans]
  Essential gene: C elegans homolog=K02A4.1; Phenotype=Emb,Lvl
  Coding regions on vcDNA: vcDNA=SeqID_49684; Strand=+; Position=1-261
QRYPSMRELRRAIDEQRLFQIFGSGTACAVSPVGRILYREPGTGQMEELLIPTITSSAHVMQRLYKTITDIQYGRVIRSDWTRTVA

SEQ ID NO: 123262 - protein, 89 aa, Heterodera glycines
  Homolog annotation: Hit_ID=XP_328535.1; Match level="QueryCoverage =100%, HitCoverage=35%, E-value=6e-35, Identity=73%"; Hit description= hypothetical protein [Neurospora crassa] gb|EAA33714.1| hypothetical protein [Neurospora crassa] sp|Q7SB
  Gene Ontology: Mol. function=structural constituent of ribosome; Cellular component=cytosolic large ribosomal subunit (sensu Eukarya); Biological process=protein biosynthesis
  Essential gene: C elegans homolog=F53G12.10; Phenotype=Emb,Lva
  Coding regions on vcDNA: vcDNA=SeqID_49685; Strand=+; Position=3-272
KVHGQRIALSDNAVVEKSLGKAGLICVEDLIHEIYTVGPNFKKANNFLWPFKLSSPNGAFNKRKFKHFIEGGDFGNREEFINELVRKMN

SEQ ID NO: 123263 - protein, 177 aa, Heterodera glycines
  misc_feature (66)..(66): Xaa can be any naturally occurring amino acid
  misc_feature (124)..(124): Xaa can be any naturally occurring amino acid
  Homolog annotation: Hit_ID=NP_871953.1; Match level="QueryCoverage =99%, HitCoverage=42%, E-value=3e-56, Identity=58%"; Hit description =i mitochondrial  ascsu pyruvate dehydrogenase e1 component type (45.8 kD) (2I357Co) [Caenorhabditis elega
  Gene Ontology: Mol. function=pyruvate dehydrogenase activity; Cellular component=mitochondrion; Biological process=acetyl-CoA metabolism
  Essential gene: C elegans homolog=T05H10.6a; Phenotype=Emb
  Coding regions on vcDNA: vcDNA=SeqID_49686; Strand=+; Position=2-532
TLQTRPYELFKLDSGPSTEVRLTLDDALDYYKKMLLVRLMDTSANNLYYEKRIRGFCHLYSRQNAXGVGMVAATDANDDVITAYRCHGWTYLMGATAPYILDELTGRIAGNVYRTSGSMHMYAXNFFCGQGIICEQLPIVAGIGFALKYRRQRNICLTLYGDGADNHRPLFTATNMT

SEQ ID NO: 123264 - protein, 192 aa, Heterodera glycines
  Homolog annotation: Hit_ID=NP_491780.1; Match level="QueryCoverage =100%, HitCoverage=45%, E-value=1e-66, Identity=56%"; Hit description= of inner mitochondrial membrane 44 (49.4 kD) (1G754) [Caenorhabditis elegans] gb|AAB53011.1| Hypothetica
  Gene Ontology: Mol. function=protein transporter activity; Cellular component=mitochondrial matrix; Biological process=mitochondrial translocation
  Essential gene: C elegans homolog=T09B4.9; Phenotype=Lva
  Coding regions on vcDNA: vcDNA=SeqID_49687; Strand=+; Position=3-578
NSYYNKIIDWKTRIDESENIFVRTVRGTFERVQLAFESKDNVSEVLTQISKIDPEFDKSEWLRFCEKEMIPNILESTYQMNFEVLRDWCYEKAFNLIANSIKEYEKIGFNTRDSRIIDVSKVELVTGNMTDQGPTLVIQFQVFMTNVVKNSEGKIVQGDPEKAVRVRHIWVICRDMEEFNPATAWKLLELHM

SEQ ID NO: 123265 - protein, 49 aa, Heterodera glycines
  Homolog annotation: Hit_ID=NP_498231.1; Match level="QueryCoverage =97%, HitCoverage=34%, E-value=4e-13, Identity=75%"; Hit description =ribosomal Protein, Large subunit (15.0 kD) (rpl-23) [Caenorhabditis elegans] gb|AAK18857.1| Ribosomal pro
  Essential gene: C elegans homolog=B0336.10; Phenotype=Emb,Ste
  Coding regions on vcDNA: vcDNA=SeqID_49688; Strand=+; Position=2-148
GASGAKFRVSLALPVGARINCADNTGANNLSAIAVYVIRGRLTRMPTAA

SEQ ID NO: 123266 - protein, 60 aa, Heterodera glycines
  Homolog annotation: Hit_ID=NP_504688.1; Match level="QueryCoverage =100%, HitCoverage=55%, E-value=3e-21, Identity=86%"; Hit description= SyNaptoBrevin related, synaptic vesicle-associated membrane protein (12.0 kD) (snb-1) [Caenorhabditis el
  Gene Ontology: Mol. function=v-SNARE activity; Cellular component =synaptic vesicle; Biological process=nonselective vesicle transport
  Essential gene: C elegans homolog=T10H9.4; Phenotype=Rup,Unc
  Coding regions on vcDNA: vcDNA=SeqID_49689; Strand=+; Position=2-181
GGARPSNKRLQQTQAQVDEVVGIMKVNVEKVMERDQKLSQLDDHADALQYCATQYQKSAA

SEQ ID NO: 123267 - protein, 152 aa, Heterodera glycines
  Homolog annotation: Hit_ID=AAL06642.1; Match level="QueryCoverage =60%, HitCoverage=14%, E-value=1e-26, Identity=54%"; Hit description =serine-threonine protein kinase [Ancylostoma caninum]
  Essential gene: C elegans homolog=C32D5.2; Phenotype=Sma
  Coding regions on vcDNA: vcDNA=SeqID_49690; Strand=+; Position=30-485
MPTQSTVIPKFGIWSASPPSTTESGRSSSLPTSLLSVNNDSFGEVPLSNRCFCNYGPSVCDMEDTCIKHTSAVCFHAIVLEFNSGTGAIERRHFFGCAPLEKGSDASHLTCNAWRSSHSNGRTVACCYEGNFCNQNLTLPDSPALQVSTGLK

SEQ ID NO: 123268 - protein, 116 aa, Heterodera glycines
  Homolog annotation: Hit_ID=CAE70207.1; Match level="QueryCoverage =96%, HitCoverage=69%, E-value=2e-23, Identity=49%"; Hit description =Hypothetical protein CBG16683 [Caenorhabditis briggsae]
  Gene Ontology: Mol. function=structural constituent of ribosome; Cellular component=cytosolic large ribosomal subunit (sensu Eukarya); Biological process=protein biosynthesis
  Essential gene: C elegans homolog=C14B9.7; Phenotype=Emb
  Coding regions on vcDNA: vcDNA=SeqID_49691; Strand=+; Position=2-349
PNGYRRGSRYVFARPFHEHGVEPLSTFYRAYKRGDIVAVQGNSAFQKGMSFKAHLGDTGRVLNVTKHATGRLFQRECSPSHDPKRVYGRGRQEKPTGSHLEFLRRCETNKWQKKRK

SEQ ID NO: 123269 - protein, 183 aa, Heterodera glycines
  Homolog annotation: Hit_ID=NP_503446.1; Match level="QueryCoverage =70%, HitCoverage=26%, E-value=2e-29, Identity=48%"; Hit description =cell Division Cycle related (55.7 kD) (cdc-25.2) [Caenorhabditis elegans] gb|AAB94237.2| Cell division cy
  Gene Ontology: Mol. function=protein phosphatase activity; Cellular component=nucleus; Biological process=meiotic spindle assembly
  Essential gene: C elegans homolog=F16B4.8; Phenotype=Bmd,Emb,Lvl
  Coding regions on vcDNA: vcDNA=SeqID_49692; Strand=+; Position=6-554
MESYVQVEDQYSRDSGISLAQSTTSQQSCFAKIYFPTLYRLRGQGSIRLTPIKRAQVPHKGFRRINADTMANLLGSLTEELFQRRFILIDCRYPYEYDAGHIWYSLNLWETTSIEKLFYPEEEERFGEIIVRTPIFYCEYSQKRGPKMALALQEFDRVRNESRYPYVDYHDIYLMDRGYRYFF

SEQ ID NO: 123270 - protein, 77 aa, Heterodera glycines
  Homolog annotation: Hit_ID=NP_503425.2; Match level="QueryCoverage =100%, HitCoverage=46%, E-value=4e-21, Identity=62%"; Hit description= UNCoordinated locomotion UNC-60 (unc-60) [Caenorhabditis elegans] gb|AAL02461.1| Uncoordinated protein 6
  Essential gene: C elegans homolog=C38C3.5a; Phenotype=Let
  Coding regions on vcDNA: vcDNA=SeqID_49693; Strand=+; Position=29-259
FQTQRPGARTSNMDKTVFIHLCPEGASIKKKMLYASSASAIKASLGTAKILQFHASDQSDIAHKKSLTKLNDKYRDN

SEQ ID NO: 123271 - protein, 158 aa, Heterodera glycines
  Homolog annotation: Hit_ID=CAE67422.1; Match level="QueryCoverage =99%, HitCoverage=45%, E-value=2e-56, Identity=63%"; Hit description =Hypothetical protein CBG12910 [Caenorhabditis briggsae]
  Gene Ontology: Mol. function=protein methyltransferase activity; Cellular component=nucleus; Biological process=organogenesis
  Essential gene: C elegans homolog=Y113G7B.17; Phenotype=Gro,Rup
  Coding regions on vcDNA: vcDNA=SeqID_49694; Strand=+; Position=2-475
GVIEVIHSKIEDIEQLPGGIEHVDVIVSEWMGYCLFYESMLNTVIYARDKWLASDGILFPDKATLFLCAIEDRQYKDDYINWWDNVYGFNMSCIRQLAITEPLVDVVDRGQVVTDNVVLKEVDLYTVQVAELACETTFSLRGIPNDYVAALGAVFAGE

SEQ ID NO: 123272 - protein, 193 aa, Heterodera glycines
  Homolog annotation: Hit_ID=NP_495280.1; Match level="QueryCoverage =97%, HitCoverage=48%, E-value=3e-20, Identity=33%"; Hit description =hydroyxsteroid dehydrogenase like (40.9 kD) (2G648) [Caenorhabditis elegans] gb|AAC46799.1| Hypothetical
  Essential gene: C elegans homolog=C32D5.12; Phenotype=Dpy,Lvl,Unc
  Coding regions on vcDNA: vcDNA=SeqID_49695; Strand=+; Position=49-627
MGVKVAITGGSGFLAAHLIKRLRADANVDEIRTIDRKPFRQLGTIDDCPPSSVGFPSLIHFQCDLLDIAKLEKALDGVDVLFHLARKAFEYIFFADQKALNDRYSRDNLEATHSLLNTIFKCSVPRLVHVGDAFANIPPGDNFGSAEHIHRGLPSKFLLGHYGETRIKAELAGREKCGKILPNGQPFHALFLR

SEQ ID NO: 123273 - protein, 115 aa, Heterodera glycines
  misc_feature (38)..(38): Xaa can be any naturally occurring amino acid
  misc_feature (73)..(73): Xaa can be any naturally occurring amino acid
  Homolog annotation: Hit_ID=AAR27291.1; Match level="QueryCoverage =98%, HitCoverage=64%, E-value=6e-22, Identity=46%"; Hit description =cyclophilin [Thellungiella halophila]
  Gene Ontology: Mol. function=peptidyl-prolyl cis-trans isomerase activity; Cellular component=histone deacetylase complex; Biological process=protein metabolism
  Essential gene: C elegans homolog=Y75B12B.2; Phenotype=Emb
  Coding regions on vcDNA: vcDNA=SeqID_49696; Strand=+; Position=2-346
VTSAPNTAENFRALCTAQNGMGNSGKPLHYFSRRNLLXAIIPIFLVQGGDFSQCNGIARDSLSGQIISPQDFXKKHCLPRLLSMDDDDLLPNHSPIFFSTGKTNWLEGKLIWFNR

SEQ ID NO: 123274 - protein, 154 aa, Heterodera glycines
  Homolog annotation: Hit_ID=NP_494883.1; Match level="QueryCoverage =99%, HitCoverage=74%, E-value=6e-27, Identity=41%"; Hit description =glutathione S-Transferase (23.0 kD) (gst-7) [Caenorhabditis elegans] gb|AAB37846.1| Glutathione s-transfe
  Gene Ontology: Mol. function=glutathione transferase activity; Biological process=glutathione conjugation reaction
  Essential gene: C elegans homolog=R05F9.5a; Phenotype=Unclassified
  Coding regions on vcDNA: vcDNA=SeqID_49697; Strand=+; Position=9-470
MVHYKLYYFDLTARGEPIRYLLHYAGQPFEDIRIKAEDWQTEKPKFIYGQVPVLEVDGKQLAQQAAIMQYLAEKFELAGLFSWETAKALEITCYVNDIITELVPYLGATIGFLPGDEAALRSDVFLRCVKRAFPLLIAQLDQSKAGFMLPSGLA

SEQ ID NO: 123275 - protein, 163 aa, Heterodera glycines
  Homolog annotation: Hit_ID=NP_492417.1; Match level="QueryCoverage =100%, HitCoverage=6%, E-value=6e-73, Identity=79%"; Hit description =fatty acid synthase (1J552) [Caenorhabditis elegans] emb|CAB04244.1| Hypothetical protein F32H2.5 [Caenor
  Gene Ontology: Cellular component=mitochondrion; Biological process =polar body extrusion after meiotic divisions
  Essential gene: C elegans homolog=F32H2.5; Phenotype=Emb
  Coding regions on vcDNA: vcDNA=SeqID_49698; Strand=+; Position=1-489
VRSCLEIGPLGGVFHLAMVLRDCLFENQNQQNFKDAAEAKYFGTISLDEATRKGCEQLRWFVVFSSITSGRGNAGQTNYGWFFSTMERIIEQRRADGFPGIAIQWGAIGDVGVILENMGDNNTVVGGTLPQRMPSCLGSLDLFLSWNHPIVSSLLKRTPSGKK

SEQ ID NO: 123276 - protein, 194 aa, Heterodera glycines
  misc_feature (146)..(146): Xaa can be any naturally occurring amino acid
  Homolog annotation: Hit_ID=AAQ89579.1; Match level="QueryCoverage =100%, HitCoverage=29%, E-value=4e-97, Identity=91%"; Hit description= heat shock protein 70-C [Heterodera glycines] gb|AAM93256.1| heat shock protein 70-C [Heterodera glycines
  Gene Ontology: Mol. function=Hsp70/Hsp90 organizing protein activity; Cellular component=endoplasmic reticulum; Biological process=cell organization and biogenesis
  Essential gene: C elegans homolog=C15H9.6; Phenotype=Dpy,Lva
  Coding regions on vcDNA: vcDNA=SeqID_49699; Strand=+; Position=1-582
FTALLVIVCSKQEEGGAKEKKYCTIIGIDLGTTYSCVGVYKNGRVEIIANDQGNRITPSYVAFTPDSGERLIGDAAKYQLTLNPENTIFDAKRLIGREFTDKTVQDDMKLWPFKIYNKANKPHVQVKVGNEDKQFAAEEVSAMVLXKMKEIAESYLGHELKNAVLTVPAYFNDAQRTATKESATIPGPKLATIL

SEQ ID NO: 123277 - protein, 217 aa, Heterodera glycines
  Homolog annotation: Hit_ID=AAP41124.1; Match level="QueryCoverage =95%, HitCoverage=70%, E-value=2e-61, Identity=54%"; Hit description =aldose reductase [Pristionchus pacificus]
  Gene Ontology: Mol. function=aldo-keto reductase activity; Biological process=salinity response
  Essential gene: C elegans homolog=C35D10.6; Phenotype=Unc
  Coding regions on vcDNA: vcDNA=SeqID_49700; Strand=+; Position=6-656
MTNHLDRKGIEYVSKRMPKIGLGTYQIHGNDIFEVIDAALEVGYRFIDTAQIYRNEKHIGDALTELLPKYGLKREDIFITTKLSPANQGTAKCANSLAESLRLLRTDYVDLALIHWPGTSRLKRENPRNAQLRAESWKAMEQMHGEGQLRAIGVSNFNVPHLEQLIGGGWAKVMPAVNQCECHPHWAQPQLIAFCARNGIHFQAYSSFGGESNRGEL

SEQ ID NO: 123278 - protein, 131 aa, Heterodera glycines
  misc_feature (88)..(88): Xaa can be any naturally occurring amino acid
  Homolog annotation: Hit_ID=AAL26582.1; Match level="QueryCoverage =100%, HitCoverage=51%, E-value=3e-41, Identity=64%"; Hit description= ribosomal protein S6 [Spodoptera frugiperda] sp|Q95V32|RS6_SPOFR 40S ribosomal protein S6
  Gene Ontology: Cellular component=eukaryotic 48S initiation complex; Biological process=reproduction
  Essential gene: C elegans homolog=Y71A12B.1; Phenotype=Ste
  Coding regions on vcDNA: vcDNA=SeqID_49701; Strand=+; Position=2-394
KLNIAYPATGAQKHLRRLKMRKKLRIFFDKRMEQEVEADSMGDEWKGYVLRISGGNDKRRFPMKPGVITISRVRLLLSRGHCCYRPRXKGERKPKSGPGCIGHSNMSGLALVVGNRGEQEVEGLTDRVEPR

SEQ ID NO: 123279 - protein, 98 aa, Heterodera glycines
  misc_feature (36)..(36): Xaa can be any naturally occurring amino acid
  misc_feature (38)..(38): Xaa can be any naturally occurring amino acid
  Homolog annotation: Hit_ID=CAC70149.1; Match level="QueryCoverage =98%, HitCoverage=42%, E-value=8e-18, Identity=49%"; Hit description =putative pre-mrna cleavage factor [Brugia malayi]
  Gene Ontology: Mol. function=RNA binding; Cellular component=nucleus; Biological process=mRNA processing
  Essential gene: C elegans homolog=F43G9.5; Phenotype=Emb,Sck,Stp
  Coding regions on vcDNA: vcDNA=SeqID_49702; Strand=+; Position=2-295
KMIPWYPLTNHTVGTTETHSERETSLIARIQRLRDXIXNTGMRPMADGVLLAHQHSLTHGMLLQIQTTFFKLAGRELSHAEKWVGRTKRMLEQDTRRD

SEQ ID NO: 123280 - protein, 163 aa, Heterodera glycines
  misc_feature (62)..(62): Xaa can be any naturally occurring amino acid
  Homolog annotation: Hit_ID=NP_491654.1; Match level="QueryCoverage =100%, HitCoverage=28%, E-value=4e-58, Identity=65%"; Hit description= CBF1 interacting corepressor (65.8 kD) (1G222) [Caenorhabditis elegans] gb|AAB37808.1| Hypothetical prot
  Gene Ontology: Biological process=growth
  Essential gene: C elegans homolog=F55F8.4; Phenotype=Emb
  Coding regions on vcDNA: vcDNA=SeqID_49703; Strand=+; Position=2-490
GKGFPNFMTNKDFPPSAWGNLQMKCRSCRQKNDLKRTPQDDLHAHYDKDQEILNNKALLGDXQARMGLSFMDDAPAGINNNSDERSEPKYEWLRKYNAPREEWAKGNELIQDQPFRIQVRYVRCVKCLAWGHLNTDRECPLYGMSGNADYHGYANNPSDIIRD

SEQ ID NO: 123281 - protein, 101 aa, Heterodera glycines
  misc_feature (60)..(60): Xaa can be any naturally occurring amino acid
  Homolog annotation: Hit_ID=NP_741664.1; Match level="QueryCoverage =96%, HitCoverage=22%, E-value=4e-12, Identity=36%"; Hit description =glioma tumor suppressor candidate region gene 2 like (49.7 kD) (5T479) [Caenorhabditis elegans] emb|CAC51
  Essential gene: C elegans homolog=Y39B6A.33; Phenotype=Lva
  Coding regions on vcDNA: vcDNA=SeqID_49704; Strand=-; Position=2-304
KERKKGTILQKGQRALKAFSKRKRLGGEKFEPFEEPFVSVGELPANLSQLSPQGNVLEEXLKSFESRSFFRLAGERQPTTLKARLKFKMVERTHRVNERGG

SEQ ID NO: 123282 - protein, 155 aa, Heterodera glycines
  misc_feature (141)..(141): Xaa can be any naturally occurring amino acid
  Homolog annotation: Hit_ID=AAO14563.2; Match level="QueryCoverage =100%, HitCoverage=21%, E-value=1e-69, Identity=89%"; Hit description= Hsp90 [Heterodera glycines]
  Gene Ontology: Mol. function=heat shock protein activity; Cellular component=centrosome; Biological process=reproduction
  Essential gene: C elegans homolog=C47E8.5; Phenotype=Emb,Ste
  Coding regions on vcDNA: vcDNA=SeqID_49705; Strand=+; Position=2-466
SEQSLATFAFQAEIAQMMSLIINTFYSNKEIFLRELISNSSDALDKIRYQALTDPSQMESGKELFIQIVPIKSFKTLTIIDTGIGMTTADLVNNLGTIAKSGTKAFMEALQAGADISMIGQFRVGLYSAFLGADRVNVTSXHHDDDRYQWDNSAG

SEQ ID NO: 123283 - protein, 196 aa, Heterodera glycines
  Homolog annotation: Hit_ID=NP_502121.1; Match level="QueryCoverage =81%, HitCoverage=55%, E-value=3e-20, Identity=33%"; Hit description =putative nuclear protein, with 2 coiled coil-4 domains (33.3 kD) (4M62) [Caenorhabditis elegans] emb|CAA9
  Essential gene: C elegans homolog=B0035.15; Phenotype=Gro
  Coding regions on vcDNA: vcDNA=SeqID_49706; Strand=+; Position=25-612
MIKNFLQRMLSPILRSETVIKLNQKSALKRIDAIEKGKIKALAPKHTTTAKLQRDIDKDNKIKEVLNSKENSFIDRINKITINSSDPPITANRQGIRKEQYGQQNFSEHEYGFFELPLEKMKNNKVMFREAIEILRARMELLSNKSPHDQSFFEQQSDYIQNHPAVKRVDKDKLERVWQYFRPFAIIRDQMLLSKR

SEQ ID NO: 123284 - protein, 210 aa, Heterodera glycines
  misc_feature (64)..(64): Xaa can be any naturally occurring amino acid
  misc_feature (107)..(107): Xaa can be any naturally occurring amino acid
  Homolog annotation: Hit_ID=NP_501727.1; Match level="QueryCoverage =95%, HitCoverage=64%, E-value=4e-82, Identity=76%"; Hit description =adenine nucleotide family member (4K472) [Caenorhabditis elegans] emb|CAA92472.1| Hypothetical protein K0
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_49707; Strand=+; Position=38-667
MSENKSEGGAEKKKSGGFNTKKFLLDLASGGTAAAVSKTAVAPIERVKLLLQVQDASIHITADXRYKGIIDVLVRVPKEQGFLSLWRGNLANVIRYFPTQALNFAFXDTYKRVFTQGVDKEKQFLKFFTMNLASGGAAGATSLCYVYPMDFARTRLATDVVKADARSVRSLAYWIMQIRKSDGPIGLYRGFFGSVRGIIILRASYFGWFD

SEQ ID NO: 123285 - protein, 71 aa, Heterodera glycines
  Homolog annotation: Hit_ID=AAN52380.1; Match level="QueryCoverage =98%, HitCoverage=56%, E-value=1e-12, Identity=52%"; Hit description =ribosomal protein L35 [Branchiostoma belcheri] gb|AAO31777.1| ribosomal protein L35 [Branchiostoma belcher
  Gene Ontology: Mol. function=structural constituent of ribosome; Cellular component=cytosolic large ribosomal subunit (sensu Eukarya); Biological process=protein biosynthesis
  Essential gene: C elegans homolog=ZK652.4; Phenotype=Emb,Ste
  Coding regions on vcDNA: vcDNA=SeqID_49708; Strand=+; Position=2-214
TRVKTHELQVKKKEELMRMLEELKTELGSLHVSKVTNGAVSKLSNIHEARQEIVRILTGIRQRPKNDLLQF

SEQ ID NO: 123286 - protein, 154 aa, Heterodera glycines
  Homolog annotation: Hit_ID=CAE67737.1; Match level="QueryCoverage =100%, HitCoverage=100%, E-value=7e-26, Identity=42%"; Hit description=Hypothetical protein CBG13312 [Caenorhabditis briggsae]
  Gene Ontology: Mol. function=NADH dehydrogenase (ubiquinone) activity; Cellular component=membrane fraction; Biological process =gametogenesis
  Essential gene: C elegans homolog=Y56A3A.19; Phenotype=Lva
  Coding regions on vcDNA: vcDNA=SeqID_49709; Strand=+; Position=7-468
MNKAFVKAALCSKSTNVCLFKRLVRPVVQIGSRPITGAGFGHPMTRQKMQMYSPEMRAVNYQQKRTHMHAILTKKTVEDCVMLNLHLFDKVDNDKLTFDSDFFKDLGIDSLDFVEFIIAIEDEFEFEIPDGDSDRMRTPRDVYNYICDKCDVYD

SEQ ID NO: 123287 - protein, 122 aa, Heterodera glycines
  Homolog annotation: Hit_ID=CAE68974.1; Match level="QueryCoverage =99%, HitCoverage=8%, E-value=1e-23, Identity=45%"; Hit description =Hypothetical protein CBG14956 [Caenorhabditis briggsae]
  Essential gene: C elegans homolog=Y47G6A.12; Phenotype=Mei
  Coding regions on vcDNA: vcDNA=SeqID_49710; Strand=+; Position=1-369
GCSSVRVVDEGPGLDGRSSVYEYMIARAPCVIGCLWMVTDGEIDRFFMALTEYCFAELHKKEGGAVPDTFRLLLEGVLEARRRCKLPFLTGAAVVAYGLPVAAALTAALSSPAVSGTLSSSN

SEQ ID NO: 123288 - protein, 125 aa, Heterodera glycines
  Homolog annotation: Hit_ID=CAE62725.1; Match level="QueryCoverage =74%, HitCoverage=20%, E-value=3e-24, Identity=60%"; Hit description =Hypothetical protein CBG06885 [Caenorhabditis briggsae]
  Gene Ontology: Mol. function=enoyl-CoA hydratase activity; Cellular component=mitochondrial membrane; Biological process=fatty acid beta- oxidation
  Essential gene: C elegans homolog=B0303.3; Phenotype=Emb
  Coding regions on vcDNA: vcDNA=SeqID_49711; Strand=+; Position=99-473
MLCLSMLYVLPFSNRIQLSVSCWLLIFKDTLLKECKTSNIAREAAITAGFPDSIPCNTVTLACISSGVSIQNISLMISTGYLKAGIAGGVELLSDFPIRYNRKVRLSLIDLQKGKSFGERFKHLK

SEQ ID NO: 123289 - protein, 204 aa, Heterodera glycines
  Homolog annotation: Hit_ID=CAE59922.1; Match level="QueryCoverage =100%, HitCoverage=23%, E-value=1e-80, Identity=73%"; Hit description= Hypothetical protein CBG03408 [Caenorhabditis briggsae]
  Gene Ontology: Cellular component=COPI vesicle coat; Biological process=intracellular protein transport
  Essential gene: C elegans homolog=T14G10.5; Phenotype=Gro,Ste,Unc
  Coding regions on vcDNA: vcDNA=SeqID_49712; Strand=+; Position=1-612
PKPTLRFAAVRTLNRISIDYPQAVISCNVDLEQLITDSNRSIATLAITTLLKTGAEASVERLMKQIGTFVSEISDEFKIVVIEAIRSLCHRYPRKHATLMNFLASMLRDEGGFDYKKAIVDTIITIVEDNPGAKDLGLSHLCEFIEDCEHAALATRVLHLLGREGPTTANPSRYIRFIESRVSVESSQVRAAAVTARAEIGAEC

SEQ ID NO: 123290 - protein, 113 aa, Heterodera glycines
  misc_feature (86)..(86): Xaa can be any naturally occurring amino acid
  Homolog annotation: Hit_ID=CAE73435.1; Match level="QueryCoverage =80%, HitCoverage=14%, E-value=1e-14, Identity=45%"; Hit description =Hypothetical protein CBG20878 [Caenorhabditis briggsae]
  Essential gene: C elegans homolog=R05H10.2; Phenotype=Lva
  Coding regions on vcDNA: vcDNA=SeqID_49713; Strand=+; Position=3-342
RGLNCLRKLNNNPTTFSDERRPIVEFSIENLNALRVKERRQQKETKSEENEEEKQQTKNRVGNAEALEKTKREMMAGGKKWLPFFXGTKIRHKKPQNGLSTTPGKRRGQTKNK

SEQ ID NO: 123291 - protein, 85 aa, Heterodera glycines
  Homolog annotation: Hit_ID=CAE68925.1; Match level="QueryCoverage =98%, HitCoverage=66%, E-value=3e-22, Identity=63%"; Hit description =Hypothetical protein CBG14904 [Caenorhabditis briggsae]
  Gene Ontology: Mol. function=hydrogen-exporting ATPase activity, phosphorylative mechanism; Cellular component=integral to synaptic vesicle membrane
  Essential gene: C elegans homolog=F46F11.5; Phenotype=Emb
  Coding regions on vcDNA: vcDNA=SeqID_49714; Strand=+; Position=2-256
VSHTDGIQQLLAAEKRAAEKINDARKLKAQRLKQAKQEAQAEIDQYRHEREQRFREFVFFYLGTRDDIEAHIYYDTQANLKAMEQ

SEQ ID NO: 123292 - protein, 96 aa, Heterodera glycines
  misc_feature (20)..(20): Xaa can be any naturally occurring amino acid
  Homolog annotation: Hit_ID=AAH76693.1; Match level="QueryCoverage =98%, HitCoverage=35%, E-value=4e-23, Identity=55%"; Hit description =LOC447981 protein [Xenopus tropicalis]
  Gene Ontology: Mol. function=structural constituent of ribosome; Cellular component=cytosolic large ribosomal subunit (sensu Eukarya); Biological process=protein biosynthesis
  Essential gene: C elegans homolog=Y24D9A.4a; Phenotype=Ste
  Coding regions on vcDNA: vcDNA=SeqID_49715; Strand=+; Position=47-334
AVENKKASLDVVAHDVDPIXIVICLPAICRKFGVPYAIVKGKVFLGQVVYRKTTFVECLCDVNPEDRNSLTNLAEGAVTHINEPSDELPKNSGGAI

SEQ ID NO: 123293 - protein, 118 aa, Heterodera glycines
  misc_feature (12)..(12): Xaa can be any naturally occurring amino acid
  misc_feature (26)..(26): Xaa can be any naturally occurring amino acid
  Homolog annotation: Hit_ID=CAE70207.1; Match level="QueryCoverage =99%, HitCoverage=72%, E-value=8e-29, Identity=52%"; Hit description =Hypothetical protein CBG16683 [Caenorhabditis briggsae]
  Gene Ontology: Mol. function=structural constituent of ribosome; Cellular component=cytosolic large ribosomal subunit (sensu Eukarya); Biological process=protein biosynthesis
  Essential gene: C elegans homolog=C14B9.7; Phenotype=Emb
  Coding regions on vcDNA: vcDNA=SeqID_49716; Strand=+; Position=26-379
GHGAFQKDVPFXAEHRKTGRVFNATXHALGVLRNKRVLHRIIPKRINVRVEHVKPSGSRLKFLQRCKANDLQKKQHKEGNAPFVALKRKPKEPRVAHLVKVKSTKVERLAPVKFKIVA

SEQ ID NO: 123294 - protein, 142 aa, Heterodera glycines
  Homolog annotation: Hit_ID=CAE71331.1; Match level="QueryCoverage =94%, HitCoverage=82%, E-value=3e-40, Identity=61%"; Hit description =Hypothetical protein CBG18231 [Caenorhabditis briggsae]
  Gene Ontology: Mol. function=RNA binding; Cellular component=small nuclear ribonucleoprotein complex; Biological process=positive regulation of growth rate
  Essential gene: C elegans homolog=Y48A6B.3; Phenotype=Gro
  Coding regions on vcDNA: vcDNA=SeqID_49717; Strand=+; Position=3-428
SQQNITEQSVSAPTTDRNEYEELSKLVNPIAKPLANRKLAKKVYKLVKKAAKEKGFLRHGLADVMKAFRKNEKGIIVLAGNVSPIDVYSHIPAICEKKGLPYVFTPSREQLGLCAGYKRPAGGLLGKRRESYAELLQRTPEA

SEQ ID NO: 123295 - protein, 86 aa, Heterodera glycines
  misc_feature (54)..(54): Xaa can be any naturally occurring amino acid
  Homolog annotation: Hit_ID=NP_499152.1; Match level="QueryCoverage =100%, HitCoverage=53%, E-value=7e-25, Identity=65%"; Hit description= initiation Factor Five eIF-5A homolog (17.9 kD) (iff-1) [Caenorhabditis elegans] pir||S41010 translation
  Gene Ontology: Mol. function=translation initiation factor activity; Cellular component=ribosome; Biological process=translational initiation
  Essential gene: C elegans homolog=T05G5.10; Phenotype=Emb
  Coding regions on vcDNA: vcDNA=SeqID_49718; Strand=+; Position=93-350
MAESGEHDHDFTSGESGAAATYPKQCSALRKNEFVMIKGRPCKVVEMSTSNIFXHGHAKVHLDALYIFPTKKEEDDRPFTHRLKVP

SEQ ID NO: 123296 - protein, 142 aa, Heterodera glycines
  misc_feature (75)..(75): Xaa can be any naturally occurring amino acid
  Homolog annotation: Hit_ID=BAD11763.1; Match level="QueryCoverage =73%, HitCoverage=22%, E-value=2e-25, Identity=48%"; Hit description =mitochondria bc1 complex core subunit 1 [Brugia malayi]
  Gene Ontology: Mol. function=mitochondrial processing peptidase activity; Cellular component=mitochondrial processing peptidase complex; Biological process=mitochondrial processing
  Essential gene: C elegans homolog=F56D2.1; Phenotype=Emb
  Coding regions on vcDNA: vcDNA=SeqID_49719; Strand=+; Position=23-449
MLKMLLKFPSIHRFCSIRSLTQLPNSYEVLRDRGDTAELSQLKNGFRVASYANGRPTVTVGVWLNAGSRIETNDXNGIASLFEGLLHKGSGKRNSVQLQTELAKLGARLRSFTTREHSAFFVECLKSDTDKVVELLADALLN

SEQ ID NO: 123297 - protein, 108 aa, Heterodera glycines
  Homolog annotation: Hit_ID=CAE65195.1; Match level="QueryCoverage =100%, HitCoverage=41%, E-value=4e-38, Identity=76%"; Hit description= Hypothetical protein CBG10070 [Caenorhabditis briggsae]
  Gene Ontology: Mol. function=hydrogen-transporting ATPase activity, rotational mechanism; Cellular component=vacuolar membrane (sensu Fungi); Biological process=hydrogen transport
  Essential gene: C elegans homolog=F55H2.2; Phenotype=Emb
  Coding regions on vcDNA: vcDNA=SeqID_49720; Strand=+; Position=2-325
GGGKDRIAVFPSRMAQTVMKTRLKGAQKRHSLLNKKADALNMRFREILKKITENKKRMADVLKDFFFSLAEAKFTAGDFSHMLDQNAASQAQYTVRMNRHNVVGVSQP

SEQ ID NO: 123298 - protein, 114 aa, Heterodera glycines
  Homolog annotation: Hit_ID=NP_498774.1; Match level="QueryCoverage =92%, HitCoverage=65%, E-value=9e-28, Identity=55%"; Hit description =ribosomal Protein, Large subunit (18.3 kD) (rpl-21) [Caenorhabditis elegans] gb|AAA27951.1| Ribosomal pro
  Gene Ontology: Mol. function=structural constituent of ribosome; Cellular component=cytosolic large ribosomal subunit (sensu Eukarya); Biological process=protein biosynthesis
  Essential gene: C elegans homolog=C14B9.7; Phenotype=Emb
  Coding regions on vcDNA: vcDNA=SeqID_49721; Strand=+; Position=2-343
ARTKFRRSFRKHSGEALTTCYRECKRGDIVTVKGNGAFQKGMPIKACHGNTGRVFTVSQHALFFVLNKRVRHRIIPIRISVRVEHVKPSGSRLEFLPRSKANDLHKKPHNEGRP

SEQ ID NO: 123299 - protein, 200 aa, Heterodera glycines
  Homolog annotation: Hit_ID=AAO15464.1; Match level="QueryCoverage =100%, HitCoverage=98%, E-value=1e-94, Identity=81%"; Hit description= 60S ribosomal protein L15 [Spodoptera frugiperda]
  Gene Ontology: Mol. function=structural constituent of ribosome; Cellular component=cytosolic large ribosomal subunit (sensu Eukarya); Biological process=protein biosynthesis
  Essential gene: C elegans homolog=K11H12.2; Phenotype=Gro,Stp
  Coding regions on vcDNA: vcDNA=SeqID_49722; Strand=+; Position=23-622
MGAYKYIQELYRKKQSDVLRFLLRIRVWQYRQLTKMHRAPKPSRPDKARRMGYKAKHGYAVFRIRVRRGGRKKPVPKGATYGKPKSQGVNQLKPTRNLQSVAEERVGRRCGGLRVLNSYWVAEDSTYKYFEVICVDPAHKAIRRDPKANWICKPVMKHRELPGLTSAGRKSRRTWKGHRYSQTKGGISRAVWLRKNSLFL

SEQ ID NO: 123300 - protein, 157 aa, Heterodera glycines
  misc_feature (84)..(84): Xaa can be any naturally occurring amino acid
  misc_feature (113)..(113): Xaa can be any naturally occurring amino acid
  misc_feature (123)..(123): Xaa can be any naturally occurring amino acid
  misc_feature (151)..(151): Xaa can be any naturally occurring amino acid
  Homolog annotation: Hit_ID=CAB48391.1; Match level="QueryCoverage =100%, HitCoverage=78%, E-value=9e-58, Identity=70%"; Hit description= peroxiredoxin [Globodera rostochiensis]
  Gene Ontology: Mol. function=thioredoxin peroxidase activity; Cellular component=extracellular space; Biological process=response to oxidative stress
  Essential gene: C elegans homolog=F09E5.15; Phenotype=Sck,Sma
  Coding regions on vcDNA: vcDNA=SeqID_49723; Strand=+; Position=37-504
MSSSSKAFIGKPAPNFMADAVVNGDFKTISLEQFKGQYVVLFFYPLDFTFVCPTEIIAFSDKAGEFKKIGVQLIACSTDSKFAXLEWINKPRKQERLGEMNNPVAGEPSHQIXRGYRVLMEEXGIVYSGMFIIHEKGGLRSETHHQLPLGXSGEKNL

SEQ ID NO: 123301 - protein, 177 aa, Heterodera glycines
  Homolog annotation: Hit_ID=EAL17981.1; Match level="QueryCoverage =100%, HitCoverage=47%, E-value=4e-56, Identity=64%"; Hit description= hypothetical protein CNBK3320 [Cryptococcus neoformans var. neoformans B-3501A]
  Gene Ontology: Mol. function=methyltransferase activity; Cellular component=small nuclear ribonucleoprotein complex; Biological process=ribosomal large subunit assembly and maintenance
  Essential gene: C elegans homolog=T01C3.7; Phenotype=Emb,Lva
  Coding regions on vcDNA: vcDNA=SeqID_49724; Strand=+; Position=17-547
MVPGESVYGEKRISSQQTENAPIAAITPKTEETTNGSNGVSAPTAAAAGPAPPVEYRVWNPFRSKLAAAVMAGIEDTHIYPGARVLYLGAASGTSVSHVSDIVGPEGMVYAVEFSHRSGRDLLGMAKKRSNVVPIVDDARHPHKYSMMIGIVDTIFSDVAQPDQARIVAHNAHKFLK

SEQ ID NO: 123302 - protein, 213 aa, Heterodera glycines
  Homolog annotation: Hit_ID=EAK84309.1; Match level="QueryCoverage =99%, HitCoverage=79%, E-value=1e-89, Identity=71%"; Hit description =hypothetical protein UM03322.1 [Ustilago maydis 521] ref|XP _400937.1| hypothetical protein UM03322.1 [Usti
  Gene Ontology: Mol. function=structural constituent of ribosome; Cellular component=cytosolic large ribosomal subunit (sensu Eukarya); Biological process=protein biosynthesis
  Essential gene: C elegans homolog=F10B5.1; Phenotype=Lva,Ste
  Coding regions on vcDNA: vcDNA=SeqID_49725; Strand=+; Position=1-639
PRNYFKMGRRPSRCYRYCKNKPYPKSRFCRGVPDPKIRIYDMGRKRAGVEEFPLCVHLLSDELQQISSEALEAARVTANRFIFKQAGKDSFHLRVRVHPFHVLRINKMLSCAGADRLQTGMRGAYGKPYGTAARVNIGQILFSIRCKDSNKAVVIEALRRAKYKFPGRQKILVSKKWGFTKLSREDFQEGIQNGSVVPDGNGIKIYNNHGTLQ

SEQ ID NO: 123303 - protein, 148 aa, Heterodera glycines
  misc_feature (84)..(84): Xaa can be any naturally occurring amino acid
  Homolog annotation: Hit_ID=NP_491608.1; Match level="QueryCoverage =96%, HitCoverage=70%, E-value=2e-24, Identity=44%"; Hit description =ribosomal Protein, Large subunit (23.7 kD) (rpl-19) [Caenorhabditis elegans] gb|AAB53979.1| Ribosomal pro
  Gene Ontology: Cellular component=cytosolic ribosome (sensu Eukarya); Biological process=protein biosynthesis
  Essential gene: C elegans homolog=C09D4.5; Phenotype=Lva,Ste
  Coding regions on vcDNA: vcDNA=SeqID_49726; Strand=+; Position=95-538
HRLLIPKHCQSPFTLSRSRTLRRICKWPGHGDPNSSCDSPCPYATTLGFPIRPMRARRPLLNGYPDATTFSKHLYHELYLKLTXNAFQNKRKLMDYIFKKETQNKLSKPLAEQDEERLNKNKDTRKRREDRLASKRKELLHPVSDSDK

SEQ ID NO: 123304 - protein, 134 aa, Heterodera glycines
  misc_feature (27)..(27): Xaa can be any naturally occurring amino acid
  misc_feature (46)..(46): Xaa can be any naturally occurring amino acid
  Homolog annotation: Hit_ID=NP_498393.1; Match level="QueryCoverage =100%, HitCoverage=88%, E-value=5e-20, Identity=43%"; Hit description= ribosomal Protein, Small subunit (17.3 kD) (rps-13) [Caenorhabditis elegans] gb|AAB47594.1| Ribosomal pr
  Gene Ontology: Mol. function=structural constituent of ribosome; Cellular component=cytosolic small ribosomal subunit (sensu Eukarya); Biological process=protein biosynthesis
  Essential gene: C elegans homolog=C16A3.9; Phenotype=Emb
  Coding regions on vcDNA: vcDNA=SeqID_49727; Strand=+; Position=2-403
GTCISRSDVPYRRFEHPWQKLTLQEVXDQLLKLARSRLRPPSNCRXYLPDSLGGRQVPHVTGKLIMRILPSKGRAAEIWEDLCDVICKDGTILNVVERRRHDIDAADTVFWVESTINHFCRDFICKQMLKPTWK

SEQ ID NO: 123305 - protein, 219 aa, Heterodera glycines
  Homolog annotation: Hit_ID=NP_742069.1; Match level="QueryCoverage =100%, HitCoverage=38%, E-value=2e-58, Identity=51%"; Hit description= vesicular transport protein rvps45 [Rattus norvegicus] gb|AAH81705.1| Vesicular transport protein rvps45
  Gene Ontology: Mol. function=chaperone activity; Cellular component =TRAPP; Biological process=reproduction
  Essential gene: C elegans homolog=C44C1.4a; Phenotype=Gro,Lvl,Sma,Unc
  Coding regions on vcDNA: vcDNA=SeqID_49728; Strand=+; Position=1-657
QQLESIADMKKFVEQYPQFKKISGTVAKHVQLVGELSRMVTDENLLEISELEQNIAVANGDYSACLDSLRRLIQHPKTTDLNALRLAMLFSLRFEGNSGALSFVHELLRKRGMANKQLQLISTLLEFAGQRRRQNDLFGDRSAMEMTKRFIKGLKGVENIYTQHEPFILQLIDLASRGKLPESVYPSTDLANLNSRFENVILFVIGGTTFEESAAVANL

SEQ ID NO: 123306 - protein, 213 aa, Heterodera glycines
  Homolog annotation: Hit_ID=NP_492256.1; Match level="QueryCoverage =86%, HitCoverage=30%, E-value=1e-13, Identity=26%"; Hit description =kinase UPstream gene (in operon), Nuclear Pore complex Protein NPP-2 (68.0 kD) (npp-2) [Caenorhabditis el
  Gene Ontology: Biological process=negative regulation of FGF receptor signaling pathway
  Essential gene: C elegans homolog=T01G9.4; Phenotype=Egl,Emb,Pvl,Unc
  Coding regions on vcDNA: vcDNA=SeqID_49729; Strand=+; Position=3-641
VEYAQLLFQDDQLWEIAPEYLIASGLGSVGQRILDQLVSQFNWRGNTSVAQRLLTICDRYELGTAREDILRSLVLMLCRQGEWTSALGWALQMSSNELTVNVSRRILEGAISPDRIGQMRIFEALDDQFVNCSELVLLYKFYTFKRLLLEGELRQAVHILHELFIDNSSPVEFHAVLFEEMIRILCSFQQPLVGLDVLNPEEMITPGLDRELV

SEQ ID NO: 123307 - protein, 203 aa, Heterodera glycines
  Homolog annotation: Hit_ID=AAO85519.1; Match level="QueryCoverage =97%, HitCoverage=62%, E-value=2e-55, Identity=53%"; Hit description =putative serine/threonine phosphatase [Oesophagostomum dentatum] gb|AAO85518.1| putative serine/threonine
  Gene Ontology: Mol. function=protein serine/threonine phosphatase activity; Cellular component=cytoplasm; Biological process=protein amino acid dephosphorylation
  Essential gene: C elegans homolog=W09C3.6; Phenotype=Ste
  Coding regions on vcDNA: vcDNA=SeqID_49730; Strand=+; Position=7-615
MAVPFSLQVDGLIYRVRNSTYGQFPLDVTEHDLRQLCDATMDVFRQQQTLVRIQPPVNVCGDIHGQFTDLLRIFSTLGPPPEKKYLFLGDYVDRGPQSLETVVLLFCYKVKYPESVTLLRGNHECSNINRVYGFYSEIEQRYHQADTRRLFDMFNQTFAWMPYVGLIGDRILCMHGGISDRITSLQQLNELRRPLLTLPSPSL

SEQ ID NO: 123308 - protein, 117 aa, Heterodera glycines
  Homolog annotation: Hit_ID=CAD43146.1; Match level="QueryCoverage =81%, HitCoverage=33%, E-value=5e-12, Identity=40%"; Hit description =putative ribosomal protein S2 [Toxoplasma gondii]
  Gene Ontology: Mol. function=structural constituent of ribosome; Cellular component=integral to plasma membrane; Biological process =cell adhesion
  Essential gene: C elegans homolog=B0393.1; Phenotype=Emb,Ste
  Coding regions on vcDNA: vcDNA=SeqID_49731; Strand=+; Position=218-568
AQHRLSQHVPITSVAVLPPCSSARNHFHYNYSEPRLLLVSEAHVELQAVRHELYANTPRIATANTDSPLQLVDIAFPANDNQKLSFEQYSWMLLREILLDALGIHCTLCLWWITCDL

SEQ ID NO: 123309 - protein, 212 aa, Heterodera glycines
  Homolog annotation: Hit_ID=CAE64436.1; Match level="QueryCoverage =87%, HitCoverage=25%, E-value=4e-23, Identity=34%"; Hit description =Hypothetical protein CBG09139 [Caenorhabditis briggsae]
  Essential gene: C elegans homolog=T20B12.1; Phenotype=Emb
  Coding regions on vcDNA: vcDNA=SeqID_49732; Strand=+; Position=3-638
NRHFSHWSVPDDRRAEFTLEKVWHHLRYFEHSAAKEALREASELSGIEKVEFGGALGRRTRFQQKEVPQLFLQVTLSSSQNGDGSLAPSPSELPKNCESGDDTLLERIVFSEGTEQKVLNPVQCACVLNMALVERHGKATADEIRTEETTAFLEEIINQKSCWAVQFRALYERSLLERQNRRRMERACAQLESLGKVLDNATPSSVTLLHRL

SEQ ID NO: 123310 - protein, 124 aa, Heterodera glycines
  misc_feature (105)..(105): Xaa can be any naturally occurring amino acid
  Homolog annotation: Hit_ID=P53021; Match level="QueryCoverage=100%, HitCoverage=98%, E-value=7e-59, Identity=85%"; Hit description=Major sperm protein 1 gb|AAA29146.1| major sperm protein
  Essential gene: C elegans homolog=C04G2.4; Phenotype=Unclassified
  Coding regions on vcDNA: vcDNA=SeqID_49733; Strand=+; Position=2-373
QLPPEDVATMPTQKVVFNAPFDNEATYYMRVINPGTKRIGYAFKTTKPKRIYMNPPNGVLGPKESVDVAVSCDAFYPGSEDTKGDRVTVEWTNTPDPAATALQLXWFQGYWMVRRKNLPIEYNV

SEQ ID NO: 123311 - protein, 205 aa, Heterodera glycines
  Homolog annotation: Hit_ID=NP_502247.1; Match level="QueryCoverage =78%, HitCoverage=50%, E-value=3e-78, Identity=84%"; Hit description =protein phosphatase catalytic (36.3 kD) (4M623) [Caenorhabditis elegans] emb|CAB01174.1| Hypothetical pro
  Gene Ontology: Mol. function=protein phosphatase type 2A, intrinsic catalyst activity; Cellular component=cytoplasm; Biological process =embryogenesis and morphogenesis
  Essential gene: C elegans homolog=F38H4.9; Phenotype=Emb
  Coding regions on vcDNA: vcDNA=SeqID_49734; Strand=+; Position=47-661
MEAMEVDSKASGGGEPMNNNNNANSSSNPRTVLDESGGPKKMSHELSREFIKDIDEWIAQLYECKQLSETQVRLLCDKAREILKTESNVQEVKCPVTVCGDVHGQFHDLMELFKMGGKSPDTNYLFMGDYVDRGYYSVETVSLLVCLKVRYPERVTILRGNHESRQITQVYGFYDECLRKYGNSKVWNYFTDLFDYFPLTALVDG

SEQ ID NO: 123312 - protein, 200 aa, Heterodera glycines
  misc_feature (77)..(77): Xaa can be any naturally occurring amino acid
  Homolog annotation: Hit_ID=AAH47265.1; Match level="QueryCoverage =100%, HitCoverage=16%, E-value=7e-29, Identity=38%"; Hit description= MGC53503 protein [Xenopus laevis]
  Gene Ontology: Cellular component=cytoplasm
  Essential gene: C elegans homolog=F25G6.2; Phenotype=Emb,Lva
  Coding regions on vcDNA: vcDNA=SeqID_49735; Strand=+; Position=3-602
LLPLDHSLLDQLASVYARAGTEIKRMTFKSIEIAIKSIGMHSEELLNMINTCPSEAETLVARIVHLLTERTAPSVAXVDSVRKLHHSRNTDVRSLIPILTGLNKEELLQLVPKFVLSAKNSNSVPAFFKKLLFGRHIENGEPLITAQELLLELHRIRPNRKELGFLMQNLDILLVDANREFTIGKDVLANTVETLLNDEP

SEQ ID NO: 123313 - protein, 159 aa, Heterodera glycines
  Homolog annotation: Hit_ID=CAE68480.1; Match level="QueryCoverage =93%, HitCoverage=21%, E-value=5e-38, Identity=50%"; Hit description =Hypothetical protein CBG14281 [Caenorhabditis briggsae]
  Essential gene: C elegans homolog=F47B7.2a; Phenotype=Gro,Unc
  Coding regions on vcDNA: vcDNA=SeqID_49736; Strand=+; Position=85-561
MALEKVPKIDWNQFEVQYLDLVSALHYLLTVEVPRNPVLGNTELTALKRFVHLLRLHGPGSTSVRRLFYRLDEWLSSQHQPVVMTDKYLSTLDEIQSDLGHPIPSNTSFVACRGSKPFLRGYTCGLWTLFHLLTVQAYKERHRSPSFDPVAEVLEPIHS

SEQ ID NO: 123314 - protein, 106 aa, Heterodera glycines
  misc_feature (72)..(72): Xaa can be any naturally occurring amino acid
  misc_feature (79)..(79): Xaa can be any naturally occurring amino acid
  Homolog annotation: Hit_ID=CAE57854.1; Match level="QueryCoverage =100%, HitCoverage=70%, E-value=3e-24, Identity=50%"; Hit description= Hypothetical protein CBG00891 [Caenorhabditis briggsae]
  Gene Ontology: Mol. function=thioredoxin reductase (NADPH) activity; Cellular component=nucleus
  Essential gene: C elegans homolog=R05H5.3; Phenotype=Emb
  Coding regions on vcDNA: vcDNA=SeqID_49737; Strand=+; Position=1-318
DGSKVEAEVFLKDKVVAVYFSAGWCPPCRAFTPELKKFYEELKKAGKNFEVLFISLFRAAKDLVEYYRDFHXSLGLAQXGNPKIQELLQNNEKKTMPTGRRIKPIG

SEQ ID NO: 123315 - protein, 171 aa, Heterodera glycines
  Homolog annotation: Hit_ID=CAE71538.1; Match level="QueryCoverage =97%, HitCoverage=35%, E-value=9e-63, Identity=65%"; Hit description =Hypothetical protein CBG18478 [Caenorhabditis briggsae]
  Essential gene: C elegans homolog=T01B11.2a; Phenotype=Emb
  Coding regions on vcDNA: vcDNA=SeqID_49738; Strand=+; Position=129-641
MATEKAELVAKRAKMISSKCQTFYADEPILVTRASMQFLFDENGRRFLDCISNVQHVGHCHPRVVEAVHCQMRLSTCNIRFLSPLLTECAESLLQTLPAQLDTVLFCNSGSEANDLALQLARDWTGTRDVAVLEHAYHGHQTTAMQMSPYKFDRGAKIKRPKWGHVCPTPD

SEQ ID NO: 123316 - protein, 79 aa, Heterodera glycines
  Homolog annotation: Hit_ID=EAK96442.1; Match level="QueryCoverage =93%, HitCoverage=40%, E-value=2e-18, Identity=64%"; Hit description =ubiquitin-ribosomal protein fusion S27a [Candida albicans SC5314] gb|EAK96371.1| ubiquitin-ribosomal prote
  Essential gene: C elegans homolog=F25B5.4a; Phenotype=Emb
  Coding regions on vcDNA: vcDNA=SeqID_49739; Strand=+; Position=154-393
MEIFCLFFPLFFTILFRFAHRIILKQNIMFQIFVKTLTGKTITLEVEASDPIENVKAKIQGKEGIPPDQQRLIFAGTSA

SEQ ID NO: 123317 - protein, 114 aa, Heterodera glycines
  Homolog annotation: Hit_ID=P30757; Match level="QueryCoverage=100%, HitCoverage=92%, E-value=6e-51, Identity=88%"; Hit description =Histone H2B pir||S16084 histone H2B - sipunculid (Sipunculus nudus)
  Gene Ontology: Mol. function=DNA binding; Cellular component =nucleosome; Biological process=nucleosome assembly
  Essential gene: C elegans homolog=H02I12.6; Phenotype=Gro,Pvl,Ste
  Coding regions on vcDNA: vcDNA=SeqID_49740; Strand=+; Position=2-346
AKKAVKSTKAVRTGDKKRRKARKESYSVYIYRVLKQVHPDTGISSKAMSIMNSFVNDVFERIAAEASRLAHYNKRSTISSREIQTAVRLILPGELAKHAVSEGTKAVTKYPSSK

SEQ ID NO: 123318 - protein, 198 aa, Heterodera glycines
  Homolog annotation: Hit_ID=XP_418672.1; Match level="QueryCoverage =98%, HitCoverage=20%, E-value=2e-49, Identity=46%"; Hit description =PREDICTED: similar to cytoplasmic dynein intermediate chain 1 [Gallus gallus]
  Gene Ontology: Mol. function=protein binding; Cellular component =dynein complex; Biological process=microtubule-based movement
  Essential gene: C elegans homolog=C17H12.1; Phenotype=Emb,Lva
  Coding regions on vcDNA: vcDNA=SeqID_49741; Strand=+; Position=1-594
VINVWNTRFKTASPEMTFTSSSRVMSMTWDMFNANIIFGACYSGQICIWDTRVNKRMPVCKTPLTAKAHTQPLLCMRMVGTANAHDLVTISTDGRMCSWSIDNLQSPIEATELTCNRTKKPICALSMAFLHNSINNYVLGTEEGELYIGDRHAASGESSRNIAAHQLPITALDTHRALGAIDFSSLWLTCSMEFGIKL

SEQ ID NO: 123319 - protein, 52 aa, Heterodera glycines
  Homolog annotation: Hit_ID=EAK93554.1; Match level="QueryCoverage =86%, HitCoverage=34%, E-value=3e-12, Identity=75%"; Hit description =histone H2A [Candida albicans SC5314] gb|EAK93517.1| histone H2A [Candida albicans SC5314]
  Gene Ontology: Mol. function=DNA binding; Cellular component=nuclear nucleosome; Biological process=chromatin assembly/disassembly
  Essential gene: C elegans homolog=T23D8.6; Phenotype=Emb
  Coding regions on vcDNA: vcDNA=SeqID_49742; Strand=+; Position=2-157
KKMQITPRHLQLAVRNDEELNKLLSEVTISRGGVLPNIHTELLSKMQQNKQQ

SEQ ID NO: 123320 - protein, 169 aa, Heterodera glycines
  misc_feature (64)..(64): Xaa can be any naturally occurring amino acid
  Homolog annotation: Hit_ID=NP_493750.1; Match level="QueryCoverage =98%, HitCoverage=43%, E-value=1e-36, Identity=48%"; Hit description =T BoX family member, T-box transcription factor required for posterior body patterning, Male ABnormal MAB
  Gene Ontology: Mol. function=transcriptional repressor activity; Cellular component=transcription factor complex; Biological process =development
  Essential gene: C elegans homolog=T27A1.6; Phenotype=Emb
  Coding regions on vcDNA: vcDNA=SeqID_49743; Strand=+; Position=2-508
GHLYFVFMDVVPVERRHRFRYRYDKSQWQSAGKADKQPFGRLFLHNESPFSGEQLPLQLVTFDXAKLTNNEKSSPDPDQLLLNSMHKYRPRVHVLCVAPSADRSVQTPTFPRQFRRAADFDKLSRFPYRTFEFPETKFVAVTAYQNQLVTRKKIELNPFAKGFRDQKGD

SEQ ID NO: 123321 - protein, 183 aa, Heterodera glycines
  Homolog annotation: Hit_ID=NP_492209.1; Match level="QueryCoverage =100%, HitCoverage=69%, E-value=7e-54, Identity=60%"; Hit description= initiation factor (27.6 kD) (1I604) [Caenorhabditis elegans] emb|CAB00049.1| Hypothetical protein K04G2.
  Gene Ontology: Mol. function=electron transporter activity; Cellular component=eukaryotic translation initiation factor 2 complex; Biological process=electron transport
  Essential gene: C elegans homolog=K04G2.1; Phenotype=Lva
  Coding regions on vcDNA: vcDNA=SeqID_49744; Strand=+; Position=2-550
LDLGKKKKKKKAKTTELKLSEDEHEEEKEVTALAEGVGRTNLLDTKNPDAWTDYNYDEMLDMVFNIMREKNPEMVSGKKKTFVMKPPEVQRAGSKKTAFTNFTEICRLLKRDPKHVLQFLMAELGTTGSIDGNQCLIVKGKFQQKHFENVLRGYINEYVRCHTWRSSDTQLTKDVSPLFFIQC

SEQ ID NO: 123322 - protein, 56 aa, Heterodera glycines
  Homolog annotation: Hit_ID=CAE58579.1; Match level="QueryCoverage =98%, HitCoverage=30%, E-value=1e-13, Identity=63%"; Hit description =Hypothetical protein CBG01745 [Caenorhabditis briggsae]
  Gene Ontology: Mol. function=structural constituent of ribosome; Cellular component=cytosolic large ribosomal subunit (sensu Eukarya); Biological process=reproduction
  Essential gene: C elegans homolog=E04A4.8; Phenotype=Emb,Gro
  Coding regions on vcDNA: vcDNA=SeqID_49745; Strand=+; Position=2-169
TFGIWLRYHSRTGHHYMYREYLDVCEAEADTHCYHDMGARQRPQADLIQIVTAQTI

SEQ ID NO: 123323 - protein, 108 aa, Heterodera glycines
  Homolog annotation: Hit_ID=CAE57892.1; Match level="QueryCoverage =72%, HitCoverage=15%, E-value=2e-15, Identity=49%"; Hit description =Hypothetical protein CBG00938 [Caenorhabditis briggsae]
  Essential gene: C elegans homolog=W07A12.6; Phenotype=Egl
  Coding regions on vcDNA: vcDNA=SeqID_49746; Strand=+; Position=1-327
ANCTGAQFFSFALLLNNWSRPNCFGYLWHFGLDWQCHLIAPFLLHLLFRRQSVGLIVVAVLIIGSMCLRAFKCVSNGICNKSDVDIPVGSLLWTLAYSLSDSIRLNVM

SEQ ID NO: 123324 - protein, 145 aa, Heterodera glycines
  Homolog annotation: Hit_ID=CAE58967.1; Match level="QueryCoverage =86%, HitCoverage=40%, E-value=7e-09, Identity=28%"; Hit description =Hypothetical protein CBG02239 [Caenorhabditis briggsae]
  Essential gene: C elegans homolog=ZK381.1; Phenotype=Emb,Him
  Coding regions on vcDNA: vcDNA=SeqID_49747; Strand=+; Position=45-479
MPPLFPEKVESIRHLSTKSWEATFTKDYLSNEGQLRFLSRMCYLAMAHYLLYRGVLPKGVFKRRKLEDLAIYCFDGNTRWGRKLSEMMKGIREAIDQKYIKQAFVMINEDKEDPDVATEVFSVGFCYNEQHTMTVLDDKGNRIVS

SEQ ID NO: 123325 - protein, 169 aa, Heterodera glycines
  Homolog annotation: Hit_ID=NP_494937.1; Match level="QueryCoverage =56%, HitCoverage=15%, E-value=3e-16, Identity=43%"; Hit description =DiSHevelled related (dsh-2) [Caenorhabditis elegans] gb|AAK31465.1| Dishevelled related protein 2 [Caenor
  Essential gene: C elegans homolog=C27A2.6; Phenotype=Bmd,Pvl,Rup
  Coding regions on vcDNA: vcDNA=SeqID_49748; Strand=+; Position=37-543
FIPPTIEGEQLENDENVSPSRVSPTNAFGVQKSGHLLHNFAEPGPLTTKIYYYVDDQQIPFSTFFAIPPSKITLADFKKCITRRNYRYYCKVMDPALNAEVKTDIRDENAVLKPNSKNGRFELFLLSETQQTHSSASTLPIQKLQHVDAIRASLMEKRTTANNYILDGR

SEQ ID NO: 123326 - protein, 172 aa, Heterodera glycines
  misc_feature (72)..(72): Xaa can be any naturally occurring amino acid
  misc_feature (88)..(88): Xaa can be any naturally occurring amino acid
  misc_feature (111)..(111): Xaa can be any naturally occurring amino acid
  misc_feature (141)..(141): Xaa can be any naturally occurring amino acid
  misc_feature (160)..(160): Xaa can be any naturally occurring amino acid
  Homolog annotation: Hit_ID=NP_498118.1; Match level="QueryCoverage =99%, HitCoverage=47%, E-value=3e-22, Identity=35%"; Hit description =ATP/GTP binding protein, Gro-1 OPeron gene GOP-2 (39.7 kD) (gop-2) [Caenorhabditis elegans] gb|AAA19064.1
  Essential gene: C elegans homolog=C34E10.2; Phenotype=Emb
  Coding regions on vcDNA: vcDNA=SeqID_49749; Strand=+; Position=2-520
ISFVLRLESLLHSNKEFEYLFFVEQAEGTDEFPENVDIEDTGMLKKCNARDIGLFHDRDILSKLNLDCNHCXLVEDLMETRKGTMAYXFITTRGSLRGWRGPTTALTSADXLADSFPTVNAYVRDSARSHKPTTIMTMMIXSCSIVYRTKLPAFDNMHRXDVGEPAFTRKWM

SEQ ID NO: 123327 - protein, 73 aa, Heterodera glycines
  Homolog annotation: Hit_ID=CAE57587.1; Match level="QueryCoverage =98%, HitCoverage=44%, E-value=4e-19, Identity=65%"; Hit description =Hypothetical protein CBG00567 [Caenorhabditis briggsae]
  Gene Ontology: Mol. function=translation initiation factor activity; Cellular component=ribosome; Biological process=protein biosynthesis
  Essential gene: C elegans homolog=F54C9.1; Phenotype=Lva,Unc
  Coding regions on vcDNA: vcDNA=SeqID_49750; Strand=+; Position=2-220
RGESGGTASYPEQCSVLRCIELLMIKGRPCKLVEMSASYTGKRGPAEVLLVALDIFTFKNWDYICPSTHIMDV

SEQ ID NO: 123328 - protein, 116 aa, Heterodera glycines
  misc_feature (12)..(12): Xaa can be any naturally occurring amino acid
  misc_feature (70)..(70): Xaa can be any naturally occurring amino acid
  misc_feature (77)..(77): Xaa can be any naturally occurring amino acid
  misc_feature (100)..(101): Xaa can be any naturally occurring amino acid
  Homolog annotation: Hit_ID=AAV84251.1; Match level="QueryCoverage =99%, HitCoverage=34%, E-value=5e-39, Identity=67%"; Hit description =ribosomal protein S6 [Culicoides sonorensis]
  Gene Ontology: Cellular component=eukaryotic 48S initiation complex; Biological process=reproduction
  Essential gene: C elegans homolog=Y71A12B.1; Phenotype=Ste
  Coding regions on vcDNA: vcDNA=SeqID_49751; Strand=+; Position=2-349
EDEKKLRIFFDXRMAQEAEADSLGDEWKGYVLRISGGNNKQGFPMKHGVITNSRVRLLLSQGHSCYRLRXKGQRMRXSFLGCIGDSNMSGLALDAVKKGXXQIEGLADLVLPRRRG

SEQ ID NO: 123329 - protein, 175 aa, Heterodera glycines
  Homolog annotation: Hit_ID=EAL33903.1; Match level="QueryCoverage =99%, HitCoverage=39%, E-value=2e-28, Identity=35%"; Hit description =GA18733-PA [Drosophila pseudoobscura]
  Gene Ontology: Mol. function=protein binding; Cellular component =nuclear chromatin; Biological process=chromatin silencing
  Essential gene: C elegans homolog=C09G4.5a; Phenotype=Lvl,Sck,Stp
  Coding regions on vcDNA: vcDNA=SeqID_49752; Strand=+; Position=2-526
NHRGTVYSVSFNPFTHSEAPIYFATVRKNRVSVHLCPPEKGFLLVRQFQHQHANDEFYYSVTWAYNLEKAQHVLVVRGFRGIIRVVIPLNGRLRCALIGDGDSINELCTSPVSPMIVASASNDLTVRIWNVTYSQCLAILGGTNGHRDQDFDSSGAFLGTASMDHAVDLWHIGKA

SEQ ID NO: 123330 - protein, 168 aa, Heterodera glycines
  Homolog annotation: Hit_ID=NP_502293.1; Match level="QueryCoverage =66%, HitCoverage=14%, E-value=1e-54, Identity=79%"; Hit description =cleavage polyadenylation factor specificity (4M854) [Caenorhabditis elegans] pir||T20738 hypothetical pro
  Gene Ontology: Mol. function=endoribonuclease activity; Cellular component=mRNA cleavage and polyadenylation specificity factor complex; Biological process=mRNA cleavage
  Essential gene: C elegans homolog=F11A10.8; Phenotype=Emb
  Coding regions on vcDNA: vcDNA=SeqID_49753; Strand=+; Position=1-504
ALALLKQDVFIQARKYPLASQLNDIPNYIFSTIGLDGTHVELYDERKPIASSADLKLPFPGMDKSGRGVCLKNEVKACMFGALCPLRHIIKDKQVVCKHWLRGLCKKGDQCEFLHEYDLSRMPECFFFSKYLACSNRECPFRHIDPESKIKDCPWYDRGFCRHGPFCK

SEQ ID NO: 123331 - protein, 159 aa, Heterodera glycines
  Homolog annotation: Hit_ID=XP_392469.1; Match level="QueryCoverage =99%, HitCoverage=33%, E-value=1e-43, Identity=53%"; Hit description =similar to CG5735-PB [Apis mellifera]
  Gene Ontology: Biological process=synaptonemal complex formation
  Essential gene: C elegans homolog=B0414.5; Phenotype=Emb,Ste
  Coding regions on vcDNA: vcDNA=SeqID_49754; Strand=+; Position=2-478
VFSRKVFIGGLPIDITETELKQAFHKFGSLLVDWPNRSSDSHFVKKEHYSGAASRVTGYAFLIFLEEASVQRLIAKCYSEGDRFYMLMSSQTVREKPVQVRPWRLADMDYMPRPSAHLDPRRTIFIGGVPRPTKANELAFVLEAAFGPVCYASIDVDPE

SEQ ID NO: 123332 - protein, 66 aa, Heterodera glycines
  misc_feature (40)..(40): Xaa can be any naturally occurring amino acid
  Homolog annotation: Hit_ID=EAL23014.1; Match level="QueryCoverage =100%, HitCoverage=57%, E-value=6e-18, Identity=68%"; Hit description= hypothetical protein CNBA7810 [Cryptococcus neoformans var. neoformans B-3501A]
  Gene Ontology: Mol. function=structural constituent of ribosome; Cellular component=cytosolic large ribosomal subunit (sensu Eukarya); Biological process=protein biosynthesis
  Essential gene: C elegans homolog=C42C1.14; Phenotype=Lva
  Coding regions on vcDNA: vcDNA=SeqID_49755; Strand=+; Position=53-251
MVQRLQYRRRLSYNTKSNKVRVVKTPGGKLVYHYELKKGXASPKCGDCGSALTGIPALRPRKYATL

SEQ ID NO: 123333 - protein, 136 aa, Heterodera glycines
  Homolog annotation: Hit_ID=AAH53812.1; Match level="QueryCoverage =77%, HitCoverage=73%, E-value=4e-35, Identity=67%"; Hit description =Rps15-prov protein [Xenopus laevis] gb|AAH81261.1| Unknown (protein for MGC:86345) [Xenopus laevis] pir||C
  Gene Ontology: Mol. function=structural constituent of ribosome; Cellular component=eukaryotic 48S initiation complex; Biological process=positive regulation of growth rate
  Essential gene: C elegans homolog=F36A2.6; Phenotype=Lva
  Coding regions on vcDNA: vcDNA=SeqID_49756; Strand=+; Position=2-409
SFHQCVHPEDDFERLLPNGVTNSFTPVIPGRGRRKMNRGLNRKHKSLLVRLRKATLHCPKLMKPECVKTHLRDMIVLPEMVRCVVGIHSGKAYNQVEILADMIGYYLGEFSITHTPVQHRRPGICATHSSRVIPLK

SEQ ID NO: 123334 - protein, 152 aa, Heterodera glycines
  misc_feature (74)..(74): Xaa can be any naturally occurring amino acid
  Homolog annotation: Hit_ID=A45618; Match level="QueryCoverage=97%, HitCoverage=31%, E-value=7e-52, Identity=68%"; Hit description =translation elongation factor eEF-1 alpha chain - nematode (Onchocerca volvulus) sp|P27592|EF1A_ONCVO ELONGATI
  Gene Ontology: Mol. function=translation factor activity, nucleic acid binding
  Essential gene: C elegans homolog=R03G5.1a; Phenotype=Emb,Lva,Unc
  Coding regions on vcDNA: vcDNA=SeqID_49757; Strand=+; Position=2-460
LDSILPPLLPTDKPLRLPLQDVYNIGGIGTVPAGRGQTGALKPGMVDTFAPQRISCEPKKVEMPRQPLPEALPXDFFGFNAKNISVKDILPRSGATDAKTYPAKEAFIFPAQVIIINHPGLITAGYTPVGDWHTAHIACEFAQLKEKVRPTA

SEQ ID NO: 123335 - protein, 121 aa, Heterodera glycines
  misc_feature (114)..(114): Xaa can be any naturally occurring amino acid
  Homolog annotation: Hit_ID=NP_498126.1; Match level="QueryCoverage =100%, HitCoverage=64%, E-value=2e-17, Identity=43%"; Hit description= butyrate-induced transcript 1 like (19.4 kD) (3G364) [Caenorhabditis elegans] gb|AAG00038.1| Hypothetica
  Gene Ontology: Mol. function=co-chaperone activity; Cellular component=cytoplasm; Biological process=mitosis
  Essential gene: C elegans homolog=ZC395.10; Phenotype=Ste
  Coding regions on vcDNA: vcDNA=SeqID_49758; Strand=+; Position=2-364
RHPDVLWAQRANVGLLSIEVHDCKNPKFKLDKNKVIFEAQGQGIATGTDSKLYRAELDLYAPIDPEKSSYHIGARLVTLTLAKADTDAPWWPRLLSDKRKPSWLKVDFAPWKDXDEDDEEE

SEQ ID NO: 123336 - protein, 210 aa, Heterodera glycines
  Homolog annotation: Hit_ID=NP_492360.1; Match level="QueryCoverage =100%, HitCoverage=83%, E-value=1e-86, Identity=74%"; Hit description= proteasome Alpha Subunit (28.2 kD) (pas-4) [Caenorhabditis elegans] emb|CAB02269.1| Hypothetical protein
  Gene Ontology: Mol. function=endopeptidase activity; Cellular component=26S proteasome; Biological process=ubiquitin-dependent protein catabolism
  Essential gene: C elegans homolog=C36B1.4; Phenotype=Emb,Lva,Unc
  Coding regions on vcDNA: vcDNA=SeqID_49759; Strand=+; Position=18-647
MEHYDRAITIFSPDGRLFQVDYAQEAVKKGSTAVAVKGKNCVVIGVEKKSIPTLQDERTIRKIHALDSHVMVAFAGLSADARVLIDRARVECENYKLTLEDRVSVMHISRIIADIKQRYTQTTGRRPFGISMLVGGFDSDGTPHLFKTEPSGVYYELLAGSIGRNEKIVKEYLEKEYGNDNTADEESTLKLMLKSLAPVVQSGAQNIEIA

SEQ ID NO: 123337 - protein, 87 aa, Heterodera glycines
  Homolog annotation: Hit_ID=AAK92166.1; Match level="QueryCoverage =100%, HitCoverage=69%, E-value=6e-19, Identity=52%"; Hit description= ribosomal protein L31 [Spodoptera frugiperda] emb|CAC19413.1| ribosomal protein L31 [Heliothis virescens]
  Gene Ontology: Mol. function=structural constituent of ribosome; Cellular component=cytosolic large ribosomal subunit (sensu Eukarya); Biological process=protein biosynthesis
  Essential gene: C elegans homolog=W09C5.6a; Phenotype=Emb,Ste,Stp
  Coding regions on vcDNA: vcDNA=SeqID_49760; Strand=+; Position=2-262
YTIHLHKRFHGIRFQHRAPQAIQEVKKLAEQHMGTPYVRVDAPLNIFLWALGAHNVPFSRSGLTFALTHVTDDDSRGKLYPLATHVP

SEQ ID NO: 123338 - protein, 156 aa, Heterodera glycines
  Homolog annotation: Hit_ID=CAE56706.1; Match level="QueryCoverage =96%, HitCoverage=52%, E-value=5e-19, Identity=37%"; Hit description =Hypothetical protein CBG24492 [Caenorhabditis briggsae]
  Gene Ontology: Biological process=chromosome segregation
  Essential gene: C elegans homolog=C41G7.3; Phenotype=Him
  Coding regions on vcDNA: vcDNA=SeqID_49761; Strand=+; Position=35-502
MPLPCTAADTPNSLPGPAGASIGAFTGATSNGTSLDRELVQSVYNQNSPSFDRCCSYDYLLGNTDDTLPGGYASYLVYKIGGGFDYTDTTVALGLYGATVLSGCFLVPMLKKQDTKALTANAVVLAGLSVATSVAFYNIDKISAYWTMPFTLWAIF

SEQ ID NO: 123339 - protein, 74 aa, Heterodera glycines
  misc_feature (30)..(30): Xaa can be any naturally occurring amino acid
  Homolog annotation: Hit_ID=NP_495912.1; Match level="QueryCoverage =87%, HitCoverage=21%, E-value=2e-18, Identity=67%"; Hit description =haymaker protein (32.4 kD) (2J262) [Caenorhabditis elegans] emb|CAA93850.1| Hypothetical protein C18E9.6
  Essential gene: C elegans homolog=C18E9.6; Phenotype=Gro,Sma
  Coding regions on vcDNA: vcDNA=SeqID_49762; Strand=+; Position=27-248
MPNVTTEGNNIGSYEELRRKCRDLFPVCFXGAKAMVQKGLSSHFQVSHNISISPALNGYRFGATYVGYMEGDPS

SEQ ID NO: 123340 - protein, 48 aa, Heterodera glycines
  Homolog annotation: Hit_ID=NP_492576.1; Match level="QueryCoverage =100%, HitCoverage=35%, E-value=1e-09, Identity=64%"; Hit description= ribosomal Protein, Large subunit (15.4 kD) (rpl-14) [Caenorhabditis elegans] emb|CAB03835.1| Hypothetica
  Gene Ontology: Biological process=positive regulation of growth rate
  Essential gene: C elegans homolog=C04F12.4; Phenotype=Emb,Lva
  Coding regions on vcDNA: vcDNA=SeqID_49763; Strand=+; Position=2-145
IYHRFDEIGRVVYIAKGKDQGKLPALVNVIDSINVLLDGPSSGVTRRV

SEQ ID NO: 123341 - protein, 202 aa, Heterodera glycines
  misc_feature (83)..(83): Xaa can be any naturally occurring amino acid
  Homolog annotation: Hit_ID=NP_592833.1; Match level="QueryCoverage =98%, HitCoverage=83%, E-value=3e-62, Identity=61%"; Hit description =40s ribosomal protein s6 [Schizosaccharomyces pombe] emb|CAA91100.1| SPAC13G6.07c [Schizosaccharomyces po
  Gene Ontology: Cellular component=eukaryotic 48S initiation complex; Biological process=protein biosynthesis
  Essential gene: C elegans homolog=Y71A12B.1; Phenotype=Ste
  Coding regions on vcDNA: vcDNA=SeqID_49764; Strand=+; Position=2-610
KLNIADPSSGSRKTFEIDDEKRYHVLIDKRISQEIPGDQVGYEFKGYVFRITGGNDKQGFPMKHGVLVNHRVRLLLSEGHSCXRPRRTGERKRNAIRGCIINHDSAGVSLVDFKKGEDDIGGVTDVTVPKLLGSQRASEIRKTFELTKEDDVLKYEIRREVPKKAGKADFKVSRIQRLVTPLTLQRKRAHHAEKRIRAVAAP

SEQ ID NO: 123342 - protein, 203 aa, Heterodera glycines
  Homolog annotation: Hit_ID=CAE67815.1; Match level="QueryCoverage =86%, HitCoverage=35%, E-value=6e-15, Identity=30%"; Hit description =Hypothetical protein CBG13395 [Caenorhabditis briggsae]
  Essential gene: C elegans homolog=M176.2; Phenotype=Emb,Lva
  Coding regions on vcDNA: vcDNA=SeqID_49765; Strand=+; Position=3-611
NITEEFRQTVNFIENCYKDGFKQPLILFCQRADYMTHESKENNEKKLELKQVEINTGPIGGLGTSSRVTMLHQHVLSMANADISPRALPPNHTDTMVAKALHMAWNEFGNSEAVILFLHSSPSDTRLIESRQVQNEVARISNGQTKCVFLILREAINRLKLHPKDFSLILDDKYLVAVAVHRYSSTTPQELTFTREIIRRSTA

SEQ ID NO: 123343 - protein, 166 aa, Heterodera glycines
  misc_feature (136)..(136): Xaa can be any naturally occurring amino acid
  Homolog annotation: Hit_ID=NP_505412.2; Match level="QueryCoverage =95%, HitCoverage=40%, E-value=5e-63, Identity=68%"; Hit description =putative endoplasmic reticulum protein of fungal and metazoan origin (48.7 kD) (5J808) [Caenorhabditis el
  Essential gene: C elegans homolog=K07B1.5a; Phenotype=Emb
  Coding regions on vcDNA: vcDNA=SeqID_49766; Strand=-; Position=2-599
PRFYWFYEGKLYMWLQAFIAYWGYTADYDVYEYGEDIRKYGEKDRVLVIVNHQSTADVPTLFTVLQTKGVATRKVIGSAFGIIGRMHGDYFIQQGKATRDKELIRLKGHLQKVFWDRDRRWVILFPEGGFYFCFQXYAKENNFPHLEHCTLPRMGEQQINYKIILK

SEQ ID NO: 123344 - protein, 75 aa, Heterodera glycines
  misc_feature (10)..(10): Xaa can be any naturally occurring amino acid
  misc_feature (31)..(31): Xaa can be any naturally occurring amino acid
  misc_feature (43)..(43): Xaa can be any naturally occurring amino acid
  Homolog annotation: Hit_ID=NP_493270.1; Match level="QueryCoverage =100%, HitCoverage=16%, E-value=3e-19, Identity=62%"; Hit description= TuBulin, Alpha (49.9 kD) (tba-2) [Caenorhabditis elegans] emb|CAB16856.1| Hypothetical protein C47B2.3 [
  Gene Ontology: Mol. function=GTP binding; Cellular component =cytoskeleton; Biological process=microtubule-based process
  Essential gene: C elegans homolog=C47B2.3; Phenotype=Emb
  Coding regions on vcDNA: vcDNA=SeqID_49767; Strand=+; Position=2-226
NVDLSVFQHXNLFLYPQEHFPHATYSPLISXEKAYHNPLSVSXIPNTSFEPAKQKIKSDPHFGNYVHMCLLYRGD

SEQ ID NO: 123345 - protein, 216 aa, Heterodera glycines
  misc_feature (13)..(13): Xaa can be any naturally occurring amino acid
  misc_feature (118)..(118): Xaa can be any naturally occurring amino acid
  Homolog annotation: Hit_ID=A45618; Match level="QueryCoverage=99%, HitCoverage=46%, E-value=7e-93, Identity=77%"; Hit description =translation elongation factor eEF-1 alpha chain - nematode (Onchocerca volvulus) sp|P27592|EF1A_ONCVO ELONGATI
  Gene Ontology: Mol. function=translation factor activity, nucleic acid binding
  Essential gene: C elegans homolog=R03G5.1a; Phenotype=Emb,Lva,Unc
  Coding regions on vcDNA: vcDNA=SeqID_49768; Strand=+; Position=1-646
VPFDPISGFMATXMLEPSDRMPRFNGWAIQRKDGNASGKTLLEALDSILPPQRPTDNPLRLPLQDVYNIVGIGTVPGGCVETGVLKPGMEVTFAPPSISTEVKSLEMHQEYLPKALPXDNVGFNVKNISVKDIRRGSVASDSKNNPAKETKSFTAQVIIMNHPGQIAAGYTPVLDCHTAHITWKFAELKEKVDRQSGKIRDDNPKALKTGDAGIVH

SEQ ID NO: 123346 - protein, 145 aa, Heterodera glycines
  Homolog annotation: Hit_ID=CAE67381.1; Match level="QueryCoverage =95%, HitCoverage=31%, E-value=1e-39, Identity=56%"; Hit description =Hypothetical protein CBG12864 [Caenorhabditis briggsae]
  Gene Ontology: Mol. function=chaperone activity; Cellular component =vacuole (sensu Fungi); Biological process=protein folding
  Essential gene: C elegans homolog=C01G8.2; Phenotype=Emb
  Coding regions on vcDNA: vcDNA=SeqID_49769; Strand=+; Position=2-573
PRCHITSTGAILLADIIPSLIIKLFSPFIIDRVPFGFRHLLVCIMQALSFVIVAFSQSFTLSLIGIIFASLGSGLGENCLLALSSHYKRSTISAWSSGTGGAGIVGSVAYAALTEPKLFGLSPRNALLSMLIVPIIFAIASVIEF

SEQ ID NO: 123347 - protein, 183 aa, Heterodera glycines
  misc_feature (107)..(107): Xaa can be any naturally occurring amino acid
  Homolog annotation: Hit_ID=CAD60932.1; Match level="QueryCoverage =100%, HitCoverage=48%, E-value=1e-66, Identity=68%"; Hit description= beta actin [Dicentrarchus labrax]
  Gene Ontology: Biological process=reproduction
  Essential gene: C elegans homolog=T04C12.6; Phenotype=Ste
  Coding regions on vcDNA: vcDNA=SeqID_49770; Strand=+; Position=2-550
KLAALVVNYGSGMCKAGFTDDDAPRAGFPSIVGRPRHQGGMALHGYRTTTYSVEDYVAAPSRDILTLNYPIEHCILTNWDHMEKIWHHTFYNKMRVTPKDHPVLLTXVPLKPIANTQKMTQIMFDTFDTPAMYVAIHAVLTLYISGRTTCLTLDSGYGDTHTVPIYEGYTLTHTILTMDLGGR

SEQ ID NO: 123348 - protein, 201 aa, Heterodera glycines
  misc_feature (87)..(87): Xaa can be any naturally occurring amino acid
  Homolog annotation: Hit_ID=NP_501727.1; Match level="QueryCoverage =100%, HitCoverage=64%, E-value=1e-77, Identity=73%"; Hit description= adenine nucleotide family member (4K472) [Caenorhabditis elegans] emb|CAA92472.1| Hypothetical protein K
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_49771; Strand=+; Position=2-604
LEKKKSGGFNTKKFLLDLTSSGTAAAVSKTAVAPIQRVKVLLQEKDASIHITADKRYKGVIYVLVRVPMEQGFLSMWRGNLDNVIRXFPTQALNFAFKDTYKRGFTLGVDEEKQLLKIFAMNLASGGAAGATSMGFEYPLDSARTRLAADAGKADAREFKGSADCIMKILKSDGPIGLYRGFFVDGQGIIIYRAAYFCCFD

SEQ ID NO: 123349 - protein, 198 aa, Heterodera glycines
  misc_feature (64)..(64): Xaa can be any naturally occurring amino acid
  Homolog annotation: Hit_ID=CAE69076.1; Match level="QueryCoverage =88%, HitCoverage=57%, E-value=1e-53, Identity=57%"; Hit description =Hypothetical protein CBG15094 [Caenorhabditis briggsae]
  Gene Ontology: Biological process=positive regulation of embryonic development
  Essential gene: C elegans homolog=Y92H12BR.8; Phenotype=Lva
  Coding regions on vcDNA: vcDNA=SeqID_49772; Strand=+; Position=27-619
MAWLSRATFCPHQLHQKAVKTPLQKAVTSAAERALDIVGNASRVRLQDLRDNPGARTVGRQVRXEGHYQAGHTIGELQHASKPPLGWVWGDYYKPWQRSFDGDRRFNGDINLRREYIPISLVELQRLIDLGWLDTSRLVDIAAICATKLLEQKFKPELRQFGIHLTDEREEIFSTPINLEVQWALGTAIAAIERAGGR

SEQ ID NO: 123350 - protein, 171 aa, Heterodera glycines
  misc_feature (134)..(134): Xaa can be any naturally occurring amino acid
  Homolog annotation: Hit_ID=CAE74232.1; Match level="QueryCoverage =97%, HitCoverage=34%, E-value=3e-41, Identity=48%"; Hit description =Hypothetical protein CBG21917 [Caenorhabditis briggsae]
  Gene Ontology: Mol. function=adenylosuccinate lyase activity; Biological process=oviposition
  Essential gene: C elegans homolog=R06C7.5a; Phenotype=Gro,Pvl,Stp,Unc
  Coding regions on vcDNA: vcDNA=SeqID_49773; Strand=+; Position=2-514
DSTDQYGSVFVESGCRRSPLLRLFSPQNKALLWRQLWIWLAESERELGLEAQISAEMVAELKAQKHNINWDKIRANERTMKHEVVAHIHAYSEVCPLAKGIIHLGATSSFVQDNTCLILQREAIDHLLERLAIXLGRAADFAQNTPIFDPWAHHFQAGVVTTVGKGPQLWP

SEQ ID NO: 123351 - protein, 69 aa, Heterodera glycines
  Homolog annotation: Hit_ID=NP_497617.1; Match level="QueryCoverage =98%, HitCoverage=18%, E-value=2e-12, Identity=45%"; Hit description =phosphotyrosyl phosphatase activator (42.9 kD) (3D872) [Caenorhabditis elegans] gb|AAK29984.1| Hypothetic
  Essential gene: C elegans homolog=Y71H2AM.20a; Phenotype=Emb,Lva
  Coding regions on vcDNA: vcDNA=SeqID_49774; Strand=+; Position=45-251
LISILDLLEAWINEFPPEDMGLQRFGNKSFKKWFERLMSDGQSLLSDLFPENLKSAVLEIWPYLMDSFG

SEQ ID NO: 123352 - protein, 104 aa, Heterodera glycines
  misc_feature (56)..(56): Xaa can be any naturally occurring amino acid
  Homolog annotation: Hit_ID=NP_498778.1; Match level="QueryCoverage =91%, HitCoverage=55%, E-value=2e-11, Identity=41%"; Hit description =mitochondrial ribosomal protein L18 (19.4 kD) (3J235) [Caenorhabditis elegans] gb|AAA27999.1| Hypothetica
  Essential gene: C elegans homolog=D2007.4; Phenotype=Lva
  Coding regions on vcDNA: vcDNA=SeqID_49775; Strand=+; Position=2-313
SAALLQNYPRCLERERLQRNPSGWEFGKNRAQHNFIYRVIFCPTINAIAARVTHYXDGIEIEASAPVKTVHSQLYSLTDVSAAYNIGRMMAHRCHMAAIEHCMS

SEQ ID NO: 123353 - protein, 87 aa, Heterodera glycines
  misc_feature (60)..(60): Xaa can be any naturally occurring amino acid
  misc_feature (67)..(67): Xaa can be any naturally occurring amino acid
  Homolog annotation: Hit_ID=AAC24580.1; Match level="QueryCoverage =96%, HitCoverage=53%, E-value=8e-24, Identity=65%"; Hit description =ADP/ATP translocase [Heterodera glycines]
  Gene Ontology: Biological process=embryogenesis and morphogenesis
  Essential gene: C elegans homolog=T27E9.1a; Phenotype=Emb
  Coding regions on vcDNA: vcDNA=SeqID_49776; Strand=+; Position=2-262
SSVVSGQRIIIYRAAYFGCCDPSNMLFSREGKQMNFFINWAIAPVFTVASIVIHYPRDTXPKRMMIXLGREDLMAQNFGDCAVKIFK

SEQ ID NO: 123354 - protein, 148 aa, Heterodera glycines
  misc_feature (116)..(116): Xaa can be any naturally occurring amino acid
  Homolog annotation: Hit_ID=NP_495707.1; Match level="QueryCoverage =95%, HitCoverage=65%, E-value=2e-45, Identity=63%"; Hit description =ribosomal Protein, Large subunit (24.7 kD) (rpl-10) [Caenorhabditis elegans] emb|CAA88308.1| Hypothetical
  Gene Ontology: Mol. function=structural constituent of ribosome; Cellular component=cytosolic large ribosomal subunit (sensu Eukarya); Biological process=protein biosynthesis
  Essential gene: C elegans homolog=F10B5.1; Phenotype=Lva,Ste
  Coding regions on vcDNA: vcDNA=SeqID_49777; Strand=+; Position=2-448
GRRPALYYRCLRNKPYPKSRFCCGAPDPKSRIFDLSGKRGSVDEFPCGVLLISNVWEHFSSEALDAARICANKYMVNNCGMDVLHMSLRIQPFRVIPINKMMTCSGADRLHTGWRXSCGKPLGLLARVCIGDILTTDRVRDWHRALAL

SEQ ID NO: 123355 - protein, 279 aa, Heterodera glycines
  Homolog annotation: Hit_ID=CAE59974.1; Match level="QueryCoverage =100%, HitCoverage=79%, E-value=4e-48, Identity=38%"; Hit description= Hypothetical protein CBG03465 [Caenorhabditis briggsae]
  Gene Ontology: Mol. function=pre-mRNA splicing factor activity; Cellular component=spliceosome complex; Biological process=mRNA splicing
  Essential gene: C elegans homolog=F32B6.3; Phenotype=Gro
  Coding regions on vcDNA: vcDNA=SeqID_49778; Strand=+; Position=20-856
KMDLLEIIALKRKQIEDIAIEHGSGAKMIRHSDLFKKEKDAYLERQKQLGKEQHLSVKGLNTEELLDAKFSLTGSDSMPRPEVVRRLRARGQPIRLFGESDAMALKRLRRLEIEKTEQNEGWKNDFQAALSQVENEELMEQVIRGKRGKDEMGRHDVQIEQSEDDASWDQIVMMAPLLGSGNDQADCDLIRAFLSYILKRWGKELNAREESIKRSATGKMQAGMHKQTVEHLSPLMKSLEKYTVNNDIRLYLTNITKLCVVERKYIVASTAYMEMSIGN

SEQ ID NO: 123356 - protein, 276 aa, Heterodera glycines
  Homolog annotation: Hit_ID=NP_497290.1; Match level="QueryCoverage =65%, HitCoverage=74%, E-value=7e-46, Identity=48%"; Hit description =CDP-alcohol phosphatidyltransferase (26.8 kD) (3B526) [Caenorhabditis elegans] gb|AAC71137.1| Hypothetica
  Gene Ontology: Mol. function=cardiolipin synthase activity; Cellular component=mitochondrion; Biological process=lipid metabolism
  Essential gene: C elegans homolog=F23H11.9; Phenotype=Unclassified
  Coding regions on vcDNA: vcDNA=SeqID_49779; Strand=+; Position=25-852
MPTLNLSSFAPRRLFSTTAANFCCHSTIGLVASPMPTATGFAAYARFSTSDGPPSGSSAPHNNQLASPKPSADKMAEMGNADEEFDENGRETRERIGTIPNIICMLRMASTPLLGYLVVHEQYLPGCILFVLIAFTDILDGSVARHFPSQRSLLGTFLDPIADKFLISTLFITLTYMQLIPVPVTAIVFGRDLLLVLCSIVLRFKMVDAPLTVRRFFDPTVSPMRIQPTSLSKYNTFLQLSLVSLSLAAPVFNFPGHYALQGLQFLTVLTTVFSGL

SEQ ID NO: 123357 - protein, 232 aa, Heterodera glycines
  misc_feature (104)..(104): Xaa can be any naturally occurring amino acid
  misc_feature (151)..(151): Xaa can be any naturally occurring amino acid
  misc_feature (218)..(218): Xaa can be any naturally occurring amino acid
  Homolog annotation: Hit_ID=AAC79129.1; Match level="QueryCoverage =99%, HitCoverage=71%, E-value=2e-82, Identity=68%"; Hit description =glyceraldehyde-3-phosphate-dehydrogenase [Globodera rostochiensis] sp|O16027|G3P1_GLORO Glyceraldehyde-3-p
  Gene Ontology: Mol. function=glyceraldehyde 3-phosphate dehydrogenase (phosphorylating) activity; Cellular component=cytoplasm; Biological process=glycolysis
  Essential gene: C elegans homolog=K10B3.7; Phenotype=Unclassified
  Coding regions on vcDNA: vcDNA=SeqID_49780; Strand=+; Position=83-778
MVKPKVGINGFGRIGRLALRAAIEKDTVQVVAVNDPFIELDYMVYMFNYDSTHGRFKGKISTNAGNLVVEKEGKSAHTIKVFNLKDPAEIKWGEAGAEYVIESXGVLPPLRRALLIFKRCKKVVISAPSADAPMYVKGFNRNSTTRLRDEXNNHASWPTTCLASVGKVINDKFGFIQRLITTVVAVTAHPKTGDGATGKHWPNRTCAGQKFFPPTTGXAKGVGQSFPEFNEN

SEQ ID NO: 123358 - protein, 214 aa, Heterodera glycines
  Homolog annotation: Hit_ID=NP_500037.2; Match level="QueryCoverage =78%, HitCoverage=52%, E-value=3e-09, Identity=23%"; Hit description =cytochrome oxidase assembly protein like (35.2 kD) (4B855) [Caenorhabditis elegans] gb|AAF60807.2| Hypoth
  Essential gene: C elegans homolog=Y55F3AR.1; Phenotype=Gro
  Coding regions on vcDNA: vcDNA=SeqID_49781; Strand=+; Position=24-665
MSNPLSSSFLCRKCFLRPVHFHSQQKHGISSLLKGNADNFVVVMSNSYLAEGFTETFKFLSSVSLLGPSSSVLLLAVGLRLATVPVRILTEKLTSQRLMMVHLVRKQVYEKIGSHYGIATTFDAVNGKWTLNTRDSLIRKSADELSEENVKRQVNDQKLTMSRLVMLRYCLVPIWIPCNFGILRYVEGLFGQQIPGFFGLDSFTLPDPFMVFRF

SEQ ID NO: 123359 - protein, 197 aa, Heterodera glycines
  Homolog annotation: Hit_ID=CAC00543.1; Match level="QueryCoverage =94%, HitCoverage=38%, E-value=1e-41, Identity=49%"; Hit description =necepsin II [Necator americanus]
  Gene Ontology: Mol. function=saccharopepsin activity; Cellular component=vacuole (sensu Fungi); Biological process=induction of non- apoptotic programmed cell death
  Essential gene: C elegans homolog=R12H7.2; Phenotype=Ced
  Coding regions on vcDNA: vcDNA=SeqID_49782; Strand=+; Position=1-591
MLSKITVVLAFLCLLLALLVGIDAQQSQWEQKQNRAAPRGLASVTLRRMDTVRSRLAAAGSLVQFRKHLRQALRQRLDRLYSDKMARADVAFDTDAAAREGIDEVLRNYMDAQYYGDISIGSPPQNFTVIFDTGSSNLWVPSKKCSFFDLACRYHSKYDHKKSSTYQPDGREVAIEYGTGSMKGFVSKDTVCIMDGM

SEQ ID NO: 123360 - protein, 104 aa, Heterodera glycines
  misc_feature (22)..(22): Xaa can be any naturally occurring amino acid
  misc_feature (30)..(30): Xaa can be any naturally occurring amino acid
  misc_feature (76)..(76): Xaa can be any naturally occurring amino acid
  misc_feature (99)..(99): Xaa can be any naturally occurring amino acid
  Homolog annotation: Hit_ID=CAE67008.1; Match level="QueryCoverage =98%, HitCoverage=3%, E-value=1e-32, Identity=70%"; Hit description =Hypothetical protein CBG12408 [Caenorhabditis briggsae]
  Gene Ontology: Cellular component=mitochondrion; Biological process =polar body extrusion after meiotic divisions
  Essential gene: C elegans homolog=F32H2.5; Phenotype=Emb
  Coding regions on vcDNA: vcDNA=SeqID_49783; Strand=+; Position=2-310
LDIGPLGGVFLLAMVLRDCLFXNLNQQNFXYAGEAKYFGTITLDEATRKRCEHLPWFVMFSSITYGRRNAGQTIYXGWSHSTMESIIGQRRADGFPAIXIRWGA

SEQ ID NO: 123361 - protein, 101 aa, Heterodera glycines
  Homolog annotation: Hit_ID=NP_502365.1; Match level="QueryCoverage =100%, HitCoverage=70%, E-value=3e-34, Identity=68%"; Hit description= ribosomal Protein, Small subunit (15.9 kD) (rps-23) [Caenorhabditis elegans] emb|CAA94601.1| Hypothetica
  Gene Ontology: Cellular component=eukaryotic 48S initiation complex; Biological process=protein biosynthesis
  Essential gene: C elegans homolog=F28D1.7; Phenotype=Ste
  Coding regions on vcDNA: vcDNA=SeqID_49784; Strand=+; Position=8-310
PNGMRTALKLTKHRQEHRWNDERYEKTNRGTRWKADPCGGACMAKGIVLDNIGDEAKQPGSAIQRCVRVQLIKDRRKITAFVPNDSCLYCIQDNDEVLVSG

SEQ ID NO: 123362 - protein, 211 aa, Heterodera glycines
  misc_feature (126)..(126): Xaa can be any naturally occurring amino acid
  misc_feature (189)..(189): Xaa can be any naturally occurring amino acid
  Homolog annotation: Hit_ID=CAE72557.1; Match level="QueryCoverage =100%, HitCoverage=73%, E-value=8e-61, Identity=56%"; Hit description= Hypothetical protein CBG19741 [Caenorhabditis briggsae]
  Gene Ontology: Mol. function=endopeptidase activity; Cellular component=proteasome core complex (sensu Eukarya); Biological process=embryonic cleavage
  Essential gene: C elegans homolog=K05C4.1; Phenotype=Emb
  Coding regions on vcDNA: vcDNA=SeqID_49785; Strand=+; Position=2-634
FLNGTTTLYFVYKPKTPQDKGGVIVAVDSRATGGTYISSKTVEKIIPINDQLVATMAGGASDCHYWTRVESEYCNLFELREGTQISVAAANKYFANVMYHYRGQELGVHSMVCGVDKFGPSIYVVXAEGTHLNIDTICSRLSGMLHSMHILDTKYNEAMTDAEALELGREGIEYTTFRDAASGGHCNLXHITSEGQTIYAPFDVGDKYYEF

SEQ ID NO: 123363 - protein, 131 aa, Heterodera glycines
  misc_feature (33)..(33): Xaa can be any naturally occurring amino acid
  misc_feature (47)..(47): Xaa can be any naturally occurring amino acid
  misc_feature (52)..(52): Xaa can be any naturally occurring amino acid
  Homolog annotation: Hit_ID=NP_497617.1; Match level="QueryCoverage =98%, HitCoverage=33%, E-value=4e-22, Identity=42%"; Hit description =phosphotyrosyl phosphatase activator (42.9 kD) (3D872) [Caenorhabditis elegans] gb|AAK29984.1| Hypothetic
  Gene Ontology: Mol. function=protein phosphatase type 2A, intrinsic regulator activity; Cellular component=soluble fraction; Biological process=protein amino acid dephosphorylation
  Essential gene: C elegans homolog=Y71H2AM.20a; Phenotype=Emb,Lva
  Coding regions on vcDNA: vcDNA=SeqID_49786; Strand=+; Position=2-394
ANESFQKWSKRLMADGQRLLSDELPENLQCALXLEIWPYLMHSLGNXTLTEXGSSRETSFLIFLFCLDQIGVLRSPDNDRASILWIFHPYLKLARRLQSEYRMEPCGSKGDPAIDDFHLWALLTGRARLID

SEQ ID NO: 123364 - protein, 59 aa, Heterodera glycines
  Homolog annotation: Hit_ID=CAE64199.1; Match level="QueryCoverage =98%, HitCoverage=13%, E-value=1e-11, Identity=50%"; Hit description =Hypothetical protein CBG08829 [Caenorhabditis briggsae]
  Gene Ontology: Mol. function=protein binding; Biological process =purine nucleotide biosynthesis
  Essential gene: C elegans homolog=C37H5.6a; Phenotype =Emb,Gro,Pvl,Stp,Unc
  Coding regions on vcDNA: vcDNA=SeqID_49787; Strand=+; Position=2-178
SKGNSLDLLIGHHNIDIVSRCHGLNHACHTVLANGREYHFHLMPSRLASQKVLNIVGNG

SEQ ID NO: 123365 - protein, 163 aa, Heterodera glycines
  misc_feature (106)..(106): Xaa can be any naturally occurring amino acid
  Homolog annotation: Hit_ID=NP_495455.2; Match level="QueryCoverage =99%, HitCoverage=39%, E-value=2e-38, Identity=51%"; Hit description =3-Ketoacyl-coA Thiolase (kat-1AND2H367) [Caenorhabditis elegans] gb|AAA82397.2| 3-ketoacyl-coa thiolase p
  Gene Ontology: Mol. function=acetyl-CoA C-acetyltransferase activity; Cellular component=mitochondrion; Biological process=lipid metabolism
  Essential gene: C elegans homolog=T02G5.4; Phenotype=Unclassified
  Coding regions on vcDNA: vcDNA=SeqID_49788; Strand=+; Position=2-490
EAFVLEACRTPLGSFRSQLGSWTWTALVSECITKLLKRSNGPAKETHHVYLSQVCQASGANAPTRPAALGSALDVAAAVCTVSSVCRTGLISSMLAAAIIVLNHQXLDIGGEMESMSHVNFYLERGKLPYGGAKLIDGIARDRLTDAYYSEHMSDCAERTAKE

SEQ ID NO: 123366 - protein, 209 aa, Heterodera glycines
  misc_feature (28)..(28): Xaa can be any naturally occurring amino acid
  misc_feature (62)..(62): Xaa can be any naturally occurring amino acid
  misc_feature (195)..(195): Xaa can be any naturally occurring amino acid
  Homolog annotation: Hit_ID=CAE65195.1; Match level="QueryCoverage =100%, HitCoverage=78%, E-value=3e-42, Identity=48%"; Hit description= Hypothetical protein CBG10070 [Caenorhabditis briggsae]
  Gene Ontology: Mol. function=hydrogen-transporting ATPase activity, rotational mechanism; Cellular component=vacuolar membrane (sensu Fungi); Biological process=vacuolar acidification
  Essential gene: C elegans homolog=F55H2.2; Phenotype=Emb
  Coding regions on vcDNA: vcDNA=SeqID_49789; Strand=+; Position=2-628
KYRMAGSPPPMARTVTTTKLSRAQKGHXLTEEKRGCIQYAYSQEILKKITENQKRLADGQKXQLFLMRKAKFTAGDSSHMVELNEASPAQNTLRMNRQNVVGDCLPVIQPHREDGSDGDTYYLTGLDQGGANSEKLKRYYNDAGELLVEMPTLATGFITLHEAIKMTNRPENTLELIIFPKTDNTPTHLVTEFDXTDRDEFFLMTNIRA

SEQ ID NO: 123367 - protein, 223 aa, Heterodera glycines
  misc_feature (76)..(76): Xaa can be any naturally occurring amino acid
  misc_feature (106)..(106): Xaa can be any naturally occurring amino acid
  misc_feature (134)..(134): Xaa can be any naturally occurring amino acid
  Homolog annotation: Hit_ID=CAE67745.1; Match level="QueryCoverage =100%, HitCoverage=74%, E-value=1e-48, Identity=47%"; Hit description= Hypothetical protein CBG13320 [Caenorhabditis briggsae] emb|CAE67740.1| Hypothetical protein CBG13315 [Ca
  Gene Ontology: Mol. function=transcription factor activity; Cellular component=CCR4-NOT core complex; Biological process=regulation of transcription, DNA-dependent
  Essential gene: C elegans homolog=Y56A3A.20; Phenotype=Emb
  Coding regions on vcDNA: vcDNA=SeqID_49790; Strand=+; Position=2-670
IQVELTRLRELDNDYPILDVDTEYPRDIATAAGRFRRKEDVNYLPVKLQVDCLKLIQVGFTLMIEGGQLPPSRVFXHFILHFDPSIDSFAHNSLELLPTEAFDFNXHHTEGILLEDCGELLTTSGLVADRRITXLTFHSCFDYGHLIRAIMLVKLPEDDQDFFRYHRKLIPNRFHFEILLRLTGSRDTMLNGRLQELADQLHVPRIATCHQVGSDSLLTAMTF

SEQ ID NO: 123368 - protein, 134 aa, Heterodera glycines
  misc_feature (30)..(30): Xaa can be any naturally occurring amino acid
  misc_feature (38)..(38): Xaa can be any naturally occurring amino acid
  misc_feature (61)..(61): Xaa can be any naturally occurring amino acid
  misc_feature (70)..(70): Xaa can be any naturally occurring amino acid
  misc_feature (115)..(115): Xaa can be any naturally occurring amino acid
  Homolog annotation: Hit_ID=NP_498349.1; Match level="QueryCoverage =99%, HitCoverage=53%, E-value=7e-27, Identity=50%"; Hit description =ribosomal Protein, Small subunit (27.3 kD) (rps-3) [Caenorhabditis elegans] gb|AAF99870.1| Ribosomal prot
  Gene Ontology: Mol. function=structural constituent of ribosome; Cellular component=cytosolic small ribosomal subunit (sensu Eukarya); Biological process=protein biosynthesis
  Essential gene: C elegans homolog=C23G10.3; Phenotype=Emb
  Coding regions on vcDNA: vcDNA=SeqID_49791; Strand=+; Position=2-402
SQQAITKKRKAVQYGIFRAELYNFLMKEMXRKRIPVSXVPNAPSRTELMLMGTRTQCVLGXRGQCIHQLXARVQKWLGYSSEQIELYDEKVSSHDLCAEANCDHLRINLVGGLHXGHAGYCVLLFIVESNDSGC

SEQ ID NO: 123369 - protein, 235 aa, Heterodera glycines
  misc_feature (85)..(85): Xaa can be any naturally occurring amino acid
  misc_feature (171)..(171): Xaa can be any naturally occurring amino acid
  misc_feature (201)..(201): Xaa can be any naturally occurring amino acid
  misc_feature (221)..(221): Xaa can be any naturally occurring amino acid
  Homolog annotation: Hit_ID=CAE57680.1; Match level="QueryCoverage =100%, HitCoverage=43%, E-value=6e-77, Identity=65%"; Hit description= Hypothetical protein CBG00674 [Caenorhabditis briggsae]
  Gene Ontology: Mol. function=chaperone activity; Cellular component =actin filament; Biological process=cell organization and biogenesis
  Essential gene: C elegans homolog=K01C8.10; Phenotype=Emb,Lva,Ste
  Coding regions on vcDNA: vcDNA=SeqID_49792; Strand=+; Position=2-706
NIRGSKADADAVLTTLGPRAMDIMILSGDRKVTITHDGATILNHMSVVHPTAKMLVKLSMAQDIVAGDGTTTVVVLAGSLLDAAXKLLAKGIHPTTISDSFQRAATFSETVLEEMATPIDINDDDELVKLTMTSLNSNVDSQYSHLLTPMAVPAVKKLMSSPEDSSDHLKXIKGDNQLGHTVDESQLIDGALIDHKSMGHXGPAQVENAKIGLIQFLFSPXKPNMENQVVISDYA

SEQ ID NO: 123370 - protein, 245 aa, Heterodera glycines
  misc_feature (224)..(224): Xaa can be any naturally occurring amino acid
  Homolog annotation: Hit_ID=EAL25332.1; Match level="QueryCoverage =97%, HitCoverage=61%, E-value=3e-94, Identity=41%"; Hit description =GA18673-PA [Drosophila pseudoobscura]
  Gene Ontology: Mol. function=poly(A) binding; Cellular component =cytoplasm; Biological process=mRNA metabolism
  Essential gene: C elegans homolog=Y106G6H.2a; Phenotype=Gro,Stp
  Coding regions on vcDNA: vcDNA=SeqID_49793; Strand=+; Position=92-826
MAPSYPLASLYVGDLHPDVTEAMLFERFSNAGPVLSIRVCRDAITRRSLGYAYVNFQQPADAERALDTMNFDMILNKPIRIMWSQRDPSIRRSGAGNIFIKNLGKEIDTKAIYDTFSMFGSILSCKISTDIDGGSKGYGFIHFETEEAANSAIAKVNGMLLDGKKVFVGKFLPRSARDKQIGDPSSRFTNGYVKNFGDAMNSEKLSEVFSQFGEIISAKVMEGXQRQSKGVGFVAYKDPESAARA

SEQ ID NO: 123371 - protein, 139 aa, Heterodera glycines
  Homolog annotation: Hit_ID=NP_493746.1; Match level="QueryCoverage =50%, HitCoverage=10%, E-value=7e-14, Identity=60%"; Hit description =yeast splicing factor PRP related, pre-mRNA splicing factor 3a (73.8 kD) (prp-21) [Caenorhabditis elegans
  Gene Ontology: Mol. function=pre-mRNA splicing factor activity; Cellular component=nucleus; Biological process=embryogenesis and morphogenesis
  Essential gene: C elegans homolog=W07E6.4; Phenotype=Emb
  Coding regions on vcDNA: vcDNA=SeqID_49794; Strand=-; Position=1-544
PHAKVESDEEGGAESGDEETAKERAAIEAAEDAAGELHQRLNIGAEKQHTGSTLTQPAPAAPTAGRVIIRDYDPKKSRGGPVSKTAAASTEKYIISPLTNERIPADKLHEHVRYNTVDPQFKEKRDRCVLAKGGLSLEV

SEQ ID NO: 123372 - protein, 132 aa, Heterodera glycines
  Homolog annotation: Hit_ID=EAL28949.1; Match level="QueryCoverage =98%, HitCoverage=31%, E-value=4e-23, Identity=43%"; Hit description =GA15542-PA [Drosophila pseudoobscura]
  Essential gene: C elegans homolog=F09G8.3; Phenotype=Lva
  Coding regions on vcDNA: vcDNA=SeqID_49795; Strand=+; Position=2-397
DESVSASAAAIQERERRERLLTISDAMKFYLERKHDHMAILDKENLLYTQGKRHLANIMGFNPDSIIGDQISHSIRYLFPSGLFHNEALPVMKPPEEVFPKIVKIDVDSSGSPNHSLFFTAEPKFYSLLSDI

SEQ ID NO: 123373 - protein, 88 aa, Heterodera glycines
  misc_feature (17)..(18): Xaa can be any naturally occurring amino acid
  Homolog annotation: Hit_ID=EAL25231.1; Match level="QueryCoverage =98%, HitCoverage=24%, E-value=2e-10, Identity=40%"; Hit description =GA21281-PA [Drosophila pseudoobscura]
  Essential gene: C elegans homolog=Y43F4B.4; Phenotype=Him
  Coding regions on vcDNA: vcDNA=SeqID_49796; Strand=+; Position=2-265
GRASITDIEFGPYYLGXXLGACTSSGRLIIYEAEDIMALDNWNVLHDYEVRKNRLSSLWWRKNGFDAPHIVVSFDDVDAAPAEKVFVF

SEQ ID NO: 123374 - protein, 183 aa, Heterodera glycines
  misc_feature (116)..(116): Xaa can be any naturally occurring amino acid
  misc_feature (130)..(130): Xaa can be any naturally occurring amino acid
  misc_feature (144)..(144): Xaa can be any naturally occurring amino acid
  Homolog annotation: Hit_ID=AAN15196.1; Match level="QueryCoverage =100%, HitCoverage=48%, E-value=1e-80, Identity=83%"; Hit description= actin [Globodera rostochiensis] gb|AAN78299.1| actin 1 [Heterodera glycines] gb|AAG47837.2| actin 1 [Hete
  Gene Ontology: Biological process=reproduction
  Essential gene: C elegans homolog=T04C12.6; Phenotype=Ste
  Coding regions on vcDNA: vcDNA=SeqID_49797; Strand=+; Position=28-577
MCDEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVALYEHPVLLTEAPLDPKAXREKMTPILFETFHXPAMYVGLQARLVLXASGRTTGLRVELRGWGHPNPGPSTRGIALPQAFFRLDLA

SEQ ID NO: 123375 - protein, 274 aa, Heterodera glycines
  Homolog annotation: Hit_ID=NP_498192.2; Match level="QueryCoverage =100%, HitCoverage=23%, E-value=4e-96, Identity=65%"; Hit description= rna polymerase (129.1 kD) (3G653) [Caenorhabditis elegans] gb|AAA50695.2| Hypothetical protein F09F7.3 [
  Gene Ontology: Mol. function=DNA-directed RNA polymerase activity; Cellular component=DNA-directed RNA polymerase III complex; Biological process=transcription from Pol III promoter
  Essential gene: C elegans homolog=F09F7.3; Phenotype=Emb,Lva
  Coding regions on vcDNA: vcDNA=SeqID_49798; Strand=+; Position=11-832
MKAVFLGLMIRRLIEAEKGVCEADDRDFYGNKRIELAGSLLSLLFEDLFKRFNSELKRIADSHLNRNMAAPLDIVRHMRQDLITNGLVNALATGNWTIRRFKMERHGVTQVLSRLSYISVLGMMTRINSTFEKTRKVSGPRSLQSSQWGMICPADTPEGESCGLVKNLSLLSHITTDSDEAPILQLLYNFGVQDVRPLKFSVVHERRYHIVFLNGSIGGITDDVEKIIGTVRLMRRRGNLGCLCLGRFQHRHKCAVFGHRGGRLWPPYGIVENG

SEQ ID NO: 123376 - protein, 182 aa, Heterodera glycines
  misc_feature (114)..(114): Xaa can be any naturally occurring amino acid
  misc_feature (151)..(151): Xaa can be any naturally occurring amino acid
  misc_feature (165)..(165): Xaa can be any naturally occurring amino acid
  Homolog annotation: Hit_ID=AAN78298.1; Match level="QueryCoverage =100%, HitCoverage=48%, E-value=2e-58, Identity=64%"; Hit description= actin 2 [Globodera rostochiensis]
  Gene Ontology: Cellular component=actin filament; Biological process =reproduction
  Essential gene: C elegans homolog=T04C12.6; Phenotype=Ste
  Coding regions on vcDNA: vcDNA=SeqID_49799; Strand=+; Position=2-547
EEAAALGADNGSGTSKAAFPGDDAPRTALPSSAGRPRHHGLMAGMGQNDSYTGNHAPPKRGTPTLKNPIEHRSASNCDDVEKSWDHTFYYELRDAPDERPELLTNAPLNPKVYXETTTQVMDETYNTPDMDAAIQAVLALNASGRTTGLAXDSGDGVGLSEHICXGYDLPHAIHGMDLARRD

SEQ ID NO: 123377 - protein, 192 aa, Heterodera glycines
  Homolog annotation: Hit_ID=NP_496115.1; Match level="QueryCoverage =86%, HitCoverage=33%, E-value=7e-31, Identity=39%"; Hit description =cytochrome P450 family member (2K92) [Caenorhabditis elegans] emb|CAB09134.1| Hypothetical protein T10B9.
  Gene Ontology: Mol. function=oxidoreductase activity; Biological process=epoxygenase P450 pathway
  Essential gene: C elegans homolog=T10B9.4; Phenotype=Clr,Emb,Slu
  Coding regions on vcDNA: vcDNA=SeqID_49800; Strand=+; Position=28-665
MVLLFLQLALILLCSVFAFIVMMRKHRKYWSNRGIPSPTPQLISGNFGSLYGDYPSMFQLRDWTRQYGKQYGVQYGWRNALVISDPALVHELLVTKFEYFHARNLTPIFGNTDTNKWISMFLARGGRWKRLRMIANPAFSVANLKKCMCLIDDSVKNAINFLEKARNKGESFNIHRHFVEMSFDVIARVALG

SEQ ID NO: 123378 - protein, 211 aa, Heterodera glycines
  misc_feature (166)..(166): Xaa can be any naturally occurring amino acid
  misc_feature (188)..(188): Xaa can be any naturally occurring amino acid
  Homolog annotation: Hit_ID=AAN15196.1; Match level="QueryCoverage =100%, HitCoverage=56%, E-value=4e-87, Identity=77%"; Hit description= actin [Globodera rostochiensis] gb|AAN78299.1| actin 1 [Heterodera glycines] gb|AAG47837.2| actin 1 [Hete
  Gene Ontology: Biological process=reproduction
  Essential gene: C elegans homolog=T04C12.6; Phenotype=Ste
  Coding regions on vcDNA: vcDNA=SeqID_49801; Strand=+; Position=2-634
CYEQVAALVADTGTGMSKARFTGDDAPRAVIPSIVSRPRHQGVMVDMGQNDSCVGDNAQSQRGILTLKYPIEHGIITNWDDVEKIWYLTLYNELRVGPHEHPELLTEATLNPMAKIETMTQIVFKTFNAPAMYVAIHAVLSLYASSRTTRLVLDSGDGVSHTVTIXEGYALRQGILRWDLDGHDLTEXLMTILTERGYSFVTTAEREIARE

SEQ ID NO: 123379 - protein, 285 aa, Heterodera glycines
  misc_feature (115)..(115): Xaa can be any naturally occurring amino acid
  misc_feature (142)..(142): Xaa can be any naturally occurring amino acid
  Homolog annotation: Hit_ID=NP_501727.1; Match level="QueryCoverage =55%, HitCoverage=50%, E-value=4e-56, Identity=73%"; Hit description =adenine nucleotide family member (4K472) [Caenorhabditis elegans] emb|CAA92472.1| Hypothetical protein K0
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_49802; Strand=+; Position=33-887
VRRWRCIEESVGFNTKKFLLDLASGGTAAAVSKTAVAPIERVKLLLQVQDASIHITADKRYKGIIDVLVRVPKEQGFLSLLRGNLANVIRYFPTQALNFAFKDTYDFFFTQGVDXEKQFLKFFAMRLASGGAAGATSLWMGXPLDFAGTGVGGDGEKADGRGVGGWSGGGGRGWGGRGAVGAGGGWGGGGPGGGVERGGGSVGRGGGGRGGGRAEGGRGGGVGGAVGRVGGAPGVGWGGGVSARRGGGAARAARADCNGGPRPGGACGGRGLGMAPGRKGGRGGG

SEQ ID NO: 123380 - protein, 74 aa, Heterodera glycines
  misc_feature (45)..(45): Xaa can be any naturally occurring amino acid
  misc_feature (53)..(53): Xaa can be any naturally occurring amino acid
  Homolog annotation: Hit_ID=S43425; Match level="QueryCoverage=100%, HitCoverage=16%, E-value=1e-22, Identity=71%"; Hit description =tubulin alpha chain - giant octopus sp|Q06331|TBA_OCTDO TUBULIN ALPHA CHAIN gb|AAA16610.1| alpha tubulin
  Gene Ontology: Mol. function=structural constituent of cytoskeleton; Cellular component=microtubule; Biological process=microtubule cytoskeleton organization and biogenesis
  Essential gene: C elegans homolog=C47B2.3; Phenotype=Emb
  Coding regions on vcDNA: vcDNA=SeqID_49803; Strand=+; Position=2-223
LTTHGSLEHSDCLLMVDNEVIYHICPRNLEVERSSYTTLKRLISXAVSSMTAXLRCDGALNVHLTEFHNCLVPY

SEQ ID NO: 123381 - protein, 172 aa, Heterodera glycines
  misc_feature (1)..(1): Xaa can be any naturally occurring amino acid
  misc_feature (11)..(11): Xaa can be any naturally occurring amino acid
  misc_feature (14)..(15): Xaa can be any naturally occurring amino acid
  misc_feature (19)..(20): Xaa can be any naturally occurring amino acid
  misc_feature (23)..(23): Xaa can be any naturally occurring amino acid
  misc_feature (25)..(25): Xaa can be any naturally occurring amino acid
  misc_feature (33)..(34): Xaa can be any naturally occurring amino acid
  misc_feature (40)..(40): Xaa can be any naturally occurring amino acid
  misc_feature (44)..(45): Xaa can be any naturally occurring amino acid
  misc_feature (47)..(47): Xaa can be any naturally occurring amino acid
  misc_feature (49)..(49): Xaa can be any naturally occurring amino acid
  misc_feature (56)..(56): Xaa can be any naturally occurring amino acid
  misc_feature (62)..(62): Xaa can be any naturally occurring amino acid
  misc_feature (66)..(66): Xaa can be any naturally occurring amino acid
  misc_feature (70)..(70): Xaa can be any naturally occurring amino acid
  misc_feature (76)..(76): Xaa can be any naturally occurring amino acid
  misc_feature (151)..(151): Xaa can be any naturally occurring amino acid
  Homolog annotation: Hit_ID=AAF34686.1; Match level="QueryCoverage =98%, HitCoverage=44%, E-value=3e-54, Identity=68%"; Hit description =actin [Schistosoma japonicum] gb|AAC46966.1| actin sp|P53471|ACT2 _SCHMA ACTIN 2
  Gene Ontology: Biological process=reproduction
  Essential gene: C elegans homolog=T04C12.5; Phenotype=Ste
  Coding regions on vcDNA: vcDNA=SeqID_49804; Strand=+; Position=2-518
XAGEDAPRAEXPTXXGRPXXQGXRXGRGQKDAXXGDEAQXKRGXXTXKXPREHGTXTNGDDXEKSXHHTXHFFFAXPPPRSTRVLVTEAPLNPKANREKMTQIMFETFNTPAMYVGIQAVLVLYASGRTTGLVLDFGDGGTHTVPIYEGYXALPHAIPRLGLGRGGTSLDYG

SEQ ID NO: 123382 - protein, 141 aa, Heterodera glycines
  Homolog annotation: Hit_ID=P38981; Match level="QueryCoverage=99%, HitCoverage=44%, E-value=9e-25, Identity=41%"; Hit description=40S ribosomal protein SA (p40) (34/67 kDa laminin binding protein) gb|AAA90978.1| 34/67 kD laminin binding pro
  Gene Ontology: Mol. function=laminin receptor activity; Cellular component=eukaryotic 48S initiation complex; Biological process =protein biosynthesis
  Essential gene: C elegans homolog=B0393.1; Phenotype=Emb,Ste
  Coding regions on vcDNA: vcDNA=SeqID_49805; Strand=+; Position=2-424
TDDDTLKYWVCDSHVGPHNMDYQMDHYAWIPLSNGIHILNIPQTRERLLLAIRAISAIENPSDAVDGSAPPNTPRPMLPLACHICATPIGGRFWPGSLTNRSLMNFLEPRMLAMGHDSLYHKENREVPYINHPILTLVDTD

SEQ ID NO: 123383 - protein, 187 aa, Heterodera glycines
  misc_feature (5)..(6): Xaa can be any naturally occurring amino acid
  misc_feature (10)..(11): Xaa can be any naturally occurring amino acid
  misc_feature (13)..(13): Xaa can be any naturally occurring amino acid
  misc_feature (15)..(15): Xaa can be any naturally occurring amino acid
  misc_feature (17)..(17): Xaa can be any naturally occurring amino acid
  misc_feature (20)..(21): Xaa can be any naturally occurring amino acid
  misc_feature (26)..(26): Xaa can be any naturally occurring amino acid
  misc_feature (32)..(32): Xaa can be any naturally occurring amino acid
  misc_feature (36)..(39): Xaa can be any naturally occurring amino acid
  misc_feature (41)..(44): Xaa can be any naturally occurring amino acid
  misc_feature (46)..(48): Xaa can be any naturally occurring amino acid
  misc_feature (51)..(51): Xaa can be any naturally occurring amino acid
  misc_feature (53)..(53): Xaa can be any naturally occurring amino acid
  misc_feature (57)..(57): Xaa can be any naturally occurring amino acid
  misc_feature (59)..(61): Xaa can be any naturally occurring amino acid
  misc_feature (65)..(65): Xaa can be any naturally occurring amino acid
  misc_feature (69)..(70): Xaa can be any naturally occurring amino acid
  misc_feature (73)..(73): Xaa can be any naturally occurring amino acid
  misc_feature (75)..(75): Xaa can be any naturally occurring amino acid
  misc_feature (77)..(77): Xaa can be any naturally occurring amino acid
  misc_feature (81)..(83): Xaa can be any naturally occurring amino acid
  misc_feature (85)..(85): Xaa can be any naturally occurring amino acid
  misc_feature (87)..(87): Xaa can be any naturally occurring amino acid
  misc_feature (89)..(90): Xaa can be any naturally occurring amino acid
  misc_feature (93)..(96): Xaa can be any naturally occurring amino acid
  misc_feature (103)..(104): Xaa can be any naturally occurring amino acid
  misc_feature (108)..(108): Xaa can be any naturally occurring amino acid
  misc_feature (111)..(111): Xaa can be any naturally occurring amino acid
  misc_feature (113)..(113): Xaa can be any naturally occurring amino acid
  misc_feature (115)..(119): Xaa can be any naturally occurring amino acid
  misc_feature (121)..(122): Xaa can be any naturally occurring amino acid
  misc_feature (125)..(125): Xaa can be any naturally occurring amino acid
  misc_feature (128)..(129): Xaa can be any naturally occurring amino acid
  misc_feature (131)..(133): Xaa can be any naturally occurring amino acid
  misc_feature (135)..(135): Xaa can be any naturally occurring amino acid
  misc_feature (140)..(140): Xaa can be any naturally occurring amino acid
  misc_feature (142)..(142): Xaa can be any naturally occurring amino acid
  misc_feature (147)..(147): Xaa can be any naturally occurring amino acid
  misc_feature (151)..(151): Xaa can be any naturally occurring amino acid
  misc_feature (155)..(155): Xaa can be any naturally occurring amino acid
  misc_feature (166)..(167): Xaa can be any naturally occurring amino acid
  misc_feature (170)..(170): Xaa can be any naturally occurring amino acid
  misc_feature (173)..(175): Xaa can be any naturally occurring amino acid
  misc_feature (186)..(186): Xaa can be any naturally occurring amino acid
  Homolog annotation: Hit_ID=AAK95187.1; Match level="QueryCoverage =99%, HitCoverage=91%, E-value=4e-36, Identity=45%"; Hit description =40S ribosomal protein S5 [Ictalurus punctatus]
  Gene Ontology: Mol. function=structural constituent of ribosome; Cellular component=cytosolic small ribosomal subunit (sensu Eukarya); Biological process=protein biosynthesis
  Essential gene: C elegans homolog=T05E11.1; Phenotype=Ste
  Coding regions on vcDNA: vcDNA=SeqID_49806; Strand=+; Position=5-565
VEIKXXGKWXXNXVXVXEIXXVDYVXVKEKGXKYLXXXXGXXXXKXXXKGXCXVVEXLXXXMMMXGLNXXKKXMXVXIVKXXXEXIXLXXGEXXXXVLVNGVXXSGPXEDXKXIXXXXXVXXKEXDVXXLXXXNXGIWLXCXGFREXGFRXIKKXGEWFGDELMNXXKGXKNXXXIKKKEELEGVXK

SEQ ID NO: 123384 - protein, 225 aa, Heterodera glycines
  Homolog annotation: Hit_ID=CAE70907.1; Match level="QueryCoverage =99%, HitCoverage=29%, E-value=6e-86, Identity=65%"; Hit description =Hypothetical protein CBG17704 [Caenorhabditis briggsae]
  Gene Ontology: Mol. function=transcriptional repressor activity; Cellular component=cytoplasm; Biological process=regulation of transcription, DNA-dependent
  Essential gene: C elegans homolog=C49H3.5a; Phenotype=Slu
  Coding regions on vcDNA: vcDNA=SeqID_49807; Strand=+; Position=132-806
MSSDDQSDKECPLCMEAFDIDDINFYPCNCQYQICRFCWHRIRTNENGLCPACRQSYPEDPVNFQPLSSADVRKIKSEKKQKVQQQKNKVVESRKHLAEFRVLQKNLVYAVGLSHRMADPELLKKPEFFGKFGKIIKIAVGAAPAINSAQPAVHTAYITYTRSEDALRAIHAVTNMMVEGRFLKASLGTTKYCSNFLKGQACHKPECMYLHEGAEDQISFTKEDM

SEQ ID NO: 123385 - protein, 42 aa, Heterodera glycines
  Homolog annotation: Hit_ID=AAQ05016.1; Match level="QueryCoverage =97%, HitCoverage=10%, E-value=2e-09, Identity=70%"; Hit description =beta-actin [Tigriopus japonicus]
  Gene Ontology: Biological process=embryogenesis and morphogenesis
  Essential gene: C elegans homolog=T25C8.2; Phenotype=Unclassified
  Coding regions on vcDNA: vcDNA=SeqID_49808; Strand=+; Position=2-127
SNQEIAALKEDNGSRMCNAGFTGHDTPHAVYPSIEGRPHHQG

SEQ ID NO: 123386 - protein, 268 aa, Heterodera glycines
  misc_feature (16)..(16): Xaa can be any naturally occurring amino acid
  misc_feature (18)..(18): Xaa can be any naturally occurring amino acid
  Homolog annotation: Hit_ID=A48575; Match level="QueryCoverage=99%, HitCoverage=91%, E-value=1e-127, Identity=38%"; Hit description =paramyosin - nematode (Onchocerca volvulus)
  Gene Ontology: Mol. function=ATP binding; Cellular component=striated muscle thick filament; Biological process=striated muscle contraction
  Essential gene: C elegans homolog=F07A5.7; Phenotype=Prz
  Coding regions on vcDNA: vcDNA=SeqID_49809; Strand=+; Position=3-806
GRSVAELKQRIDELTXEXENTQRELRGALAELQKMKHLYEKAVEQKEALARENKKLQDDLHEAKEALADANRKLHELDLENARLAGEIRELQTALKEADAARRDAENRAHRALAELQALRIEMERRLQEKEEEIENLRKNMQFEIDRLTAALADAEARMKAEISRLKKKYQAEIAELEMTVDNLNRANIEAQKTIKKQSEQLKVLQASLEDTQRQLQQTLDQYALAQRKVSALAAELEECKTALDNAVRARKQAELDLEEAHGRINDL

SEQ ID NO: 123387 - protein, 121 aa, Heterodera glycines
  misc_feature (37)..(37): Xaa can be any naturally occurring amino acid
  misc_feature (49)..(49): Xaa can be any naturally occurring amino acid
  misc_feature (63)..(63): Xaa can be any naturally occurring amino acid
  Homolog annotation: Hit_ID=O17503; Match level="QueryCoverage=100%, HitCoverage=31%, E-value=4e-29, Identity=56%"; Hit description =Actin, cytoplasmic emb|CAA74014.1| actin [Branchiostoma lanceolatum]
  Gene Ontology: Biological process=reproduction
  Essential gene: C elegans homolog=T04C12.6; Phenotype=Ste
  Coding regions on vcDNA: vcDNA=SeqID_49810; Strand=+; Position=2-367
AALVGGHGSGMCKAGFAGDDAPRAGVSVICGRPRHQXVMVGMGQKDSYXGKEGQSKRGILDLXYRMENGSVTNWDNLKKILDPPLLKQIWCRPPRNTRGFFPKAPPLPRRAHKKKITPILF

SEQ ID NO: 123388 - protein, 247 aa, Heterodera glycines
  misc_feature (57)..(57): Xaa can be any naturally occurring amino acid
  Homolog annotation: Hit_ID=AAN78298.1; Match level="QueryCoverage =100%, HitCoverage=65%, E-value=1e-109, Identity=79%"; Hit description=actin 2 [Globodera rostochiensis]
  Gene Ontology: Biological process=reproduction
  Essential gene: C elegans homolog=T04C12.6; Phenotype=Ste
  Coding regions on vcDNA: vcDNA=SeqID_49811; Strand=+; Position=2-742
CDEEVAALEVDDGSGMCKAGFAGDDAPRAEFPPIVGRPRHHGALVGMGQNDSYVRDXAQSKRGILTLKYPIEHGIIAHWDDMEKIWLHTIYNELRVAPEEHPALLTEAPLNPNAIREKMTQIMIKTFITPTMYVAIQDVLSLYASGRTTGLVMDSGDGDTHNVAIYKGYVLHRDILRLDLVGRDLTDYLMNILTERGHSFLTTADRDIVRDINDKVCYETLYFEQEMVNADSSSAVEKSYELTDCQV

SEQ ID NO: 123389 - protein, 234 aa, Heterodera glycines
  Homolog annotation: Hit_ID=CAE63234.1; Match level="QueryCoverage =99%, HitCoverage=50%, E-value=8e-95, Identity=73%"; Hit description =Hypothetical protein CBG07596 [Caenorhabditis briggsae]
  Gene Ontology: Mol. function=cytoskeletal adaptor activity; Cellular component=actin filament; Biological process=intracellular protein transport
  Essential gene: C elegans homolog=T04C10.2a; Phenotype=Unclassified
  Coding regions on vcDNA: vcDNA=SeqID_49812; Strand=+; Position=64-765
MSSISTLRRQVKNVACNYTDAQVKVREATSNDPWGPTTVLMSEIADLTHNPVSFTEIMSMVWKRLNDHGKNWRHVYKSLVLLDYLIKCGSEKVSAQCRENLFSIETLKDFQHIEDNRDQGLNVRAKAKQMVALLQDDEKLKNERARFLLTRKRFIQNGSSGISSDGSRRSVGRRNIETGATDPEFEEARPSSLGEEEMQLQIALALSKEECEKERELRRGDDIRLQIAIEESKR

SEQ ID NO: 123390 - protein, 172 aa, Heterodera glycines
  Homolog annotation: Hit_ID=NP_499882.1; Match level="QueryCoverage =93%, HitCoverage=49%, E-value=5e-45, Identity=52%"; Hit description =farnesyltransferase (38.5 kD) (4A992) [Caenorhabditis elegans] gb|AAB94144.1| Hypothetical protein R02D3.
  Gene Ontology: Mol. function=protein geranylgeranyltransferase activity; Cellular component=protein farnesyltransferase complex; Biological process=signal transduction
  Essential gene: C elegans homolog=R02D3.5; Phenotype=Pvl,Rup,Unc
  Coding regions on vcDNA: vcDNA=SeqID_49813; Strand=+; Position=269-784
MNSSSPVGYIPLLYRDRPEWRDVTPIYNSAEENAVVRIATSEEFDDAFAYLRAVMNANELSERTLELTQTCIAQNPANYSVWLYRRAILRALNKDVSEELRYCEEIIIENPKNYQVWHNRKTLVDESGIYAAELPFIAQQLHDEPKNYHAWQHRQWVVQRFDLFNEQEMDFA

SEQ ID NO: 123391 - protein, 74 aa, Heterodera glycines
  Homolog annotation: Hit_ID=CAE60169.1; Match level="QueryCoverage =100%, HitCoverage=23%, E-value=1e-23, Identity=75%"; Hit description= Hypothetical protein CBG03723 [Caenorhabditis briggsae]
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_49814; Strand=+; Position=2-223
EEERWIHTKKFLLDLASGGTAAAVSKTAVAPIERVKLLLQVQDASNHITADKRYKSIIDVLRRGSQEQGFLALW

SEQ ID NO: 123392 - protein, 190 aa, Heterodera glycines
  Homolog annotation: Hit_ID=NP_491967.2; Match level="QueryCoverage =96%, HitCoverage=56%, E-value=1e-82, Identity=79%"; Hit description =putative RNA binding protein with KH domain(s) (1H452) [Caenorhabditis elegans] gb|AAB52897.2| Temporaril
  Gene Ontology: Mol. function=RNA binding; Cellular component=nucleus; Biological process=vasculogenesis
  Essential gene: C elegans homolog=T21G5.5a; Phenotype=Gro
  Coding regions on vcDNA: vcDNA=SeqID_49815; Strand=+; Position=170-739
MSKPDLDYLSQLLKDKKQLSAFPNIFAHVERLVDEEINRVRVSIFQCEFSHEPLQLPEPIGEVTVRQEKVFVPVKQYPEYNFVGRILGPRGMTAKQLETETGCRIMVRGKGSMRDKKKEEMNRGKPNWEHLSEELHVIIQCEDAPNRAEVKMARAVEEVNKLLVPAPEGEDDLKKKQLMELAIINGTFRS

SEQ ID NO: 123393 - protein, 211 aa, Heterodera glycines
  misc_feature (17)..(17): Xaa can be any naturally occurring amino acid
  misc_feature (54)..(54): Xaa can be any naturally occurring amino acid
  misc_feature (73)..(73): Xaa can be any naturally occurring amino acid
  misc_feature (200)..(200): Xaa can be any naturally occurring amino acid
  misc_feature (209)..(209): Xaa can be any naturally occurring amino acid
  Homolog annotation: Hit_ID=AAK66762.1; Match level="QueryCoverage =100%, HitCoverage=31%, E-value=8e-75, Identity=70%"; Hit description= proprotein convertase 2 [Heterodera glycines]
  Gene Ontology: Mol. function=peptidase activity; Cellular component =extracellular space; Biological process=proteolysis and peptidolysis
  Essential gene: C elegans homolog=K04F10.4a; Phenotype=Emb,Lvl
  Coding regions on vcDNA: vcDNA=SeqID_49816; Strand=-; Position=2-633
RYSLFDGRVRELPLLEXEYIKRHLVSRQSSFSHFKCQLNGVLFEYIHSFAFVVXLTPAEIVLKAKVYKSAPPXFHCEAGTIVMPREIPASGEMVLTLRPSACTGSSTEVYFLEHLQSIVSLNSSRRGDSTLYLISPTGTPLMILSRRPKDGDAKKKFSFWPFVALLSWGAPPRGRWRLVVRFLSGCFAPLGLAFRGPLTXFSLLLLGSXEP

SEQ ID NO: 123394 - protein, 239 aa, Heterodera glycines
  misc_feature (79)..(79): Xaa can be any naturally occurring amino acid
  Homolog annotation: Hit_ID=A25135; Match level="QueryCoverage=99%, HitCoverage=63%, E-value=2e-69, Identity=56%"; Hit description=actin A3, cytosolic - silkworm
  Gene Ontology: Biological process=reproduction
  Essential gene: C elegans homolog=T04C12.6; Phenotype=Ste
  Coding regions on vcDNA: vcDNA=SeqID_49817; Strand=+; Position=2-721
CHKKCSALVGDCGPRMRSACLARYHAPRAVFPSIVARPPHRGLVLGMTQRDSHVRHDAHSKRDILTLKHHSEHRLLPLXDHVENMWHHIFYHDLRVPPEEHPALLTDAPLNPRAHRKDMTHIVLDTLHTPDVYVDIQGALSVYLSGHNTGLVLHSGYGVPHSVPIYEVYAVPHDILRLHLRGRDLSDYQKKILSERGHSLETTRERDIARHLRENVRYVALHFERDMDSGVFFSSGEKI

SEQ ID NO: 123395 - protein, 95 aa, Heterodera glycines
  Homolog annotation: Hit_ID=CAE58541.1; Match level="QueryCoverage =65%, HitCoverage=11%, E-value=3e-10, Identity=50%"; Hit description =Hypothetical protein CBG01700 [Caenorhabditis briggsae]
  Essential gene: C elegans homolog=ZK180.3a; Phenotype=Slu,Unc
  Coding regions on vcDNA: vcDNA=SeqID_49818; Strand=+; Position=32-316
MDNFASVYRHMLAGQLVIRLVSFLLNFALLRLVDPSLLGFFNVKMTLLYTTICFLSREPIRRLCLSSDFPLHKVPSYASLSPVRCSPWPPFPSAV

SEQ ID NO: 123396 - protein, 175 aa, Heterodera glycines
  misc_feature (36)..(36): Xaa can be any naturally occurring amino acid
  misc_feature (50)..(50): Xaa can be any naturally occurring amino acid
  misc_feature (125)..(125): Xaa can be any naturally occurring amino acid
  misc_feature (139)..(139): Xaa can be any naturally occurring amino acid
  Homolog annotation: Hit_ID=AAL78224.1; Match level="QueryCoverage =100%, HitCoverage=79%, E-value=1e-66, Identity=75%"; Hit description= hypothetical protein Hgg-30 [Heterodera glycines]
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_49819; Strand=+; Position=5-526
MNDVSAPDNENVEQKSTVCRAHKNSERQAELKRHYXTTKDERIQRYQGLXLYVHNLHHTLNDETLRSNYESYRHLPSAKGMRDEHGRSERFGSVCFERADKATDAVVEMNNKIIENEPLYLALAXQPEEDRTAQLASQXLQRLAAMRMHNPAGLMLTMYAPASDGFFLPQAIYNQ

SEQ ID NO: 123397 - protein, 236 aa, Heterodera glycines
  misc_feature (213)..(213): Xaa can be any naturally occurring amino acid
  Homolog annotation: Hit_ID=AAN15196.1; Match level="QueryCoverage =100%, HitCoverage=62%, E-value=1e-115, Identity=87%"; Hit description=actin [Globodera rostochiensis] gb|AAN78299.1| actin 1 [Heterodera glycines] gb|AAG47837.2| actin 1 [Het
  Gene Ontology: Cellular component=actin filament; Biological process =reproduction
  Essential gene: C elegans homolog=T04C12.6; Phenotype=Ste
  Coding regions on vcDNA: vcDNA=SeqID_49820; Strand=+; Position=11-718
EIAALVEDNGSGMCKAGFAGDDAPRGGCPTIVGRPRDHGVMVGMGQKDSYVGYKAQSKRGILTLKYPIEHSIVTNWDDMEKIWHHTFYHELRVSPEEHPVLLTNGPLNPKDNREKMTQIMFETINTPAMYVAIQAELSLYASGRNTGLVLESGDGVTHTVPIYEGYALPHTILRWDLAGRDLTDYLMKILTERGYSFMTTVERDIVRDIKEKXCYVALDFEQEMDTAACSSSEENS

SEQ ID NO: 123398 - protein, 116 aa, Heterodera glycines
  Homolog annotation: Hit_ID=AAR83295.1; Match level="QueryCoverage =92%, HitCoverage=28%, E-value=2e-14, Identity=43%"; Hit description =actin [Spodoptera exigua]
  Gene Ontology: Biological process=reproduction
  Essential gene: C elegans homolog=T04C12.6; Phenotype=Ste
  Coding regions on vcDNA: vcDNA=SeqID_49821; Strand=+; Position=41-388
MWHGRISRGDDAPPRGCFRSIVGRPGHQGVMVGMGKKNPTWKTRPIQPGILNLNNPIETGSYTMGNKLKKIGPNLLKKKWVPPPRKPGLFKKAPVNPKGKKKKITPNLVRKFKNPG

SEQ ID NO: 123399 - protein, 78 aa, Heterodera glycines
  misc_feature (53)..(53): Xaa can be any naturally occurring amino acid
  misc_feature (74)..(74): Xaa can be any naturally occurring amino acid
  Homolog annotation: Hit_ID=NP_001003349.1; Match level="QueryCoverage= 98%, HitCoverage=20%, E-value=1e-31, Identity=81%"; Hit description =beta-actin [Canis familiaris] gb|AAB71610.2| beta-actin [Canis familiaris]
  Gene Ontology: Biological process=reproduction
  Essential gene: C elegans homolog=T25C8.2; Phenotype=Unclassified
  Coding regions on vcDNA: vcDNA=SeqID_49822; Strand=+; Position=14-246
DAALVADNGSGMCNAGFTGKDAPRAVFPTIVGRPRHQGVMVRLGQKDSYLGDXAHCKRGILTLKHPIEHGIIPXWDDM

SEQ ID NO: 123400 - protein, 222 aa, Heterodera glycines
  Homolog annotation: Hit_ID=AAT70232.1; Match level="QueryCoverage =100%, HitCoverage=96%, E-value=1e-108, Identity=68%"; Hit description=unc-87 [Heterodera glycines]
  Essential gene: C elegans homolog=F08B6.4a; Phenotype=Unc
  Coding regions on vcDNA: vcDNA=SeqID_49823; Strand=+; Position=2-667
EAPSATMETKVAGGGAAPKRVWRWTLSQLRQTDGIIPSQGGWNKGDSQKLMTNFGTPRDTTTKVKVENLAEIREDILLKSHGEVRLQSGTNRFASHKGFDSIGTGRDVCREGVNVNILPADLDPLPEETIRASDWIVRLHAGATRFYSQKGVTLFGTGRPETTRMKESTHPEYSHERDIDNTEIPLLMGTNKFASHNGMTGFGSKRRETTKMLDTSPPEYSH

SEQ ID NO: 123401 - protein, 137 aa, Heterodera glycines
  misc_feature (15)..(15): Xaa can be any naturally occurring amino acid
  Homolog annotation: Hit_ID=AAK66762.1; Match level="QueryCoverage =99%, HitCoverage=20%, E-value=3e-76, Identity=98%"; Hit description =proprotein convertase 2 [Heterodera glycines]
  Gene Ontology: Mol. function=peptidase activity; Cellular component =extracellular space; Biological process=proteolysis and peptidolysis
  Essential gene: C elegans homolog=K04F10.4a; Phenotype=Emb,Lvl
  Coding regions on vcDNA: vcDNA=SeqID_49824; Strand=+; Position=3-412
PSVQSPTDPLYPFPXYLKNDGQSNGKPRLDLNVEKAWALGYTGKNITTAIMDDGVDYMHADLRFNFNAEASYDFSSNDPYPYPRYTDDWFNSHGTRCAGEISAARDNGICGVGVAYDSKVAGIRMLDQPYMTDLIEA

SEQ ID NO: 123402 - protein, 242 aa, Heterodera glycines
  misc_feature (41)..(41): Xaa can be any naturally occurring amino acid
  misc_feature (203)..(203): Xaa can be any naturally occurring amino acid
  Homolog annotation: Hit_ID=AAG17452.1; Match level="QueryCoverage =100%, HitCoverage=64%, E-value=2e-46, Identity=43%"; Hit description= beta-actin [Hypophthalmichthys molitrix]
  Gene Ontology: Biological process=reproduction
  Essential gene: C elegans homolog=T04C12.6; Phenotype=Ste
  Coding regions on vcDNA: vcDNA=SeqID_49825; Strand=+; Position=2-727
CNGRFASDDGPRTACPYTAGRPRNKGAMRRMGQKDTGPGQXAHPTRAIPTRKKPNEHRIYTDWDHVEKMWHHLFYNQLRGTPEDHPELLTKDPHKAEGSTKKRTTVQYETTRTPAMNGDIPAMLAMDHYGRNTGNQLDWGQGVAQTETRNQGEAPHQDIHREDSASRDNTEYKKTNRHGARDSFVTTARLRDRTRPPDKMCYXGVHFEQELGKVRAAPSLENSSQPPDCELITDSKDRLRGP

SEQ ID NO: 123403 - protein, 242 aa, Heterodera glycines
  misc_feature (58)..(58): Xaa can be any naturally occurring amino acid
  misc_feature (69)..(69): Xaa can be any naturally occurring amino acid
  misc_feature (84)..(84): Xaa can be any naturally occurring amino acid
  misc_feature (168)..(168): Xaa can be any naturally occurring amino acid
  misc_feature (177)..(177): Xaa can be any naturally occurring amino acid
  misc_feature (220)..(220): Xaa can be any naturally occurring amino acid
  Homolog annotation: Hit_ID=CAA70694.1; Match level="QueryCoverage =99%, HitCoverage=68%, E-value=1e-68, Identity=58%"; Hit description =cathepsin S-like cysteine proteinase [Heterodera glycines]
  Gene Ontology: Mol. function=cathepsin S activity; Cellular component= extracellular space; Biological process=proteolysis and peptidolysis
  Essential gene: C elegans homolog=T03E6.7; Phenotype=Emb,Gro,Unc
  Coding regions on vcDNA: vcDNA=SeqID_49826; Strand=+; Position=2-727
QRFCILANSPLSLIAASLATKDLFALASNHSTTYAKRPMQAKHANSATSGKIAKNIAXIWREGLTSVRXNNVVNSHILGFENDXVSINVAPNQLMHETPAQYIPIRWLKWLCMRPRHTMVTLVGNSSTLSEKLNWPEKRAMTRAKDQGDCGSWWTFTDNGTIEGALGXKTASKSISXSERNLVDSASKYGNKGCDGGLMDSAFEYVRYNEGLDTDEAYPXEAETGKCRCQNETEGGTAVRFK

SEQ ID NO: 123404 - protein, 153 aa, Heterodera glycines
  Homolog annotation: Hit_ID=AAH81188.1; Match level="QueryCoverage =88%, HitCoverage=48%, E-value=2e-13, Identity=35%"; Hit description =MGC84420 protein [Xenopus laevis]
  Essential gene: C elegans homolog=H38K22.2a; Phenotype=Emb
  Coding regions on vcDNA: vcDNA=SeqID_49827; Strand=+; Position=143-601
MLPTPTFISDCHTVGAYRQKIDHLFNKYACDGDDEAHKAGPDRICPYGMVLFLHDLYITPTIPAVMVLAWKLRAHKRCKFTLDEFHHRIATLIPTGAEDINRLRTILLKAEQDFCAERTLFRELYQFIFISVKAAEQTSIKLDAAPACYQMLL

SEQ ID NO: 123405 - protein, 106 aa, Heterodera glycines
  Homolog annotation: Hit_ID=CAE56710.1; Match level="QueryCoverage =68%, HitCoverage=17%, E-value=3e-19, Identity=58%"; Hit description =Hypothetical protein CBG24496 [Caenorhabditis briggsae]
  Gene Ontology: Cellular component=postsynaptic membrane; Biological process=neuromuscular junction development
  Essential gene: C elegans homolog=F30A10.8a; Phenotype=Unclassified
  Coding regions on vcDNA: vcDNA=SeqID_49828; Strand=+; Position=2-322
TLNTYVACEAIQQVTAPCVWNDQQCELSIQLDRGIKLSTTGDGQMLWQYPFEAIRATGDDGQQFLWMDFGEPIGEQVSERTEQHETLTKTKKLKIVFYGMIILKNY

SEQ ID NO: 123406 - protein, 73 aa, Heterodera glycines
  Homolog annotation: Hit_ID=CAE61654.1; Match level="QueryCoverage =97%, HitCoverage=27%, E-value=8e-10, Identity=45%"; Hit description =Hypothetical protein CBG05588 [Caenorhabditis briggsae]
  Gene Ontology: Biological process=reproduction
  Essential gene: C elegans homolog=B0250.3; Phenotype=Emb,Ste
  Coding regions on vcDNA: vcDNA=SeqID_49829; Strand=+; Position=2-220
AGDRGTFGTSGGDRATIAPHNPDIKRTRAHLPSGGKRENPAATHVMIVVVAARGPTGRKLKKARPDYHPIRAN

SEQ ID NO: 123407 - protein, 159 aa, Heterodera glycines
  misc_feature (14)..(14): Xaa can be any naturally occurring amino acid
  misc_feature (65)..(65): Xaa can be any naturally occurring amino acid
  misc_feature (105)..(105): Xaa can be any naturally occurring amino acid
  Homolog annotation: Hit_ID=CAE69463.1; Match level="QueryCoverage =83%, HitCoverage=70%, E-value=4e-24, Identity=39%"; Hit description =Hypothetical protein CBG15659 [Caenorhabditis briggsae]
  Essential gene: C elegans homolog=W04B5.4; Phenotype=Lva
  Coding regions on vcDNA: vcDNA=SeqID_49830; Strand=+; Position=10-485
IRTCWVWRKNNRWXRYLPRRNDSHNLIDMDELGEQCATFSDPMPADPPKLWVAWLYTDSYGSGRXIRDQVTKLFGKDAKTGEMQVFKNTLSTNKQLWKNKHLLEXRAVTFPNGEPGAGNATHLEIMADGRCVIHPQNLANVDQFPLIGRSKPVSPRYLA

SEQ ID NO: 123408 - protein, 193 aa, Heterodera glycines
  Homolog annotation: Hit_ID=CAE66157.1; Match level="QueryCoverage =98%, HitCoverage=32%, E-value=1e-66, Identity=63%"; Hit description =Hypothetical protein CBG11388 [Caenorhabditis briggsae]
  Gene Ontology: Mol. function=serine C-palmitoyltransferase activity; Cellular component=mitochondrion; Biological process=gametogenesis
  Essential gene: C elegans homolog=F43H9.2a; Phenotype=Unclassified
  Coding regions on vcDNA: vcDNA=SeqID_49831; Strand=+; Position=2-583
VLEGCDPADVDVCMASYTKSFGAAGGYLAGKSSLIAHLRRHSPTSFYSLAMSAPVAQQVFTSMSIIMGRDNTDQGWRRIERLARNTRYFRLRLKQMGFIVYGSNDSPVIPIMIYHPTKCGLWGRLLLERKISAVVVSFPATAMTESRCRICISAAHDKEMLDRVLDAIDEVGDISATKHSHRTHRYRQLDVKW

SEQ ID NO: 123409 - protein, 218 aa, Heterodera glycines
  Homolog annotation: Hit_ID=NP_504474.1; Match level="QueryCoverage =83%, HitCoverage=78%, E-value=8e-30, Identity=37%"; Hit description =Williams-Beuren syndrome critical region protein 24 like (25.6 kD) (5G71) [Caenorhabditis elegans] gb|AAB
  Essential gene: C elegans homolog=CD4.4; Phenotype=Emb,Lva,Unc
  Coding regions on vcDNA: vcDNA=SeqID_49832; Strand=+; Position=2-655
ESVVDICVSTLMSKLQNYTEDQLQNLLHDESRLNAMVDSMPQVSSLPNDKEIKLAHSKSLAEYNLSIEPQLNKALNHLRETHANAVRTKGEVNEMKAKLDSVAEARSLDSVCVSLKNLAQNAEDESETAAELFYKGAMEIDDFIKKFTEKRVIGHTTRLKAEKLAELLRQQCQYQPQHPSPSALGMTTQTQYSSPGVAASMYPVLGQAYTSPANFRHS

SEQ ID NO: 123410 - protein, 152 aa, Heterodera glycines
  Homolog annotation: Hit_ID=XP_330225.1; Match level="QueryCoverage =98%, HitCoverage=99%, E-value=3e-67, Identity=81%"; Hit description =hypothetical protein [Neurospora crassa] gb|EAA34807.1| hypothetical protein [Neurospora crassa]
  Gene Ontology: Mol. function=structural constituent of ribosome; Cellular component=cytosolic small ribosomal subunit (sensu Eukarya); Biological process=protein biosynthesis
  Essential gene: C elegans homolog=C16A3.9; Phenotype=Emb
  Coding regions on vcDNA: vcDNA=SeqID_49833; Strand=+; Position=58-516
MGRMHAPGKGISSSALPYRRTPPSWCKVTPQKVVETICKLAKKGMTPSQIGVTLRDSHGVPQVKNITGNKILRVLKSNGLAPEIPEDLYHLIKKAVSVRKHLERNRKDKDSKFRLILIESRIHRLARYYKTVGQLPPTWKYESSNAGALVGM

SEQ ID NO: 123411 - protein, 181 aa, Heterodera glycines
  Homolog annotation: Hit_ID=AAK94490.1; Match level="QueryCoverage =88%, HitCoverage=16%, E-value=1e-43, Identity=52%"; Hit description =PAZ/Piwi domain protein [Heterodera glycines]
  Gene Ontology: Mol. function=translation initiation factor activity; Biological process=gametogenesis
  Essential gene: C elegans homolog=F55A12.1; Phenotype=Emb
  Coding regions on vcDNA: vcDNA=SeqID_49834; Strand=+; Position=2-547
CSEGQFKMILKFEVPLIQCALRSAGCDNVGLTLIVSNKLQNVRFFSKQIQPNAKPPEQNIKPGTVIDTAVVHPSNCEFFLNSHRTLQGTARTPKYTVVYDDNKFSLMDLEEMSYHLCFGHQIINSIVSLPAPVYIANEYAKRGRNLFNYYDAPRDMETFADLNQKLCLEHAGWIAPHRVNA

SEQ ID NO: 123412 - protein, 260 aa, Heterodera glycines
  Homolog annotation: Hit_ID=NP_510789.1; Match level="QueryCoverage =96%, HitCoverage=61%, E-value=7e-91, Identity=61%"; Hit description =acetyl-Coenzyme A Dehydrogenase family member (XR830) [Caenorhabditis elegans] gb|AAC69025.1| Hypothetica
  Gene Ontology: Mol. function=acyl-CoA dehydrogenase activity; Cellular component=mitochondrial matrix; Biological process=energy pathways
  Essential gene: C elegans homolog=K05F1.3; Phenotype=Unclassified
  Coding regions on vcDNA: vcDNA=SeqID_49835; Strand=+; Position=45-824
MQPFVHWSKCIFKRPFSNSSKLFSSSFSMGFNFEFTEEQKQLQAAVKKFTQDEIIPKASHYDKTMEFPWEVIKKAHANGFMNVDIPSDCGGLDLELVSNVLISEVIGYGCTGIGTAILGNDLAATPLVIGAKEEVKKKFLSRLIDEPIMASYCVTEPGAGSDVAALKTKAEKKGDEWVINGSKMWITNGGVASWYFVLARTDPDPKASTGKAFTAFVVDGNTPGIVRGKKEINMGQRCSDTRAISFEDVVVPNAQVIGAP

SEQ ID NO: 123413 - protein, 221 aa, Heterodera glycines
  Homolog annotation: Hit_ID=NP_491802.1; Match level="QueryCoverage =89%, HitCoverage=11%, E-value=7e-24, Identity=35%"; Hit description =chondroitin sulfate proteoglycan 4 (1G825) [Caenorhabditis elegans] gb|AAN60527.1| Hypothetical protein C
  Essential gene: C elegans homolog=C48E7.6; Phenotype=Emb
  Coding regions on vcDNA: vcDNA=SeqID_49836; Strand=+; Position=55-717
MITADFHASHPSLGPSQIVYRIDQLPNTLRLSLNNFSLPLFRQFTQLDIDQGTVALEHTPSSEMAKCDVIGLRIGMEGHEDGHGQQQKASPQFVHSRVLAIRIDPMALLSSAHLGAESNGERSAIIYNVTKRPENGTFFWVDREKEAGSFSQRSIDRGEVLYAQMNMEAFQDIFEYVLSNDEMELLPKKGIVRVQPVFQPPPTHAPLLSLVWPISTPLRLK

SEQ ID NO: 123414 - protein, 84 aa, Heterodera glycines
  misc_feature (44)..(44): Xaa can be any naturally occurring amino acid
  misc_feature (73)..(73): Xaa can be any naturally occurring amino acid
  Homolog annotation: Hit_ID=AAP13582.1; Match level="QueryCoverage =100%, HitCoverage=41%, E-value=9e-28, Identity=69%"; Hit description= Ras-related protein Rab7 [Lentinula edodes]
  Gene Ontology: Mol. function=ATP binding; Cellular component=Golgi apparatus; Biological process=embryogenesis and morphogenesis
  Essential gene: C elegans homolog=W03C9.3; Phenotype=Unclassified
  Coding regions on vcDNA: vcDNA=SeqID_49837; Strand=+; Position=2-253
VSQYVNKRISNHYKATIGADFLTKDVMIDDRLVTMQIWDTAGQXRMHSLRDSFYRDADWCALAYDGTHAPSFXSLKSWRDDFLV

SEQ ID NO: 123415 - protein, 276 aa, Heterodera glycines
  Homolog annotation: Hit_ID=CAE60721.1; Match level="QueryCoverage =99%, HitCoverage=19%, E-value=1e-98, Identity=60%"; Hit description =Hypothetical protein CBG04396 [Caenorhabditis briggsae]
  Essential gene: C elegans homolog=F54D1.6; Phenotype=Lva,Ste
  Coding regions on vcDNA: vcDNA=SeqID_49838; Strand=+; Position=3-830
AVDKTREQETRQRYNLPRVSGLMRPFPDTSTGSIYSTLTLNEVNSEAIRQQIINYYRIPGSGERFTDYQQQALNQFQIPTDNMFTTSKEEDKKFEAFPEASIKSEPIYKTAAIYETPQYRFVPRTGAVLMQMLQQCNDLANRETIGLQPYQGQMYWDWASQCPDNPGKILQECGDNVPCLYDYTLLNAEVLGNEVKDTWNAFFHDRWSAIQNYNSCGPINIEYPEYLIKTPALSSGYLQGDIARFECFQTHWIKGDAEFKCTQVVDYNFPQMWRFE

SEQ ID NO: 123416 - protein, 52 aa, Heterodera glycines
  Essential gene: C elegans homolog=R06F6.2; Phenotype=Emb,Gro,Sma
  Coding regions on vcDNA: vcDNA=SeqID_49839; Strand=+; Position=47-205
MHDANGRELKCWAYSKTNNEVIVASRETVYFYDINHCLETGGENRRCCAMGK

SEQ ID NO: 123417 - protein, 73 aa, Heterodera glycines
  misc_feature (1)..(2): Xaa can be any naturally occurring amino acid
  Homolog annotation: Hit_ID=NP_500895.1; Match level="QueryCoverage =95%, HitCoverage=59%, E-value=6e-13, Identity=60%"; Hit description =ribosomal Protein, Small subunit (12.9 kD) (rps-25) [Caenorhabditis elegans] gb|AAK39246.1| Ribosomal pro
  Essential gene: C elegans homolog=K02B2.5; Phenotype=Gro
  Coding regions on vcDNA: vcDNA=SeqID_49840; Strand=+; Position=2-220
XXGGGGKGKKNTRRKGKVRDKLANMGVFDQATDDKLDKEIISVKRISPRGGAEGLKGRASLGKAGRGGVDQKG

SEQ ID NO: 123418 - protein, 86 aa, Heterodera glycines
  Homolog annotation: Hit_ID=CAE71475.1; Match level="QueryCoverage =96%, HitCoverage=15%, E-value=2e-10, Identity=33%"; Hit description =Hypothetical protein CBG18393 [Caenorhabditis briggsae]
  Essential gene: C elegans homolog=M03C11.4; Phenotype=Emb
  Coding regions on vcDNA: vcDNA=SeqID_49841; Strand=+; Position=158-415
KYLERVRSLAHWYIDAVSYTDNDDHGYYNYFLFAVRQSYYGDGSSVHRFDRYGNMYRFYHHPDKERVRIAQILVPPTYQRIALGPP

SEQ ID NO: 123419 - protein, 201 aa, Heterodera glycines
  Homolog annotation: Hit_ID=NP_493558.1; Match level="QueryCoverage =96%, HitCoverage=69%, E-value=2e-51, Identity=53%"; Hit description =proteasome Beta Subunit (31.2 kD) (pbs-5) [Caenorhabditis elegans] emb|CAB04567.1| Hypothetical protein K
  Gene Ontology: Mol. function=endopeptidase activity; Cellular component=proteasome core complex (sensu Eukarya); Biological process=embryonic cleavage
  Essential gene: C elegans homolog=K05C4.1; Phenotype=Emb
  Coding regions on vcDNA: vcDNA=SeqID_49842; Strand=+; Position=28-630
MFYHDPYEDDYSHDKELKQLVQMDDLAIPKFVMPPLGIKPKKFVRKHFGPNSRLPMAQFLKGTTTLSFVYKPKTPQDKGGVIVAVDSRATGGTYISSKTVEKIIPINDQLVATMAGGAADCQYCTRAASKYCNLFQLKEGTQISVAAASKYFANVMYDYRGQELGVHSMVCGVDKFGPSIYMGETEGTRVKIDNICSLRSG

SEQ ID NO: 123420 - protein, 179 aa, Heterodera glycines
  Homolog annotation: Hit_ID=NP_573062.1; Match level="QueryCoverage =60%, HitCoverage=83%, E-value=1e-38, Identity=68%"; Hit description =CG8198-PA [Drosophila melanogaster] gb|AAF48498.2| CG8198-PA [Drosophila melanogaster] gb|AAL90184.1| AT2
  Gene Ontology: Cellular component=mitochondrial matrix; Biological process=iron ion transport
  Essential gene: C elegans homolog=Y39B6A.3; Phenotype=Lva
  Coding regions on vcDNA: vcDNA=SeqID_49843; Strand=+; Position=1-537
RQAISLTPAAVARVRQLIEQRPSARALRVGVQQRGCNGFTYTLDYAEQKNRFDEEVKQDGVNIWIDAKAQLTLLGSEMDFGESKLASEFVFHNPNIKGTCGCGESFNMDDNTTMGAAAVTNSSTAPTEMASSPERQMPSSTNAQSYWTEGSSSHSSYSGGGSSDYSSGGSSGSDSSSST

SEQ ID NO: 123421 - protein, 222 aa, Heterodera glycines
  Homolog annotation: Hit_ID=AAM73862.1; Match level="QueryCoverage =46%, HitCoverage=10%, E-value=5e-28, Identity=66%"; Hit description =putative serine/threonine protein kinase; HcSTK [Haemonchus contortus]
  Gene Ontology: Mol. function=protein serine/threonine kinase activity; Cellular component=membrane; Biological process=asymmetric protein localization involved in cell fate commitment
  Essential gene: C elegans homolog=H39E23.1a; Phenotype=Spo
  Coding regions on vcDNA: vcDNA=SeqID_49844; Strand=+; Position=1-666
VHKDSSQKFYCLSPTFKRALFKVNLSPPSQQPPQSSSATHQGGHHRHTSSGHHHSSGMTASSSRAPNRTRTGDDLHIGKYKLLKTIGKGNFAKVKLAKHVPTGVEVAIKIIDKTVLNQSSLQKLFREVRIMKQCIVSDETARANPESLETDRITEMHSIRGCVFSTRALVFVGNGNKVGGFALARASGFKVNLAIARAVKKAARDLFHIELHEDRTVFQDFF

SEQ ID NO: 123422 - protein, 211 aa, Heterodera glycines
  Homolog annotation: Hit_ID=NP_490675.1; Match level="QueryCoverage =100%, HitCoverage=99%, E-value=4e-93, Identity=83%"; Hit description= RAB family member (23.4 kD) (rab-11.1) [Caenorhabditis elegans] gb|AAB54158.1| Rab family protein 11.1 [
  Gene Ontology: Mol. function=RAB small monomeric GTPase activity; Cellular component=Golgi apparatus; Biological process=signal transduction
  Essential gene: C elegans homolog=F53G12.1; Phenotype=Emb,Ste
  Coding regions on vcDNA: vcDNA=SeqID_49845; Strand=+; Position=73-705
MTSRDDEYDYLFKVVLIGDSGVGKSNLLSRFTRNEFNLESKSTIGVEFATRSIQVDSKTVKAQIWDTAGQERYRAITSAYYRGAVGALLVYDIAKHVTYENVERWLKELRDHSDQNIVIMLVGNKSDLRHLRAVPTDEAKAYAERNQLSFIETSALDATNVEDAFTNILTEIYRSVSTRQVPPDRMVPIHSQHNITLSSSTSANKEKKACC

SEQ ID NO: 123423 - protein, 225 aa, Heterodera glycines
  misc_feature (14)..(14): Xaa can be any naturally occurring amino acid
  Homolog annotation: Hit_ID=CAB88203.1; Match level="QueryCoverage =99%, HitCoverage=99%, E-value=5e-97, Identity=61%"; Hit description =putative cuticular collagen [Globodera pallida]
  Gene Ontology: Mol. function=structural constituent of cuticle; Cellular component=basement membrane; Biological process=cuticle biosynthesis (sensu Nematoda)
  Essential gene: C elegans homolog=C15A11.6; Phenotype=Emb
  Coding regions on vcDNA: vcDNA=SeqID_49846; Strand=+; Position=5-681
MQETHIVLGIASVXSQLAIIATVVTLPSLYSEMSQMNSKVRDGVEAFRVNTDSAWTDLMDVQVVVTPPSKPRDNPFNSIFRAKRQLPGHCQCAGLQQPSCPPGPPGPSGPPGQPGQPGRPGAAGQPGQPGANGVVSRPIPGPKGPPGAPGQNGNPGGQGQPGQPGGQGPPGPPGAPGQPGQPGNSGQPGQPGAPGQPGKDSGYCPCPPRSSVLAVKKKMAAAKKA

SEQ ID NO: 123424 - protein, 168 aa, Heterodera glycines
  Homolog annotation: Hit_ID=NP_502786.1; Match level="QueryCoverage =100%, HitCoverage=32%, E-value=7e-30, Identity=41%"; Hit description= RNA-binding region RNP-1 (63.6 kD) (4P555) [Caenorhabditis elegans] emb|CAB54457.1| Hypothetical protein
  Gene Ontology: Biological process=embryogenesis and morphogenesis
  Essential gene: C elegans homolog=Y57G11C.9a; Phenotype=Emb
  Coding regions on vcDNA: vcDNA=SeqID_49847; Strand=+; Position=1-504
QHTVFIRGLPGNMSTDEIREFFEKDFGACTFDFVKVSPDRTKLYIAVRFDSKAAARKVMFNFSTDGELLGFKVEMTWFRDIRRYLAHCAKQGIRSSRFRGRSDYRRDDEQYKGRGRSRSPTRSPEREEGARSRSASAASRQFNANRRRSQSRSHSAHSHSHSRSLSSG

SEQ ID NO: 123425 - protein, 196 aa, Heterodera glycines
  misc_feature (27)..(27): Xaa can be any naturally occurring amino acid
  misc_feature (73)..(73): Xaa can be any naturally occurring amino acid
  Homolog annotation: Hit_ID=AAK39275.2; Match level="QueryCoverage =96%, HitCoverage=39%, E-value=2e-40, Identity=43%"; Hit description =Glutamyl(e)/glutaminyl(q) trna synthetase protein 3 [Caenorhabditis elegans]
  Gene Ontology: Mol. function=glutamate-tRNA ligase activity; Cellular component=mitochondrion; Biological process=tRNA modification
  Essential gene: C elegans homolog=T07A9.2; Phenotype=Gro
  Coding regions on vcDNA: vcDNA=SeqID_49848; Strand=+; Position=2-592
AFDQPGRVSFAPCPTGELHLGSVRTAXFNFLWARKYNGKFVLRIEDTDRERLVEGSEQRIEQTLYHFGLTPDXSPLRGGQLGSYYQSERMPLYRELADQSVDIGHSYKGFCIQKRLDYLHRKANSERIPFRKDGICRQVSTEETRAREQNEEEFVVRLKWDGRTTGFTDIEFWYYEHYSEGGDFLDLKRDGFPTYP

SEQ ID NO: 123426 - protein, 87 aa, Heterodera glycines
  misc_feature (34)..(34): Xaa can be any naturally occurring amino acid
  Homolog annotation: Hit_ID=CAE56536.1; Match level="QueryCoverage =90%, HitCoverage=9%, E-value=1e-17, Identity=45%"; Hit description =Hypothetical protein CBG24263 [Caenorhabditis briggsae]
  Gene Ontology: Biological process=embryogenesis and morphogenesis
  Essential gene: C elegans homolog=C23G10.8; Phenotype=Emb
  Coding regions on vcDNA: vcDNA=SeqID_49849; Strand=+; Position=3-265
PFDLWLTQIRQNTKPLMDLCLRPMAFRPPFFGGXFILNGAFANHLPELPLNVDTILGSDSPMENFVTTAPFDVLNPLNFTAIWASTA

SEQ ID NO: 123427 - protein, 168 aa, Heterodera glycines
  misc_feature (117)..(117): Xaa can be any naturally occurring amino acid
  Homolog annotation: Hit_ID=AAG60623.1; Match level="QueryCoverage =100%, HitCoverage=68%, E-value=1e-43, Identity=57%"; Hit description= ribosomal protein S6 [Aplysia californica] sp|Q9BMX5|RS6_APLCA 40S ribosomal protein S6
  Gene Ontology: Cellular component=eukaryotic 48S initiation complex; Biological process=protein biosynthesis
  Essential gene: C elegans homolog=Y71A12B.1; Phenotype=Ste
  Coding regions on vcDNA: vcDNA=SeqID_49850; Strand=+; Position=104-607
IPSGNEKQGFRMNQGVLFNHRVSLRLSEGHSWYRLRRTRERKGETIRGCIVNLDISVVSLVVGKKGEADIAGVTDVTAPKRLGPKRAWKIAQMLTLSNEDYVLEYVLRREVPEKSGXPESNAPKIQRLVTPLTLQRKRAHHAEKRIRVVAAREAAAFYNNLLADRAHE

SEQ ID NO: 123428 - protein, 89 aa, Heterodera glycines
  misc_feature (45)..(45): Xaa can be any naturally occurring amino acid
  Homolog annotation: Hit_ID=NP_502365.1; Match level="QueryCoverage =100%, HitCoverage=62%, E-value=5e-29, Identity=67%"; Hit description= ribosomal Protein, Small subunit (15.9 kD) (rps-23) [Caenorhabditis elegans] emb|CAA94601.1| Hypothetica
  Gene Ontology: Cellular component=eukaryotic 48S initiation complex; Biological process=protein biosynthesis
  Essential gene: C elegans homolog=F28D1.7; Phenotype=Ste
  Coding regions on vcDNA: vcDNA=SeqID_49851; Strand=+; Position=2-271
SRKLKPHRQERRWNDKRCKKTPLGTRWKDDPFRGAWMAKGIGLDXIGVESRQPTSAIPKCVREQLVKNSNKITAYVPNNGRLNLIDEND

SEQ ID NO: 123429 - protein, 172 aa, Heterodera glycines
  misc_feature (80)..(80): Xaa can be any naturally occurring amino acid
  Homolog annotation: Hit_ID=CAE60034.1; Match level="QueryCoverage =100%, HitCoverage=25%, E-value=9e-13, Identity=34%"; Hit description= Hypothetical protein CBG03543 [Caenorhabditis briggsae]
  Gene Ontology: Mol. function=oxidoreductase activity; Cellular component=integral to membrane; Biological process=embryogenesis and morphogenesis
  Essential gene: C elegans homolog=K10D2.6; Phenotype=Emb
  Coding regions on vcDNA: vcDNA=SeqID_49852; Strand=+; Position=2-517
HPFPWTRTFKTGQTHYQYICSPDNPVLKQASRRSPATKTQPAELTAADHSVWTRHSAMYANDIAKERGSIGDAVPPFPAXKSPLHLVLEVLPRLQDHYYSISTTDRLDTPLLPLTADELHYNTSHERLDKRECTNSLEDLAPAESTEPVYFSQSQLLLPQHRLQPLIITETP

SEQ ID NO: 123430 - protein, 115 aa, Heterodera glycines
  misc_feature (1)..(1): Xaa can be any naturally occurring amino acid
  misc_feature (4)..(7): Xaa can be any naturally occurring amino acid
  misc_feature (9)..(11): Xaa can be any naturally occurring amino acid
  Homolog annotation: Hit_ID=NP_498572.1; Match level="QueryCoverage =88%, HitCoverage=67%, E-value=1e-34, Identity=69%"; Hit description =ribosomal Protein, Small subunit (16.2 kD) (rps-14) [Caenorhabditis elegans] gb|AAC48301.1| Ribosomal pro
  Gene Ontology: Mol. function=structural constituent of ribosome; Cellular component=eukaryotic 48S initiation complex; Biological process=ribosomal small subunit assembly and maintenance
  Essential gene: C elegans homolog=F37C12.9; Phenotype=Emb,Ste
  Coding regions on vcDNA: vcDNA=SeqID_49853; Strand=+; Position=2-349
XEKXXXXEXXXEEFHETFVHVTDLSGRETIVKITGGMRVKDDRDEASSYAVMLAAQDVAERCKQVGINALHVKLSETGGTKTKKAGFFFQAEMRAHERSGMKIGRIEDGRPIPLD

SEQ ID NO: 123431 - protein, 270 aa, Heterodera glycines
  Homolog annotation: Hit_ID=NP_502196.1; Match level="QueryCoverage =100%, HitCoverage=29%, E-value=4e-96, Identity=59%"; Hit description= methionyl tRNA Synthetase (101.7 kD) (mrs-1) [Caenorhabditis elegans] emb|CAA97803.1| Hypothetical prote
  Gene Ontology: Mol. function=methionine-tRNA ligase activity; Cellular component=cytoplasm; Biological process=protein biosynthesis
  Essential gene: C elegans homolog=F58B3.5; Phenotype=Lva
  Coding regions on vcDNA: vcDNA=SeqID_49854; Strand=+; Position=1-810
VLSRYCRMREYQSLSFCGTDEYGTATEMKALSEGLTPRQLCDKFYELHKKTYDWFSIDFDFFGRTSNPNQTEIAQDIFNKLFANGFTSIDAQMQLHCANCNKFLADRFVNGICPHCQFADARGDQCDGCGHLLDGVDLVEPKCRICGGKPTLEQSRHIFLDLDRLKPHLQAFLDRTMATSDSRWSANAISITKQWLNHGLGRRGITRDLKWGTPVPLAEVASKVFYVWFDAPIGYLSITKSHLGNDWHRWWKNPDDRELFNFIGKDTAPF

SEQ ID NO: 123432 - protein, 135 aa, Heterodera glycines
  misc_feature (48)..(48): Xaa can be any naturally occurring amino acid
  Homolog annotation: Hit_ID=NP_058877.1; Match level="QueryCoverage =96%, HitCoverage=31%, E-value=2e-30, Identity=53%"; Hit description =fumarylacetoacetate hydrolase [Rattus norvegicus] gb|AAH76381.1| Fumarylacetoacetate hydrolase [Rattus no
  Gene Ontology: Mol. function=fumarylacetoacetase activity; Biological process=tyrosine catabolism
  Essential gene: C elegans homolog=K10C2.4; Phenotype=Emb,Lva,Unc
  Coding regions on vcDNA: vcDNA=SeqID_49855; Strand=+; Position=2-406
RHALEIAIGTQILDLSVETHLFTGTLLSERRNVFSQETLNQFMGLSRXCWLEERLHLPSLLVHANPMLIDDSELRERALAAETEAKMHFPDQIGDYTDFYSSIYHATDDGTKVRVKNNDLMKNGNGLPLVYLGRA

SEQ ID NO: 123433 - protein, 73 aa, Heterodera glycines
  misc_feature (51)..(51): Xaa can be any naturally occurring amino acid
  misc_feature (61)..(61): Xaa can be any naturally occurring amino acid
  Homolog annotation: Hit_ID=CAA34603.1; Match level="QueryCoverage =100%, HitCoverage=47%, E-value=8e-21, Identity=71%"; Hit description= unnamed protein product [Brugia pahangi] sp|P62300|RS13_WUCBA 40S ribosomal protein S13 (40S ribosomal pr
  Gene Ontology: Mol. function=structural constituent of ribosome; Cellular component=cytosolic small ribosomal subunit (sensu Eukarya); Biological process=protein biosynthesis
  Essential gene: C elegans homolog=C16A3.9; Phenotype=Emb
  Coding regions on vcDNA: vcDNA=SeqID_49856; Strand=+; Position=2-220
GNKIVRILRSKGMAPEIPEDLYHLIKKAGSIRKAFERFRQDIESKYPSNFXVESRIHRLGXYFQTKRLLPAPW

SEQ ID NO: 123434 - protein, 139 aa, Heterodera glycines
  Homolog annotation: Hit_ID=NP_502365.1; Match level="QueryCoverage =100%, HitCoverage=97%, E-value=3e-56, Identity=76%"; Hit description= ribosomal Protein, Small subunit (15.9 kD) (rps-23) [Caenorhabditis elegans] emb|CAA94601.1| Hypothetica
  Gene Ontology: Cellular component=eukaryotic 48S initiation complex; Biological process=protein biosynthesis
  Essential gene: C elegans homolog=F28D1.7; Phenotype=Ste
  Coding regions on vcDNA: vcDNA=SeqID_49857; Strand=+; Position=2-418
KPTGIRTARQLKKRRQEQRWNDKRYKIAGLGTPWKADPFGGACMAKRIVLEKSGGKPRQPNSAIRKCARVQLIKNSKKITAFVPNDGCLNFIEENDEKLVSGFGRRGHAVGDIPGVRFKVVRRANTALLALFRVNKERP

SEQ ID NO: 123435 - protein, 104 aa, Heterodera glycines
  Homolog annotation: Hit_ID=EAL19965.1; Match level="QueryCoverage =98%, HitCoverage=57%, E-value=1e-31, Identity=62%"; Hit description =hypothetical protein CNBF2920 [Cryptococcus neoformans var. neoformans B-3501A]
  Gene Ontology: Mol. function=structural constituent of ribosome; Cellular component=cytosolic large ribosomal subunit (sensu Eukarya); Biological process=protein biosynthesis
  Essential gene: C elegans homolog=F10E7.7; Phenotype =Clr,Emb,Gro,Sck,Slu,Stp
  Coding regions on vcDNA: vcDNA=SeqID_49858; Strand=+; Position=3-317
SVRLYSKARILGYKRSQRNQQTNQVLLRVEGVNTKEDTEFYLGKRVAYVYKAERAINGSKVRVMWGRIARPHGNSGVVKVLFKNTVPPKSFGARARVMLYPSRV

SEQ ID NO: 123436 - protein, 253 aa, Heterodera glycines
  Homolog annotation: Hit_ID=NP_510560.1; Match level="QueryCoverage =98%, HitCoverage=57%, E-value=1e-72, Identity=55%"; Hit description =putative cytoplasmic protein family member of ancient origin (XQ115) [Caenorhabditis elegans] emb|CAC7009
  Essential gene: C elegans homolog=H13N06.3a; Phenotype=Gro,Slu
  Coding regions on vcDNA: vcDNA=SeqID_49859; Strand=+; Position=3-761
SFDFLKEHDDCVKFPEKLKSGSCESNGLKPIMITDWDGTMKDYCSRYATNLQPIYTAISLAKFSQAYTRLSAVLTAGPLRGPGILDLIALPKDGPIVFGGSYGREWWFDGKRIVHDEGISDAGLTALDSLSEKMATLLQDNEYAHFALIGSGVQRKVDRLTLGVQTVSKHVDVALSQKYQNEVIQLVQRVDPNSQFLHFAPSNGCEVEVMVHEQGKVWTKAKGMAKIVGTLGESLEKGTVLICGDTHSDLPMV

SEQ ID NO: 123437 - protein, 224 aa, Heterodera glycines
  Homolog annotation: Hit_ID=NP_741320.1; Match level="QueryCoverage =100%, HitCoverage=87%, E-value=1e-42, Identity=43%"; Hit description= SET domain mariner transposase fusion gene (27.1 kD) (4C373) [Caenorhabditis elegans] gb|AAK68462.1| Hyp
  Gene Ontology: Mol. function=methyltransferase activity; Cellular component=nucleus; Biological process=establishment and/or maintenance of chromatin architecture
  Essential gene: C elegans homolog=Y2H9A.1; Phenotype=Stp
  Coding regions on vcDNA: vcDNA=SeqID_49860; Strand=+; Position=15-686
MDFEYIVANPSEGGTDSAFLDEDFEGCNCTDGQCCTSAAGGCSCLPGKRDNYNPITGKWIDQGGTDQRQGVPHLECHQNCVCAWEPDKCANRQVQFGVRQPIRVAPCTSGKGFGVFASALIEIGTFVIEYVGEVLGEEEARRRINIVGRHEHNYLFTIREFFGGECRSTFIDARHKGNISRFINHSCEPNLSLQIVRLGRQCPSLAMFASRDIQSGEELSYSYG

SEQ ID NO: 123438 - protein, 89 aa, Heterodera glycines
  Homolog annotation: Hit_ID=AAL99922.1; Match level="QueryCoverage =91%, HitCoverage=9%, E-value=1e-18, Identity=54%"; Hit description =CLL-associated antigen KW-2 [Homo sapiens]
  Essential gene: C elegans homolog=T08G11.4; Phenotype=Emb,Lva,Unc
  Coding regions on vcDNA: vcDNA=SeqID_49861; Strand=+; Position=1-270
SITPWGGPAYLHRGSSRKDLLADMEPNGVDIFRVAKKISPNIVYFLPKNTRTDQLIALAGPGGRVELEQTVLNEKIKALHAYFGLLAAN

SEQ ID NO: 123439 - protein, 149 aa, Heterodera glycines
  misc_feature (36)..(36): Xaa can be any naturally occurring amino acid
  misc_feature (51)..(51): Xaa can be any naturally occurring amino acid
  Homolog annotation: Hit_ID=NP_501503.1; Match level="QueryCoverage =93%, HitCoverage=33%, E-value=4e-17, Identity=36%"; Hit description =polynucleotide 5'-kinase 3'-phosphatase (46.2 kD) (4J500) [Caenorhabditis elegans] emb|CAA91035.2| Hypoth
  Essential gene: C elegans homolog=F21D5.5; Phenotype=Unclassified
  Coding regions on vcDNA: vcDNA=SeqID_49862; Strand=+; Position=2-448
RRSWLHVDNTIGLCLQVIVSLGTPNFRKPCPGMCHXLKAKITVKCESSDKXSFYDGYAAARLKSSIRPTNDHSCADRLFALNLSLPLQTPELIVSMVSAEEPIRLHDFDPSQYLREHSAQSVPNDYHMPGPSLPKLMLLVVSPASSKST

SEQ ID NO: 123440 - protein, 141 aa, Heterodera glycines
  misc_feature (83)..(83): Xaa can be any naturally occurring amino acid
  misc_feature (102)..(102): Xaa can be any naturally occurring amino acid
  Homolog annotation: Hit_ID=NP_495445.2; Match level="QueryCoverage =96%, HitCoverage=35%, E-value=1e-17, Identity=36%"; Hit description =probable rna phosphate cyclase-like protein (41.6 kD) (2H339) [Caenorhabditis elegans] gb|AAB93426.2| Hyp
  Gene Ontology: Mol. function=RNA-3'-phosphate cyclase activity; Cellular component=nucleolus; Biological process=35S primary transcript processing
  Essential gene: C elegans homolog=ZK1127.5; Phenotype=Emb,Lva
  Coding regions on vcDNA: vcDNA=SeqID_49863; Strand=+; Position=83-508
IGYFSDALIVLAPYCDAPLIVNLTGVAIPTMKSTSTPFRLLRLPGFSRLVLVDKCPEINMTTRRLKTTGGGTVTFSNPIKRNXLAVPRIKPRKECMITGHAXLYKESAYIASRMIDGTQQMLLGSLSDVYITIDQRIVPQD

SEQ ID NO: 123441 - protein, 236 aa, Heterodera glycines
  Homolog annotation: Hit_ID=CAE69195.1; Match level="QueryCoverage =100%, HitCoverage=60%, E-value=2e-30, Identity=34%"; Hit description= Hypothetical protein CBG15234 [Caenorhabditis briggsae]
  Gene Ontology: Mol. function=nucleoside transporter activity; Cellular component=integral to plasma membrane; Biological process =physiological processes
  Essential gene: C elegans homolog=ZK809.4; Phenotype=Sck
  Coding regions on vcDNA: vcDNA=SeqID_49864; Strand=+; Position=3-710
PGEFALARILGNNLCGILMAVLYILIIVLVGANAALAATVYFGLALFTVVLCIFSFHFLQKLNFYNYYVQKAAKARANNGTNILHEEETGEAKANIKVTHPPLKTYIAIFSEVRRQLLDVWLVFFVTLALFPTVLLKVSLISPFNDQKTSESLYKQLTVFLNFNVWAAVGCWLSGFSPRPSPDYLSLPICLRLLFLPLFWVCDYQYDHLTPRRFVFIHNPWVFTVLITLMALSHGY

SEQ ID NO: 123442 - protein, 109 aa, Heterodera glycines
  Homolog annotation: Hit_ID=AAO14563.2; Match level="QueryCoverage =97%, HitCoverage=14%, E-value=2e-44, Identity=82%"; Hit description =Hsp90 [Heterodera glycines]
  Gene Ontology: Biological process=reproduction
  Essential gene: C elegans homolog=C47E8.5; Phenotype=Emb,Ste
  Coding regions on vcDNA: vcDNA=SeqID_49865; Strand=+; Position=2-328
NTTGKKLVSPSAEGLELPESEEDNKKFEQDKVTFDKLCKVIKDILDNRVRKVSVSDRLVSSPCCIVTGEYGWSANMERIMKAHTLPDSSTLGYMASKKNLEIVPDHSIV

SEQ ID NO: 123443 - protein, 204 aa, Heterodera glycines
  misc_feature (41)..(41): Xaa can be any naturally occurring amino acid
  misc_feature (59)..(59): Xaa can be any naturally occurring amino acid
  misc_feature (72)..(72): Xaa can be any naturally occurring amino acid
  misc_feature (102)..(102): Xaa can be any naturally occurring amino acid
  misc_feature (111)..(111): Xaa can be any naturally occurring amino acid
  Homolog annotation: Hit_ID=NP_058877.1; Match level="QueryCoverage =98%, HitCoverage=48%, E-value=6e-23, Identity=36%"; Hit description =fumarylacetoacetate hydrolase [Rattus norvegicus] gb|AAH76381.1| Fumarylacetoacetate hydrolase [Rattus no
  Gene Ontology: Mol. function=fumarylacetoacetase activity; Biological process=tyrosine catabolism
  Essential gene: C elegans homolog=K10C2.4; Phenotype=Emb,Lva,Unc
  Coding regions on vcDNA: vcDNA=SeqID_49866; Strand=+; Position=108-716
MPSVSFVDVPVNSPFTFENLPFGVFSTNENSKKRIGVAIGXPIRDLSVVKHLFHGRCFXERQNVFKSETLNXILGLNPQCLLQGRLTLPFRAVPMPPQCFPXQQISQKGFXSQFEGQIHLPPPIGIKLTFNPLLIRPPMFDQCFLGKHTPFGEIEIGAPCYHGRGSNFLFPDRKHFPRGQIKGEIIPPHLLTNRYGLLLEMGFF

SEQ ID NO: 123444 - protein, 253 aa, Heterodera glycines
  Homolog annotation: Hit_ID=EAK81714.1; Match level="QueryCoverage =98%, HitCoverage=49%, E-value=5e-91, Identity=67%"; Hit description =hypothetical protein UM00953.1 [Ustilago maydis 521] ref|XP _398568.1| hypothetical protein UM00953.1 [Usti
  Gene Ontology: Mol. function=glycine hydroxymethyltransferase activity; Cellular component=mitochondrion; Biological process =serine catabolism
  Essential gene: C elegans homolog=C05D11.11a; Phenotype=Emb
  Coding regions on vcDNA: vcDNA=SeqID_49867; Strand=+; Position=15-773
MNLSPVDSVTHCTTTSTMTQITKPVDPWNECLNTSLEVEDPEMFRLVELEKYRQYSCLELIASENFTSQAVMEANGSALTNKYSEGLPNARYYGGNEFIDQVEVLCQQRALKAFNLDSSTWGINVQSYSGSTANFSALTALLAPHDRIMGLDLPSGGHLTHGYQTAKKKISSSAIYFESMPYQVDMTTGLLDYDRLEQNAALFRPKLIICGASAYARDWDYARLRKIADTHGAYLMADIAHISGLVAAQEQNN

SEQ ID NO: 123445 - protein, 81 aa, Heterodera glycines
  misc_feature (13)..(13): Xaa can be any naturally occurring amino acid
  Homolog annotation: Hit_ID=NP_507636.1; Match level="QueryCoverage =100%, HitCoverage=20%, E-value=5e-18, Identity=48%"; Hit description= nuclear Hormone Receptor (43.9 kD) (nhr-70) [Caenorhabditis elegans] emb|CAB11571.1| Hypothetical protei
  Gene Ontology: Mol. function=transcriptional activator activity; Cellular component=transcription factor complex; Biological process =gametogenesis
  Essential gene: C elegans homolog=Y40B10A.8; Phenotype=Emb
  Coding regions on vcDNA: vcDNA=SeqID_49868; Strand=+; Position=2-244
AVCAHDGHGVHFXVQACRACAGLFQRSTIAERVYRCRYHGNCDICQREVRCVCHACPLDKCLGLGMDPDAVPRHRDQIGPR

SEQ ID NO: 123446 - protein, 229 aa, Heterodera glycines
  misc_feature (137)..(137): Xaa can be any naturally occurring amino acid
  misc_feature (200)..(200): Xaa can be any naturally occurring amino acid
  Homolog annotation: Hit_ID=AAR12009.1; Match level="QueryCoverage =100%, HitCoverage=68%, E-value=1e-77, Identity=56%"; Hit description= cathepsin B-like proteinase [Triatoma infestans]
  Gene Ontology: Mol. function=peroxidase activity; Cellular component =extracellular space; Biological process=protein targeting
  Essential gene: C elegans homolog=F57F5.1; Phenotype=Emb,Lva,Unc
  Coding regions on vcDNA: vcDNA=SeqID_49869; Strand=+; Position=2-688
RDQGRCGSCWALAAVTAMSDRVCVASNGKTQVSLSAEDLVSCCRICGMGCNGGYPAMVWQYFKHWGLISGGYLPDKSEGCLDYSVLPCEHHTAGPRGTCDEGPTPKCTKKSSAASGLTYKKSLYYAKSAYSVSSDPXAIQKEIMTNGPVEVAFSVYDDFPNYKDGVYHQTTDNFLSGHALRAIGWGEENGEPYWLIAHSXDTDWGKDGLFKIKRGTNECGIEGQVVAGI

SEQ ID NO: 123447 - protein, 125 aa, Heterodera glycines
  Homolog annotation: Hit_ID=NP_505683.1; Match level="QueryCoverage =99%, HitCoverage=18%, E-value=6e-21, Identity=45%"; Hit description =poly polymerase (73.6 kD) (5K925) [Caenorhabditis elegans] emb|CAA16309.3| Hypothetical protein Y32F6A.3
  Gene Ontology: Mol. function=RNA binding; Cellular component =cytoplasm; Biological process=reproduction
  Essential gene: C elegans homolog=Y32F6A.3; Phenotype=Emb,Lva
  Coding regions on vcDNA: vcDNA=SeqID_49870; Strand=+; Position=2-376
ALITIDSYRLSDRAHRANIYSECMEHGDIILIYMFTSFDRLLNVVRKTADLHKVEDAFLRLIPLRYYGIELDILFSRLALIQIKEYQKLSDDNLLNILDDNTFPSLNGCHVADEILPLVPNRLNF

SEQ ID NO: 123448 - protein, 272 aa, Heterodera glycines
  Homolog annotation: Hit_ID=NP_498256.2; Match level="QueryCoverage =48%, HitCoverage=23%, E-value=4e-50, Identity=69%"; Hit description =SMAll body size SMA-4, dwarfin, transforming growth factor beta signal transducer similar to Mothers Agai
  Gene Ontology: Mol. function=transcription cofactor activity; Cellular component=cytoplasm; Biological process=SMAD protein heteromerization
  Essential gene: C elegans homolog=R12B2.1; Phenotype=Dpy
  Coding regions on vcDNA: vcDNA=SeqID_49871; Strand=+; Position=3-818
QQNDAQNAVDPCAHVVHVLMCYQMGGEDEEFVRKAIESLVKKLKDRREQLESLISAVTSGGKQSTSCVTIPRSLDGRLQVAGRKGLPHVVYARIWRWPNVSKTELLKLRSCATPADHVDLICVNPFHYDRVVSSGLSAFDLASFRLDPLSSSSPSAAFRPPPPSDQMPIPLPIGHSFAHFSGAFDSHPSFSASSSHHLPSVPIDHQSANSNAFDAPFPPIPSFVPHPQQNQQRCPLIVHCLGEGQQQQIGPFQQQMCHQNTTDQSQTHRFTH

SEQ ID NO: 123449 - protein, 96 aa, Heterodera glycines
  Homolog annotation: Hit_ID=AAB81951.1; Match level="QueryCoverage =45%, HitCoverage=48%, E-value=7e-15, Identity=86%"; Hit description =Dim1p homolog [Homo sapiens]
  Gene Ontology: Mol. function=pre-mRNA splicing factor activity; Cellular component=small nuclear ribonucleoprotein complex; Biological process=cell cycle
  Essential gene: C elegans homolog=C24H11.9; Phenotype=Gro
  Coding regions on vcDNA: vcDNA=SeqID_49872; Strand=+; Position=5-295
MCDRLTQIQDLVNDLANHMCNSVGVLQASAGPCEFGTAPETLYKIANKVKNFAVIYLVDISEVPDFNKMYELYDPVTAMFFFSLSSNFFASTHCCV

SEQ ID NO: 123450 - protein, 108 aa, Heterodera glycines
  Homolog annotation: Hit_ID=AAH76221.1; Match level="QueryCoverage =97%, HitCoverage=72%, E-value=2e-22, Identity=48%"; Hit description =Ribosomal protein S15 [Danio rerio]
  Gene Ontology: Mol. function=structural constituent of ribosome; Cellular component=eukaryotic 48S initiation complex; Biological process=protein biosynthesis
  Essential gene: C elegans homolog=F36A2.6; Phenotype=Lva
  Coding regions on vcDNA: vcDNA=SeqID_49873; Strand=+; Position=2-325
PPAKRQSMNRGLNLTPKSLLPRLRKGKLNCPEVMKPECVNTHLHDMIVLPETVGCEAGTLSGQVDDAEGVRAEMMGYYLGELSITQQPVEHGTTGTGAKHTAPGIPLR

SEQ ID NO: 123451 - protein, 102 aa, Heterodera glycines
  misc_feature (24)..(24): Xaa can be any naturally occurring amino acid
  misc_feature (70)..(70): Xaa can be any naturally occurring amino acid
  misc_feature (81)..(81): Xaa can be any naturally occurring amino acid
  Homolog annotation: Hit_ID=P48817; Match level="QueryCoverage=100%, HitCoverage=67%, E-value=2e-23, Identity=54%"; Hit description =Nucleoside diphosphate kinase (NDK) (NDP kinase) gb|AAA90988.1| nucleoside diphosphate kinase pir||JC4359 nuc
  Gene Ontology: Mol. function=ATP binding; Cellular component=nucleus; Biological process=negative regulation of cell proliferation
  Essential gene: C elegans homolog=F25H2.5; Phenotype=Pvl,Stp
  Coding regions on vcDNA: vcDNA=SeqID_49874; Strand=+; Position=2-309
RTFIAIKHDSVQRGLDAKITKQFXQRGYKMVCMKLAKGTVPHLEVHYHNLKNKLFFAGLPKYMASGPIVXRFWKGLDGVPXAPVAPALKPLGQWPGTIPGDF

SEQ ID NO: 123452 - protein, 82 aa, Heterodera glycines
  misc_feature (17)..(17): Xaa can be any naturally occurring amino acid
  misc_feature (53)..(53): Xaa can be any naturally occurring amino acid
  Homolog annotation: Hit_ID=CAE58974.1; Match level="QueryCoverage =100%, HitCoverage=53%, E-value=1e-20, Identity=59%"; Hit description= Hypothetical protein CBG02247 [Caenorhabditis briggsae]
  Gene Ontology: Mol. function=ATP binding; Cellular component=nucleus; Biological process=negative regulation of cell proliferation
  Essential gene: C elegans homolog=F25H2.5; Phenotype=Pvl,Stp
  Coding regions on vcDNA: vcDNA=SeqID_49875; Strand=+; Position=2-247
GVQRGLVAKIIKQIYHXGYELIAMKLAKAPVPHLEVHYHQLKDKPYFAGLIEXVTSGPIVAMVWEGLDEGTQGHVLLGATIP

SEQ ID NO: 123453 - protein, 234 aa, Heterodera glycines
  Homolog annotation: Hit_ID=CAG01866.1; Match level="QueryCoverage =74%, HitCoverage=57%, E-value=4e-10, Identity=25%"; Hit description =unnamed protein product [Tetraodon nigroviridis]
  Essential gene: C elegans homolog=T10H9.3; Phenotype=Lva,Unc
  Coding regions on vcDNA: vcDNA=SeqID_49876; Strand=+; Position=1-702
PFIIRRSFVLGQRFCNKKTEESFRDKEKVLPLDGLQKDLRTTATSSFSLYCSHAHQILTDVTELRDLVLDKRKEYILCSNAFSLYGVQKFMSDEDRRKFDQETDLAFRHCTKLIKSLEAQIESDRTLRPSDQLKHLLAVTNLLNVYLKEVLSIVTQLRAIHVRKSRQIRRICRLANLVEMYGARIEQTQKEEEEKALKLVRMLEELKENEKCQWRKEETREEDKENVMLKKGPR

SEQ ID NO: 123454 - protein, 73 aa, Heterodera glycines
  Homolog annotation: Hit_ID=NP_733280.1; Match level="QueryCoverage =94%, HitCoverage=15%, E-value=9e-15, Identity=59%"; Hit description =CG11901-PB, isoform B [Drosophila melanogaster] ref|NP_652000.1| CG11901-PA, isoform A [Drosophila melano
  Gene Ontology: Mol. function=translation elongation factor activity; Cellular component=intracellular; Biological process=translational elongation
  Essential gene: C elegans homolog=F17C11.9a; Phenotype=Gro
  Coding regions on vcDNA: vcDNA=SeqID_49877; Strand=+; Position=2-220
AKEEADEEMDAADEAIAALPQFSDPLAALPPGSFVMDMFKRVYSNEYTASQSIPYSWDDFNPTRYSLWFSEYN

SEQ ID NO: 123455 - protein, 102 aa, Heterodera glycines
  misc_feature (78)..(78): Xaa can be any naturally occurring amino acid
  Homolog annotation: Hit_ID=AAN05584.1; Match level="QueryCoverage =97%, HitCoverage=86%, E-value=4e-22, Identity=55%"; Hit description =ribosomal protein L30 [Argopecten irradians]
  Gene Ontology: Cellular component=cytosolic ribosome (sensu Eukarya); Biological process=protein biosynthesis
  Essential gene: C elegans homolog=Y106G6H.3; Phenotype=Emb,Lva
  Coding regions on vcDNA: vcDNA=SeqID_49878; Strand=+; Position=2-307
YAHNMNDMLGMETWSGKYCLCYKKYLITLLSDKAQLVILFSNTPSLRLSEIDYYAMLTETGVLDYYGNIVELGTECGXLLHWYMLNITDPGESDFIHYMPTE

SEQ ID NO: 123456 - protein, 263 aa, Heterodera glycines
  Homolog annotation: Hit_ID=CAE60248.1; Match level="QueryCoverage =92%, HitCoverage=59%, E-value=1e-20, Identity=32%"; Hit description =Hypothetical protein CBG03822 [Caenorhabditis briggsae]
  Gene Ontology: Biological process=positive regulation of growth rate
  Essential gene: C elegans homolog=T23D8.3; Phenotype=Lva
  Coding regions on vcDNA: vcDNA=SeqID_49879; Strand=+; Position=19-807
MGKNKKPFIDRKSAVNYTLNNRELEETQRISDYKSFSFRSLDKRFEGIYEDYANEEEEGAEEMDDEEGQTGADSAIFRSLLADGQSQRSCEERFHRELPDSELKGAVLRYAKAMEIGKGRAEPTEDILVDSAKRSRWDCESILSMHSTLYNHPTEIREPMKVIGRRRGRTTKEKEMANLEETEVDGDQRDGPPAPSVRTRTSMVSVIRPKGETTEERRMRKIAVKEERRERRKEKKANKETFRAERLKLEAQRKTNQPKTRQI

SEQ ID NO: 123457 - protein, 124 aa, Heterodera glycines
  misc_feature (2)..(2): Xaa can be any naturally occurring amino acid
  Homolog annotation: Hit_ID=CAA69652.1; Match level="QueryCoverage =97%, HitCoverage=35%, E-value=2e-38, Identity=61%"; Hit description =glyceraldehyde-3-phosphate dehydrogenase [Xanthophyllomyces dendrorhous] sp|O13507|G3P_PHARH Glyceraldehyd
  Gene Ontology: Mol. function=glyceraldehyde 3-phosphate dehydrogenase (phosphorylating) activity; Cellular component=cytoplasm; Biological process=glycolysis
  Essential gene: C elegans homolog=K10B3.7; Phenotype=Unclassified
  Coding regions on vcDNA: vcDNA=SeqID_49880; Strand=+; Position=66-437
MXKIGINGFGRIGRLVFRASLQNPDVQCVAINDPFIDLEYMTYLLRYDSTHGLFKGTIEVKDGKLVVDGHTISVYKSMKPEEIQWGAAGAHYFVEASGVFLSGEKAGLHCNGGAKKGGGNGPSG

SEQ ID NO: 123458 - protein, 285 aa, Heterodera glycines
  Homolog annotation: Hit_ID=NP_502283.1; Match level="QueryCoverage =98%, HitCoverage=22%, E-value=9e-63, Identity=46%"; Hit description =SPT transcription factor family member (133.4 kD) (spt-5) [Caenorhabditis elegans] emb|CAA92985.1| Hypoth
  Gene Ontology: Cellular component=DNA-directed RNA polymerase II, holoenzyme; Biological process=embryogenesis and morphogenesis
  Essential gene: C elegans homolog=K08E4.1; Phenotype=Emb
  Coding regions on vcDNA: vcDNA=SeqID_49881; Strand=+; Position=1-855
RTFMLSDLTMGEMKILPKDVQLCAEVATGVERMGQYQYQDLVMLDKETVGVIVRLERENVEVLSMHGKILRVNPQTIECKKNSRFVKALDSQKNTIQAGDTVKVVEGFLARKKETEEERQGEIKHLFRNWAFVFSRKYPQNGGMFVCKARNLALIGGSKASESQINTTILDNSQLMSPRPNPLESPRTIHGGMTPHSGSSVVGAQSVRGDHGFKAPSVVGSIATSATGVGRQHVRRNMEIMGKTVRVLAGPMKGYIGIVKDATESTVKVELHTMPKTVNFDINKV

SEQ ID NO: 123459 - protein, 241 aa, Heterodera glycines
  Homolog annotation: Hit_ID=CAE71427.1; Match level="QueryCoverage =92%, HitCoverage=95%, E-value=9e-81, Identity=66%"; Hit description =Hypothetical protein CBG18338 [Caenorhabditis briggsae]
  Gene Ontology: Cellular component=cytoplasm; Biological process =ribosomal small subunit biogenesis
  Essential gene: C elegans homolog=Y39A1A.14; Phenotype=Lva
  Coding regions on vcDNA: vcDNA=SeqID_49882; Strand=+; Position=36-761
MKPTKRPMKHPSAPFSRDSPRSKRLKQSTDGAGGKRLFVVIEDCSLEVAKVGAEHVVLCSDKHANWLRKQNRDPAQFRPDILHQCLLMLQDSPLNSAGLLRVFFRTKQNVLVSVSPQCRLPRTFDRFCGLMVQLLHKLQIRAADSSQKLLNVVKNPVTNHLPVGCRKFLSTLNCPNLVSNMAEKVQPEAEEPVVIVVGGIAHGKISTDYTEEDIKISNYPLSAALCCAKLTSAFEQLWGVL

SEQ ID NO: 123460 - protein, 284 aa, Heterodera glycines
  Homolog annotation: Hit_ID=NP_505071.1; Match level="QueryCoverage =98%, HitCoverage=56%, E-value=1e-64, Identity=45%"; Hit description =mannosyltransferase (57.1 kD) (5I519) [Caenorhabditis elegans] gb|AAC48267.3| Hypothetical protein ZC513.
  Gene Ontology: Mol. function=alpha-16-mannosyltransferase activity; Biological process=dolichol-linked oligosaccharide biosynthesis
  Essential gene: C elegans homolog=T27F7.3a; Phenotype=Dpy,Lva
  Coding regions on vcDNA: vcDNA=SeqID_49883; Strand=+; Position=2-853
FHEYKFGHNVGTFLRLLTFSQFHFLFYASRPLPNTFAMVLVLLVFQKLLDFRFLHAAAFATVATFLFRFELLLLFGPAFLFAFVVYWRHISVLKTLLVGFCSLIIVLILSVLLDSLMWRRWVWPEGEVIHFNVWHNRSSEYGVLPFWWYFFSALPRAMFLSVFLVPFGLLIHQRVQFALVSLCLPAFLFVLLFSFLPHKELRFILYAVPLFNTSVAVFCAWIWKKARDSWFFRFCAFLVALHLLVNAIFSVSFVYASAQNYPGGVALLKLQHKHRFLRDKPIAV

SEQ ID NO: 123461 - protein, 86 aa, Heterodera glycines
  Essential gene: C elegans homolog=R10H10.4; Phenotype=Emb
  Coding regions on vcDNA: vcDNA=SeqID_49884; Strand=+; Position=51-311
MPRQVLELSDYFAPLAALIMFALAILVFSFFVINFFYITDRDDLTVFEKFGAHLHLCLGPHSMSDIYRGGPRDYPQPQGTDKEMNS

SEQ ID NO: 123462 - protein, 71 aa, Heterodera glycines
  Homolog annotation: Hit_ID=AAO33478.1; Match level="QueryCoverage =100%, HitCoverage=67%, E-value=4e-33, Identity=97%"; Hit description= ubiquitin extension protein [Heterodera glycines]
  Gene Ontology: Biological process=cell cycle
  Essential gene: C elegans homolog=F25B5.4a; Phenotype=Emb
  Coding regions on vcDNA: vcDNA=SeqID_49885; Strand=+; Position=2-217
NVKTKIQDKEGVPPDQQRLIFAGKQLEDGRTLADYNIQKESTLHLVLRLRGGNGKRNTGKNKKSNKKLDQN

SEQ ID NO: 123463 - protein, 128 aa, Heterodera glycines
  Homolog annotation: Hit_ID=NP_507032.1; Match level="QueryCoverage =95%, HitCoverage=96%, E-value=4e-58, Identity=92%"; Hit description =histone (13.4 kD) (his-3) [Caenorhabditis elegans] ref|NP_505296.1| histone (13.4 kD) (his-19) [Caenorhab
  Gene Ontology: Mol. function=DNA binding; Cellular component =nucleosome; Biological process=nucleosome assembly
  Essential gene: C elegans homolog=T23D8.6; Phenotype=Emb
  Coding regions on vcDNA: vcDNA=SeqID_49886; Strand=+; Position=40-426
MSGRGKGGKAKTGGKQKTRSSRAGLQFPVGRLHRLLRKGHYAERVGAGAPVYLAAVLEYLAAEVLELAGNASRDNKKTRINPRHLQLAVRNDEELNKLLSGVTISQGGVLPNIQAVLLPKKTQHGESQ

SEQ ID NO: 123464 - protein, 115 aa, Heterodera glycines
  Homolog annotation: Hit_ID=NP_492765.1; Match level="QueryCoverage =97%, HitCoverage=45%, E-value=1e-17, Identity=46%"; Hit description =proteasome Alpha Subunit (27.2 kD) (pas-5) [Caenorhabditis elegans] emb|CAB02097.1| Hypothetical protein
  Essential gene: C elegans homolog=F25H2.9; Phenotype=Emb,Lva
  Coding regions on vcDNA: vcDNA=SeqID_49887; Strand=+; Position=2-346
STNIGIHPKESVLLAAERHSMTKLVADHSLIKISQVDNHIAVDSAALIANSRTWVERSRVDAHLFCVTYGVKILAKHVTLYGSRSPLHFRDDDSTIELYHPDCSSMLFAVIDCQE

SEQ ID NO: 123465 - protein, 152 aa, Heterodera glycines
  Homolog annotation: Hit_ID=CAE62787.1; Match level="QueryCoverage =95%, HitCoverage=27%, E-value=7e-49, Identity=60%"; Hit description =Hypothetical protein CBG06960 [Caenorhabditis briggsae]
  Gene Ontology: Mol. function=protein binding; Cellular component =endoplasmic reticulum; Biological process=cell cycle
  Essential gene: C elegans homolog=F59E12.4a; Phenotype=Emb,Lva,Unc
  Coding regions on vcDNA: vcDNA=SeqID_49888; Strand=+; Position=60-515
MLPSNPDDKIDEVDKILSKLDGKIERKMGPLMCRHNPRQKCTNCLPLDPYDERFLHEKDIKHLSFHAHVHKLTDLHGRGTRSNNVLENVCCKLRPNCAGGHLPYPKGICTRCRPSTLTLNRQPFRHVDNIEFANSHIVNNFLNFWRRSSFQR

SEQ ID NO: 123466 - protein, 134 aa, Heterodera glycines
  misc_feature (63)..(63): Xaa can be any naturally occurring amino acid
  misc_feature (94)..(94): Xaa can be any naturally occurring amino acid
  Homolog annotation: Hit_ID=P30757; Match level="QueryCoverage=100%, HitCoverage=93%, E-value=1e-47, Identity=74%"; Hit description =Histone H2B pir||S16084 histone H2B - sipunculid (Sipunculus nudus)
  Gene Ontology: Mol. function=DNA binding; Cellular component =nucleosome; Biological process=nucleosome assembly
  Essential gene: C elegans homolog=H02I12.6; Phenotype=Gro,Pvl,Ste
  Coding regions on vcDNA: vcDNA=SeqID_49889; Strand=+; Position=58-458
MPPKPSGKGAKKAVKSTKAVRTGDKKRRKARKESYSVYIYRVLKQVHPDTGISSKAMSIMNSXGPIWRFSVPRFSIFPFLRFVNDVFERIAAEXSRLAHYNKRSTISSREIQTAVRLILPGELAKRAVSEGTKA

SEQ ID NO: 123467 - protein, 92 aa, Heterodera glycines
  Homolog annotation: Hit_ID=NP_495912.1; Match level="QueryCoverage =100%, HitCoverage=40%, E-value=3e-19, Identity=45%"; Hit description= haymaker protein (32.4 kD) (2J262) [Caenorhabditis elegans] emb|CAA93850.1| Hypothetical protein C18E9.6
  Essential gene: C elegans homolog=C18E9.6; Phenotype=Gro,Sma
  Coding regions on vcDNA: vcDNA=SeqID_49890; Strand=+; Position=2-280
GKQSNTLSYALRYIQPTWIFSGTLAPTELHLCYYHKQSEHLQFGVEFEANFKLQEVNTTFAYQIELPFSLAISGVLDHVKAQGKFGIGLLIG

SEQ ID NO: 123468 - protein, 169 aa, Heterodera glycines
  Homolog annotation: Hit_ID=NP_506486.1; Match level="QueryCoverage =97%, HitCoverage=19%, E-value=1e-12, Identity=22%"; Hit description =citron-like (105.0 kD) (5O516) [Caenorhabditis elegans] emb|CAB04720.1| Hypothetical protein T08G5.5 [Cae
  Essential gene: C elegans homolog=T08G5.5; Phenotype=Emb,Rup
  Coding regions on vcDNA: vcDNA=SeqID_49891; Strand=+; Position=25-531
MDFNGAERHCQTYYDERNASTRNIFFDLFHYYIKGEMPQKEVIQAESDYEIRRKPNISEALKLFKRHPTKIDTVGAFALIPPTTAFNRICEAVKALFGSLNNQLASTNLIVSFTNLVIRRTKNRLDELKRQRISITENVECSICRKRIMNSASVRNRGHSFAHFFCYKN

SEQ ID NO: 123469 - protein, 175 aa, Heterodera glycines
  misc_feature (170)..(170): Xaa can be any naturally occurring amino acid
  Homolog annotation: Hit_ID=NP_741684.1; Match level="QueryCoverage =96%, HitCoverage=34%, E-value=8e-49, Identity=50%"; Hit description =putative nuclear protein, with a coiled coil-4 domain, of eukaryotic origin (5T574) [Caenorhabditis elega
  Gene Ontology: Cellular component=actin filament; Biological process =actin cytoskeleton organization and biogenesis
  Essential gene: C elegans homolog=Y39B6A.14; Phenotype=Lva
  Coding regions on vcDNA: vcDNA=SeqID_49892; Strand=+; Position=3-527
EGSRKETKSLKEVLQKFRHAKETRKRKKNLDQAKKVIVTAQRKKEEKRLPKDMKQCNMEAINAIYDPQSFVDRLFTTLEGRQRNEKYAIRLLQIALCARVIGVHQLQTLGFYSYLHRYIRPKQKEVTRILLYAAQACHPLVPSDVIEQLIRVVAQNFVSDRNTPEAITVXLNTIR

SEQ ID NO: 123470 - protein, 178 aa, Heterodera glycines
  misc_feature (15)..(15): Xaa can be any naturally occurring amino acid
  misc_feature (163)..(163): Xaa can be any naturally occurring amino acid
  Homolog annotation: Hit_ID=CAE63219.1; Match level="QueryCoverage =100%, HitCoverage=14%, E-value=5e-51, Identity=52%"; Hit description= Hypothetical protein CBG07577 [Caenorhabditis briggsae]
  Gene Ontology: Mol. function=receptor activity; Cellular component =integral to plasma membrane; Biological process=regulation of body size
  Essential gene: C elegans homolog=F33C8.1a; Phenotype=Unc
  Coding regions on vcDNA: vcDNA=SeqID_49893; Strand=+; Position=3-536
VIGPRCDKCEPKYFXDPKNGGTCTYELAIDFIFTFKLDSNDIRDKYVNQINFFSVPYKRDTDVQFSITCECDTGAKVTINLTTQLLEGRPPHTKHLMAGQLCTASGIKRTYSSTDPGFAFGTETNTTFHVRVNDFETPIKIQISFAQSLPINWILFFVIFVAXFIVLLDAAGLIWISK

SEQ ID NO: 123471 - protein, 177 aa, Heterodera glycines
  Homolog annotation: Hit_ID=CAE67836.1; Match level="QueryCoverage =72%, HitCoverage=32%, E-value=6e-44, Identity=66%"; Hit description =Hypothetical protein CBG13421 [Caenorhabditis briggsae]
  Gene Ontology: Mol. function=DNA-(apurinic or apyrimidinic site) lyase activity; Cellular component=mitochondrion; Biological process= base-excision repair
  Essential gene: C elegans homolog=T05H10.2; Phenotype=Emb
  Coding regions on vcDNA: vcDNA=SeqID_49894; Strand=+; Position=12-542
MVEPKIPTTSDFNEENPVKSTPESHSLIKNGFFMSEEYGMTTKSVYTSQISQSVIKAGLYSKKNLGVHVSAAGSLENAIWNAIEMGCRSFALFVRNQRRWNAKPMDESVVERWNCAIKKTKFPLHQIVPHGSYLLNAGSPDQKKLEMTRKAMLDECQRCERLGIQFYNFHPGFTTGK

SEQ ID NO: 123472 - protein, 178 aa, Heterodera glycines
  Homolog annotation: Hit_ID=NP_492766.1; Match level="QueryCoverage =100%, HitCoverage=57%, E-value=2e-83, Identity=84%"; Hit description= ribosomal Protein, Acidic (33.8 kD) (rpa-0) [Caenorhabditis elegans] emb|CAB02098.1| Hypothetical protei
  Gene Ontology: Mol. function=DNA-(apurinic or apyrimidinic site) lyase activity; Cellular component=cytosolic ribosome (sensu Eukarya); Biological process=protein biosynthesis
  Essential gene: C elegans homolog=F25H2.10; Phenotype=Emb,Lva,Ste
  Coding regions on vcDNA: vcDNA=SeqID_49895; Strand=+; Position=1-534
KANYFTRIISLYEEYPKCLLVGVDNVGSKQMQEIRGAMRGHGEILMGKNTMIRKAIRGNLQKFPLLEKLLPYIVGNVGFVFTNEDLGDVRKKLLENKRGAPAKAGAIAPCDVRLPPQNSGMGPEKTSFFQALQIPTKISRGTIEILNEVHLIKTGEKVGASESALLNMLGIQPFSYGL

SEQ ID NO: 123473 - protein, 102 aa, Heterodera glycines
  Homolog annotation: Hit_ID=AAP69672.1; Match level="QueryCoverage =96%, HitCoverage=71%, E-value=4e-41, Identity=85%"; Hit description =histone H2B [Ajellomyces capsulatus] sp|Q7Z9J4|H2B_AJECA Histone H2B
  Gene Ontology: Mol. function=DNA binding; Cellular component =nucleosome; Biological process=establishment and/or maintenance of chromatin architecture
  Essential gene: C elegans homolog=C50F4.5; Phenotype=Emb,Lva,Unc
  Coding regions on vcDNA: vcDNA=SeqID_49896; Strand=+; Position=2-310
KSSAKSRKKTRKETFNTYIYKVLKQVHPDTGVSNKAMSIMNSFVADIFERVAEEASKLATYNKRSTISSREIQTAVRLILPGELAKHAVSEGTKAVTKYQSS

SEQ ID NO: 123474 - protein, 172 aa, Heterodera glycines
  Homolog annotation: Hit_ID=CAB02838.1; Match level="QueryCoverage =52%, HitCoverage=48%, E-value=4e-11, Identity=36%"; Hit description =Hypothetical protein C41G7.1a [Caenorhabditis elegans] pir||T19892 hypothetical protein C41G7.1 - Caenorha
  Essential gene: C elegans homolog=C41G7.1a; Phenotype=Lva,Unc
  Coding regions on vcDNA: vcDNA=SeqID_49897; Strand=+; Position=3-518
INELYKCSTSVAERFFSTYGLFSTNLSHCQALTKFLPESNCCIGNEKSGTTSDNLKTPDFVSENSTTVRLYLEGIRDKLRPNIESDVEAADDHGDEREAEGTSGTTKIADNDVKKDAFPIPDLCPPPPPSMFGKIAVAGNEKEALTNMLMSWYMSGYHTGFYQGVMHEKTTR

SEQ ID NO: 123475 - protein, 130 aa, Heterodera glycines
  Homolog annotation: Hit_ID=CAE63795.1; Match level="QueryCoverage =84%, HitCoverage=22%, E-value=2e-28, Identity=54%"; Hit description =Hypothetical protein CBG08337 [Caenorhabditis briggsae]
  Gene Ontology: Mol. function=carboxypeptidase D activity; Cellular component=membrane fraction; Biological process=neuropeptide signaling pathway
  Essential gene: C elegans homolog=F59A3.1; Phenotype=Rup,Unc
  Coding regions on vcDNA: vcDNA=SeqID_49898; Strand=+; Position=3-395
LELSCEKMPAPERLPQFWVDNKLALLEFIRLAHIGIKGMVSDARNGEPIANAVVWVRNVTDGDGQTAIKHPVTTWITGDYFRPLVSGCYQIAVEADGYEIGIKTLNISQKDVKEVPTLMLIKEALIVEKC

SEQ ID NO: 123476 - protein, 101 aa, Heterodera glycines
  Homolog annotation: Hit_ID=AAH88624.1; Match level="QueryCoverage =90%, HitCoverage=7%, E-value=1e-14, Identity=42%"; Hit description =Unknown (protein for MGC:98139) [Xenopus laevis] ref|NP_598569.1| high density lipoprotein binding protein
  Essential gene: C elegans homolog=C08H9.2; Phenotype=Gro,Pvl,Slu,Unc
  Coding regions on vcDNA: vcDNA=SeqID_49899; Strand=+; Position=2-307
TGDSLVTIRGRKEFVEGAKARIEAIVEDLEAQTQIQIDVDPKHHRHFIIRGAEVLKNIQKEFDCQISFPKQETGDSLVTIRGRKELVEGAKARIEADSKGI

SEQ ID NO: 123477 - protein, 161 aa, Heterodera glycines
  Homolog annotation: Hit_ID=CAE69357.1; Match level="QueryCoverage =98%, HitCoverage=60%, E-value=3e-52, Identity=65%"; Hit description =Hypothetical protein CBG15446 [Caenorhabditis briggsae]
  Gene Ontology: Mol. function=actin binding; Cellular component =troponin complex; Biological process=positive regulation of growth rate
  Essential gene: C elegans homolog=F42E11.4; Phenotype=Dpy,Egl,Rup,Unc
  Coding regions on vcDNA: vcDNA=SeqID_49900; Strand=+; Position=29-511
MADIEAAPAPKSDEEAKRQALAAKKAEVRKRLEEAGKKGKKKKGFLTPERKKKLRKLLMIKAAENLRNQQKQLDSERQNVLSKRIPQCPNIDAIEDKGQLEKMYNDLFQQMLKLEEEKYDINFVVSQKDAEISEITISVNDLRGKFVKPTLKEVSQYDNKF

SEQ ID NO: 123478 - protein, 183 aa, Heterodera glycines
  Homolog annotation: Hit_ID=NP_495799.1; Match level="QueryCoverage =98%, HitCoverage=36%, E-value=2e-33, Identity=43%"; Hit description =splicing factor SF3a60 (57.5 kD) (2I814) [Caenorhabditis elegans] emb|CAA91420.2| Hypothetical protein T1
  Gene Ontology: Mol. function=pre-mRNA splicing factor activity; Cellular component=spliceosome complex; Biological process =fertilization
  Essential gene: C elegans homolog=T13H5.4; Phenotype=Emb
  Coding regions on vcDNA: vcDNA=SeqID_49901; Strand=+; Position=2-550
SLHEQYVNLKEVTRVDYISYLSKFDHLHELSREKTKKTGAYKTYVLSLEEYLRDFISRAKPLIDIVMELDRVDKDFEEKLKEGKVIGWSNEKPSGAMKKFAQPSAEIDVSNFNSPEELEELGADRLKAALIALGLKCGGTVKERAFRLFSTRSSDGSNAVNGNGKLTAEDTKEENRKYTLAKA

SEQ ID NO: 123479 - protein, 131 aa, Heterodera glycines
  Homolog annotation: Hit_ID=NP_495256.1; Match level="QueryCoverage =85%, HitCoverage=11%, E-value=1e-18, Identity=42%"; Hit description =transducin protein (103.2 kD) (2G563) [Caenorhabditis elegans] gb|AAK31492.1| Hypothetical protein F13H8.
  Gene Ontology: Cellular component=mitochondrion
  Essential gene: C elegans homolog=F13H8.2; Phenotype=Gro
  Coding regions on vcDNA: vcDNA=SeqID_49902; Strand=+; Position=2-397
EQQANRILRCIKRGALIRQAKGRALQLAVSSDEAIVCCVGSDSMLDIYRHFTVEESKKRYQKKLRKLRLRADSQPTESEKETNEAMESEVSRDVTTLITRIGDFRADAKLKWVDLCEEFDDASLHFCAGPF

SEQ ID NO: 123480 - protein, 106 aa, Heterodera glycines
  Homolog annotation: Hit_ID=NP_491212.1; Match level="QueryCoverage =98%, HitCoverage=27%, E-value=8e-40, Identity=68%"; Hit description =innexin, putative gap junction protein, OPUs gap junctional protein (45.1 kD) (inx-13) [Caenorhabditis el
  Gene Ontology: Biological process=jump response
  Essential gene: C elegans homolog=Y8G1A.2; Phenotype=Gro,Rup,Stp,Unc
  Coding regions on vcDNA: vcDNA=SeqID_49903; Strand=+; Position=2-403
FTKLLYVANVFLQFVILNALLGPQYTFWGIGILSDIWNGREWSESGHFPRVTMCDFNVRVLGNIHRWTVQCVLMINMFNEKIFLFFWFWFIFVGLLSLLSLFYWAF

SEQ ID NO: 123481 - protein, 149 aa, Heterodera glycines
  Homolog annotation: Hit_ID=NP_509130.1; Match level="QueryCoverage =97%, HitCoverage=24%, E-value=6e-42, Identity=52%"; Hit description =tolloid-like precursor family member (XH333) [Caenorhabditis elegans] pir||T16617 hypothetical protein K1
  Gene Ontology: Mol. function=metallopeptidase activity; Cellular component=extracellular; Biological process=embryogenesis and morphogenesis
  Essential gene: C elegans homolog=C37H5.9a; Phenotype=Emb
  Coding regions on vcDNA: vcDNA=SeqID_49904; Strand=+; Position=3-452
QPANPIYLSFMCGNPAGVAVHETMHALGFQHEQLRFDRDQFITIQWENVNPQQLDFFTMSDVTKFSSYGIKYDYGSIMQYASTIASSAPGKKTMVAKLKPTENERLMGQREGLSLSDVEAVKKMYCQPSCDDKIIFCGIWATMNLCEFS

SEQ ID NO: 123482 - protein, 150 aa, Heterodera glycines
  Homolog annotation: Hit_ID=CAE57411.1; Match level="QueryCoverage =96%, HitCoverage=20%, E-value=7e-22, Identity=33%"; Hit description =Hypothetical protein CBG00366 [Caenorhabditis briggsae]
  Essential gene: C elegans homolog=ZK550.3; Phenotype=Emb,Sck,Sma,Stp
  Coding regions on vcDNA: vcDNA=SeqID_49905; Strand=+; Position=2-451
SFERCDPSVRLFDVTDNATNSRIGFLYVDIFSRETKKIGRGQWLSMLGRPPNQLRDLDALVYFLGAHPHSENEHESFLHHEELSEMLSAFGRALQLLLSRAPCHFLSLPLAPYYASDFDANDFMPAFMKFCIYKPRFLGLLSSPNSQNGQ

SEQ ID NO: 123483 - protein, 185 aa, Heterodera glycines
  Homolog annotation: Hit_ID=NP_509748.2; Match level="QueryCoverage =100%, HitCoverage=29%, E-value=8e-82, Identity=78%"; Hit description= abnormal cell MIGration MIG-15, serine threonine protein kinase involved in cell migration and signal tr
  Gene Ontology: Mol. function=ATP binding; Biological process=protein kinase cascade
  Essential gene: C elegans homolog=ZC504.4a; Phenotype=Unclassified
  Coding regions on vcDNA: vcDNA=SeqID_49906; Strand=+; Position=3-557
WGVNLLIGTDTGLMLLDRSGQGKVYHLITRRRFDQMSVMEGQNILVTISGKKRRVRVYYLSWLKQKILRTEGLQQTEKRNGWTNVGEFQCATHFKIVRYERIKFLVIGIEDSISIYAWAPKPYNRFMAFKSFGQLSHAPVIVDLTIEENARLKVLYGSLAGFHAIDLDSASIYDIYSPHRAQCGQ

SEQ ID NO: 123484 - protein, 89 aa, Heterodera glycines
  Homolog annotation: Hit_ID=JC4382; Match level="QueryCoverage=98%, HitCoverage=21%, E-value=4e-15, Identity=46%"; Hit description =ribosomal protein L3.e, cytosolic - Toxocara canis gb|AAA92285.1| ribosomal protein L3 sp|P49149|RL3_TOXCA 60S
  Gene Ontology: Mol. function=structural constituent of ribosome; Cellular component=cytosolic large ribosomal subunit (sensu Eukarya); Biological process=protein biosynthesis
  Essential gene: C elegans homolog=F13B10.2a; Phenotype=Emb,Ste
  Coding regions on vcDNA: vcDNA=SeqID_49907; Strand=+; Position=2-268
KGYHHTTEIDSTIHPLGNPRSTSNCNRYPMTNFDISEKNINPTTNFPHYGLYKHDIPMIRAWCTLSKRPSITLRKTLIKHTARLPLHKK

SEQ ID NO: 123485 - protein, 101 aa, Heterodera glycines
  Homolog annotation: Hit_ID=CAE68696.1; Match level="QueryCoverage =74%, HitCoverage=10%, E-value=3e-11, Identity=45%"; Hit description =Hypothetical protein CBG14611 [Caenorhabditis briggsae]
  Essential gene: C elegans homolog=C42D8.8a; Phenotype=Unc
  Coding regions on vcDNA: vcDNA=SeqID_49908; Strand=-; Position=3-305
MLRPTDTQYNSFVSFFLSSPIICVFYDEEYGDDDEEEEPDDKTAKKETTADAKAEQDPYFKDDPQGNEHERFRDAEERLEKRHRKKVTKVITEWSELFERY

SEQ ID NO: 123486 - protein, 85 aa, Heterodera glycines
  Homolog annotation: Hit_ID=AAQ89579.1; Match level="QueryCoverage =100%, HitCoverage=12%, E-value=1e-33, Identity=83%"; Hit description= heat shock protein 70-C [Heterodera glycines] gb|AAM93256.1| heat shock protein 70-C [Heterodera glycines
  Gene Ontology: Mol. function=Hsp70/Hsp90 organizing protein activity; Cellular component=endoplasmic reticulum lumen; Biological process =protein folding
  Essential gene: C elegans homolog=C15H9.6; Phenotype=Dpy,Lva
  Coding regions on vcDNA: vcDNA=SeqID_49909; Strand=+; Position=2-259
DNHLWGKFNLTGIPPAPRGVPQIQVTFEIDVSGILHVTAEDKRTGNRNKITITNDHYRLAPEEIERRIYFAENPAEEDKKTKELV

SEQ ID NO: 123487 - protein, 63 aa, Heterodera glycines
  Homolog annotation: Hit_ID=NP_491790.1; Match level="QueryCoverage =96%, HitCoverage=8%, E-value=7e-23, Identity=73%"; Hit description =gastrin-binding protein like (81.5 kD) (1G784) [Caenorhabditis elegans] gb|AAK21464.1| Hypothetical protei
  Gene Ontology: Mol. function=enoyl-CoA hydratase activity; Cellular component=mitochondrion; Biological process=growth
  Essential gene: C elegans homolog=T08B2.7a; Phenotype=Unclassified
  Coding regions on vcDNA: vcDNA=SeqID_49910; Strand=+; Position=2-193
VASVFGLGFPPFWGGPFRFVDLYGAQKLIKHMERYGNIYSAVQFKPCQLLSDYAKAGRKFYPK

SEQ ID NO: 123488 - protein, 67 aa, Heterodera glycines
  Homolog annotation: Hit_ID=AAN32889.1; Match level="QueryCoverage =100%, HitCoverage=56%, E-value=4e-30, Identity=94%"; Hit description= ubiquitin extension protein [Heterodera glycines]
  Gene Ontology: Biological process=cell cycle
  Essential gene: C elegans homolog=F25B5.4a; Phenotype=Emb
  Coding regions on vcDNA: vcDNA=SeqID_49911; Strand=+; Position=2-205
KIQDKEGVPPDQQRLIFAGKQLEDGRTLADYNIQKESTLHLVLRLRGGNGKRSTGKNKTSNKKLDQN

SEQ ID NO: 123489 - protein, 159 aa, Heterodera glycines
  misc_feature (110)..(110): Xaa can be any naturally occurring amino acid
  Homolog annotation: Hit_ID=NP_502538.1; Match level="QueryCoverage =98%, HitCoverage=24%, E-value=8e-19, Identity=37%"; Hit description =cell death protein, Caspase, ICE-like apoptotic protease., CEll Death abnormality CED-3 (56.6 kD) (ced-3)
  Essential gene: C elegans homolog=C48D1.2; Phenotype=Ste
  Coding regions on vcDNA: vcDNA=SeqID_49912; Strand=+; Position=2-479
AQLNSQNCPYLMGKPKIFFIQACRGEIKDFGVLRALPIGTDCADGAVSSKAAASNNSKRGPLSMFSRNSSPRNSLAASIQIPLHLRNEGECSANLTSKEIFQKDPTNADXLVVHSTTPHYVSWRNSANGAWFVQSLCKVFSEMAPKHCEILEMLTTVNY

SEQ ID NO: 123490 - protein, 161 aa, Heterodera glycines
  Homolog annotation: Hit_ID=NP_491560.1; Match level="QueryCoverage =98%, HitCoverage=27%, E-value=6e-18, Identity=35%"; Hit description =ezrin, Radixin and Moesin family, Ezrin/Radixin/Moesin (66.0 kD) (erm-1) [Caenorhabditis elegans] gb|AAB3
  Gene Ontology: Cellular component=plasma membrane; Biological process= establishment and/or maintenance of epithelial cell polarity
  Essential gene: C elegans homolog=C01G8.5a; Phenotype=Emb,Gro,Stp,Unc
  Coding regions on vcDNA: vcDNA=SeqID_49913; Strand=+; Position=2-484
KEEMESAQRELEVAQGRIRRLEDQIYELNEAKRLLEEKEHELQTLNTELASERAMSEEERSRLLTEIAMQESRVSEMRFEVKNKTDEMNKLKAEVESGKTTAHIYNPGNGHLPTEFNDPDDLTNAHIELSTFHEGDVNNVMPQRELDRTNFTDQDMSLKTN

SEQ ID NO: 123491 - protein, 152 aa, Heterodera glycines
  misc_feature (20)..(20): Xaa can be any naturally occurring amino acid
  Homolog annotation: Hit_ID=CAE60292.1; Match level="QueryCoverage =94%, HitCoverage=44%, E-value=4e-55, Identity=72%"; Hit description =Hypothetical protein CBG03876 [Caenorhabditis briggsae]
  Gene Ontology: Mol. function=cyclin-dependent protein kinase activity; Cellular component=nucleus; Biological process=mitotic cell cycle, embryonic
  Essential gene: C elegans homolog=Y39G10AL.3; Phenotype=Emb
  Coding regions on vcDNA: vcDNA=SeqID_49914; Strand=+; Position=20-473
MDIKTKKNRRYEKIKHLGEXFANVYQAKDIETGTIVAVKKIKLGSRHEARDGVNRTAIREIKLLMEIRHDNIITLLDVIGHRTSIQLVFDFMETDLENVIKDSETILQHSHIKNMLLQVFLGLEHLHLLFILHRDLKPNNLLMNTSGRIKIA

SEQ ID NO: 123492 - protein, 84 aa, Heterodera glycines
  Essential gene: C elegans homolog=Y48A6B.5; Phenotype=Gro
  Coding regions on vcDNA: vcDNA=SeqID_49915; Strand=+; Position=215-469
KVVIRFSLGEQLFSVSSGYHAGNGCYEFHGSICASLAGFLHVYSLRDSQNTETNIVEVRRNIDERSNVLPSQGKIVTARVNLKF

SEQ ID NO: 123493 - protein, 47 aa, Heterodera glycines
  misc_feature (35)..(35): Xaa can be any naturally occurring amino acid
  Homolog annotation: Hit_ID=NP_491640.1; Match level="QueryCoverage =100%, HitCoverage=64%, E-value=1e-15, Identity=72%"; Hit description= UBiquitin-Like (8.7 kD) (ubl-5) [Caenorhabditis elegans] gb|AAK21382.1| Ubiquitin-like family protein 5
  Essential gene: C elegans homolog=F46F11.4; Phenotype=Gro,Stp,Unc
  Coding regions on vcDNA: vcDNA=SeqID_49916; Strand=+; Position=2-142
LKKLVSTQVGTKWDKLLLKKWNTIYRDHITLPDYXIHDGFNFELYYQ

SEQ ID NO: 123494 - protein, 90 aa, Heterodera glycines
  Homolog annotation: Hit_ID=CAE64869.1; Match level="QueryCoverage =96%, HitCoverage=18%, E-value=4e-19, Identity=48%"; Hit description =Hypothetical protein CBG09668 [Caenorhabditis briggsae]
  Gene Ontology: Mol. function=electron transporter activity; Biological process=UDP-glucose metabolism
  Essential gene: C elegans homolog=F29F11.1; Phenotype=Emb
  Coding regions on vcDNA: vcDNA=SeqID_49917; Strand=+; Position=3-275
DFISEVQNVRELFSVHDNPYEAAIGCYAVVILTEWDEFKDLDYNRIYGDMKKPVCPFDGRRIVNEENLRNIGFRVFKVGSASNQTLNFFP

SEQ ID NO: 123495 - protein, 172 aa, Heterodera glycines
  Homolog annotation: Hit_ID=NP_502355.2; Match level="QueryCoverage =99%, HitCoverage=28%, E-value=4e-63, Identity=65%"; Hit description =yeast CCR4 carbon catabolite repression 4-like, an endonuclease/exonuclease/phosphatase family member wit
  Gene Ontology: Mol. function=3'-5' exoribonuclease activity; Cellular component=cytoplasm; Biological process=regulation of transcription, DNA-dependent
  Essential gene: C elegans homolog=ZC518.3a; Phenotype=Emb
  Coding regions on vcDNA: vcDNA=SeqID_49918; Strand=+; Position=3-518
VAGNLLMVGTAHIHWDPEFCDVKLIQAMMLVHELQKILDRIALKYHLRTQQIPVLVTGDFNSLPELGVLEFLSKGAISKDHPDLKSFREDSCLSCLSADHEDQQNFTHSLRLDSSVDASQIPFTNYTLDFKGMIDYIFATPQSLARLGILGPLDSSWVQQNKFVGFPQPHVP

SEQ ID NO: 123496 - protein, 100 aa, Heterodera glycines
  Homolog annotation: Hit_ID=XP_528110.1; Match level="QueryCoverage =94%, HitCoverage=27%, E-value=1e-17, Identity=49%"; Hit description =PREDICTED: proline synthetase co-transcribed homolog [Pan troglodytes]
  Gene Ontology: Mol. function=pyridoxal phosphate binding; Cellular component=intracellular; Biological process=amino acid metabolism
  Essential gene: C elegans homolog=F09E5.8; Phenotype=Emb
  Coding regions on vcDNA: vcDNA=SeqID_49919; Strand=+; Position=3-302
LLPLATHVTEQCHSLTLIGLMTIGSISQSLGSGDENADFALLRKLRDALQTELRLSTELELSMGMSADYQLAIKYGSTNVRVGSTIFGVPNYTKKIGHRR

SEQ ID NO: 123497 - protein, 216 aa, Heterodera glycines
  Homolog annotation: Hit_ID=CAE65161.1; Match level="QueryCoverage =93%, HitCoverage=49%, E-value=2e-23, Identity=32%"; Hit description =Hypothetical protein CBG10030 [Caenorhabditis briggsae]
  Gene Ontology: Mol. function=DNA primase activity; Cellular component= alpha DNA polymerase:primase complex; Biological process =embryogenesis and morphogenesis
  Essential gene: C elegans homolog=F58A4.4; Phenotype=Emb
  Coding regions on vcDNA: vcDNA=SeqID_49920; Strand=+; Position=3-650
RGCVAIVKYLTFNKDGSAINKYRVHPFVTESYRKIMESGDFEQLIMEQGWLDSAVQWNSTILAHWADQSLAELLDKSFSRLQTPKLRWESMKLRFDDATPINARGIKLPPTPSDEARPFFISLVMTFAYPQLHAQVTAGLNHLLKSPFSVHPENGNVTIPLSTKEIHTCDPNVVPQINELLTHLSSLQSYRENKENHRSIIYAQTLLASHITRFEQ

SEQ ID NO: 123498 - protein, 109 aa, Heterodera glycines
  Homolog annotation: Hit_ID=XP_424236.1; Match level="QueryCoverage =79%, HitCoverage=21%, E-value=8e-18, Identity=47%"; Hit description =PREDICTED: similar to FLJ20699 protein, partial [Gallus gallus]
  Essential gene: C elegans homolog=Y54G11A.7; Phenotype=Emb
  Coding regions on vcDNA: vcDNA=SeqID_49921; Strand=+; Position=125-454
QFRYRRQCADTRLLGKSLCDGIVAFQMGQFERTFDLVYPIRTQLYKISGSNAQRDIFTQMLLHAALRCADNERRSKATVLIEERNKMKPNSAVIERLLQKHKQTAHNNC

SEQ ID NO: 123499 - protein, 142 aa, Heterodera glycines
  misc_feature (26)..(26): Xaa can be any naturally occurring amino acid
  Homolog annotation: Hit_ID=NP_491282.1; Match level="QueryCoverage =100%, HitCoverage=100%, E-value=9e-44, Identity=59%"; Hit description=CalPoNin (cpn-3) [Caenorhabditis elegans] gb|AAB52338.1| Calponin protein 3 [Caenorhabditis elegans] pi
  Gene Ontology: Mol. function=troponin C binding; Biological process =growth
  Essential gene: C elegans homolog=F28H1.2; Phenotype=Emb,Lva
  Coding regions on vcDNA: vcDNA=SeqID_49922; Strand=+; Position=9-434
MYSHATPGGIGFQVVAQQATKFNDQXGKLILHWVKKLTGENFSTDGSRENSYKSVNDGTLLCKLTNGIHPGSVKKIQQPTGNFACMENINAFVSFAKAQGVPTEETFQSVDLFEARDLYSVSGTVLSLGRILETKGKPKPFS

SEQ ID NO: 123500 - protein, 120 aa, Heterodera glycines
  misc_feature (18)..(19): Xaa can be any naturally occurring amino acid
  Homolog annotation: Hit_ID=AAN32889.1; Match level="QueryCoverage =100%, HitCoverage=100%, E-value=2e-57, Identity=94%"; Hit description=ubiquitin extension protein [Heterodera glycines]
  Gene Ontology: Biological process=cell cycle
  Essential gene: C elegans homolog=F25B5.4a; Phenotype=Emb
  Coding regions on vcDNA: vcDNA=SeqID_49923; Strand=+; Position=98-459
MNHFGLTFLFVAVSLLLXXAPGFDGMQIFVKTLTGKTITLEVESSDTVDNVKTKIQDKEGVPPDQQRLIFAGKQLEDGRTLADYNIQKESTLHLVLRLRGGNGKRNTGKNKKSNKKLDQN

SEQ ID NO: 123501 - protein, 177 aa, Heterodera glycines
  Homolog annotation: Hit_ID=AAK60209.1; Match level="QueryCoverage =100%, HitCoverage=82%, E-value=2e-88, Identity=88%"; Hit description= vap-1 [Heterodera glycines]
  Gene Ontology: Cellular component=extracellular space
  Essential gene: C elegans homolog=F49E11.9; Phenotype=Unclassified
  Coding regions on vcDNA: vcDNA=SeqID_49924; Strand=+; Position=67-597
MEYFPSKFVCCLLIALIAVPCSVLALSDSSRVAVLALHNNYRSQLAKGTAANLTGTMPAGSNLIQQKYNTSIESVAQNWANGCSMSHSSSSGMGENLYMTSSSTISEADALKQACDMWWAELKQYGFQSSLVLDMDQFNKGIGHWSQQAWANTAQIGCAMARCPSSTWKTWVVCHYK

SEQ ID NO: 123502 - protein, 103 aa, Heterodera glycines
  misc_feature (85)..(85): Xaa can be any naturally occurring amino acid
  Homolog annotation: Hit_ID=CAE61290.1; Match level="QueryCoverage =98%, HitCoverage=50%, E-value=2e-33, Identity=70%"; Hit description =Hypothetical protein CBG05114 [Caenorhabditis briggsae]
  Gene Ontology: Mol. function=TATA-binding protein binding; Cellular component=cytoplasm; Biological process=nuclear positioning
  Essential gene: C elegans homolog=Y65B4BR.5a; Phenotype=Gro,Stp
  Coding regions on vcDNA: vcDNA=SeqID_49925; Strand=+; Position=2-310
GDITEEQKKVAEAAVLSEQVAEKGSKQSRSEKKARKLFSKLGLKQVHGVSRVCMRNLKSITFVINMPDVYKIPGSNTYVVFGEAXIEDLAQHAQITDVENMKP

SEQ ID NO: 123503 - protein, 187 aa, Heterodera glycines
  misc_feature (131)..(131): Xaa can be any naturally occurring amino acid
  misc_feature (159)..(159): Xaa can be any naturally occurring amino acid
  Homolog annotation: Hit_ID=CAE68603.1; Match level="QueryCoverage =91%, HitCoverage=95%, E-value=1e-37, Identity=48%"; Hit description =Hypothetical protein CBG14479 [Caenorhabditis briggsae]
  Gene Ontology: Mol. function=signal transducer activity; Cellular component=cytosol; Biological process=negative regulation of cell adhesion
  Essential gene: C elegans homolog=F46H6.1; Phenotype=Unc
  Coding regions on vcDNA: vcDNA=SeqID_49926; Strand=+; Position=10-568
MTTEKESSSGSDDVINASEFASEETFYSPPAQKSVKEIIEADHNDESLKKYKEQLLGENASGPVLVEPDNPKNVLVRRISLVSDDQVKHSMDLPAKGDFVFCVKESCTYRIRFEFVVQREIICGLKYAHKXTKELYMLGSYGPRHEPYTYETSPEEAPXGRGKYRVHSLITDDDKNIWLDWSWHIEI

SEQ ID NO: 123504 - protein, 133 aa, Heterodera glycines
  misc_feature (68)..(68): Xaa can be any naturally occurring amino acid
  Homolog annotation: Hit_ID=A39106; Match level="QueryCoverage=100%, HitCoverage=89%, E-value=1e-25, Identity=45%"; Hit description =ribosomal protein S19.e - common roundworm sp|P24494|R19G_ASCSU 40S ribosomal protein S19G (Eliminated protei
  Gene Ontology: Mol. function=structural constituent of ribosome; Cellular component=cytosolic small ribosomal subunit (sensu Eukarya); Biological process=hemocyte development
  Essential gene: C elegans homolog=T05F1.3; Phenotype=Emb,Lva
  Coding regions on vcDNA: vcDNA=SeqID_49927; Strand=+; Position=2-400
DVDQQYIVPSVTSFTKTIGTIPSPYWVAMDSSGTYTKVPPTNPYWYHARPSSLPPPMNIRSPSSDCSXPNEYGGKNRRRFAPMHYTKAYGAVIHKALHSLEEIKWVEKDGGTGGRKLTKQGQKDLDRIASQLR

SEQ ID NO: 123505 - protein, 123 aa, Heterodera glycines
  Homolog annotation: Hit_ID=NP_492322.1; Match level="QueryCoverage =100%, HitCoverage=92%, E-value=2e-38, Identity=61%"; Hit description= RAN (nuclear import/export) related (15.1 kD) (ran-4) [Caenorhabditis elegans] emb|CAA99890.1| Hypotheti
  Gene Ontology: Mol. function=RAN protein binding; Cellular component =nucleus; Biological process=protein-nucleus import
  Essential gene: C elegans homolog=R05D11.3; Phenotype=Emb,Lva
  Coding regions on vcDNA: vcDNA=SeqID_49928; Strand=+; Position=1-443
SIGQAFVQHFYTKFDVPDGPTRTVGLHDLYDAEHSFMTFEGNQVKGRQAILDKYGALPFRTIQHGITKTDSQPLPDGSILVTVIGQLKTDDDPVNSFNHCFILRPNSCGGFFISNEVFRLVLH

SEQ ID NO: 123506 - protein, 233 aa, Heterodera glycines
  misc_feature (173)..(173): Xaa can be any naturally occurring amino acid
  Homolog annotation: Hit_ID=NP_505762.1; Match level="QueryCoverage =97%, HitCoverage=71%, E-value=2e-84, Identity=65%"; Hit description =PRP38 family (38.2 kD) (5L286) [Caenorhabditis elegans] emb|CAA98434.1| Hypothetical protein D1054.14 [Ca
  Gene Ontology: Biological process=mRNA splicing
  Essential gene: C elegans homolog=D1054.14; Phenotype=Emb
  Coding regions on vcDNA: vcDNA=SeqID_49929; Strand=+; Position=1-699
ANRTARDAHTIKGTNPQYLIEKIIRTRIYDSLYWKEQCFGLSAETVVDRATELRYIGGIYAGNIKPAQFLCLTLKLLQLQPDKDIIIEFIRQDDFKYVRALGAMYIRLVFNSVEVFKYLEPLYNDYRKLRYMNRMGKFELLYMDEFVDNLLREDHYCNIQLPRLQKLQALEEXDQLELYAFALDEDLERLSTDSEDEQETRNSTPNIGSLRRSLLRIRGRILSKSRERIRRSL

SEQ ID NO: 123507 - protein, 64 aa, Heterodera glycines
  Homolog annotation: Hit_ID=CAE73188.1; Match level="QueryCoverage =100%, HitCoverage=48%, E-value=2e-18, Identity=73%"; Hit description= Hypothetical protein CBG20587 [Caenorhabditis briggsae]
  Essential gene: C elegans homolog=C26F1.4; Phenotype=Gro
  Coding regions on vcDNA: vcDNA=SeqID_49930; Strand=+; Position=2-193
LRGGKVHGSLARAGKVRAQTPREEKQENKTKKRGRALRDIHYKRSDVNVAATGPGRRRGPNSNA

SEQ ID NO: 123508 - protein, 88 aa, Heterodera glycines
  Homolog annotation: Hit_ID=AAL05950.1; Match level="QueryCoverage =88%, HitCoverage=57%, E-value=3e-25, Identity=65%"; Hit description =frataxin [Caenorhabditis elegans] ref|NP_495183.1| FRataxin Homolog (15.7 kD) (frh-1) [Caenorhabditis eleg
  Gene Ontology: Mol. function=iron-sulfur electron transfer carrier; Cellular component=mitochondrion; Biological process=synaptic transmission
  Essential gene: C elegans homolog=F59G1.7; Phenotype=Emb,Gro
  Coding regions on vcDNA: vcDNA=SeqID_49931; Strand=+; Position=227-493
CKIKAFDVSYSMGVLTAHISPRIGTYVINKQTPNKQIWLSSPVSGPKRYDLSDKGRWVYKHDGVTLRELLEKEFRHIFKNDQISLHQS

SEQ ID NO: 123509 - protein, 69 aa, Heterodera glycines
  misc_feature (25)..(25): Xaa can be any naturally occurring amino acid
  misc_feature (47)..(47): Xaa can be any naturally occurring amino acid
  Homolog annotation: Hit_ID=NP_495823.1; Match level="QueryCoverage =100%, HitCoverage=48%, E-value=2e-13, Identity=53%"; Hit description= ribosomal Protein, Large subunit (16.1 kD) (rpl-26) [Caenorhabditis elegans] emb|CAA92674.1| Hypothetica
  Essential gene: C elegans homolog=F28C6.7a; Phenotype=Emb,Lva,Ste
  Coding regions on vcDNA: vcDNA=SeqID_49932; Strand=+; Position=89-295
VTVTRGHYRGNAGRLMLVCRKKDVXHVDKITRDKAITNNRALGIHTXSVQITDVKMDKDRRSLLERQAA

SEQ ID NO: 123510 - protein, 117 aa, Heterodera glycines
  Homolog annotation: Hit_ID=CAE63795.1; Match level="QueryCoverage =88%, HitCoverage=21%, E-value=1e-20, Identity=47%"; Hit description =Hypothetical protein CBG08337 [Caenorhabditis briggsae]
  Gene Ontology: Mol. function=metallocarboxypeptidase activity; Cellular component=extracellular space; Biological process=transport
  Essential gene: C elegans homolog=F59A3.1; Phenotype=Rup,Unc
  Coding regions on vcDNA: vcDNA=SeqID_49933; Strand=+; Position=6-359
MVTSFPVSFFLFFSTALIHGTMGGLFWSKKPADSADDSLWSRYHDQNAMEELLEKVHSKCPNVARLYSVGRSVQGRDLAVIEFSLHPGRHQILKPEMKYIGNMHGNEAIGRKLASKR

SEQ ID NO: 123511 - protein, 94 aa, Heterodera glycines
  Homolog annotation: Hit_ID=AAH81497.1; Match level="QueryCoverage =97%, HitCoverage=82%, E-value=2e-50, Identity=92%"; Hit description =Unknown (protein for IMAGE:7251344) [Danio rerio]
  Gene Ontology: Mol. function=protein binding; Cellular component =ubiquitin ligase complex; Biological process=protein modification
  Essential gene: C elegans homolog=ZK287.5; Phenotype=Emb,Lva
  Coding regions on vcDNA: vcDNA=SeqID_49934; Strand=+; Position=83-367
LSAIKKRFEVKKWNAVALWAWDIVVDTCAICRNHIMDLCIECQANQASSTNEECTVAWGVCNHAFHFHCISRWLRTRQVCPLDNRDWEFQRYGH

SEQ ID NO: 123512 - protein, 72 aa, Heterodera glycines
  misc_feature (13)..(13): Xaa can be any naturally occurring amino acid
  Homolog annotation: Hit_ID=CAE70150.1; Match level="QueryCoverage =95%, HitCoverage=79%, E-value=1e-17, Identity=60%"; Hit description =Hypothetical protein CBG16614 [Caenorhabditis briggsae]
  Essential gene: C elegans homolog=F37C12.11; Phenotype=Emb
  Coding regions on vcDNA: vcDNA=SeqID_49935; Strand=+; Position=16-232
IDCPEKCSSSSRXFGSDHAFIRLEVVYVDQATGRMIPGKTTKYSICGKLRFMGETDDCILSLAERDGIIPPD

SEQ ID NO: 123513 - protein, 169 aa, Heterodera glycines
  Homolog annotation: Hit_ID=NP_498409.1; Match level="QueryCoverage =97%, HitCoverage=99%, E-value=5e-24, Identity=35%"; Hit description =mitochondrial ribosomal protein S17 (18.4 kD) (3H520) [Caenorhabditis elegans] gb|AAB53829.1| Hypothetica
  Essential gene: C elegans homolog=C05D11.10; Phenotype=Lva
  Coding regions on vcDNA: vcDNA=SeqID_49936; Strand=+; Position=1-507
MQQLSKKSAWVSKVSGELLLAKVKQITTIGLQRDTCVKVKISKNNFYEYNRMFFMSSAYEWSLDPESKCRVGDVVLIRRLSEIHRPSKTVQYAVEKVVFQHGNFIDPVTKRRVFGAKEFEKEVELRKDLVDKIYSEPLGEEDEGIKNDDQLKRNKIRRRMEERERRAND

SEQ ID NO: 123514 - protein, 182 aa, Heterodera glycines
  misc_feature (73)..(73): Xaa can be any naturally occurring amino acid
  misc_feature (141)..(141): Xaa can be any naturally occurring amino acid
  misc_feature (147)..(147): Xaa can be any naturally occurring amino acid
  Homolog annotation: Hit_ID=AAR85527.1; Match level="QueryCoverage =100%, HitCoverage=72%, E-value=5e-67, Identity=73%"; Hit description= 14-3-3b protein [Meloidogyne incognita]
  Gene Ontology: Mol. function=protein domain specific binding; Cellular component=cytoplasm; Biological process=protein targeting
  Essential gene: C elegans homolog=M117.2; Phenotype=Emb
  Coding regions on vcDNA: vcDNA=SeqID_49937; Strand=+; Position=17-562
ELVQRFKLAEQAERWDDMAQSMKKVTELGAELSNEERILLSVAYKNVVGARRSSWRVISCIEQETDGSEKKHXMCQEYREKVEQELRDICYDLLDLLDIYLIPNAGYPESKVFYLMMKGDYYRYLVEVVIGDDAIAVVETXSRHSSXACDIANDRLQPTHAITFYIALYLCVFYLEDVISAD

SEQ ID NO: 123515 - protein, 101 aa, Heterodera glycines
  misc_feature (64)..(64): Xaa can be any naturally occurring amino acid
  Homolog annotation: Hit_ID=NP_871846.1; Match level="QueryCoverage =98%, HitCoverage=48%, E-value=1e-19, Identity=51%"; Hit description =nascent polypeptide-associated complex NAC and Ubiquitin-associated domain containing protein (22.1 kD) (
  Gene Ontology: Mol. function=TATA-binding protein binding; Cellular component=nascent polypeptide-associated complex; Biological process= nuclear positioning
  Essential gene: C elegans homolog=Y65B4BR.5a; Phenotype=Gro,Stp
  Coding regions on vcDNA: vcDNA=SeqID_49938; Strand=+; Position=2-304
VKTKEEDSKKTTTDDGSSSEEEVPELEEGDVTEEQKKVAEAAGLSEHVAEKGSKQSRSEKKARXLFCELGAPRVHSVSRVCIRQSKSVVVVINQPDVYESS

SEQ ID NO: 123516 - protein, 62 aa, Heterodera glycines
  Homolog annotation: Hit_ID=NP_499781.1; Match level="QueryCoverage =100%, HitCoverage=82%, E-value=1e-10, Identity=51%"; Hit description= ubiquinol-cytochrome C reductase complex protein like (8.7 kD) (3O550) [Caenorhabditis elegans] emb|CAB0
  Essential gene: C elegans homolog=T27E9.2; Phenotype=Gro
  Coding regions on vcDNA: vcDNA=SeqID_49939; Strand=+; Position=2-187
DHLTYVREQCDHTVAHLKSILEECNERVRTTPKTTVISHMEMIDYMEGLDHCAKRKAFKALK

SEQ ID NO: 123517 - protein, 94 aa, Heterodera glycines
  misc_feature (24)..(24): Xaa can be any naturally occurring amino acid
  Homolog annotation: Hit_ID=NP_508413.1; Match level="QueryCoverage =100%, HitCoverage=47%, E-value=3e-30, Identity=69%"; Hit description= ribosomal Protein, Large subunit (22.8 kD) (rpl-11.2) [Caenorhabditis elegans] gb|AAA83599.1| Ribosomal
  Gene Ontology: Mol. function=structural constituent of ribosome; Cellular component=cytosolic ribosome (sensu Eukarya); Biological process=protein biosynthesis
  Essential gene: C elegans homolog=F07D10.1; Phenotype=Lva
  Coding regions on vcDNA: vcDNA=SeqID_49940; Strand=+; Position=2-283
IHKLCPNIRVGDSGDRLTHAAKDXEQLTGQTPALSKARHTARSLGIHGSEKIAGHCTDRGPKADEIIDRGLKVCEYELYRENFSDTATFGSPIQ

SEQ ID NO: 123518 - protein, 100 aa, Heterodera glycines
  Homolog annotation: Hit_ID=AAR85527.1; Match level="QueryCoverage =100%, HitCoverage=39%, E-value=2e-36, Identity=80%"; Hit description= 14-3-3b protein [Meloidogyne incognita]
  Gene Ontology: Mol. function=DNA binding; Cellular component=nucleus; Biological process=protein targeting
  Essential gene: C elegans homolog=M117.2; Phenotype=Emb
  Coding regions on vcDNA: vcDNA=SeqID_49941; Strand=+; Position=36-338
MSDNKEELVQRAKLAEQAERYDDMAQSMKKVTELGAELSNEERNLLSVAYKNVVGARRSSWRVISSIEQKTEGSEKKQLIGRTDVEDQENAPRNFFHRII

SEQ ID NO: 123519 - protein, 97 aa, Heterodera glycines
  Homolog annotation: Hit_ID=NP_492119.1; Match level="QueryCoverage =94%, HitCoverage=74%, E-value=3e-26, Identity=57%"; Hit description =NADH dehydrogenase 1 beta subcomplex 7, possibly N-myristoylated (14.4 kD) (1I156) [Caenorhabditis elegan
  Gene Ontology: Mol. function=NADH dehydrogenase (ubiquinone) activity; Cellular component=membrane fraction
  Essential gene: C elegans homolog=D2030.4; Phenotype=Age,Gro,Lva
  Coding regions on vcDNA: vcDNA=SeqID_49942; Strand=+; Position=1-294
PLYGFPKGRKPREMQASWEELEKMKMPISERDYCAHKMVALRKCVWDRAPFASHYCHGRRHDLGLCLYDDHLMRMKEFEREKRLLMRKARKERAKAA

SEQ ID NO: 123520 - protein, 128 aa, Heterodera glycines
  Homolog annotation: Hit_ID=NP_996955.1; Match level="QueryCoverage =93%, HitCoverage=9%, E-value=7e-17, Identity=45%"; Hit description =hypothetical protein zgc:77279 [Danio rerio] gb|AAH66436.1| Hypothetical protein zgc:77279 [Danio rerio]
  Gene Ontology: Mol. function=microtubule binding; Cellular component =Golgi apparatus; Biological process=microtubule stabilization
  Essential gene: C elegans homolog=C07H6.3; Phenotype=Sma,Ste,Stp
  Coding regions on vcDNA: vcDNA=SeqID_49943; Strand=+; Position=21-407
MHTGSNNRVGIRTGSAASSASAGAVSDEQFRSSFEAVPNVRVESFRDLIAELQKQAALLENVNNDWTKRIKALQMLRALLVTDIGCYGALVEQSYALLGNAFLLSVKDLRSQLCREACITIALFFANL

SEQ ID NO: 123521 - protein, 150 aa, Heterodera glycines
  Homolog annotation: Hit_ID=NP_060518.1; Match level="QueryCoverage =94%, HitCoverage=95%, E-value=4e-66, Identity=83%"; Hit description =mago-nashi homolog [Homo sapiens] gb|AAH10905.1| Mago-nashi homolog [Homo sapiens] dbj|BAB14202.1| unname
  Gene Ontology: Cellular component=cytoplasm; Biological process =oocyte microtubule cytoskeleton polarization
  Essential gene: C elegans homolog=R09B3.5; Phenotype=Dpy,Emb,Lva
  Coding regions on vcDNA: vcDNA=SeqID_49944; Strand=+; Position=3-455
SIKREQFYVRYYVGHKGKFGHEFLEFEFRPDGKLRYANNSNYKNDTLIRKECYVGKSVMDELKRIIEDSEIMNEDDANWPEPDRVGRQELEILSGNDHVSFTTSKIGCLVEVNDSKDPVGLRSFYYLAQDLKCLVFSLIGLHFKIRPIAQ

SEQ ID NO: 123522 - protein, 113 aa, Heterodera glycines
  Homolog annotation: Hit_ID=CAE65135.1; Match level="QueryCoverage =52%, HitCoverage=35%, E-value=3e-20, Identity=83%"; Hit description =Hypothetical protein CBG10001 [Caenorhabditis briggsae]
  Gene Ontology: Mol. function=hydrogen-transporting two-sector ATPase activity; Cellular component=integral to membrane; Biological process=proton transport
  Essential gene: C elegans homolog=R10E11.8; Phenotype=Ste
  Coding regions on vcDNA: vcDNA=SeqID_49945; Strand=+; Position=10-351
MSGDNSALIAAEQAAYGPFFGSLGVTAAMIFTAAGSAYGTAKSGTGIACMAVARPDLVMKAIIPGARSLRNDCLTAAKFLLNNGRKKEGKNGTSAEHCADRRVLMIKMTSHRI

SEQ ID NO: 123523 - protein, 156 aa, Heterodera glycines
  Homolog annotation: Hit_ID=CAE66391.1; Match level="QueryCoverage =98%, HitCoverage=70%, E-value=1e-53, Identity=68%"; Hit description =Hypothetical protein CBG11654 [Caenorhabditis briggsae]
  Gene Ontology: Mol. function=translation factor activity, nucleic acid binding; Cellular component=eukaryotic translation initiation factor 4 complex; Biological process=translational initiation
  Essential gene: C elegans homolog=H06H21.3; Phenotype=Emb,Gro,Sma,Unc
  Coding regions on vcDNA: vcDNA=SeqID_49946; Strand=+; Position=1-468
PKNKGKGGKNRRRGRNENDIMKRELVEKDGDDQAYAQVVKMLGNGRLTAFCFDGKNRLCHIRGKLRKKVWINTGDIILIGLRGYQDDKADVNLKYTPDEARILKNSGQLPESTKLNEVGEEQNEGEVEFIDNGNRSDEDEVAAQDRNFSLSESSSE

SEQ ID NO: 123524 - protein, 44 aa, Heterodera glycines
  Homolog annotation: Hit_ID=NP_740781.1; Match level="QueryCoverage =81%, HitCoverage=19%, E-value=2e-09, Identity=75%"; Hit description =ribosomal protein L22/L17 (1B631) [Caenorhabditis elegans] gb|AAK29902.1| Ribosomal protein, large subuni
  Essential gene: C elegans homolog=Y48G8AL.8a; Phenotype=Emb,Lva
  Coding regions on vcDNA: vcDNA=SeqID_49947; Strand=+; Position=2-136
KIHYCKRPDNSTKSCKARGSDLRVHFKNTRETARAINWHVANSE

SEQ ID NO: 123525 - protein, 111 aa, Heterodera glycines
  Homolog annotation: Hit_ID=NP_499549.1; Match level="QueryCoverage =85%, HitCoverage=71%, E-value=2e-26, Identity=57%"; Hit description =acyl carrier protein mitochondrial (15.0 kD) (3N4) [Caenorhabditis elegans] emb|CAB60498.1| Hypothetical
  Gene Ontology: Mol. function=NADH dehydrogenase (ubiquinone) activity; Cellular component=mitochondrion; Biological process =gametogenesis
  Essential gene: C elegans homolog=Y56A3A.19; Phenotype=Lva
  Coding regions on vcDNA: vcDNA=SeqID_49948; Strand=+; Position=108-443
MTRQKMQMYSPEMRAVNYQQKRTHMHAILTKKTVEDRVMLNLHLFDKVDNDKLTFDSDFFKDLGIDSLDFVEFIIAIEDEFEFEIPDGDSDRMRTPRDVYNYICDKCDVYD

SEQ ID NO: 123526 - protein, 112 aa, Heterodera glycines
  Homolog annotation: Hit_ID=CAE69896.1; Match level="QueryCoverage =71%, HitCoverage=95%, E-value=1e-14, Identity=46%"; Hit description =Hypothetical protein CBG16246 [Caenorhabditis briggsae]
  Essential gene: C elegans homolog=R10H10.4; Phenotype=Emb
  Coding regions on vcDNA: vcDNA=SeqID_49949; Strand=+; Position=39-377
MPKMDFDLFDMFAPIVVALIFAAILLILSFTCINWYCITQKDDLTIFEKLGARANLRLGPHTMIQIKRGGYASTYAREEDDERRKLTMTSQQQQRMELLLEEDNPKGTVAQI

SEQ ID NO: 123527 - protein, 181 aa, Heterodera glycines
  Homolog annotation: Hit_ID=NP_496012.1; Match level="QueryCoverage =89%, HitCoverage=88%, E-value=5e-18, Identity=31%"; Hit description =putative N-myristoylated nuclear protein, with a coiled coil domain (19.2 kD) (2J707) [Caenorhabditis ele
  Gene Ontology: Biological process=embryogenesis and morphogenesis
  Essential gene: C elegans homolog=M176.3; Phenotype=Emb
  Coding regions on vcDNA: vcDNA=SeqID_49950; Strand=+; Position=2-544
SQSREERPRKLPKQNNGEPNENIVRINRTEMPEEFQAVLLSDNVVQQVMKSGQNTTNDLRTRELDKELTMQRERNKQLTEQLRTLEEKRAVESASAAVSAAVSAVKTIETSARNSKEEEIEEKRRIFEETAKRLEETFLSRHWPDACADEQKEIVGCLAKFPGQVLSCHSLLDIYRKCINN

SEQ ID NO: 123528 - protein, 159 aa, Heterodera glycines
  misc_feature (72)..(72): Xaa can be any naturally occurring amino acid
  Homolog annotation: Hit_ID=NP_491961.1; Match level="QueryCoverage =97%, HitCoverage=74%, E-value=2e-59, Identity=73%"; Hit description =dna directed rna polymerase ii polypeptide e (24.3 kD) (1H427) [Caenorhabditis elegans] gb|AAF39906.1| Hy
  Gene Ontology: Mol. function=DNA-directed RNA polymerase activity; Cellular component=DNA-directed RNA polymerase II, holoenzyme; Biological process=embryogenesis and morphogenesis
  Essential gene: C elegans homolog=H27M09.2; Phenotype=Emb
  Coding regions on vcDNA: vcDNA=SeqID_49951; Strand=+; Position=128-603
ICLQMCHDRGYLVTQDELDQTLDQFKDQFGDRPSERRPGRGELTILVAHNDDPTGESYREGALLKCRFLDQXICQQMQEQNITRAIIVVQSGMTPSAKQAIVDMAPKYILEHFLEAELMINITEHELVPEHVVMSSEEKAELLARYKLRDNQLPRIQVS

SEQ ID NO: 123529 - protein, 109 aa, Heterodera glycines
  Homolog annotation: Hit_ID=NP_496767.1; Match level="QueryCoverage =97%, HitCoverage=98%, E-value=5e-38, Identity=68%"; Hit description =one IG domain (oig-2) [Caenorhabditis elegans] emb|CAA21634.1| Hypothetical protein Y38F1A.9 [Caenorhabdi
  Essential gene: C elegans homolog=Y38F1A.9; Phenotype=Unclassified
  Coding regions on vcDNA: vcDNA=SeqID_49952; Strand=+; Position=3-332
MVCPPSFERAPSIINKPNGSVLFECIWNANPEPTVKWFLKDKELAGDRFVSKVKKQVGKYLCTLTIKSPNQQDQGIYKVVATNPQGTHSVSQNYMLMCTANEVFKTQMD

SEQ ID NO: 123530 - protein, 133 aa, Heterodera glycines
  Homolog annotation: Hit_ID=NP_491077.1; Match level="QueryCoverage =93%, HitCoverage=92%, E-value=3e-16, Identity=37%"; Hit description =nuclear Transport Factor 2-related eXporT protein, binds Ran-GTP (15.5 kD) (nxt-1) [Caenorhabditis elegan
  Essential gene: C elegans homolog=Y71F9AM.5; Phenotype=Emb,Lva
  Coding regions on vcDNA: vcDNA=SeqID_49953; Strand=+; Position=8-409
MSSSALVKIKLDQEVCADAEKLVRLYTELADVHRTRISKLYSAHDPQIVWNGNPYKGMPEIETFWRNLPETSHDVACLDAHRIDPTSDDMSLVVLAMGTVIIGGLSHAYNQSLLLVLEGSTYKIKSDNYRVID

SEQ ID NO: 123531 - protein, 170 aa, Heterodera glycines
  misc_feature (88)..(88): Xaa can be any naturally occurring amino acid
  Homolog annotation: Hit_ID=NP_741476.1; Match level="QueryCoverage =99%, HitCoverage=84%, E-value=3e-22, Identity=36%"; Hit description =ICLn ion channel homolog, nucleotide-sensitive chloride conductance regulator (22.9 kD) (icl-1) [Caenorha
  Gene Ontology: Mol. function=auxiliary transport protein activity; Cellular component=plasma membrane; Biological process=transport
  Essential gene: C elegans homolog=C01F6.8a; Phenotype=Emb,Lva,Unc
  Coding regions on vcDNA: vcDNA=SeqID_49954; Strand=+; Position=14-524
MLILQELDPPTEAVIETEGQVVAHWENHCLGQGTLYLIESALVWISHGTKNGFRLPIPSIVVHAASGANEDFSEPCLFLMVDYSKTGXEYVPAEVDDIDEETEEDPEVKTVAVRLVPTNAMRISELFSTLSKCHELNPEIDEQMSDNDSLLGDDECDDDGEWAQNGNSDH

SEQ ID NO: 123532 - protein, 176 aa, Heterodera glycines
  Homolog annotation: Hit_ID=NP_497850.1; Match level="QueryCoverage =99%, HitCoverage=29%, E-value=4e-11, Identity=25%"; Hit description =mitochondrial ribosomal protein L21 (3F332) [Caenorhabditis elegans] pir||T22121 hypothetical protein F43
  Essential gene: C elegans homolog=F43C1.3; Phenotype=Gro
  Coding regions on vcDNA: vcDNA=SeqID_49955; Strand=+; Position=2-529
SCSFCPNEKLDLYKCPQCSSFYCSLRCFRCKKHIKCSEDFYRKECEKHNELLSNDPFELNPTDDKQKKTKVMTFEQYMAQQNQNSGGKKDKSTANPQIAVRADEEILFDSDDEPEYLSKMIASTLEQFNSLDDQELDRRILNAGLPIGLGEEQTAKGETSQEEMEILYQQLMGEEK

SEQ ID NO: 123533 - protein, 171 aa, Heterodera glycines
  misc_feature (21)..(21): Xaa can be any naturally occurring amino acid
  Homolog annotation: Hit_ID=CAA70477.2; Match level="QueryCoverage =97%, HitCoverage=89%, E-value=4e-52, Identity=65%"; Hit description =SEC-2 protein [Globodera pallida]
  Essential gene: C elegans homolog=F02A9.2; Phenotype=Bmd,Dpy
  Coding regions on vcDNA: vcDNA=SeqID_49956; Strand=+; Position=14-526
VFTDAHLTTLDINLIPAEYRXLIPEEVTKFYHQLTEDDKKALKEVAERHQEFQTEDHAMEALKEKSEKLYNKAVELRTLVKGKIDQLVPDSKAFVIRMIEKAKGMRPKAVEKPKLEELRTVANELIDKYKALNDDTKESLKSNCPQITSVIHNEKLQTLAKSLLEHEAPAA

SEQ ID NO: 123534 - protein, 109 aa, Heterodera glycines
  Homolog annotation: Hit_ID=CAE75457.1; Match level="QueryCoverage =89%, HitCoverage=92%, E-value=6e-18, Identity=41%"; Hit description =Hypothetical protein CBG23452 [Caenorhabditis briggsae]
  Essential gene: C elegans homolog=R04F11.2; Phenotype=Emb,Lva
  Coding regions on vcDNA: vcDNA=SeqID_49957; Strand=+; Position=2-331
RPKTVPKEQHPFYILHPEPIRISPLLRFARWSALGLGIVYGFVRLRMVSKYHADIREWEVQKTIHKKDADKKESLRVLREQNEWIMKITDMNLEEGKSQLGVEHLYDLK

SEQ ID NO: 123535 - protein, 137 aa, Heterodera glycines
  misc_feature (95)..(95): Xaa can be any naturally occurring amino acid
  Homolog annotation: Hit_ID=NP_494712.1; Match level="QueryCoverage =100%, HitCoverage=53%, E-value=9e-57, Identity=73%"; Hit description= proteasome Regulatory Particle, Non-ATPase-like, S13 (34.6 kD) (rpn -11) [Caenorhabditis elegans] gb|AAC2
  Gene Ontology: Mol. function=proteasome endopeptidase activity; Cellular component=26S proteasome; Biological process=ubiquitin -dependent protein catabolism
  Essential gene: C elegans homolog=K07D4.3; Phenotype=Emb
  Coding regions on vcDNA: vcDNA=SeqID_49958; Strand=+; Position=5-468
MERLLRLGGLSGLGAGSLNATPHDSNQVDTSETVYISSLALLKMLKHGRAGVPMEVMGLMLGEFVDDYTVNVIDVFAMPQSGTGVSVEAVDPVFXGVDINTQQSFEALSDRAVAFVVDPIQSVKGKVVIDAVRTINP

SEQ ID NO: 123536 - protein, 344 aa, Heterodera glycines
  misc_feature (191)..(191): Xaa can be any naturally occurring amino acid
  misc_feature (200)..(200): Xaa can be any naturally occurring amino acid
  Homolog annotation: Hit_ID=CAE74484.1; Match level="QueryCoverage =99%, HitCoverage=98%, E-value=1e-134, Identity=69%"; Hit description= Hypothetical protein CBG22235 [Caenorhabditis briggsae]
  Gene Ontology: Mol. function=structural constituent of ribosome; Cellular component=cytosolic large ribosomal subunit (sensu Eukarya); Biological process=protein biosynthesis
  Essential gene: C elegans homolog=B0041.4; Phenotype=Emb,Ste
  Coding regions on vcDNA: vcDNA=SeqID_49959; Strand=+; Position=34-1064
MASRPLVSIYNEKNEPTGKQIKLPAVFRAPIRPDIVSFIHDQIRKNKRQAYAVSTAAGHQTSAESWGTGRAVARIPRVRGGGTHRSGQGAFGNMCRGGRMFAPTKVYRRWHRRVNVAQRRYAIVSAIAASAVPALVQARGHVIDQLNEIPLVISDKIESFTKTKEAVGFLQRAHLWDDVEKVYKSKRFRAXGKGKRRNRXYKQKLGPLVIYNNDGGIVRAFRNVPGVTLLSVSHLNLLKIAPGGHLGRLVVWTESAFRQLDPLFGTWTRQSNVKKGFTLPRAKMTNSDFARIIRSEEITKVLRPTMARKVRRVAKIHGNPLKKPSLMAKLNPYAAVLRRAAVLA

SEQ ID NO: 123537 - protein, 409 aa, Heterodera glycines
  misc_feature (169)..(169): Xaa can be any naturally occurring amino acid
  Homolog annotation: Hit_ID=CAE69324.1; Match level="QueryCoverage =100%, HitCoverage=86%, E-value=1e-108, Identity=56%"; Hit description=Hypothetical protein CBG15399 [Caenorhabditis briggsae]
  Gene Ontology: Mol. function=ATP binding; Biological process=protein kinase cascade
  Essential gene: C elegans homolog=F53A9.10a; Phenotype=Gro,Slu
  Coding regions on vcDNA: vcDNA=SeqID_49960; Strand=+; Position=207 -1431
MSEEESQYSDEEVEEESIAADEVSVQEPAPPKEEEPAPEAEAEAPPAEEKEEEEEEEPGSPGGAGDAPKEEFRRTSVTESVAPTAQLRRAPPPQPKPAEESMTEAEAAMLAVKKRHEEEEEAKMRDNDERRRQELAAVEDELRVLKERQAERRAEREKEEAEFAERRRXQDEDRRRKDEEERKARLEAEKAKRDEEKRKRHLMMAGGFGGFVAADAEGAGKNFVVPEKSEKGAQQGMPGQTSKPRGLSKEQQEEAKRNYMSIVNRPVDVSNMLPNDIKANIKQLHARIVKLEGEKYDLEKRKDRQEYDLKELSERQKQHARAKALETGADPTEVESSGNFPPKVRVASRFDRQTDLRGYGQRRDLFEHPAETPEPKIVHGSGRPPPEWGRKEFEELENIRKNLEPPKYV

SEQ ID NO: 123538 - protein, 169 aa, Heterodera glycines
  Homolog annotation: Hit_ID=CAE65556.1; Match level="QueryCoverage =84%, HitCoverage=50%, E-value=1e-44, Identity=53%"; Hit description =Hypothetical protein CBG10545 [Caenorhabditis briggsae]
  Essential gene: C elegans homolog=T21D12.3; Phenotype=Unclassified
  Coding regions on vcDNA: vcDNA=SeqID_49961; Strand=+; Position=3-509
SCRIRHEATSLPPLLLERLKKRGIVASKNEDEEVFAESYDQDDDSKLEISREKYRGGAPGCPNKHNPFHVCTDFCFDHWQEGYPESRLSDKYLEQRNKMLRNYPLPKDWVEIYDPGMHRHYYWNQMTDEVSWLSPKHPKAVISEAAAKSAKEAWNMSKIERSEGERGGR

SEQ ID NO: 123539 - protein, 232 aa, Heterodera glycines
  Homolog annotation: Hit_ID=CAE73453.1; Match level="QueryCoverage =87%, HitCoverage=29%, E-value=3e-65, Identity=59%"; Hit description =Hypothetical protein CBG20902 [Caenorhabditis briggsae]
  Gene Ontology: Biological process=physiological processes
  Essential gene: C elegans homolog=Y48B6A.1; Phenotype=Lva
  Coding regions on vcDNA: vcDNA=SeqID_49962; Strand=+; Position=12-707
MKRSIMQKDCTSKGENVSQLDKSTSKMEGSKPLQIEEYDTSDEEDLRNTIGNIPVQWYNDYDHVGYTLSGDKIKKDAIKTDEIDAFLQKEEDSDYWRKVFDRQSGQQMALTDQQVEKLNAIADNRFPEIGYNPYPPFLDIFSSVREIHPISNRPPDKRSFVPSADERRIVGRMVHAIKMGWLKRKEPPKGSEEEEEPRLYDLWDDEGDEQRKSKSQMARVRMHLPAPKVKPP

SEQ ID NO: 123540 - protein, 114 aa, Heterodera glycines
  Homolog annotation: Hit_ID=CAA12260.1; Match level="QueryCoverage =100%, HitCoverage=84%, E-value=3e-17, Identity=45%"; Hit description= troponin [Brugia pahangi]
  Essential gene: C elegans homolog=T22E5.5; Phenotype=Stp,Unc
  Coding regions on vcDNA: vcDNA=SeqID_49963; Strand=+; Position=253-594
EEEPAPEAEAEAPPAEEKEEEEEEEPGSPGGAGDAPKEEFRRTSVTESVAPTAQLRRAPPPQPKPAEESMTEAEAAMLAVKKRHEEEEEANMRDNDERRRQELAAVEDELRVLK

SEQ ID NO: 123541 - protein, 195 aa, Heterodera glycines
  misc_feature (15)..(15): Xaa can be any naturally occurring amino acid
  Homolog annotation: Hit_ID=AAN15196.1; Match level="QueryCoverage =100%, HitCoverage=51%, E-value=9e-80, Identity=73%"; Hit description= actin [Globodera rostochiensis] gb|AAN78299.1| actin 1 [Heterodera glycines] gb|AAG47837.2| actin 1 [Hete
  Gene Ontology: Biological process=reproduction
  Essential gene: C elegans homolog=T04C12.6; Phenotype=Ste
  Coding regions on vcDNA: vcDNA=SeqID_49964; Strand=+; Position=2-586
CDEEVAALLADNGSXMCNAGFPVDDAPRAVFPSIVGRPRHQGVMVRMGHKDSYVGHEAQSNRGILTLNYPIDHCILTHWDDMENIWHHTFYHELRVPPQEHPVLLPKAPLNPKGHRKKMTPILFQNFHTPAIYLALPALLSLYAFGPTTGLLLDFRDGGTHTGPLYQGYPLAHALLRLDLGGPDLTDYPEKIPPE

SEQ ID NO: 123542 - protein, 381 aa, Heterodera glycines
  misc_feature (99)..(99): Xaa can be any naturally occurring amino acid
  misc_feature (174)..(174): Xaa can be any naturally occurring amino acid
  misc_feature (206)..(206): Xaa can be any naturally occurring amino acid
  misc_feature (328)..(328): Xaa can be any naturally occurring amino acid
  Homolog annotation: Hit_ID=AAN15196.1; Match level="QueryCoverage =100%, HitCoverage=100%, E-value=0.0, Identity=94%"; Hit description =actin [Globodera rostochiensis] gb|AAN78299.1| actin 1 [Heterodera glycines] gb|AAG47837.2| actin 1 [Heter
  Gene Ontology: Biological process=reproduction
  Essential gene: C elegans homolog=M03F4.2a; Phenotype=Ste
  Coding regions on vcDNA: vcDNA=SeqID_49965; Strand=+; Position=88-1231
MCDEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAXPEEHPVLLTEAPLNPKANREKMTQIMFETFNTPAMYVGPSRPCCPLYASGRTTGLVLDSGDGVTHTVPIYEGYGXAPRPILPFGLGPGGDLTDYLMKILTERGYSFXTTAEREIVRDIKEKLCYVALDFEQEMATAASSSSLEKSYELPDGQVITVGNERFRCPEALFQPSFIGMESAGIHESTYNSIMKCDIDIRKDLYANNVLSGGTTMYPGIADRMQKEMTALAPXSTMKIKIIAPPERKYSVWIGGSILASLSTFQQMWISKQEYDESGPSIVHRKCF

SEQ ID NO: 123543 - protein, 150 aa, Heterodera glycines
  Homolog annotation: Hit_ID=NP_496290.2; Match level="QueryCoverage =94%, HitCoverage=64%, E-value=5e-26, Identity=46%"; Hit description =programmed cell death 10 (24.8 kD) (2K896) [Caenorhabditis elegans] emb|CAA90115.2| Hypothetical protein
  Essential gene: C elegans homolog=C14A4.11; Phenotype=Dpy,Emb
  Coding regions on vcDNA: vcDNA=SeqID_49966; Strand=+; Position=30-479
MSNNDIIFGNEEGVNYLAPWTYSCLIKTSIDRLKTALSENREAIHALNHLQEVFRQIDRASPSFLYDFSKLLLIESGVAGTNVQESYLRMHANAATEELELPQFAHIAEFQYLSMRAVSLCKVLARIPDEMTDRRPFLETIKEIASSIKQ

SEQ ID NO: 123544 - protein, 324 aa, Heterodera glycines
  Homolog annotation: Hit_ID=NP_505415.2; Match level="QueryCoverage =85%, HitCoverage=59%, E-value=4e-45, Identity=41%"; Hit description =ubiquinone biosynthesis monooxgenase coq6 (49.1 kD) (5J819) [Caenorhabditis elegans] gb|AAB54238.2| Coenz
  Gene Ontology: Mol. function=ubiquinone biosynthesis monooxygenase activity; Cellular component=extracellular space; Biological process= electron transport
  Essential gene: C elegans homolog=K07B1.2; Phenotype=Age,Unclassified
  Coding regions on vcDNA: vcDNA=SeqID_49967; Strand=+; Position=733 -1887
MLKHCTQIRSFATHQSIFYDVVIVGGGLVGSAMACSIGTNSALGPSTRVLLLESGRLHSVKQSKEAETKHTYNNRVSAVSPSSPFLFYSQFGVWDEICSKRVHPISALYVEDGCAKSKIHFKQLDKRSPIAHIVQNELIVAALQQCIRDRCANVEVRQGAVVDQNLSVPDNLGQNVTIQFEDGTIEASLMIAADGSKSTARKRVFIDFEETAYEQRAVVGTLALQHNSESDESFAWQRFVPSGPVALLPLGHELCSLVWTVSTADAARLLQLSPEHFVEELNGTLVSSAFYGSPNNGQFDNSSANSLVNNSLDCLGKALNFLPS

SEQ ID NO: 123545 - protein, 371 aa, Heterodera glycines
  Homolog annotation: Hit_ID=NP_497663.1; Match level="QueryCoverage =100%, HitCoverage=82%, E-value=0.0, Identity=91%"; Hit description =MEChanosensory abnormality MEC-12, TuBulin, Alpha, specific of 15 protofilament microtubules found in mech
  Gene Ontology: Mol. function=GTP binding; Cellular component =microtubule; Biological process=spindle assembly
  Essential gene: C elegans homolog=C47B2.3; Phenotype=Emb
  Coding regions on vcDNA: vcDNA=SeqID_49968; Strand=+; Position=102 -1214
MREVISIHVGQAGVQIGNACWELYCLEHGIQPDGKMPSDQNNQDDSFSTFFSETGNGRHVPRAVMVDLEPTVIDEIRTGTYKHLFHPEQLITGKEDAANNYARGHYTVGKEIIDPVLDRIRRIADNCTGLQGFLIFHSFGGGTGSGFTSLLMERLSVDYGKKSKLEFSIYPAPQVSTAVVEPYNSVLTTHTTLEHSDCAFMVDNEAIYDICRRNLDVERPSYTNLNRLISQVVSSITASLRFDGALNVDLTEFQTNLVPYPRIHFPLATYSPVISAEKAYHESLSVSRITNMCFEPSNQMVKCDPRHGKYMAVCLLYRGDVVPKDVNAAIASIKTNRSIQFVDWCPTGFKVGINYQPPTVVPGGDVAKVPR

SEQ ID NO: 123546 - protein, 479 aa, Heterodera glycines
  misc_feature (362)..(362): Xaa can be any naturally occurring amino acid
  Homolog annotation: Hit_ID=CAE69279.1; Match level="QueryCoverage =100%, HitCoverage=45%, E-value=5e-96, Identity=40%"; Hit description= Hypothetical protein CBG15333 [Caenorhabditis briggsae]
  Gene Ontology: Mol. function=RNA helicase activity; Cellular component=small nucleolar ribonucleoprotein complex; Biological process=processing of 20S pre-rRNA
  Essential gene: C elegans homolog=C06E1.10; Phenotype=Lva
  Coding regions on vcDNA: vcDNA=SeqID_49969; Strand=+; Position=1-1438
ATLKLQDFLRQRLFSISQPKVVSVQARQFPVTIYFERRTPTNYLEATFKKVCKIHEEYPAGGILAFVTGQREVTHLVKLLENKYTKISASKLLRKEKMKKCRKKETKEEEEEGLLLDNDEFGTSDMDLEDEAWQNTFFGSDDESLNASQSFKKYPPLLAIPLYSLLPVNLQKKIFNEPPDDGSRVCVVSTNVAETSLTIPNVRYVIDSGREKKREYDPITGVSRFVVGWCSKASADQRSGRAGRVQSGYAFRLYSSAVYEDMRDHSTPEILNKPIDQLILMLKAMNFTKIDNFPFPTPPRLDQIKSSELRLSHIGALRVQEGLYTITQLGQSLAQLPLTPSFAKVVISSIRGGLLPFAVTLXKEDGTEERRKRVSEVIKQRFLWCAVGEALLFGDLTVILNTVGAADYEEENARAIEALGLRPKALKGINKQRHQLTLLLNKSDSVEKLPEKFRMDAPSQEQLRRLRHIMVKCHPDKLA

SEQ ID NO: 123547 - protein, 198 aa, Heterodera glycines
  Homolog annotation: Hit_ID=NP_508413.1; Match level="QueryCoverage =93%, HitCoverage=94%, E-value=3e-88, Identity=83%"; Hit description =ribosomal Protein, Large subunit (22.8 kD) (rpl-11.2) [Caenorhabditis elegans] gb|AAA83599.1| Ribosomal p
  Gene Ontology: Mol. function=structural constituent of ribosome; Cellular component=cytosolic ribosome (sensu Eukarya); Biological process=protein biosynthesis
  Essential gene: C elegans homolog=F07D10.1; Phenotype=Lva
  Coding regions on vcDNA: vcDNA=SeqID_49970; Strand=+; Position=45-641
LKPNKLRQKKEKKLGNPMRDLKIQKLCLNICVGESGDRLTRAAKVLEQLTGQTPVLSKARYTVRSFGIRRNEKIAVHCTVRGPKAEEIIDRGLKVKEYELYRENFSDTGNFGFGIQEHIDLGIKYDPSIGIYGMDFYVVLGRAGLRVAKRRRIQGRIGASHRVQKEEAVKWFQQKYDGVILPPKPKESRKGGHRGRKR

SEQ ID NO: 123548 - protein, 139 aa, Heterodera glycines; identical to SEQ ID NO: 122701
  Homolog annotation: Hit_ID=NP_492576.1; Match level="QueryCoverage =97%, HitCoverage=100%, E-value=1e-44, Identity=65%"; Hit description= ribosomal Protein, Large subunit (15.4 kD) (rpl-14) [Caenorhabditis elegans] emb|CAB03835.1| Hypothetica
  Gene Ontology: Mol. function=structural constituent of ribosome; Cellular component=cytosolic large ribosomal subunit (sensu Eukarya); Biological process=positive regulation of growth rate
  Essential gene: C elegans homolog=C04F12.4; Phenotype=Emb,Lva
  Coding regions on vcDNA: vcDNA=SeqID_49971; Strand=+; Position=40-459

SEQ ID NO: 123549 - protein, 95 aa, Heterodera glycines
  Homolog annotation: Hit_ID=XP_328535.1; Match level="QueryCoverage =94%, HitCoverage=36%, E-value=1e-35, Identity=73%"; Hit description =hypothetical protein [Neurospora crassa] gb|EAA33714.1| hypothetical protein [Neurospora crassa] sp|Q7SBD
  Gene Ontology: Mol. function=structural constituent of ribosome; Cellular component=cytosolic large ribosomal subunit (sensu Eukarya); Biological process=protein biosynthesis
  Essential gene: C elegans homolog=F53G12.10; Phenotype=Emb,Lva
  Coding regions on vcDNA: vcDNA=SeqID_49972; Strand=+; Position=54-341
MPQDEGKVHGQRIALSDNAVVEKSLGKAGLICVEDLIHEIYTVGPNFKKANNFLWPFKLSSPNGAFNKRKFKHFIEGGDFGNREEFINELVRKMN

SEQ ID NO: 123550 - protein, 170 aa, Heterodera glycines
  Homolog annotation: Hit_ID=NP_871953.1; Match level="QueryCoverage =81%, HitCoverage=34%, E-value=2e-44, Identity=62%"; Hit description =i mitochondrial  ascsu pyruvate dehydrogenase e1 component type (45.8 kD) (2I357Co) [Caenorhabditis elega
  Gene Ontology: Mol. function=pyruvate dehydrogenase activity; Cellular component=extracellular space; Biological process=acetyl -CoA metabolism
  Essential gene: C elegans homolog=T05H10.6a; Phenotype=Emb
  Coding regions on vcDNA: vcDNA=SeqID_49973; Strand=+; Position=37-546
MIFLTSFSKHPLSAAFRFFSSVNEVTLQTRPYKLFKLDSGPSTEVRLTRDEALDYYRKMQLVRRMETSAFFLYKEKRIRGFCHLYSGQEACAVGMVAATDPNDAVITAYRCHGWTYLMGATVQDILGELTGRIAGNVYGRRGCMGSGPKEPFSAGDGNPLGVRTDSMGGG

SEQ ID NO: 123551 - protein, 154 aa, Heterodera glycines; identical to SEQ ID NO: 122608
  Homolog annotation: Hit_ID=NP_491398.1; Match level="QueryCoverage =100%, HitCoverage=100%, E-value=2e-35, Identity=51%"; Hit description=ribosomal Protein, Small subunit (16.9 kD) (rps-10) [Caenorhabditis elegans] gb|AAK18912.1| Ribosomal p
  Gene Ontology: Mol. function=structural constituent of ribosome; Cellular component=cytosolic small ribosomal subunit (sensu Eukarya); Biological process=locomotory behavior
  Essential gene: C elegans homolog=D1007.6; Phenotype=Emb,Lva,Ste
  Coding regions on vcDNA: vcDNA=SeqID_49974; Strand=+; Position=48-512

SEQ ID NO: 123552 - protein, 85 aa, Heterodera glycines; identical to SEQ ID NO: 122112
  Homolog annotation: Hit_ID=CAE63804.1; Match level="QueryCoverage =94%, HitCoverage=76%, E-value=3e-28, Identity=75%"; Hit description =Hypothetical protein CBG08350 [Caenorhabditis briggsae]
  Gene Ontology: Mol. function=structural constituent of ribosome; Cellular component=ribosome; Biological process=protein biosynthesis
  Essential gene: C elegans homolog=F37C12.4; Phenotype=Emb
  Coding regions on vcDNA: vcDNA=SeqID_49975; Strand=+; Position=40-297

SEQ ID NO: 123553 - protein, 148 aa, Heterodera glycines
  Homolog annotation: Hit_ID=NP_524867.2; Match level="QueryCoverage =100%, HitCoverage=76%, E-value=3e-53, Identity=61%"; Hit description= CG4539-PA [Drosophila melanogaster] gb|AAF52821.2| CG4539-PA [Drosophila melanogaster] gb|AAM29419.1| RE
  Gene Ontology: Biological process=gametogenesis
  Essential gene: C elegans homolog=F30A10.9; Phenotype=Lva,Lvl
  Coding regions on vcDNA: vcDNA=SeqID_49976; Strand=+; Position=31-474
MGRHKKTQKFRNKLQKLIKPTDDRIKDEIRVKKPPKEDENALKIKEAPKISAAMFLKYNTQLGPPFHVIIDTNFVNFSIKNRIDIMTGFMDCLYAKVVPYISDCVLGELEKMGRRFKLALKIIKDNRFQRLQCTHKGIYADDCIVQRV

SEQ ID NO: 123554 - protein, 129 aa, Heterodera glycines; identical to SEQ ID NO: 120387
  Homolog annotation: Hit_ID=NP_499867.1; Match level="QueryCoverage =52%, HitCoverage=80%, E-value=7e-11, Identity=45%"; Hit description =putative Golgi protein (10.2 kD) (4A881) [Caenorhabditis elegans] gb|AAC19190.1| Hypothetical protein F29
  Essential gene: C elegans homolog=F29C4.2; Phenotype=Gro
  Coding regions on vcDNA: vcDNA=SeqID_49977; Strand=+; Position=14-403

SEQ ID NO: 123555 - protein, 190 aa, Heterodera glycines; identical to SEQ ID NO: 122095
  Homolog annotation: Hit_ID=XP_317628.1; Match level="QueryCoverage =95%, HitCoverage=64%, E-value=7e-71, Identity=68%"; Hit description =ENSANGP00000019124 [Anopheles gambiae] gb|EAA12157.2| ENSANGP00000019124 [Anopheles gambiae str. PEST]
  Gene Ontology: Mol. function=F-actin capping activity; Cellular component=actin filament; Biological process=cell organization and biogenesis
  Essential gene: C elegans homolog=M106.5; Phenotype =Bmd,Dpy,Emb,Gro,Lvl
  Coding regions on vcDNA: vcDNA=SeqID_49978; Strand=+; Position=103-672

SEQ ID NO: 123556 - protein, 215 aa, Heterodera glycines
  Homolog annotation: Hit_ID=NP_498360.2; Match level="QueryCoverage =94%, HitCoverage=84%, E-value=3e-36, Identity=37%"; Hit description =breast carcinoma amplified sequence 2 like (27.6 kD) (3H334) [Caenorhabditis elegans] gb|AAC24446.2| Hypo
  Essential gene: C elegans homolog=T12A2.7; Phenotype=Bmd,Unc
  Coding regions on vcDNA: vcDNA=SeqID_49979; Strand=+; Position=23-667
MLPAIKPANSDGIVLDALPYIDDQQYTDEHRQLALQLIQAECKKFPMTKNYLRNLPEPDYDKFTTPRIMEHQAKMANKQEIEKIDLLRYEVPSPANTSRSGNKKAWLGAIDNCRAQLSNQSLRKMNLELLDEFGPEAFLRSNQHLKKQVEKEEAELFKLRSQLYELNARRKRSQLDAGERLAALGQTWVELVTKNAAMVVRHDKLGNRIRTLAKL

SEQ ID NO: 123557 - protein, 425 aa, Heterodera glycines; identical to SEQ ID NO: 122057
  Homolog annotation: Hit_ID=CAE75137.1; Match level="QueryCoverage =100%, HitCoverage=100%, E-value=1e-132, Identity=56%"; Hit description=Hypothetical protein CBG23066 [Caenorhabditis briggsae]
  Gene Ontology: Mol. function=translation elongation factor activity; Cellular component=ribosome; Biological process=translational elongation
  Essential gene: C elegans homolog=F17C11.9a; Phenotype=Gro
  Coding regions on vcDNA: vcDNA=SeqID_49980; Strand=+; Position=11-1288

SEQ ID NO: 123558 - protein, 251 aa, Heterodera glycines
  Homolog annotation: Hit_ID=XP_419824.1; Match level="QueryCoverage =98%, HitCoverage=57%, E-value=3e-44, Identity=41%"; Hit description =PREDICTED: similar to Hexaprenyldihydroxybenzoate methyltransferase, mitochondrial precursor (Dihydroxyhe
  Gene Ontology: Mol. function=methyltransferase activity; Cellular component=mitochondrion; Biological process=larval development (sensu Nematoda)
  Essential gene: C elegans homolog=Y57G11C.11; Phenotype =Age,Unclassified
  Coding regions on vcDNA: vcDNA=SeqID_49981; Strand=+; Position=87-842
MSSLIRGEIQQFASFANVFHWFDELHGCFRPLHSFNQLRIPWLSAHLATSSLNAVHLPLSGKQILDVGCGAGILSTSLCRRGALVTGLDADKSVLEIANGYKETMAPSLRKKIEFIPGTIERLAQEKDRIGTFDAVVSSEVVEHVSDLPLFIRSCCKLARPNSPIFFTTINRTIWSQLLAKTIAEDLLRILPQGLHQFEQFVAPRDLRKLLLDEQCSVGPVLGMAYNPFFNIWNWTRFTGVNYALVAHTKN

SEQ ID NO: 123559 - protein, 155 aa, Heterodera glycines; identical to SEQ ID NO: 122294
  Homolog annotation: Hit_ID=NP_492761.1; Match level="QueryCoverage =96%, HitCoverage=98%, E-value=4e-62, Identity=75%"; Hit description =nucleoside diphosphate kinase (1L130) [Caenorhabditis elegans] emb|CAB02101.1| Hypothetical protein F25H2
  Gene Ontology: Mol. function=ATP binding; Cellular component=nucleus; Biological process=negative regulation of cell proliferation
  Essential gene: C elegans homolog=F25H2.5; Phenotype=Pvl,Stp
  Coding regions on vcDNA: vcDNA=SeqID_49982; Strand=+; Position=55-522

SEQ ID NO: 123560 - protein, 265 aa, Heterodera glycines
  Homolog annotation: Hit_ID=CAE62694.1; Match level="QueryCoverage =98%, HitCoverage=44%, E-value=8e-66, Identity=50%"; Hit description =Hypothetical protein CBG06842 [Caenorhabditis briggsae]
  Gene Ontology: Cellular component=eukaryotic 48S initiation complex; Biological process=cell organization and biogenesis
  Essential gene: C elegans homolog=R08D7.3; Phenotype=Emb
  Coding regions on vcDNA: vcDNA=SeqID_49983; Strand=+; Position=1-795
IITLPQFDLPECVSTLNGWGPGSVSDSQVLSEFVGLPYQHFNKCDRIGRIVDWLGVDRFFKKGETRDRYNERVYGSSATAGVQFDYIHDNEESNFQLVDSSRPQKPQRPFRRQIPFRKLAQREQERREYEKYNVSTKMKRSILKEQQKAYKVFLRRGGGTRGTAQRPTGRRFNDRQAGKGRQPSVQVRPDWAVLKELDFVQLNKLYLPNIEPGKDIPGETYGTLHFYDKALMDKLSVKNPLHLEKFHASFYSLTTTEDPVFRKLS

SEQ ID NO: 123561 - protein, 205 aa, Heterodera glycines
  Homolog annotation: Hit_ID=CAE67093.1; Match level="QueryCoverage =95%, HitCoverage=54%, E-value=6e-87, Identity=82%"; Hit description =Hypothetical protein CBG12504 [Caenorhabditis briggsae]
  Gene Ontology: Mol. function=isocitrate dehydrogenase (NAD+) activity; Cellular component=mitochondrion; Biological process =carbohydrate metabolism
  Essential gene: C elegans homolog=F43G9.1; Phenotype=Emb,Gro,Pvl
  Coding regions on vcDNA: vcDNA=SeqID_49984; Strand=+; Position=20-634
MLKNNLLIRGKSVLFSLPLRAFSLSAQCANGEPIRRVVLIPGDGIGPEISSAVQKIFEAAKTPIDWDPVDVTPVQGRDGIFRIPNKCIELMHKNKVGLKGPLETPIGKGHRSLNLAVRKEFNLYANVRPCRSLEGHKTLYDNVDVVTIRENTEGEYSGIEHEIVSGVVQSIKLITEQASRRVARFAFEYARQNGRKEVTAVHKAN

SEQ ID NO: 123562 - protein, 195 aa, Heterodera glycines; identical to SEQ ID NO: 122783
  Homolog annotation: Hit_ID=CAE64754.1; Match level="QueryCoverage =100%, HitCoverage=100%, E-value=1e-74, Identity=70%"; Hit description=Hypothetical protein CBG09544 [Caenorhabditis briggsae]
  Gene Ontology: Mol. function=potassium channel regulator activity; Cellular component=plasma membrane; Biological process=small GTPase mediated signal transduction
  Essential gene: C elegans homolog=ZK856.8; Phenotype=Unc
  Coding regions on vcDNA: vcDNA=SeqID_49985; Strand=+; Position=11-598

SEQ ID NO: 123563 - protein, 367 aa, Heterodera glycines
  Homolog annotation: Hit_ID=CAE73779.1; Match level="QueryCoverage =99%, HitCoverage=71%, E-value=8e-92, Identity=47%"; Hit description =Hypothetical protein CBG21324 [Caenorhabditis briggsae]
  Gene Ontology: Mol. function=pre-mRNA splicing factor activity; Cellular component=cytoplasm; Biological process=mRNA splicing
  Essential gene: C elegans homolog=T10F2.4; Phenotype=Emb
  Coding regions on vcDNA: vcDNA=SeqID_49986; Strand=+; Position=32-1132
MSRFVCAISGNEPEVAVASPVSGEVFEKRLLIKYIEENGTDPITGHKLDTSNLVELKQDPGIRSMQKSLATASLPSLLKQLQDEWDATMLNNFTLRQELKAAREELTHALYQNDAACRVINRLSSELQSARQIIATLPHGRRAAAESETEATDVEMRPEEAEEGAGADGLPGISEELVNFFTDKCQDFSTARKQRGRNLPEGLASVEQIQKYEEVACHDALHSASVPGITALDLQKNFIATGGMDKTIVLFDSETENIKNTFKGHQKRISAVRLHPNLQTIVSGSFDSQIRIWNADDQSARNVIGIHDRLFFDVSLHPTGDYVLCSSEDSHWSLIDLNAGRPLIKVKSDDDDVPGIRCGHFHPEGLI

SEQ ID NO: 123564 - protein, 89 aa, Heterodera glycines; identical to SEQ ID NO: 122635
  Homolog annotation: Hit_ID=AAH59707.1; Match level="QueryCoverage =100%, HitCoverage=100%, E-value=1e-44, Identity=94%"; Hit description=Zgc:73406 protein [Danio rerio]
  Gene Ontology: Mol. function=dynein ATPase activity; Cellular component=axonemal dynein complex; Biological process=microtubule -based movement
  Essential gene: C elegans homolog=T26A5.9; Phenotype=Emb
  Coding regions on vcDNA: vcDNA=SeqID_49987; Strand=+; Position=68-337

SEQ ID NO: 123565 - protein, 205 aa, Heterodera glycines; identical to SEQ ID NO: 122561
  Homolog annotation: Hit_ID=NP_499249.1; Match level="QueryCoverage =95%, HitCoverage=63%, E-value=3e-11, Identity=24%"; Hit description =general transcription factor iih polypeptide 3 34kDa (3L208) [Caenorhabditis elegans] emb|CAA87423.1| Hyp
  Gene Ontology: Biological process=embryogenesis and morphogenesis
  Essential gene: C elegans homolog=ZK1128.4; Phenotype=Emb
  Coding regions on vcDNA: vcDNA=SeqID_49988; Strand=+; Position=19-633

SEQ ID NO: 123566 - protein, 221 aa, Heterodera glycines
  Homolog annotation: Hit_ID=NP_504474.1; Match level="QueryCoverage =81%, HitCoverage=78%, E-value=4e-31, Identity=38%"; Hit description =Williams-Beuren syndrome critical region protein 24 like (25.6 kD) (5G71) [Caenorhabditis elegans] gb|AAB
  Essential gene: C elegans homolog=CD4.4; Phenotype=Emb,Lva,Unc
  Coding regions on vcDNA: vcDNA=SeqID_49989; Strand=+; Position=2-667
ESVVDICVSTLMSKLRNYTEDQLQNLLQDESRLNAMVDSMPQVSSLPNDKEIKLAHSKSLAEYNLSIEPQLNKALNHLRETHANAVRTKGEVNEMKAKLDSVAEARSLDSVCVSLKNLAQNAEDESETAAELFYKGAMEIDDFIKKFTEKRVIGHTRRLKAEKLAELLRQQCQYQPQHPSPSALGMTTQTQYSSQGVAASMYPVLGQAYTSPANFRHSYMS

SEQ ID NO: 123567 - protein, 375 aa, Heterodera glycines
  misc_feature (349)..(349): Xaa can be any naturally occurring amino acid
  Homolog annotation: Hit_ID=CAA70693.1; Match level="QueryCoverage =100%, HitCoverage=100%, E-value=0.0, Identity=99%"; Hit description =cathepsin L-like cysteine proteinase [Heterodera glycines]
  Gene Ontology: Mol. function=cathepsin S activity; Cellular component= lysosome; Biological process=proteolysis and peptidolysis
  Essential gene: C elegans homolog=T03E6.7; Phenotype=Emb,Gro,Unc
  Coding regions on vcDNA: vcDNA=SeqID_49990; Strand=+; Position=54-1179
MLLLFLLSMLLLQTNGWRARERAIELADSDESIELQNIGQRKTDIRTPTERMSALRQMIERGFSDWNAYKQKHGKAYADQEVENERMLTYLSAKQFIDKHNEAYKEGKVSFRVGETHIADLPFSEYQKLNGFRRLMGDSLRRNASTFLAPMNVGDLPESVDWRDKGWVTEVKNQGMCGSCWAFSATGALEGQHVRDKGHLVSLSEQNLIDCSKKYGNMGCNGGIMDNAFQYIKDNKGIDKETAYPYKAKTGKKCLFKRNDVGATDSGYNDIAEGDEEDLKMAVATQGPVSVAIDAGHRSFQLYTNGVYFEKECDPENLDHGVLVVGYGTDPTQGDYWIVKNSWGTRWGXEQGYIRMARNRNNNCGIASHASFPLV

SEQ ID NO: 123568 - protein, 132 aa, Heterodera glycines
  Homolog annotation: Hit_ID=CAA52468.1; Match level="QueryCoverage =100%, HitCoverage=67%, E-value=2e-65, Identity=93%"; Hit description= ADP-ribosylation factor 1 [Solanum tuberosum] sp|P51824|ARF1_SOLTU ADP-ribosylation factor 1 pir||S36453
  Gene Ontology: Mol. function=enzyme activator activity; Cellular component=cytoplasmic vesicle; Biological process=gametogenesis
  Essential gene: C elegans homolog=B0336.2; Phenotype=Emb
  Coding regions on vcDNA: vcDNA=SeqID_49991; Strand=+; Position=172-567
MGLAISGLFSRLFGKKEVRILMVGLDAAGKTTILYKLKLGEIVTTIPTIGFNVETVEYKNISFTVWDVGGQDKIRPLWRYYFQNTQGLIFVVDSNDRERVGEAREELMRMLAEDELRDAVLLIFANKQDLPN

SEQ ID NO: 123569 - protein, 181 aa, Heterodera glycines; identical to SEQ ID NO: 122559
  Homolog annotation: Hit_ID=CAE60901.1; Match level="QueryCoverage =94%, HitCoverage=51%, E-value=4e-45, Identity=54%"; Hit description =Hypothetical protein CBG04617 [Caenorhabditis briggsae]
  Gene Ontology: Cellular component=nucleus; Biological process=rRNA processing
  Essential gene: C elegans homolog=C15H11.9; Phenotype=Lva
  Coding regions on vcDNA: vcDNA=SeqID_49992; Strand=+; Position=91-636

SEQ ID NO: 123570 - protein, 84 aa, Heterodera glycines; identical to SEQ ID NO: 119578
  Homolog annotation: Hit_ID=NP_498579.2; Match level="QueryCoverage =98%, HitCoverage=94%, E-value=2e-28, Identity=69%"; Hit description =ribosomal Protein, Small subunit (9.7 kD) (rps-21) [Caenorhabditis elegans] gb|AAC48297.2| Ribosomal prot
  Gene Ontology: Biological process=cell differentiation
  Essential gene: C elegans homolog=F37C12.11; Phenotype=Emb
  Coding regions on vcDNA: vcDNA=SeqID_49993; Strand=+; Position=32-286

SEQ ID NO: 123571 - protein, 238 aa, Heterodera glycines; identical to SEQ ID NO: 122108
  Homolog annotation: Hit_ID=AAV34862.1; Match level="QueryCoverage =97%, HitCoverage=94%, E-value=9e-94, Identity=71%"; Hit description =ribosomal protein S6 [Bombyx mori]
  Gene Ontology: Cellular component=eukaryotic 48S initiation complex; Biological process=reproduction
  Essential gene: C elegans homolog=Y71A12B.1; Phenotype=Ste
  Coding regions on vcDNA: vcDNA=SeqID_49994; Strand=+; Position=19-735

SEQ ID NO: 123572 - protein, 139 aa, Heterodera glycines; identical to SEQ ID NO: 119931
  Homolog annotation: Hit_ID=NP_491926.1; Match level="QueryCoverage =98%, HitCoverage=99%, E-value=1e-28, Identity=46%"; Hit description =lipid Binding Protein LBP-6, adipocyte P2 family member (15.6 kD) (lbp-6) [Caenorhabditis elegans] gb|AAK
  Gene Ontology: Mol. function=lipid binding; Cellular component =cytoplasm; Biological process=lipid binding
  Essential gene: C elegans homolog=W02D3.7; Phenotype=Unc
  Coding regions on vcDNA: vcDNA=SeqID_49995; Strand=+; Position=80-499

SEQ ID NO: 123573 - protein, 149 aa, Heterodera glycines
  Homolog annotation: Hit_ID=AAP92328.1; Match level="QueryCoverage =93%, HitCoverage=49%, E-value=1e-26, Identity=43%"; Hit description =leucine zipper protein [Branchiostoma belcheri tsingtaunese]
  Essential gene: C elegans homolog=H38K22.2a; Phenotype=Emb
  Coding regions on vcDNA: vcDNA=SeqID_49996; Strand=+; Position=30-476
MNRLRRDQKEKVQQFVSFTQANEQTAITCLTASNWNLEMAGDMFYQNPSYTNQQVGGGTGGGADSRKIDHLFNKYASDAKDKAQKIGPDRIGPNGMVRFLRDLNIEPTSRAVMVLAWKMGAQKQCEFTVQEFRDGISTLIPTGTVDING

SEQ ID NO: 123574 - protein, 147 aa, Heterodera glycines
  Homolog annotation: Hit_ID=AAP92328.1; Match level="QueryCoverage =93%, HitCoverage=49%, E-value=4e-27, Identity=44%"; Hit description =leucine zipper protein [Branchiostoma belcheri tsingtaunese]
  Essential gene: C elegans homolog=H38K22.2a; Phenotype=Emb
  Coding regions on vcDNA: vcDNA=SeqID_49997; Strand=+; Position=47-487
MNRLRRDQKEKVQQFVSLTQANEQTAITCLTASNWDLEMACDMFYQNPSYTNQQVGATGGADSRKIEHLFNKYACDPKDKSQKIGPDRIGPNGMVRFLRDLNIEPTSRAVMVLAWKMGAQKQCEFTLQEFRDGISTLIPTGTVEING

SEQ ID NO: 123575 - protein, 440 aa, Heterodera glycines; identical to SEQ ID NO: 122558
  Homolog annotation: Hit_ID=CAE67052.1; Match level="QueryCoverage =98%, HitCoverage=82%, E-value=3e-93, Identity=42%"; Hit description =Hypothetical protein CBG12459 [Caenorhabditis briggsae]
  Gene Ontology: Biological process=positive regulation of body size
  Essential gene: C elegans homolog=B0511.8; Phenotype=Emb,Lva
  Coding regions on vcDNA: vcDNA=SeqID_49998; Strand=+; Position=95-1414

SEQ ID NO: 123576 - protein, 205 aa, Heterodera glycines
  misc_feature (176)..(176): Xaa can be any naturally occurring amino acid
  Homolog annotation: Hit_ID=AAB62321.1; Match level="QueryCoverage =98%, HitCoverage=35%, E-value=2e-56, Identity=55%"; Hit description =RanGTPase activating protein [Xenopus laevis] sp|O13066|RGP1_XENLA Ran GTPase-activating protein 1
  Gene Ontology: Mol. function=Ran GTPase activator activity; Cellular component=cytoplasm; Biological process=signal transduction
  Essential gene: C elegans homolog=C29E4.3a; Phenotype=Emb
  Coding regions on vcDNA: vcDNA=SeqID_49999; Strand=+; Position=32-646
MRVLSFAGLQLKLDTIGDGEKIAAKIRECAGLEVLEMRGNTLGVGATAPIAEALECQSNLKRALWSDMFTGRLKEEIPRTLKTLCDAMILSGARLTELDLSDNAIGPMAVPGIKEFLAGEAAFALKTLKLNNCGLGIAGKTIAHCLIECHRRSVSHGTPLCLKIFVARRNRLEYTXTAALAEAFQIIGTLEEISMPQNGISAEGI

SEQ ID NO: 123577 - protein, 145 aa, Heterodera glycines; identical to SEQ ID NO: 122556
  Homolog annotation: Hit_ID=NP_002680.2; Match level="QueryCoverage =93%, HitCoverage=22%, E-value=6e-13, Identity=34%"; Hit description =polymerase (DNA-directed), alpha (70kD) [Homo sapiens] gb|AAH02990.1| Polymerase (DNA-directed), alpha (7
  Gene Ontology: Cellular component=chromatin; Biological process=DNA replication
  Essential gene: C elegans homolog=R01H10.1; Phenotype=Emb
  Coding regions on vcDNA: vcDNA=SeqID_50000; Strand=+; Position=3-440

SEQ ID NO: 123578 - protein, 203 aa, Heterodera glycines
  Homolog annotation: Hit_ID=CAA70694.1; Match level="QueryCoverage =100%, HitCoverage=56%, E-value=1e-107, Identity=98%"; Hit description=cathepsin S-like cysteine proteinase [Heterodera glycines]
  Gene Ontology: Mol. function=cathepsin S activity; Cellular component= lysosome; Biological process=proteolysis and peptidolysis
  Essential gene: C elegans homolog=T03E6.7; Phenotype=Emb,Gro,Unc
  Coding regions on vcDNA: vcDNA=SeqID_50001; Strand=+; Position=41-649
MAFLSRLSILPNSPISLLAVSLAVLAFVALASANPPTARETAPNAQQNNANSVATGEIAKNIAEKMERMNEFINYFRAKKFIDAHNLAFEKGEVSFKVAPNHLMHFTPAQYNRIRGLQMRSNRQRHNMATLAGNSSTLPEKLDWREKGAVTEVKDQGDCGSCWAFSATGAIEGALAQKKASKIISLSEQNLVDCSSKYGNEGC

SEQ ID NO: 123579 - protein, 411 aa, Heterodera glycines
  misc_feature (69)..(69): Xaa can be any naturally occurring amino acid
  Homolog annotation: Hit_ID=CAE66968.1; Match level="QueryCoverage =88%, HitCoverage=58%, E-value=7e-60, Identity=36%"; Hit description =Hypothetical protein CBG12363 [Caenorhabditis briggsae]
  Gene Ontology: Mol. function=protein binding; Cellular component =lamin filament; Biological process=pronuclear envelope synthesis
  Essential gene: C elegans homolog=DY3.2; Phenotype=Emb
  Coding regions on vcDNA: vcDNA=SeqID_50002; Strand=+; Position=3-1239
QLEDEVLLRTELENRLHTAKDDLDFARRSHSNQIEEIRRKRQVEMTSFSDEVEHRYQAKLQEQLQAMRXYFDNRIAQNRAEVDELYRNKLGEAAENANRNRDLAAKAREEAAMWRVRVQDLENSSKDHQGIVESLNRRVKDLEAALRRAHEDADIRIQQRDEQIEQLQKEIALMISDYQDLLDVKVQLDTELQAYQKMLEQEETRLHITPSTSPNTSVVGQNISTPNMVISTPRPVSPRLATPVTQSESLTTVRRGVKRRRLNQDDIVSFDKTSSSWKSNGHSNGNLVIGEVDKEGQYVSVINKGKEDVAVGNWTLKSSAGGREVQYKFHSRQTVKAGKTLMVWSTNSGQEHQPPNNLVFKNQQWPHDDAIRTELLNADREVEAWNEAFLQHSFSSRVEEGTDIDKNCRIM

SEQ ID NO: 123580 - protein, 651 aa, Heterodera glycines
  misc_feature (47)..(47): Xaa can be any naturally occurring amino acid
  misc_feature (423)..(423): Xaa can be any naturally occurring amino acid
  Homolog annotation: Hit_ID=AAN78300.1; Match level="QueryCoverage =100%, HitCoverage=100%, E-value=0.0, Identity=99%"; Hit description =heat shock protein 70 A [Heterodera glycines]
  Gene Ontology: Mol. function=non-chaperonin molecular chaperone ATPase activity; Cellular component=intracellular; Biological process=reproduction
  Essential gene: C elegans homolog=F26D10.3; Phenotype=Lva,Ste
  Coding regions on vcDNA: vcDNA=SeqID_50003; Strand=+; Position=36-1990
MPAKANAIGIDLGTTYSCVGVFQHGKVEIIANDQGNRTTPSYVAFTXTERLIGDAAKNQVAMNPSNTVFDAKRLIGRKFDDPAVQSDMKHWPFKVVQGEGARPKVMVEVKGEDKAFFPEEVSSMVLIKMKETAEAFLGQTVTDAVVTVPAYFNDSQRQATKDAGTIAGLNVLRIINEPTAAAIAYGLDKKGQGERHVLIFDLGGGTFDVSILTIEDGIFEVKSTAGDTHLGGEDFDNRMVNHFVAEFKRKHKKDLSSNPRALRRLRTACERAKRTLSGSTQASIEIDSLFDGIDFYTNITRARFEELCADLFRNTMDPVEKALRDAKMDKSQIHDIVLVGGSTRIPKVQKLLSDFFSGKELNKSINPDEAVAYGAAVQAAILSGDKSETVQDLLLLDVAPLSLGIETAGGVMTSLIKRNTTIXPTKTSQTFTTYSDNQPGVLIQVYEGERAMTKDNNLLGKFELSGIPPAPRGVPQIEVTFDIDANGILNVSAQDKSTGKQNKITITNDKGRLSKEEIERMVQEAEKFSKEDEVQRDRVSAKNALESYCFNIKQTMEDSNLKDKISEDDKKKVLEKCGEVLAWLDANQAAEKEEFEHQQKELEGICNPIITKLYQAGGAMPGGPMPGGGMPGGGGAAGAGGAGGPTIEEVD

SEQ ID NO: 123581 - protein, 337 aa, Heterodera glycines
  Homolog annotation: Hit_ID=AAC47348.1; Match level="QueryCoverage =81%, HitCoverage=88%, E-value=1e-124, Identity=69%"; Hit description= cysteine protease precursor [Onchocerca volvulus]
  Gene Ontology: Mol. function=cysteine-type peptidase activity; Cellular component=extracellular space; Biological process =embryogenesis and morphogenesis
  Essential gene: C elegans homolog=F32B5.8; Phenotype=Emb
  Coding regions on vcDNA: vcDNA=SeqID_50004; Strand=+; Position=13-1026
MRCSHSLPLFLCFVLFAGLASLISARLAHESFAKHRHHSRGGAAARPEAAAGDQPQKRKSIYNSNKCYRQPSDAERVQKRTSMRLYEFDDYLFDELPETWDWRNVNGVNYASTDRNQHIPQYCGSCWAMGATSSLADRINIKRKNAWPPAYLSVQEVIDCSEAGSCEGGTPDKVFEYAHKNGIPHETCNNYQARDGKCDPYNRCGSCWPDKCFTVQNYTLYKVGDFGSANGIQKMKAEIYHHGPIACGVAATPRFDNYSGGIYKERTNEDINHVISVVGWGKDAASGVPYWIGRNSWGTAWGEQGWFRVVTSEYRDAGNKYNLKIEEDCTWGEPIII

SEQ ID NO: 123582 - protein, 162 aa, Heterodera glycines; identical to SEQ ID NO: 122554
  Homolog annotation: Hit_ID=CAE65142.1; Match level="QueryCoverage =96%, HitCoverage=80%, E-value=8e-65, Identity=73%"; Hit description =Hypothetical protein CBG10008 [Caenorhabditis briggsae]
  Gene Ontology: Mol. function=translation initiation factor activity; Cellular component=ribosome; Biological process=translational initiation
  Essential gene: C elegans homolog=T05G5.10; Phenotype=Emb
  Coding regions on vcDNA: vcDNA=SeqID_50005; Strand=+; Position=102-590

SEQ ID NO: 123583 - protein, 335 aa, Heterodera glycines
  misc_feature (223)..(223): Xaa can be any naturally occurring amino acid
  misc_feature (273)..(273): Xaa can be any naturally occurring amino acid
  Homolog annotation: Hit_ID=NP_502104.1; Match level="QueryCoverage =96%, HitCoverage=90%, E-value=8e-69, Identity=46%"; Hit description =adenosine kinase (37.4 kD) (4L974) [Caenorhabditis elegans] emb|CAB03230.1| Hypothetical protein R07H5.8
  Gene Ontology: Mol. function=adenosine kinase activity; Biological process=ribonucleoside monophosphate biosynthesis
  Essential gene: C elegans homolog=R07H5.8; Phenotype=Gro
  Coding regions on vcDNA: vcDNA=SeqID_50006; Strand=+; Position=64-1070
MDKNIGNKNNNEFLLLGMGNPLLDLQVATLDTQIHAKYGLAEDGADLINSENSASLLPIFDDISTLGNKIEFVPGGSAQNTVRVCQWMVKAFGVNLKSCYFFGAVGKDKYGQILHEKAQAANIEVRYQEVPTEKTGTCAVLVFGNKRSLVAHLGAAEHFTPVHLNIEANQSLIEKISNFYVEGYFLTVSLESILFLATHVISSTRPKHFALNLSAEYICQFFXDRLEKVLPYVDILFGNKQEALAYAKTREIGKTDVGDIALYLSEKEKVNGXRKRIVVITQGPLPVLVAHDCELTQFPVEPISEDKIVDTNGAGDAFCGGFLAAFSTGRSLDLC

SEQ ID NO: 123584 - protein, 142 aa, Heterodera glycines
  Homolog annotation: Hit_ID=CAE60322.1; Match level="QueryCoverage =88%, HitCoverage=59%, E-value=7e-30, Identity=48%"; Hit description =Hypothetical protein CBG03913 [Caenorhabditis briggsae]
  Gene Ontology: Cellular component=anaphase-promoting complex; Biological process=mitosis
  Essential gene: C elegans homolog=F15H10.3; Phenotype=Emb,Ste
  Coding regions on vcDNA: vcDNA=SeqID_50007; Strand=+; Position=128-553
MSVGLSSIVDDSHQRQSHFWAEILPPGVGHTNDISGDAIWTLSSCKEGLGVHQLLNDREDTYWQSDGLQPHSITIEFQRKTEVDFLLMFLDYKLDESYTPSKIQVQTGASVLDLDEPKSLSFTEPSGWQMIDLRHAGTKRPA

SEQ ID NO: 123585 - protein, 236 aa, Heterodera glycines
  misc_feature (145)..(145): Xaa can be any naturally occurring amino acid
  Homolog annotation: Hit_ID=JC4382; Match level="QueryCoverage=99%, HitCoverage=58%, E-value=1e-122, Identity=87%"; Hit description =ribosomal protein L3.e, cytosolic - Toxocara canis gb|AAA92285.1| ribosomal protein L3 sp|P49149|RL3_TOXCA 60
  Gene Ontology: Mol. function=structural constituent of ribosome; Cellular component=cytosolic large ribosomal subunit (sensu Eukarya); Biological process=protein biosynthesis
  Essential gene: C elegans homolog=F13B10.2a; Phenotype=Emb,Ste
  Coding regions on vcDNA: vcDNA=SeqID_50008; Strand=+; Position=1-712
IAHTQMKLMKHRNKKAHIMEIQINGGTVAEKVDWAREHFEKQVPVEQVFEQDEMIDCIGVTRGKGFKGVTSRWHCKKLPRKTHKGLRKVACIGAWHPSRVSFTVARAGQKGYHHRTEINKKIYRIGKSCLTADGKKNGMTDFDIXEKNINPMGGFPHYGLVNQDFLMIRGCCIGCKKRPITLRKTLIKQTKRFAFEKINLKFIDTSSKFGHGRFQTSAEKKTFMGKLKKDFLAESA

SEQ ID NO: 123586 - protein, 170 aa, Heterodera glycines
  Homolog annotation: Hit_ID=NP_490748.1; Match level="QueryCoverage =88%, HitCoverage=79%, E-value=2e-14, Identity=31%"; Hit description =putative nuclear protein of fungal and metazoan origin (21.7 kD) (1B7) [Caenorhabditis elegans] gb|AAK299
  Essential gene: C elegans homolog=Y65B4BR.8; Phenotype=Emb,Pvl
  Coding regions on vcDNA: vcDNA=SeqID_50009; Strand=+; Position=3-512
SLPSSSSVIFQQFTIDQRHFVDEDYFSLESIFATNTNICCTFESKTPPALFPLLGRKVFEVISEKGYRANVPAWLVPAVDHICSFAVPTVYNSVNRDVIHAGAQSVNLEQLQRHYYTLGTFICRLVPGEQAQHIALALLSAFTQRIGRIVRDCTNTGAKPTRLDETEKRI

SEQ ID NO: 123587 - protein, 157 aa, Heterodera glycines
  Homolog annotation: Hit_ID=NP_498047.1; Match level="QueryCoverage =100%, HitCoverage=13%, E-value=5e-66, Identity=75%"; Hit description= RNA polymerase II subunit (3G33) [Caenorhabditis elegans] gb|AAA21158.1| Hypothetical protein C26E6.4 [C
  Gene Ontology: Mol. function=DNA binding; Cellular component=DNA -directed RNA polymerase II, core complex; Biological process =transcription from Pol II promoter
  Essential gene: C elegans homolog=C26E6.4; Phenotype=Emb
  Coding regions on vcDNA: vcDNA=SeqID_50010; Strand=+; Position=1-471
AIVAILSYGGYNQEDSVIMNQAGIDRGLFRSVFYRSYRDSEQEIDNVNEQLIEKPTRDKCKGMRNAIYEKLDDDGITSPGTRVSGDDVIIGKTIALPEVEDELEASTARYSKKDASTTLRSSETGIVDQVMVSVNAEGNKFVKIRVRSIRTPQIGDK

SEQ ID NO: 123588 - protein, 215 aa, Heterodera glycines; identical to SEQ ID NO: 122795
  Homolog annotation: Hit_ID=NP_079920.1; Match level="QueryCoverage =88%, HitCoverage=93%, E-value=4e-35, Identity=44%"; Hit description =exosome component 1 [Mus musculus] gb|AAH24423.1| Exosome component 1 [Mus musculus] sp|Q9DAA6|CSL4_MOUSE
  Gene Ontology: Mol. function=protein binding; Cellular component =nuclear exosome (RNase complex); Biological process=rRNA processing
  Essential gene: C elegans homolog=Y48A6B.5; Phenotype=Gro
  Coding regions on vcDNA: vcDNA=SeqID_50011; Strand=+; Position=26-670

SEQ ID NO: 123589 - protein, 155 aa, Heterodera glycines
  Homolog annotation: Hit_ID=CAE62219.1; Match level="QueryCoverage =84%, HitCoverage=20%, E-value=7e-39, Identity=58%"; Hit description =Hypothetical protein CBG06270 [Caenorhabditis briggsae]
  Gene Ontology: Mol. function=transporter activity; Cellular component= mitochondrion; Biological process=transport
  Essential gene: C elegans homolog=C42C1.10; Phenotype=Emb
  Coding regions on vcDNA: vcDNA=SeqID_50012; Strand=+; Position=1-465
VGLNRKDSSESQEPGLHPFQYVQAGFFTGVATRAIIQPFDVLKIRLQLQEEPLRGKSRGKYSGIFQSAKLIYHEEGIAAFWRGHIPAQGLSIVYGLVQFCTFELLTKQAGDFGFHNFSKSVDFVCGASAGCLATTCAMPFDVVRTRMVAQGAHRT

SEQ ID NO: 123590 - protein, 157 aa, Heterodera glycines; identical to SEQ ID NO: 122476
  Homolog annotation: Hit_ID=NP_506598.1; Match level="QueryCoverage =81%, HitCoverage=92%, E-value=4e-13, Identity=33%"; Hit description =putative cytoplasmic protein (16.5 kD) (5P4) [Caenorhabditis elegans] emb|CAB03983.1| Hypothetical protei
  Essential gene: C elegans homolog=C53A5.1; Phenotype=Emb,Lva
  Coding regions on vcDNA: vcDNA=SeqID_50013; Strand=+; Position=27-500

SEQ ID NO: 123591 - protein, 145 aa, Heterodera glycines
  Homolog annotation: Hit_ID=CAE62849.1; Match level="QueryCoverage =70%, HitCoverage=32%, E-value=6e-37, Identity=63%"; Hit description =Hypothetical protein CBG07028 [Caenorhabditis briggsae]
  Gene Ontology: Cellular component=cytoplasm
  Essential gene: C elegans homolog=Y43H11AL.2; Phenotype=Clr,Pch
  Coding regions on vcDNA: vcDNA=SeqID_50014; Strand=+; Position=12-446
MLFRYFPLLNEYSAHKLFLTLFPSTGSEMVRGNPHLPIIVGKEHCSNGTKWILNVFGDCVDTPMKMCGFWVGLMSLFLWLIPLFPQLYENFRNKRCEGLSIFFLMFWFIGDSCNMIGAVLTHQQPLQQIIGVYYILQDLALLGQF

SEQ ID NO: 123592 - protein, 1024 aa, Heterodera glycines
  misc_feature (81)..(81): Xaa can be any naturally occurring amino acid
  misc_feature (152)..(152): Xaa can be any naturally occurring amino acid
  Homolog annotation: Hit_ID=Q94637; Match level="QueryCoverage=73%, HitCoverage=41%, E-value=2e-72, Identity=25%"; Hit description =Vitellogenin 6 precursor gb|AAB49749.1| vitellogenin pir||T18561 vitellogenin vit-6 [similarity] - Oscheius sp
  Essential gene: C elegans homolog=C04F6.1; Phenotype=Emb,Gro
  Coding regions on vcDNA: vcDNA=SeqID_50015; Strand=+; Position=7-3083
MAILQNLNEKEAKIPTSVGVQLRILNSMPILANIEGQMKIKAESASLMSPLGIQFDVNTLASARLSQIQKMELWTPFASSXVESVRSAQVNLPLQAELNANSDQGISLKANLPKQKTQLASVHSLPITFTAKVDQNTKLVARAAPNRHHPRXKLERQQYELNSVQGQKNLAMPLHFRGHYHWPAEPTSYQQFAQLLLATENAVNIHYQPSRESPREAIFRVTGQHFEQLAQSEQPDAQLRNFFSEKFANAYSCDDEQCQQRGDCEQCEQIEQQQREDAQELEDQQMRQQSLHSFISAYKPRQQYKHSLKMVAQTNGGAKDAKAQGDIQAICDEQTAYCKVLVKVERPPIGNENQKWMLNAQAHVLMPETAASVEQLQTQPKQLKQFIAQAKAQWGQQGQQTQQVNIRVHGAQAHTQQVRAVLQQQQGSQLISAQHLRNMQRRSAFLNKFQIEAIYSLKANAQNAINRVLELFKSAYFWNTKSQLMSGQSAQKDGKIAATILIDPVTQKSANITIRTPAQQLRMEQIEVPYKVRPFALIRQRSAQQTHSLAQLFHQFSIKYRPQCTVDGRKVNTFDELIYTAPLSSNCYSVVAKDCGSDQPQFVVLMKKVAQQQQQQQTNKRAQNAAKVLKVITPEQQIECHPKTNAAGIPTQLICKVNGQQVTGDEQCQDSSSCVQFNNKQQDDVTIQTEAIAVRFNGRKAWLKVSQAYKNTQCGLCGHYDDSDDQGEELRMANGQRASDLAEFHRSYALEDAEECPQQVMNNFYSEQQQQNSEQDTFYGQFNQFEDEDEADDEQQQQSEKDEWQNEQFNGQFEEQNDGQVTDGGNPFEGIFNDQQQQQKCCCCCDDDEDEEGTNEQSQCRQNCQNGGECPEKCNKNDQKQCRKSSPPQPQQQQNCKGSDDEQCKGICNDGDEACAEQQQQWKAVWPILRTKTHEQNHAVCFSTRPVKHCPPDAYPYNPMNGYEQQQQPKTKKVSFVCMERAEPETRRLLRSLRRGQRVVDVNARGASFTENVSEPHQCWRRRY

SEQ ID NO: 123593 - protein, 245 aa, Heterodera glycines
  Homolog annotation: Hit_ID=CAE56899.1; Match level="QueryCoverage =95%, HitCoverage=59%, E-value=1e-69, Identity=54%"; Hit description =Hypothetical protein CBG24740 [Caenorhabditis briggsae]
  Gene Ontology: Mol. function=acetyl-CoA C-acetyltransferase activity; Cellular component=mitochondrion; Biological process=lipid metabolism
  Essential gene: C elegans homolog=T02G5.7; Phenotype=Bmd,Unc
  Coding regions on vcDNA: vcDNA=SeqID_50016; Strand=+; Position=170-904
MSSPPSSVLPQDVFILSAVRTPIASFRSSFASLNAVDLGTFVATEAIQRAGLRPDQVEETVTGCVLSAGSGQNVSRQIAIKSGIPEARQAYTVNKVCSSSLKALILGTQSVQLGQRSMVLVVGVESMSQAPFYLARGDNNYGDIKLLDSIQRDGISDAMLGQPMGVCAEKTVAEFGFTREQQDAYALASYARATRAWAGGAFGAEIVPVKVKQRKGTELLVAEDEEYRRLMPDKVPSLQPAFVKD

SEQ ID NO: 123594 - protein, 172 aa, Heterodera glycines; identical to SEQ ID NO: 122544
  Homolog annotation: Hit_ID=AAL40718.1; Match level="QueryCoverage =99%, HitCoverage=98%, E-value=1e-80, Identity=88%"; Hit description =myosin regulatory light chain [Meloidogyne incognita]
  Gene Ontology: Mol. function=structural constituent of muscle; Cellular component=muscle myosin; Biological process=regulation of muscle contraction
  Essential gene: C elegans homolog=C36E6.3; Phenotype=Gro,Unc
  Coding regions on vcDNA: vcDNA=SeqID_50017; Strand=+; Position=77-595

SEQ ID NO: 123595 - protein, 115 aa, Heterodera glycines; identical to SEQ ID NO: 122755
  Homolog annotation: Hit_ID=NP_035423.1; Match level="QueryCoverage =99%, HitCoverage=97%, E-value=6e-42, Identity=69%"; Hit description =polymerase (RNA) II (DNA directed) polypeptide J [Mus musculus] sp|O08740|RPBY_MOUSE DNA-directed RNA pol
  Gene Ontology: Mol. function=DNA-directed RNA polymerase activity; Cellular component=DNA-directed RNA polymerase II, core complex; Biological process=transcription from Pol II promoter
  Essential gene: C elegans homolog=W01G7.3; Phenotype=Emb,Gro,Pvl
  Coding regions on vcDNA: vcDNA=SeqID_50018; Strand=+; Position=449-796

SEQ ID NO: 123596 - protein, 114 aa, Heterodera glycines
  Homolog annotation: Hit_ID=XP_221241.2; Match level="QueryCoverage =92%, HitCoverage=36%, E-value=2e-11, Identity=37%"; Hit description =similar to Tceb2 protein [Rattus norvegicus]
  Gene Ontology: Mol. function=protein binding; Biological process=RNA elongation from Pol II promoter
  Essential gene: C elegans homolog=Y41C4A.10; Phenotype=Emb
  Coding regions on vcDNA: vcDNA=SeqID_50019; Strand=+; Position=1-345
LRKKQHLLVQARENWTAKDLKRVVEGILKVPPEKQSLYKPTNEQRTEWEAMDEKQTLHELGFTMKNARADGPAVLALVLPEDGKSPDIVPMTVAPPVPEAMAQNKQSEVEMVEE

SEQ ID NO: 123597 - protein, 118 aa, Heterodera glycines
  Homolog annotation: Hit_ID=CAE64681.1; Match level="QueryCoverage =96%, HitCoverage=94%, E-value=1e-46, Identity=83%"; Hit description =Hypothetical protein CBG09459 [Caenorhabditis briggsae]
  Gene Ontology: Mol. function=structural constituent of ribosome; Cellular component=cytosolic small ribosomal subunit (sensu Eukarya); Biological process=protein biosynthesis
  Essential gene: C elegans homolog=K02B2.5; Phenotype=Gro
  Coding regions on vcDNA: vcDNA=SeqID_50020; Strand=+; Position=40-396
MPPKASKKTDPKGGKAAPAKKKEGGGGGKAKKKKWSKGKVRDKLANMVLFDQATYDKLYKEIISVKLITPSVVSERLKVRASLAKAGLEELHQKGLIKCVVKHGSQLVYTRATKAEEA

SEQ ID NO: 123598 - protein, 136 aa, Heterodera glycines; identical to SEQ ID NO: 122101
  Homolog annotation: Hit_ID=NP_491928.1; Match level="QueryCoverage =97%, HitCoverage=97%, E-value=4e-27, Identity=45%"; Hit description =lipid Binding Protein LBP-5, adipocyte P2 family member (15.5 kD) (lbp-5) [Caenorhabditis elegans] gb|AAK
  Gene Ontology: Mol. function=lipid binding; Cellular component =cytoplasm; Biological process=lipid binding
  Essential gene: C elegans homolog=W02D3.7; Phenotype=Unc
  Coding regions on vcDNA: vcDNA=SeqID_50021; Strand=+; Position=44-454

SEQ ID NO: 123599 - protein, 249 aa, Heterodera glycines
  Homolog annotation: Hit_ID=CAE57721.1; Match level="QueryCoverage =82%, HitCoverage=32%, E-value=6e-09, Identity=25%"; Hit description =Hypothetical protein CBG00731 [Caenorhabditis briggsae]
  Essential gene: C elegans homolog=F10B5.6; Phenotype=Emb
  Coding regions on vcDNA: vcDNA=SeqID_50022; Strand=+; Position=81-830
MISRMASSSCSSPSSSSKFGPQMKCSTPKPVPMDDDGTEEGDHGEQLLLDRHELRILCDEHLQSGDCQTAAFWAEKLLALSIGRTLNERLPDIAHYLSVLTAAQFWQTIITLIERHDLFPKHLVFAFFHINALFHRELYSEIIALPVGYLCHWDDVPFIQPDSATYICAENDAVREPGIRQQLDTLLREKKYESRMLLLLAKTYLMVQNRPAAAGCLKPPEFSKATSSRCCTLRWSTVLPTISSWPPTF

SEQ ID NO: 123600 - protein, 360 aa, Heterodera glycines
  Homolog annotation: Hit_ID=XP_415408.1; Match level="QueryCoverage =76%, HitCoverage=41%, E-value=3e-13, Identity=26%"; Hit description =PREDICTED: similar to 26S proteasome non-ATPase regulatory subunit 5 (26S proteasome subunit S5B) (26S pr
  Gene Ontology: Cellular component=26S proteasome
  Essential gene: C elegans homolog=F35G12.12; Phenotype=Emb
  Coding regions on vcDNA: vcDNA=SeqID_50023; Strand=+; Position=1-1080
VHLSEKCTWENKQGEKQAETRAQLKDDAFLREIHSRLKPGIENSERRFDVHKFTCAALELPDFSDFARLRPLIDALIAELDLNDFLGCTAALEMLAETAATAPKCVPFFGQIGLLDKVYALFIRTKEEPDMGIIHIACIRFFAYLCTTDDNALTKFPKFTADVFDAVFRFDAFDVTRRQLAFETLAVISSTSGAKQIFSQNETLYNMQRAMSNLAVAVATAAEPSLKARHLEAVRMFFDRIADESGCQPEQKCTTASAEAEEQLLHRWFRWLGEPFPRLLLQCVRDPISEVQLAALRVLMALTRHQWAYAHFCAITDFVNLLVDRSVNFDADAMQLKYALICRLVEAAPSALNDGQMEML

SEQ ID NO: 123601 - protein, 164 aa, Heterodera glycines
  Homolog annotation: Hit_ID=CAE74453.1; Match level="QueryCoverage =93%, HitCoverage=100%, E-value=8e-60, Identity=67%"; Hit description= Hypothetical protein CBG22194 [Caenorhabditis briggsae]
  Gene Ontology: Mol. function=RNA cap binding; Cellular component =nucleus; Biological process=snRNA-nucleus export
  Essential gene: C elegans homolog=F26A3.2; Phenotype=Lva
  Coding regions on vcDNA: vcDNA=SeqID_50024; Strand=+; Position=5-499
MVLDPKSKDKARELGSYRDMRFEGSLPEQERRLAQSTTLYIGNLSYFTSEEQVWELFRRAGDVRRVIMGLDRFNKTPCGFCFVEYYTREDAENALRYISGTRLDDRVVRCDWDAGFKEGRQFGRGKHGGQVRDEYRQNFDSGRGGWNKTIQKRNDQFTQRNIKA

SEQ ID NO: 123602 - protein, 315 aa, Heterodera glycines
  misc_feature (28)..(28): Xaa can be any naturally occurring amino acid
  misc_feature (57)..(57): Xaa can be any naturally occurring amino acid
  Homolog annotation: Hit_ID=CAE66855.1; Match level="QueryCoverage =96%, HitCoverage=96%, E-value=1e-104, Identity=55%"; Hit description= Hypothetical protein CBG12227 [Caenorhabditis briggsae]
  Gene Ontology: Mol. function=oxidoreductase activity; Cellular component=endoplasmic reticulum; Biological process=positive regulation of body size
  Essential gene: C elegans homolog=C25A1.5; Phenotype=Sck,Sma
  Coding regions on vcDNA: vcDNA=SeqID_50025; Strand=+; Position=68-1017
MNREETNKHPLIVTYAGRHYDISGFVSXHPGGERVLRMVAGANVDSFIDGTSELLGXRHEHSAAAYGILARYSLDQEFKRDPLVDSKAPMLWRVGELRERYWTWIHHPYDGVLRLFESDLLEQLTRTKWWLIPLIWLPIVSYFFFTGLSLLREDFGFSGGPLLAFGLFAFGCLAWTLLEYSLHRGLFHWHPNAHSYRQITLHFLLHGLHHKTPMDSDRLVFPPAAAVLIVGFFYTIYRSLLPFPIFCCFASGKLFGYIVYDITHYYLHHGRPETNSGWHYRKIYHHNHHFKDSDSSFGISTTFWDYVFGTVGTFN

SEQ ID NO: 123603 - protein, 321 aa, Heterodera glycines
  Homolog annotation: Hit_ID=ZP_00193853.1; Match level="QueryCoverage =96%, HitCoverage=89%, E-value=3e-92, Identity=55%"; Hit description =COG2017: Galactose mutarotase and related enzymes [Mesorhizobium sp. BNC1]
  Gene Ontology: Biological process=carbohydrate metabolism
  Essential gene: C elegans homolog=C01B4.6; Phenotype=Bmd,Lva
  Coding regions on vcDNA: vcDNA=SeqID_50026; Strand=+; Position=47-1009
MPMLAHFGSFQGQDVFECQLRSESGVVVKVISFGAIIRDWLVPTPQDQLRSVVLGFDSFENYVEHSPFFGAIVGRVANRIGRARFTVDGKEFLLAPNEGKNQLHGGTETFGRKVWKMEPLCDNAAAKWPSGVRLSLESADGEGTFPGNLRVSVTYRLTTNKLRMDIEATSDLPCPVNIVQHNYFNLSGHGDIREHSLKLAADWFTPTSSDQIPTGEILTVSGTELDFREEKKLQTKDGKPIELDHNFVLTKGKGTDAQIAAVLRAPDNSLALTLRSNQPGLQVYTSKSLSVPVPGLYGQRYAKFGGICLEDQNFPDAVNHE

SEQ ID NO: 123604 - protein, 269 aa, Heterodera glycines
  Homolog annotation: Hit_ID=NP_493558.1; Match level="QueryCoverage =99%, HitCoverage=93%, E-value=3e-77, Identity=55%"; Hit description =proteasome Beta Subunit (31.2 kD) (pbs-5) [Caenorhabditis elegans] emb|CAB04567.1| Hypothetical protein K
  Gene Ontology: Mol. function=endopeptidase activity; Cellular component=proteasome core complex (sensu Eukarya); Biological process=embryonic cleavage
  Essential gene: C elegans homolog=K05C4.1; Phenotype=Emb
  Coding regions on vcDNA: vcDNA=SeqID_50027; Strand=+; Position=47-853
MFYHDLHDNENSHDKELKQLVQMDDLAIPKFVMPPLGIKPKKFVRKHFGPNSRLPMAQFLKGTTTLSFVYKPKTPQDKGGVIVAVDSRATGGTYISSKTVEKIIPINDQLVATMAGGAADCQYWTRVVSKYCNLFELREGTQISVAAASKYFANVMYDYRGQELGVHSMVCGVDKFGPSIYMVEAEGTRVKIDTICSLGSGMLHAMSILDTKYKEAMTDAEALELGREAIVYATFRDAASGGHCNLCHITSEGKTIYPPFDVNDKYYEF

SEQ ID NO: 123605 - protein, 143 aa, Heterodera glycines
  Homolog annotation: Hit_ID=NP_956159.1; Match level="QueryCoverage =99%, HitCoverage=74%, E-value=2e-72, Identity=90%"; Hit description =cell division cycle 42 homolog [Danio rerio] gb|AAH75761.1| Zgc:55427 protein [Danio rerio] gb|AAH48035.1
  Gene Ontology: Mol. function=signal transducer activity; Cellular component=shmoo tip; Biological process=signal transduction
  Essential gene: C elegans homolog=R07G3.1; Phenotype=Emb
  Coding regions on vcDNA: vcDNA=SeqID_50028; Strand=+; Position=54-482
MMQTIKCVVVGDGAVGKTCLLISYTTNKFPNEYVPTVFDNYAVTVMIGGEPYTLGLFDTAGQEDYDRLRPLSYPQTDVFLVCFSVVTPASFENIKEKWVPEITHHCSKTPFLLVGTQVDLREDAGTCEKLAKNKMRPISAETG

SEQ ID NO: 123606 - protein, 224 aa, Heterodera glycines; identical to SEQ ID NO: 122152
  Homolog annotation: Hit_ID=NP_524808.2; Match level="QueryCoverage =98%, HitCoverage=83%, E-value=6e-58, Identity=51%"; Hit description =CG6341-PA [Drosophila melanogaster] gb|AAF57941.2| CG6341-PA [Drosophila melanogaster]
  Gene Ontology: Mol. function=translation elongation factor activity; Cellular component=eukaryotic translation elongation factor 1 complex; Biological process=translational elongation
  Essential gene: C elegans homolog=F54H12.6; Phenotype=Lva
  Coding regions on vcDNA: vcDNA=SeqID_50029; Strand=+; Position=54-728

SEQ ID NO: 123607 - protein, 342 aa, Heterodera glycines
  misc_feature (150)..(150): Xaa can be any naturally occurring amino acid
  Homolog annotation: Hit_ID=AAC79129.1; Match level="QueryCoverage =95%, HitCoverage=100%, E-value=1e-174, Identity=94%"; Hit description=glyceraldehyde-3-phosphate-dehydrogenase [Globodera rostochiensis] sp|O16027|G3P1_GLORO Glyceraldehyde-3
  Gene Ontology: Mol. function=glyceraldehyde 3-phosphate dehydrogenase (phosphorylating) activity; Cellular component=cytoplasm; Biological process=glycolysis
  Essential gene: C elegans homolog=K10B3.7; Phenotype=Unclassified
  Coding regions on vcDNA: vcDNA=SeqID_50030; Strand=+; Position=83-1109
MVKPKVGINGFGRIGRLALRAAIEKDTVQVVAVNDPFIELDYMVYMFNYDSTHGRFKGKISTNAGNLVVEKEGKSAHTIKVFNLKDPAEIKWGEAGAEYVIESTGVFTTIEKASAHLKGGAKKVVISAPSADAPMYVMGVNEDKYDPAKXDDVISNASCTTNCLAPLAKVINDEFGIIEGLMTTVHAVTATQKTVDGPSGKQWRDGRGAAQNIIPASTGAAKAVGKVIPELNGKLTGMAFRVPTPNVSVVDLTARLEKPAPLDAIKEAVKKAANGKLKGILAYTEDQVVSTDFLGDSHSSIFDAGACISLNPHFVKLVSWYDNEFGYSCRLVDLITHCASKA

SEQ ID NO: 123608 - protein, 241 aa, Heterodera glycines
  misc_feature (161)..(161): Xaa can be any naturally occurring amino acid
  misc_feature (235)..(235): Xaa can be any naturally occurring amino acid
  Homolog annotation: Hit_ID=NP_502087.1; Match level="QueryCoverage =98%, HitCoverage=68%, E-value=2e-94, Identity=71%"; Hit description =phosphate carrier protein, mitochondrial precursor (36.7 kD) (4L912) [Caenorhabditis elegans] emb|CAA9743
  Gene Ontology: Mol. function=phosphate carrier activity; Cellular component=integral to plasma membrane; Biological process=transport
  Essential gene: C elegans homolog=F01G4.6; Phenotype=Emb,Lva
  Coding regions on vcDNA: vcDNA=SeqID_50031; Strand=+; Position=67-789
MVGITELAEATKKAFGAGPLIAANCATAENAKSGNEVEFGSMKFYGLCGIGGILSCGITHTAIVPLDLVKCRIQVDPAKYKGIIGGFKVTLQEEGVRGLAKGWAPTAIGYSMQGLGKFGLYEMFKNVYAGMIGEELAYSCRTYLYLAASASAEFFADMMLXAPMEATKVRIQTSAGAPPTLRGCAPFIYRTEGLMGFYKGLPPLWMRQIPYTMMKFACFERTVELLYKHVVPKPXAECTQA

SEQ ID NO: 123609 - protein, 144 aa, Heterodera glycines; identical to SEQ ID NO: 122506
  Homolog annotation: Hit_ID=CAE63532.1; Match level="QueryCoverage =75%, HitCoverage=87%, E-value=3e-16, Identity=39%"; Hit description =Hypothetical protein CBG08012 [Caenorhabditis briggsae]
  Gene Ontology: Biological process=gametogenesis
  Essential gene: C elegans homolog=Y40B1B.7; Phenotype=Gro,Stp
  Coding regions on vcDNA: vcDNA=SeqID_50032; Strand=+; Position=5-439

SEQ ID NO: 123610 - protein, 430 aa, Heterodera glycines
  Homolog annotation: Hit_ID=NP_508479.1; Match level="QueryCoverage =92%, HitCoverage=61%, E-value=1e-129, Identity=57%"; Hit description= immunoglobulin-like, possibly N-myristoylated (68.5 kD) (XD318) [Caenorhabditis elegans] pir||T16777 hyp
  Essential gene: C elegans homolog=T02C5.3; Phenotype=Unclassified
  Coding regions on vcDNA: vcDNA=SeqID_50033; Strand=+; Position=10-1299
MPPLSPPQLFFPAFLLLGHFLPPFAHGQLPSAMLPAPSTSQLQVKISNLPVHVATAQHLPQLVWRVVGRQATERVFCVSEAPVSQLRFVCVDCVQKNITDLVDYLNTAQDSTRIATSPAVELPPVDANPSWTGATIICQAAVNGGTKDSPPSVVDVQYLRGVHVVDSNGQGPVHIPNQGFRFYVECVRGTDGQCQQSAARRKTLHCAVQANPAANSFRWLKNGGPISGGNGPEFMIGTDMIGHSLQCAANNGLYGEELQSPAVYIDSYTAARLIQDNFQQVQSSAPFQQGNRVEMGQRVQMSCVVEGNPRPAVFWKLRRSNGQVVDAPCPQGLNGQYREVPPTQLPTGAAAVANSLAAQQSNSLIRLQAICDLQVANYSFSGQYWCSACSYVSQGLPECSPGQDAPGDRLLNIQVQGPPQQSETEPSVEQ

SEQ ID NO: 123611 - protein, 251 aa, Heterodera glycines; identical to SEQ ID NO: 122498
  Homolog annotation: Hit_ID=NP_492765.1; Match level="QueryCoverage =100%, HitCoverage=100%, E-value=5e-86, Identity=64%"; Hit description=proteasome Alpha Subunit (27.2 kD) (pas-5) [Caenorhabditis elegans] emb|CAB02097.1| Hypothetical protei
  Gene Ontology: Mol. function=endopeptidase activity; Cellular component=26S proteasome; Biological process=proteolysis and peptidolysis
  Essential gene: C elegans homolog=F25H2.9; Phenotype=Emb,Lva
  Coding regions on vcDNA: vcDNA=SeqID_50034; Strand=+; Position=73-828

SEQ ID NO: 123612 - protein, 321 aa, Heterodera glycines; identical to SEQ ID NO: 122434
  Homolog annotation: Hit_ID=NP_501859.1; Match level="QueryCoverage =99%, HitCoverage=97%, E-value=1e-139, Identity=73%"; Hit description= guanine nucleotide-binding protein -like (35.8 kD) (4K941) [Caenorhabditis elegans] emb|CAA93514.1| Hypo
  Gene Ontology: Cellular component=cytoplasm; Biological process =signal transduction
  Essential gene: C elegans homolog=K04D7.1; Phenotype=Gro,Slu
  Coding regions on vcDNA: vcDNA=SeqID_50035; Strand=+; Position=57-1022

SEQ ID NO: 123613 - protein, 209 aa, Heterodera glycines
  Homolog annotation: Hit_ID=NP_497890.1; Match level="QueryCoverage =100%, HitCoverage=55%, E-value=3e-68, Identity=56%"; Hit description= swi Snf related matrix associated actin dependent regulator of chromatin subfamily b member 1 (42.8 kD)
  Gene Ontology: Biological process=embryogenesis and morphogenesis
  Essential gene: C elegans homolog=R07E5.3; Phenotype=Emb
  Coding regions on vcDNA: vcDNA=SeqID_50036; Strand=+; Position=3-629
KTYGPRPESFTLDDGERYYVGADVGQYLKYHRGTLYKRYPQLWKRMASVEEKKKIQELGCATSYINSNIMLVKANEVEDIFDGQEEKYRASVSGGSAYGRAEGAQTLRSRGSAPWLNQQVTSGSHHLESVPCSTPSAHGRGHFKNRDYAYVADDLESYRRVMENAQAGECLVPIRLDMELDNIKLRDCFCYNKNDKLITPEMVAEVLCE

SEQ ID NO: 123614 - protein, 211 aa, Heterodera glycines
  misc_feature (192)..(192): Xaa can be any naturally occurring amino acid
  Homolog annotation: Hit_ID=NP_497890.1; Match level="QueryCoverage =99%, HitCoverage=53%, E-value=3e-62, Identity=54%"; Hit description =swi Snf related matrix associated actin dependent regulator of chromatin subfamily b member 1 (42.8 kD) (
  Gene Ontology: Biological process=embryogenesis and morphogenesis
  Essential gene: C elegans homolog=R07E5.3; Phenotype=Emb
  Coding regions on vcDNA: vcDNA=SeqID_50037; Strand=+; Position=20-652
MFKTYGPRPESFTLDDGERYYVGADVGQYLKYHRGTLYKRYPQLWKRMASVEEKKKIQELGCATSYINSNIMLVKANEVEDIFDGQEEKYRASVSGGSAYGRAEGAQTLRSRGSAPWLNQQVAQKTNVTSGSHHLESVPCSTPSAHGRGHFKNRDYAYVADDLESYRRVMENAQAGECLVPIRLDMELDNIXLRDCFCYNKNDKLITPEMV

SEQ ID NO: 123615 - protein, 385 aa, Heterodera glycines
  misc_feature (376)..(376): Xaa can be any naturally occurring amino acid
  Homolog annotation: Hit_ID=CAE57680.1; Match level="QueryCoverage =100%, HitCoverage=79%, E-value=1e-151, Identity=67%"; Hit description=Hypothetical protein CBG00674 [Caenorhabditis briggsae]
  Gene Ontology: Mol. function=chaperone activity; Cellular component =actin filament; Biological process=cell organization and biogenesis
  Essential gene: C elegans homolog=K01C8.10; Phenotype=Emb,Lva,Ste
  Coding regions on vcDNA: vcDNA=SeqID_50038; Strand=+; Position=25-1178
MSPSLSVANSNVSRQLGQPKVAGFKDKDKPESVRTSNIVAAKAVADALVELSKAQDIEAGDGTTTVVVLAGSLLDAAEKLLAKGIHPTTISDSFQRAATFSEKVLEEMATPIDINDDDELVKLAMTSLNSKVVSQHSHLLAPMAVQAVKKLMSSPEDSSVNLKLIKVVKKLGETVEESQLIEGALIDQKSMGHGGPARVEKAKIGLIQFQISPPKPNMENQVVISDYAQMDRALKEERNYILELCKQIKKAGCNVLLIQKSILRDAINEMALHFFAKMKIMVIKDIERDDIEFYAKILGCRPVASVDHFVPESLGTADLVEEIETADGKVLKVTGLKQSGCAVSILVRGSSKLVLDEAERSLHDALCVIRCLVKNXALLTGRGAP

SEQ ID NO: 123616 - protein, 159 aa, Heterodera glycines; identical to SEQ ID NO: 122132
  Homolog annotation: Hit_ID=CAE74519.1; Match level="QueryCoverage =100%, HitCoverage=100%, E-value=2e-45, Identity=57%"; Hit description=Hypothetical protein CBG22273 [Caenorhabditis briggsae]
  Gene Ontology: Mol. function=structural constituent of ribosome; Cellular component=cytosolic ribosome (sensu Eukarya); Biological process=reproduction
  Essential gene: C elegans homolog=D1007.12; Phenotype=Emb,Lva,Ste
  Coding regions on vcDNA: vcDNA=SeqID_50039; Strand=+; Position=40-519

SEQ ID NO: 123617 - protein, 161 aa, Heterodera glycines
  misc_feature (94)..(94): Xaa can be any naturally occurring amino acid
  misc_feature (113)..(113): Xaa can be any naturally occurring amino acid
  Homolog annotation: Hit_ID=CAE74519.1; Match level="QueryCoverage =100%, HitCoverage=100%, E-value=2e-42, Identity=56%"; Hit description=Hypothetical protein CBG22273 [Caenorhabditis briggsae]
  Gene Ontology: Mol. function=structural constituent of ribosome; Cellular component=cytosolic large ribosomal subunit (sensu Eukarya); Biological process=reproduction
  Essential gene: C elegans homolog=D1007.12; Phenotype=Emb,Lva,Ste
  Coding regions on vcDNA: vcDNA=SeqID_50040; Strand=+; Position=43-525
MKTETCVYSGYKIHPGHGKRVVRADGKIQIYLSKKAQRGAALKRNPRDVPWTVLYRRKHKKGVHAEEGTQRKRVKRTVQIASRPIADLTVEALXLAQRNQKPEFRKQQRDAGXIKAAKESARVKKDETKKKQQKIDKKAAPTKTKAAKQVKAPKQFVGGKR

SEQ ID NO: 123618 - protein, 238 aa, Heterodera glycines
  misc_feature (155)..(155): Xaa can be any naturally occurring amino acid
  Homolog annotation: Hit_ID=AAN46118.1; Match level="QueryCoverage =100%, HitCoverage=41%, E-value=1e-126, Identity=99%"; Hit description=intermediate filament protein HG-IF1 [Heterodera glycines]
  Gene Ontology: Mol. function=structural molecule activity; Cellular component=lamin filament; Biological process=nuclear envelope reassembly
  Essential gene: C elegans homolog=W10G6.3; Phenotype =Lvl,Unc,Unclassified
  Coding regions on vcDNA: vcDNA=SeqID_50041; Strand=+; Position=48-762
MSDDYRSSIGPRPAFNRNSTAYSSTGGPVSGGNRVLKIVTETMSSSTSGGGGGMSPFGANAAQIRDSRDREKKELSDLNDRLANYIEKVRFLEAQNRKLKADLDMLQGRRGKDTITIKTMYESEIQTAKKLIEDTGRSKHELEQDVAKLQRDLFXQRRKYEEAVRSRAGDREKLDDLLVQLSNLEAEISLLKRRIALLEEELSKLRKENSRLQADLQRVRAELDQETLNRIDYQNQVQ

SEQ ID NO: 123619 - protein, 210 aa, Heterodera glycines
  misc_feature (51)..(51): Xaa can be any naturally occurring amino acid
  Homolog annotation: Hit_ID=CAE57828.1; Match level="QueryCoverage =91%, HitCoverage=93%, E-value=2e-75, Identity=73%"; Hit description =Hypothetical protein CBG00853 [Caenorhabditis briggsae]
  Gene Ontology: Mol. function=endopeptidase Clp activity; Cellular component=mitochondrion; Biological process=misfolded or incompletely synthesized protein catabolism
  Essential gene: C elegans homolog=ZK970.2; Phenotype =Emb,Gro,Pvl,Slu,Sma,Stp
  Coding regions on vcDNA: vcDNA=SeqID_50042; Strand=+; Position=39-669
MHAIRTISRTFSRSTTAPVGIPFVVDNDGKTERVYDIYSRLLKDRIVCVMXPIDDFFAASVIAQLLFLQSESGKTAINMYINCPGGSVTAGLGIYDTMQHISAPVATWCIGQASSMGSLLLTAGAKGMRTSLPNARIMVHQPSGGAYGTAADIVIRAEEINRMRKRLNEIYAMHTGQTVETIDQALDRDRFMSALQAQQVRLFDRYGTRS

SEQ ID NO: 123620 - protein, 65 aa, Heterodera glycines; identical to SEQ ID NO: 122545
  Homolog annotation: Hit_ID=AAH78605.1; Match level="QueryCoverage =96%, HitCoverage=91%, E-value=1e-25, Identity=87%"; Hit description =MGC85550 protein [Xenopus laevis]
  Essential gene: C elegans homolog=Y41D4B.5; Phenotype=Gro,Sck,Ste
  Coding regions on vcDNA: vcDNA=SeqID_50043; Strand=+; Position=45-242

SEQ ID NO: 123621 - protein, 362 aa, Heterodera glycines; identical to SEQ ID NO: 122156
  Homolog annotation: Hit_ID=NP_495900.1; Match level="QueryCoverage =98%, HitCoverage=82%, E-value=1e-156, Identity=75%"; Hit description= enolase (46.6 kD) (2J223) [Caenorhabditis elegans] emb|CAA92692.1| Hypothetical protein T21B10.2a [Caeno
  Gene Ontology: Mol. function=phosphopyruvate hydratase activity; Cellular component=soluble fraction; Biological process =gluconeogenesis
  Essential gene: C elegans homolog=T21B10.2a; Phenotype=Emb
  Coding regions on vcDNA: vcDNA=SeqID_50044; Strand=+; Position=36-1121

SEQ ID NO: 123622 - protein, 211 aa, Heterodera glycines
  Homolog annotation: Hit_ID=NP_741215.1; Match level="QueryCoverage =92%, HitCoverage=44%, E-value=2e-57, Identity=55%"; Hit description =secreted NADH-ubiquinone oxireductase precursor (50.9 kD) (3I246) [Caenorhabditis elegans] gb|AAA62532.1|
  Gene Ontology: Mol. function=NADH dehydrogenase (ubiquinone) activity; Cellular component=membrane fraction; Biological process =growth
  Essential gene: C elegans homolog=K04G7.4a; Phenotype=Lva
  Coding regions on vcDNA: vcDNA=SeqID_50045; Strand=+; Position=20-652
MASKFVFSLRFSYPRLLTSSALNNKKSGPNFLQSRSIVTKFDLELPDDYPEPWPYKQWGFNQFMQHFDKTLKRWHINSKLIVFESNIGVGRSSIAKELADALGFYYMPAFKMDDILVDRYNNDMRDYYHLFPKRFRFPDINMFYKDPADDQTAVMQDLMYDCRWEQYLNAQAHLFNTGQGVVLERCVHADFVFANAMRAKDWISREYLNFY

SEQ ID NO: 123623 - protein, 216 aa, Heterodera glycines
  misc_feature (54)..(54): Xaa can be any naturally occurring amino acid
  misc_feature (189)..(189): Xaa can be any naturally occurring amino acid
  Homolog annotation: Hit_ID=NP_741215.1; Match level="QueryCoverage =85%, HitCoverage=42%, E-value=2e-57, Identity=57%"; Hit description =secreted NADH-ubiquinone oxireductase precursor (50.9 kD) (3I246) [Caenorhabditis elegans] gb|AAA62532.1|
  Gene Ontology: Mol. function=NADH dehydrogenase (ubiquinone) activity; Cellular component=membrane fraction; Biological process =growth
  Essential gene: C elegans homolog=K04G7.4a; Phenotype=Lva
  Coding regions on vcDNA: vcDNA=SeqID_50046; Strand=+; Position=20-667
MASKFVFSLRFSYPRLLTSSALNNKKLVPNLIQSRSIVTKFDLELPDDYPEPWXLKQWGFNQFMQHLDKTLKRWHINSKLIVFESNIGVGRSSIAKELADALGFYYMPAFKMDDILVDRYNNDMRDYYHLFPKRFRFPDINMFYKDPADDQTAVMQDLMYDCRWEQYLNAQAHLFNTGQGVVLERGRHXDFVFANAMRAKDWISREYFNFYMYKRK

SEQ ID NO: 123624 - protein, 181 aa, Heterodera glycines
  misc_feature (138)..(138): Xaa can be any naturally occurring amino acid
  Homolog annotation: Hit_ID=CAE58579.1; Match level="QueryCoverage =99%, HitCoverage=99%, E-value=4e-72, Identity=70%"; Hit description =Hypothetical protein CBG01745 [Caenorhabditis briggsae]
  Gene Ontology: Mol. function=structural constituent of ribosome; Cellular component=cytosolic large ribosomal subunit (sensu Eukarya); Biological process=reproduction
  Essential gene: C elegans homolog=E04A4.8; Phenotype=Emb,Gro
  Coding regions on vcDNA: vcDNA=SeqID_50047; Strand=+; Position=99-645
MPIKASGETLRKYIVVGRKLPTANDPNPTLHEMVIFASNHVVAKSRFWYFTSMLRRVKKTHGEIISCQEVFEKKPGSVKNFGIWLRYDSRTGHHNMYREYRDVCEAGAVTQCYRDMGARHRAQADRIQIIKVQTISVXDCKRAGVKQFQNSKIKFPLPHRVNSKRRNMTPFTTQRPRTHFV

SEQ ID NO: 123625 - protein, 225 aa, Heterodera glycines
  Homolog annotation: Hit_ID=P46436; Match level="QueryCoverage=94%, HitCoverage=96%, E-value=2e-28, Identity=38%"; Hit description =Glutathione S-transferase 1 (GST class-sigma) gb|AAB30767.1| glutathione S-transferase, AsGST1 [Ascaris suum,
  Gene Ontology: Mol. function=glutathione transferase activity; Biological process=glutathione conjugation reaction
  Essential gene: C elegans homolog=R05F9.5a; Phenotype=Unclassified
  Coding regions on vcDNA: vcDNA=SeqID_50048; Strand=+; Position=49-726
MDAETKNYKLTYFSSRGIAEPIRLILHYKGIPFEDVTFSSTLADESSREKWLKQKQNYLYGQLPNLEWDEGTEHKVLAQSQTICRYLGNKYGLAGSDFWEAAKTDEIAEWFKDIWAAFLPFLKVAVGAEAGDKEAMKKEIFVPLIYDRLVTTLVEMLNKSGSGFLLPSGLTWTDFVFANALTTFNNMDKGLLFESHKVLADYEKRVYSANESIKKYVEGREAKEF

SEQ ID NO: 123626 - protein, 207 aa, Heterodera glycines
  misc_feature (167)..(167): Xaa can be any naturally occurring amino acid
  Homolog annotation: Hit_ID=NP_501727.1; Match level="QueryCoverage =95%, HitCoverage=84%, E-value=1e-75, Identity=55%"; Hit description =adenine nucleotide family member (4K472) [Caenorhabditis elegans] emb|CAA92472.1| Hypothetical protein K0
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_50049; Strand=+; Position=38-659
MFENKSEGGAEKKKSGGFNTKKFLLDLASGGTAAAVSKTAVAPIERVKLLLQVQDASIHITADKRYKGIIDVLVRVPKEQGFLSLWRGNLANVIRYFPTQALNFAFKDTYKRVFTQGVDKEKQFLKFFAMNLASGGAAGATSLCFVYPLDFARTRLAADVGKADARXFKGLADCILKNPQSGRSPSALPPGFIPPHQGHSSFYRGPF

SEQ ID NO: 123627 - protein, 154 aa, Heterodera glycines
  misc_feature (127)..(127): Xaa can be any naturally occurring amino acid
  Homolog annotation: Hit_ID=NP_498128.1; Match level="QueryCoverage =81%, HitCoverage=66%, E-value=4e-33, Identity=57%"; Hit description =CLocK (biological timing) abnormality CLK-1, ubiquinone biosynthesis protein (20.5 kD) (clk-1) [Caenorhab
  Gene Ontology: Cellular component=mitochondrial inner membrane; Biological process=electron transport
  Essential gene: C elegans homolog=ZC395.2; Phenotype=Age,Unclassified
  Coding regions on vcDNA: vcDNA=SeqID_50050; Strand=+; Position=216-675
MNFRPFAFLSLRFSSSSSASSSSLLPSYRKAIVHPIVRVDHAGELAADRIYAGQLAVLPKTHRLVPIIEQMRREERHHLDEMERLIVKYGVRSTALAPICSVAGFMLGVGTALLGEKAAMACTIAVXEEVIGPHYDDQIKELMADDANANRELM

SEQ ID NO: 123628 - protein, 317 aa, Heterodera glycines; identical to SEQ ID NO: 122087
  Homolog annotation: Hit_ID=NP_498386.2; Match level="QueryCoverage =97%, HitCoverage=97%, E-value=2e-78, Identity=48%"; Hit description =DeHydrogenase, Short chain, complex, LEThal LET-767 (34.3 kD) (let -767Co) [Caenorhabditis elegans] gb|AAA
  Gene Ontology: Mol. function=ketoreductase activity; Cellular component=endoplasmic reticulum; Biological process=fatty acid biosynthesis
  Essential gene: C elegans homolog=C56G2.6; Phenotype=Lva
  Coding regions on vcDNA: vcDNA=SeqID_50051; Strand=+; Position=26-979

SEQ ID NO: 123629 - protein, 143 aa, Heterodera glycines; identical to SEQ ID NO: 122060
  Homolog annotation: Hit_ID=NP_502365.1; Match level="QueryCoverage =100%, HitCoverage=100%, E-value=5e-71, Identity=89%"; Hit description=ribosomal Protein, Small subunit (15.9 kD) (rps-23) [Caenorhabditis elegans] emb|CAA94601.1| Hypothetic
  Gene Ontology: Cellular component=eukaryotic 48S initiation complex; Biological process=protein biosynthesis
  Essential gene: C elegans homolog=F28D1.7; Phenotype=Ste
  Coding regions on vcDNA: vcDNA=SeqID_50052; Strand=+; Position=26-457

SEQ ID NO: 123630 - protein, 56 aa, Heterodera glycines
  misc_feature (16)..(16): Xaa can be any naturally occurring amino acid
  misc_feature (24)..(24): Xaa can be any naturally occurring amino acid
  Homolog annotation: Hit_ID=AAQ63317.1; Match level="QueryCoverage =100%, HitCoverage=100%, E-value=1e-18, Identity=71%"; Hit description=40S ribosomal protein S29 [Hippocampus comes] gb|AAK95214.1| 40S ribosomal protein S29 [Ictalurus puncta
  Essential gene: C elegans homolog=B0412.4; Phenotype=Dpy,Emb,Ste
  Coding regions on vcDNA: vcDNA=SeqID_50053; Strand=+; Position=31-203
MVHENIHWSRPRKFGXGSRSCRVXFNHHGLIRKYSLNVCRRCFREYASDIGFKKLD

SEQ ID NO: 123631 - protein, 188 aa, Heterodera glycines; identical to SEQ ID NO: 120932
  Homolog annotation: Hit_ID=NP_498660.1; Match level="QueryCoverage =98%, HitCoverage=97%, E-value=1e-74, Identity=74%"; Hit description =ribosomal Protein, Large subunit (21.5 kD) (rpl-9) [Caenorhabditis elegans] gb|AAK84469.1| Ribosomal prot
  Gene Ontology: Mol. function=RNA binding; Cellular component =cytosolic ribosome (sensu Eukarya); Biological process=reproduction
  Essential gene: C elegans homolog=R13A5.8; Phenotype=Emb,Ste
  Coding regions on vcDNA: vcDNA=SeqID_50054; Strand=+; Position=40-606

SEQ ID NO: 123632 - protein, 265 aa, Heterodera glycines
  Homolog annotation: Hit_ID=CAE70912.1; Match level="QueryCoverage =94%, HitCoverage=95%, E-value=1e-111, Identity=78%"; Hit description= Hypothetical protein CBG17709 [Caenorhabditis briggsae]
  Gene Ontology: Mol. function=structural constituent of ribosome; Cellular component=eukaryotic 48S initiation complex; Biological process=protein biosynthesis
  Essential gene: C elegans homolog=C49H3.11; Phenotype=Emb,Lva,Ste
  Coding regions on vcDNA: vcDNA=SeqID_50055; Strand=+; Position=31-825
MADRAGFQSGFGGAAPPSARGRGGPRGRGRGAARGRGRGKDAEKEWVPVTKLGRLVKDRKVLTIEEIYLHSLPIKEFEIIDLLLSGLKDEVLKIMPVQKQTRAGQRTRFKAFVAIGDHNGHVGLGVKCSKEVATAIRGAIIAAKLAIIPVRRGYWGNKIGKPHTVPCKVTGKCASVLVRLIPAPRGTGIVGAPVPKKLLQMAGIDDCYTSAVGQTATLGNFAKATYYAIQRTYSYLTPDLWKENELPRNPLDHIGRWRGAISAAR

SEQ ID NO: 123633 - protein, 126 aa, Heterodera glycines; identical to SEQ ID NO: 122134
  Homolog annotation: Hit_ID=NP_035425.2; Match level="QueryCoverage =93%, HitCoverage=89%, E-value=2e-32, Identity=53%"; Hit description =ribosomal protein S12 [Mus musculus] gb|AAH87174.1| Unknown (protein for MGC:97945) [Xenopus laevis] gb|A
  Gene Ontology: Mol. function=structural constituent of ribosome; Cellular component=cytosolic small ribosomal subunit (sensu Eukarya); Biological process=protein biosynthesis
  Essential gene: C elegans homolog=F54E7.2; Phenotype=Emb,Ste
  Coding regions on vcDNA: vcDNA=SeqID_50056; Strand=+; Position=45-425

SEQ ID NO: 123634 - protein, 143 aa, Heterodera glycines; identical to SEQ ID NO: 122710
  Homolog annotation: Hit_ID=CAE57569.1; Match level="QueryCoverage =98%, HitCoverage=99%, E-value=8e-61, Identity=77%"; Hit description =Hypothetical protein CBG00547 [Caenorhabditis briggsae]
  Gene Ontology: Mol. function=structural constituent of ribosome; Cellular component=cytosolic ribosome (sensu Eukarya); Biological process=protein biosynthesis
  Essential gene: C elegans homolog=F28C6.7a; Phenotype=Emb,Lva,Ste
  Coding regions on vcDNA: vcDNA=SeqID_50057; Strand=+; Position=45-476

SEQ ID NO: 123635 - protein, 259 aa, Heterodera glycines
  Homolog annotation: Hit_ID=NP_498703.1; Match level="QueryCoverage =84%, HitCoverage=64%, E-value=4e-25, Identity=36%"; Hit description =DNA polymerase delta p38 (3I946) [Caenorhabditis elegans]
  Essential gene: C elegans homolog=ZK652.10; Phenotype=Age,Unclassified
  Coding regions on vcDNA: vcDNA=SeqID_50058; Strand=+; Position=10-786
MMVKSALSNSLSILNGFTSRAFTTSNIRSLRFRSQRPQNELRTVGKMVAQSDSPYEKGQCFVHRLFAYRGVIIRSKNCSVFTKRISDTQTVQQEVLPFYQVLIDKDDWSEMNFETDMTTFLKSTGNREETAISGMDIVSHDEILPFEPSVSELKSLSDGSGEAAPIKHYLYDQLFKKKTGEETKRDAGVNRQRPEEEMCWIFPIAVTKQTTDCFEVQVSTFNLGSNNLNRSHSPHNWRIVLRVENSQNNTMYLRNTVLK

SEQ ID NO: 123636 - protein, 98 aa, Heterodera glycines; identical to SEQ ID NO: 122380
  Homolog annotation: Hit_ID=XP_509802.1; Match level="QueryCoverage =91%, HitCoverage=72%, E-value=2e-38, Identity=80%"; Hit description =PREDICTED: similar to ribosomal protein S27 [Pan troglodytes]
  Essential gene: C elegans homolog=F56E10.4; Phenotype=Lva
  Coding regions on vcDNA: vcDNA=SeqID_50059; Strand=+; Position=3-299

SEQ ID NO: 123637 - protein, 190 aa, Heterodera glycines; identical to SEQ ID NO: 122053
  Homolog annotation: Hit_ID=AAQ76040.1; Match level="QueryCoverage =80%, HitCoverage=98%, E-value=9e-71, Identity=85%"; Hit description =ubiquitin extension protein [Cucumis sativus]
  Gene Ontology: Biological process=cell cycle
  Essential gene: C elegans homolog=H06I04.4a; Phenotype=Ste
  Coding regions on vcDNA: vcDNA=SeqID_50060; Strand=+; Position=57-629

SEQ ID NO: 123638 - protein, 123 aa, Heterodera glycines; identical to SEQ ID NO: 122312
  Homolog annotation: Hit_ID=NP_997676.1; Match level="QueryCoverage =100%, HitCoverage=100%, E-value=3e-39, Identity=67%"; Hit description=similar to 60S RIBOSOMAL PROTEIN L35 [Rattus norvegicus] gb|AAH86116.1| Unknown (protein for MGC:98516)
  Gene Ontology: Mol. function=structural constituent of ribosome; Cellular component=cytosolic large ribosomal subunit (sensu Eukarya); Biological process=protein biosynthesis
  Essential gene: C elegans homolog=ZK652.4; Phenotype=Emb,Ste
  Coding regions on vcDNA: vcDNA=SeqID_50061; Strand=+; Position=32-403

SEQ ID NO: 123639 - protein, 110 aa, Heterodera glycines; identical to SEQ ID NO: 122542
  Homolog annotation: Hit_ID=XP_319026.1; Match level="QueryCoverage =99%, HitCoverage=100%, E-value=6e-61, Identity=92%"; Hit description= ENSANGP00000013177 [Anopheles gambiae] gb|EAA13837.1| ENSANGP00000013177 [Anopheles gambiae str. PEST]
  Gene Ontology: Mol. function=transcription factor activity; Cellular component=nucleus; Biological process=G2/M transition of mitotic cell cycle
  Essential gene: C elegans homolog=Y54F10BM.14; Phenotype=Emb
  Coding regions on vcDNA: vcDNA=SeqID_50062; Strand=+; Position=44-376

SEQ ID NO: 123640 - protein, 172 aa, Heterodera glycines
  Homolog annotation: Hit_ID=NP_776957.1; Match level="QueryCoverage =90%, HitCoverage=61%, E-value=2e-25, Identity=47%"; Hit description =DnaJ (Hsp40) homolog, subfamily B, member 6 [Bos taurus] gb|AAL73393.1| molecular chaperone MRJ [Bos taur
  Gene Ontology: Mol. function=heat shock protein activity; Biological process=protein folding
  Essential gene: C elegans homolog=T03F6.2; Phenotype=Ste
  Coding regions on vcDNA: vcDNA=SeqID_50063; Strand=+; Position=136-651
MGGEGSGRSGGVSPECLYAVLGVQKGADEAEIKKAYRRLALKWHPDKNPERKEKAEKMFKRVAQAYEVLSDEKRRTDYNRHGMCRPAEAAFASAHRRRTAPADSHYAHHQSHPFHAHFRSPFDIFREFFGDPLSSSDFHRSPFFAFPANGGMKQRRRHTTNLFGDGAFGAHF

SEQ ID NO: 123641 - protein, 89 aa, Heterodera glycines
  Homolog annotation: Hit_ID=A48821; Match level="QueryCoverage=83%, HitCoverage=7%, E-value=3e-10, Identity=43%"; Hit description=Wnt-5 protein - fruit fly (Drosophila melanogaster) gb|AAA29020.1| Wnt protein
  Gene Ontology: Mol. function=receptor binding; Cellular component =extracellular space; Biological process=cell-cell signaling
  Essential gene: C elegans homolog=F38E1.7; Phenotype=Emb
  Coding regions on vcDNA: vcDNA=SeqID_50064; Strand=+; Position=215-481
MAAQLASALSSPDYYNCQMQPGLTRRQRDICVRHPSAMRSISDGLRAAIDECHAQFERERWNCSATFNVGVPSEEDSTPETAYVFAISS

SEQ ID NO: 123642 - protein, 131 aa, Heterodera glycines; identical to SEQ ID NO: 122672
  Homolog annotation: Hit_ID=NP_725894.1; Match level="QueryCoverage =80%, HitCoverage=90%, E-value=7e-47, Identity=81%"; Hit description =CG9291-PA, isoform A [Drosophila melanogaster] ref|NP_523794.1| CG9291-PB, isoform B [Drosophila melanoga
  Essential gene: C elegans homolog=Y82E9BR.15; Phenotype=Emb,Lva
  Coding regions on vcDNA: vcDNA=SeqID_50065; Strand=+; Position=25-420

SEQ ID NO: 123643 - protein, 243 aa, Heterodera glycines
  misc_feature (108)..(108): Xaa can be any naturally occurring amino acid
  Homolog annotation: Hit_ID=CAE57015.1; Match level="QueryCoverage =96%, HitCoverage=56%, E-value=6e-41, Identity=39%"; Hit description =Hypothetical protein CBG24890 [Caenorhabditis briggsae]
  Essential gene: C elegans homolog=Y44F5A.1; Phenotype=Gro,Pvl,Stp
  Coding regions on vcDNA: vcDNA=SeqID_50066; Strand=+; Position=48-777
MERLFNTPISSLSTNTSNCTRNTICLGFLDGSIQCFSFDTQRGITPSMESSVKLGGMWRKRMKRSVRAMQISEDGTSLYATSSNRAVCLYDVETGKRVRCIREGHKSXPSAMALLPGERRHFATGAENGEIKAWDFGQPKPNVHTFGEQADIINALHIWRNNLLAASGDGTLAVYDTHKGKVRIQSETMHSELLSLAVTERFTYVGAADGHIEVFRHGQFGNIRERMETPFLMGVEQMVVLRN

SEQ ID NO: 123644 - protein, 213 aa, Heterodera glycines
  Homolog annotation: Hit_ID=AAH54266.1; Match level="QueryCoverage =96%, HitCoverage=98%, E-value=2e-83, Identity=72%"; Hit description =Rps8-prov protein [Xenopus laevis] sp|Q7SYU0|RS8_XENLA 40S ribosomal protein S8
  Gene Ontology: Cellular component=eukaryotic 48S initiation complex; Biological process=protein biosynthesis
  Essential gene: C elegans homolog=F42C5.8; Phenotype=Lva,Ste
  Coding regions on vcDNA: vcDNA=SeqID_50067; Strand=+; Position=43-684
TSKWAFPQDRWHKRRKTGGKRNPIHKKRKFEMGRPAANTKIGPKRIHLVRCRGGNIKHRGLRLDTGNFAWASEGCTRKTRIIDTMYNASNNELVRTKTLVKGMIVSIDAIPFRQWYEAHYALPLARKKGQKLTEDEEARIGGAQKRSKSTLKKYTERQKTAGVEPHLLEQFQAGRLLACISSRPGQSGRCDGYILEGKELEFYNKKLKAKKAK

SEQ ID NO: 123645 - protein, 101 aa, Heterodera glycines
  Homolog annotation: Hit_ID=NP_493465.1; Match level="QueryCoverage =90%, HitCoverage=77%, E-value=4e-23, Identity=54%"; Hit description =nadh dehydrogenase (1O705) [Caenorhabditis elegans] emb|CAA21708.1| Hypothetical protein Y63D3A.7 [Caenor
  Gene Ontology: Biological process=growth
  Essential gene: C elegans homolog=Y63D3A.7; Phenotype=Lva
  Coding regions on vcDNA: vcDNA=SeqID_50068; Strand=+; Position=37-342
MASSIRLAGGALRELRIHLCQTTAASNGVREFIQKDYVDLKQNNRDFPILVRECSGITPRIWARYEHGVETSVSVENQPRQKIMEVIKEMATKKMETKKID

SEQ ID NO: 123646 - protein, 206 aa, Heterodera glycines
  misc_feature (186)..(186): Xaa can be any naturally occurring amino acid
  Homolog annotation: Hit_ID=NP_494913.1; Match level="QueryCoverage =99%, HitCoverage=99%, E-value=5e-47, Identity=42%"; Hit description =proteasome Beta Subunit (22.7 kD) (pbs-3) [Caenorhabditis elegans] gb|AAA98018.1| Proteasome beta subunit
  Gene Ontology: Mol. function=endopeptidase activity; Cellular component=proteasome core complex (sensu Eukarya); Biological process=protein catabolism
  Essential gene: C elegans homolog=Y38A8.2; Phenotype=Emb
  Coding regions on vcDNA: vcDNA=SeqID_50069; Strand=+; Position=21-642
MPNIMGLHGGSMIAMRSKDSVVIACDLRLGEQAMKNIATNATKIHPISDNVFIGLTGFNADATTVLNKLRTHQAIYEMREQRPMSPKALTSYLAWMLYKRRFGPFLIEPIIVGLNQQNEPFISHMDVVGSVSEPEDYTVGGTGGDLAMSLCEALWRPDMTSEEMTVAVGQAMLAVVERDASTGWGXVIHTITAEGVTTKMIKSRMD

SEQ ID NO: 123647 - protein, 178 aa, Heterodera glycines; identical to SEQ ID NO: 123230
  misc_feature (63)..(63): Xaa can be any naturally occurring amino acid
  Homolog annotation: Hit_ID=NP_497407.1; Match level="QueryCoverage =94%, HitCoverage=29%, E-value=1e-32, Identity=42%"; Hit description =solute carrier family 22 member (64.6 kD) (3C510) [Caenorhabditis elegans] gb|AAK26156.1| Hypothetical pr
  Gene Ontology: Mol. function=organic cation transporter activity; Cellular component=integral to plasma membrane; Biological process =organic cation transport
  Essential gene: C elegans homolog=Y82E9BR.16a; Phenotype=Emb,Lva
  Coding regions on vcDNA: vcDNA=SeqID_50070; Strand=-; Position=2-536

SEQ ID NO: 123648 - protein, 222 aa, Heterodera glycines
  Homolog annotation: Hit_ID=NP_497803.1; Match level="QueryCoverage =99%, HitCoverage=32%, E-value=1e-23, Identity=28%"; Hit description =RRN3 (3F90) [Caenorhabditis elegans] emb|CAA84645.1| Hypothetical protein C36E8.1 [Caenorhabditis elegans
  Essential gene: C elegans homolog=C36E8.1; Phenotype=Gro
  Coding regions on vcDNA: vcDNA=SeqID_50071; Strand=+; Position=70-735
MPEKKPTKCLSKGKELPCGREIIQDFVMMMPGSMDKYHQLCSILSSFELWSEESRTSFLSQFLDSYDILDVNCSDLVLKLCKIRWHTVPPQMLSQFADFLCALAINHVHHINSVFNCFVDHFLPIGNAKDPSNFEAHRPPAVVDDHFQESLYALANLSIQNVVSCNPLTTPLLLECFVKRFPHIKQPSPKLLAFMRNVLRFADWIRDEEISAEIWSLIVEKL

SEQ ID NO: 123649 - protein, 132 aa, Heterodera glycines; identical to SEQ ID NO: 122109
  Homolog annotation: Hit_ID=NP_493571.1; Match level="QueryCoverage =86%, HitCoverage=97%, E-value=4e-52, Identity=85%"; Hit description =ribosomal Protein, Small subunit (13.2 kD) (rps-26) [Caenorhabditis elegans] emb|CAB07387.1| Hypothetical
  Gene Ontology: Mol. function=structural constituent of ribosome; Cellular component=cytosolic small ribosomal subunit (sensu Eukarya); Biological process=locomotory behavior
  Essential gene: C elegans homolog=F39B2.6; Phenotype=Lva,Ste
  Coding regions on vcDNA: vcDNA=SeqID_50072; Strand=+; Position=31-429

SEQ ID NO: 123650 - protein, 198 aa, Heterodera glycines
  Homolog annotation: Hit_ID=CAE65023.1; Match level="QueryCoverage =93%, HitCoverage=76%, E-value=8e-41, Identity=51%"; Hit description =Hypothetical protein CBG09861 [Caenorhabditis briggsae]
  Essential gene: C elegans homolog=F59A2.3; Phenotype=Rup
  Coding regions on vcDNA: vcDNA=SeqID_50073; Strand=+; Position=128-721
MLCDASRLAPPSSTFSLRMGQDSHGYGHRAFSTSGAAQELSSALDEEINAEKELVQDKLGGTSAPSVPGFKITTKGAEVRLSKTHGNEKIEVILNVNHSVDIEEDEEYEDEPQAEMEPESVPVSLPHFTISITKNNQSMFFALEMVKTDDGGFDFTVEEFFIAPSVNGEPVNEVGDDVYSSSGKYIDPKLHDLLFVRY

SEQ ID NO: 123651 - protein, 113 aa, Heterodera glycines; identical to SEQ ID NO: 122036
  Homolog annotation: Hit_ID=BAA11131.1; Match level="QueryCoverage =100%, HitCoverage=77%, E-value=5e-48, Identity=80%"; Hit description= type-1 cytochrome c [Ascaris suum]
  Gene Ontology: Mol. function=electron transporter activity; Cellular component=mitochondrion; Biological process=electron transport
  Essential gene: C elegans homolog=E04A4.7; Phenotype=Emb,Lva
  Coding regions on vcDNA: vcDNA=SeqID_50074; Strand=+; Position=48-389

SEQ ID NO: 123652 - protein, 209 aa, Heterodera glycines
  Homolog annotation: Hit_ID=CAE59841.1; Match level="QueryCoverage =94%, HitCoverage=57%, E-value=8e-56, Identity=56%"; Hit description =Hypothetical protein CBG03313 [Caenorhabditis briggsae]
  Gene Ontology: Mol. function=ubiquitin-specific protease activity; Cellular component=endoplasmic reticulum; Biological process =skeletal development
  Essential gene: C elegans homolog=F19B6.2a; Phenotype=Emb,Lva,Lvl,Unc
  Coding regions on vcDNA: vcDNA=SeqID_50075; Strand=+; Position=12-638
MFDFHQFMGLGGGAVATYSVQLRAFSAPFFQRHDERRINELNYGGKILLPNSCLDNLMRRNIQYPMLFKLTNVGPALQRGTHAGVLEFLAEEGRCYLPSWMMAQLALREGDLITVEYKALPNATYAKFKPMSTDFYNISNPRAMLEVELRKFSCLTKGDVIAVQYNEQVYEFQVKALKPENAVTIVECDINIEFDAAEGYVEPNRTHQQ

SEQ ID NO: 123653 - protein, 109 aa, Heterodera glycines; identical to SEQ ID NO: 123229
  Homolog annotation: Hit_ID=NP_491989.1; Match level="QueryCoverage =92%, HitCoverage=27%, E-value=1e-38, Identity=75%"; Hit description =isocitrate dehydrogenase (1H553) [Caenorhabditis elegans] gb|AAK85453.1| Hypothetical protein C30F12.7 [C
  Gene Ontology: Mol. function=isocitrate dehydrogenase (NAD+) activity; Cellular component=mitochondrion; Biological process =hermaphrodite genital morphogenesis
  Essential gene: C elegans homolog=F35G12.2; Phenotype=Stp
  Coding regions on vcDNA: vcDNA=SeqID_50076; Strand=+; Position=2-331

SEQ ID NO: 123654 - protein, 176 aa, Heterodera glycines; identical to SEQ ID NO: 122433
  Homolog annotation: Hit_ID=CAE59837.1; Match level="QueryCoverage =88%, HitCoverage=97%, E-value=3e-42, Identity=51%"; Hit description =Hypothetical protein CBG03309 [Caenorhabditis briggsae]
  Essential gene: C elegans homolog=T09A5.5; Phenotype=Lva
  Coding regions on vcDNA: vcDNA=SeqID_50077; Strand=+; Position=1-531

SEQ ID NO: 123655 - protein, 191 aa, Heterodera glycines; identical to SEQ ID NO: 122533
  Homolog annotation: Hit_ID=CAE75119.1; Match level="QueryCoverage =100%, HitCoverage=70%, E-value=1e-71, Identity=64%"; Hit description= Hypothetical protein CBG23047 [Caenorhabditis briggsae]
  Gene Ontology: Biological process=embryogenesis and morphogenesis
  Essential gene: C elegans homolog=Y75B8A.14; Phenotype=Emb
  Coding regions on vcDNA: vcDNA=SeqID_50078; Strand=+; Position=69-641

SEQ ID NO: 123656 - protein, 336 aa, Heterodera glycines
  Homolog annotation: Hit_ID=NP_498111.2; Match level="QueryCoverage =99%, HitCoverage=62%, E-value=1e-178, Identity=93%"; Hit description= ATP synthase subunit (57.5 kD) (atp-2) [Caenorhabditis elegans] gb|AAA19068.2| Atp synthase subunit prot
  Gene Ontology: Mol. function=transporter activity; Cellular component= proton-transporting ATP synthase, catalytic core (sensu Eukarya); Biological process=energy pathways
  Essential gene: C elegans homolog=C34E10.6; Phenotype=Emb
  Coding regions on vcDNA: vcDNA=SeqID_50079; Strand=+; Position=3-1013
LLAPYSKGGKIGLFGGAGVGKTVLIMELINNVAKAHGGFSVFAGVGERTREGNDLYHEMIEGGVIDLKGKNSKVSLVYGQMNEPPGARARVCLTGLSVAEYFRDKEGQDVLLFIDNIFRFTQAGSEVSALLGRIPSAVGYQPTLATDMGSMQERITTTKKGSITSVQAIYVPADDLTDPAPATTFAHLDATTVLSRGIAELGIYPAVDPLDSTSRIMDPNIVGNRHYDIARGVQKILQDYKSLQDIIAILGMDELSEDDKLTVSRARKIQRYLSQPFQVAEVFTGHKGKFVTLEQTIDGFESILKGEMDHIPEVAFYMQGAIDDVHKKADELAKQS

SEQ ID NO: 123657 - protein, 288 aa, Heterodera glycines
  Homolog annotation: Hit_ID=NP_510571.1; Match level="QueryCoverage =71%, HitCoverage=48%, E-value=2e-37, Identity=35%"; Hit description =delayed-early response protein/equilibrative nucleoside transporter family member (50.5 kD) (XQ221) [Caen
  Gene Ontology: Mol. function=nucleoside transporter activity; Biological process=physiological processes
  Essential gene: C elegans homolog=ZK809.4; Phenotype=Sck
  Coding regions on vcDNA: vcDNA=SeqID_50080; Strand=+; Position=311 -1174
MTTGSDRTQLQLQLHFNANNSSEASQSQNSSEQMQNCSTNERVSGEDSVPFIDRETFGDAESDRGRGPPPDRFRLVYLIVLLHGMGMLLPWNTFITIAGDYYLQFKFANVSNEDNYKVYFFNYLTVCAQIPNLLLSFLNLFVVIRGGFYRRIYFTLAVIFGICLVTIAMVYVPTDNWTFGFFLFTMLSVVLLNSASGVYQNSIWGLVADFPGEFAGAIILGNNLCGILMAVLDILIIVLGLRFVHFAFVRFAFSRCQCRTRRNSLLRSRSVYRRPLHFFFPFSSKIGS

SEQ ID NO: 123658 - protein, 84 aa, Heterodera glycines; identical to SEQ ID NO: 122135
  Homolog annotation: Hit_ID=CAE66872.1; Match level="QueryCoverage =92%, HitCoverage=89%, E-value=1e-28, Identity=70%"; Hit description =Hypothetical protein CBG12250 [Caenorhabditis briggsae]
  Essential gene: C elegans homolog=ZK652.1; Phenotype=Emb
  Coding regions on vcDNA: vcDNA=SeqID_50081; Strand=+; Position=39-293

SEQ ID NO: 123659 - protein, 154 aa, Heterodera glycines; identical to SEQ ID NO: 122726
  Homolog annotation: Hit_ID=XP_317466.1; Match level="QueryCoverage =99%, HitCoverage=96%, E-value=2e-44, Identity=58%"; Hit description =ENSANGP00000012302 [Anopheles gambiae] gb|EAA12435.2| ENSANGP00000012302 [Anopheles gambiae str. PEST]
  Gene Ontology: Biological process=cell cycle
  Essential gene: C elegans homolog=H06I04.4a; Phenotype=Ste
  Coding regions on vcDNA: vcDNA=SeqID_50082; Strand=+; Position=7-471

SEQ ID NO: 123660 - protein, 111 aa, Heterodera glycines; identical to SEQ ID NO: 122404
  Homolog annotation: Hit_ID=AAN05584.1; Match level="QueryCoverage =95%, HitCoverage=92%, E-value=1e-42, Identity=80%"; Hit description =ribosomal protein L30 [Argopecten irradians]
  Gene Ontology: Cellular component=cytosolic ribosome (sensu Eukarya); Biological process=protein biosynthesis
  Essential gene: C elegans homolog=Y106G6H.3; Phenotype=Emb,Lva
  Coding regions on vcDNA: vcDNA=SeqID_50083; Strand=+; Position=41-376

SEQ ID NO: 123661 - protein, 142 aa, Heterodera glycines
  Homolog annotation: Hit_ID=XP_420810.1; Match level="QueryCoverage =76%, HitCoverage=48%, E-value=2e-16, Identity=43%"; Hit description =PREDICTED: similar to GrpE protein homolog 1, mitochondrial precursor (Mt-GrpE#1) (HMGE) [Gallus gallus]
  Essential gene: C elegans homolog=C34C12.8; Phenotype=Lva
  Coding regions on vcDNA: vcDNA=SeqID_50084; Strand=+; Position=61-486
MTSRILSCNLRRYFSKMNQHIEFGTTKSASSDKQSPPSPTNNQTQHEGMSQECREQIEQMEKLKSDNEMLTDKYKRTLADMENLRKRTQRQIEEAKLFAIQPFCKDLLEVADVLDLALNSLEKMKTEDGAASLDSGVNKGIK

SEQ ID NO: 123662 - protein, 271 aa, Heterodera glycines; identical to SEQ ID NO: 122387
  Homolog annotation: Hit_ID=CAE56261.1; Match level="QueryCoverage =90%, HitCoverage=75%, E-value=1e-67, Identity=53%"; Hit description =Hypothetical protein CBG23904 [Caenorhabditis briggsae]
  Essential gene: C elegans homolog=F56B3.8; Phenotype=Gro
  Coding regions on vcDNA: vcDNA=SeqID_50085; Strand=+; Position=18-830

SEQ ID NO: 123663 - protein, 148 aa, Heterodera glycines
  misc_feature (66)..(66): Xaa can be any naturally occurring amino acid
  Homolog annotation: Hit_ID=CAA65506.1; Match level="QueryCoverage =99%, HitCoverage=86%, E-value=3e-46, Identity=55%"; Hit description =cuticular collagen [Teladorsagia circumcincta]
  Gene Ontology: Mol. function=structural constituent of cuticle; Cellular component=extracellular; Biological process=cuticle biosynthesis (sensu Nematoda)
  Essential gene: C elegans homolog=T07H6.3a; Phenotype=Bmd,Gro,Unc
  Coding regions on vcDNA: vcDNA=SeqID_50086; Strand=+; Position=3-447
DSLRRLAFFGVALSTVSTLICVLSVPMVYSYVQHINSQMMAEVDFCKMRSGNIWREVTRTQGMHAXTRHRVARNADACCGCGESPRGPPGPPGPDGNPGGDGQPGGPGQPGAPAQAPPRPKPSGTGCQTCAPAENGHPGPQGPPGQPG

SEQ ID NO: 123664 - protein, 350 aa, Heterodera glycines
  Homolog annotation: Hit_ID=CAB88204.1; Match level="QueryCoverage =93%, HitCoverage=95%, E-value=1e-131, Identity=60%"; Hit description= putative cuticular collagen [Globodera pallida]
  Gene Ontology: Mol. function=structural constituent of cuticle; Cellular component=basement membrane; Biological process=cuticle biosynthesis (sensu Nematoda)
  Essential gene: C elegans homolog=C15A11.6; Phenotype=Emb
  Coding regions on vcDNA: vcDNA=SeqID_50087; Strand=+; Position=3-1055
ETQIVVGVASVCSLLAIVATLVVVPSLYSQINEISLKVHDGVQAFRVNTDSAWNELMEVQITVTPPAKPRENPFVSIFRSKRQLPGHCQCAGVQQPQCPPGPPGPAGAPGQPGYPGQAGEPGQPGVPGQPGAPCPDVPHVCQHCPAGPPGKPGDQGPAGQAGQPGRPGQPGQSGGVGPPGPPGPQGQAGSPGRPGGSGQPGQPGQNGVVYKTVPGPKGQPGQPGAPGQPGAPGRPGKPGDQGQPGAPGHPGQPGQPGAPGQPGHPGAAGAPGKDASYCACPPRSGGGYGVSGGGGGGAKVEHAPLPAEQAPVPEQPAESVGVAPAPAEVASNAAGGQGEAEAAKGYRKKM

SEQ ID NO: 123665 - protein, 139 aa, Heterodera glycines
  misc_feature (83)..(83): Xaa can be any naturally occurring amino acid
  Homolog annotation: Hit_ID=NP_493644.1; Match level="QueryCoverage =85%, HitCoverage=29%, E-value=5e-58, Identity=89%"; Hit description =proteasome Regulatory Particle, ATPase-like, S10b (rpt-4) [Caenorhabditis elegans] gb|AAB70326.2| Proteas
  Gene Ontology: Mol. function=proteasome endopeptidase activity; Cellular component=26S proteasome; Biological process=proteolysis and peptidolysis
  Essential gene: C elegans homolog=F23F1.8; Phenotype=Emb
  Coding regions on vcDNA: vcDNA=SeqID_50088; Strand=+; Position=3-418
EVLKQLTEEKFIVKATNGPRYVVGCRRTIDKEKLKQGTRVALDMTTLTIMRQLPREVDPLVYKMSHEDPGNVSYAEIGGLSDXIRELREVVELPLINPELFKRVGITPPKGCLLYGPPGPPGAPGQPGQPGNSGQPGQP

SEQ ID NO: 123666 - protein, 158 aa, Heterodera glycines
  Homolog annotation: Hit_ID=NP_506872.1; Match level="QueryCoverage =85%, HitCoverage=68%, E-value=4e-11, Identity=29%"; Hit description =putative cytoplasmic protein, with a coiled coil-4 domain (5Q54) [Caenorhabditis elegans] emb|CAB03011.1|
  Essential gene: C elegans homolog=F28F8.5; Phenotype=Gro,Pvl,Slu,Stp
  Coding regions on vcDNA: vcDNA=SeqID_50089; Strand=+; Position=24-500
MSNITPGNTTQTQRGEGGGDLSADKLREINSLIAAFPSSIGQTPPDSALGTALNNMMVQWNSLLSQVVTEVDHPQPILEHIKETAEFSVKQFRDACLGMISELTRTSVDWQLNFPNEMAEQEISEYENSIRRQEQLLGKIRQKLDDEILSGENSNFVP

SEQ ID NO: 123667 - protein, 182 aa, Heterodera glycines
  Homolog annotation: Hit_ID=CAE67544.1; Match level="QueryCoverage =71%, HitCoverage=86%, E-value=1e-10, Identity=28%"; Hit description =Hypothetical protein CBG13069 [Caenorhabditis briggsae]
  Essential gene: C elegans homolog=F10E7.6; Phenotype=Clr,Gro,Sck
  Coding regions on vcDNA: vcDNA=SeqID_50090; Strand=+; Position=42-590
MASFLRFLACRHFSMSSVLRKEAEQLTNEHIDKIRQRTRFSETSAFHGRGSGGRTNGESGEDAFTNPFYIASYYDSKRFEAIRGVSIFASISLLLIYVAWFREPNEVDELWDYDMRLVYFVAKKRVLKDQIEQAKKGGHGTVDLETDLINIEVQEQKIREEEEKKAKKVAAKKKAEQKRTTA

SEQ ID NO: 123668 - protein, 259 aa, Heterodera glycines
  misc_feature (80)..(80): Xaa can be any naturally occurring amino acid
  Homolog annotation: Hit_ID=CAE71139.1; Match level="QueryCoverage =83%, HitCoverage=77%, E-value=2e-83, Identity=67%"; Hit description =Hypothetical protein CBG17994 [Caenorhabditis briggsae]
  Gene Ontology: Mol. function=laminin receptor activity; Cellular component=integral to plasma membrane; Biological process=cell adhesion
  Essential gene: C elegans homolog=B0393.1; Phenotype=Emb,Ste
  Coding regions on vcDNA: vcDNA=SeqID_50091; Strand=+; Position=11-788
DYTTYFLPPTCQARLDVFKLTDDDAMKFLVCESHIGTKKMDYQMEHYVWKRRSDGIHIINIRKTWEKLLFAARAIAAIEXSSDVVVVSAQPYAQRAVLKFAAHIGATPIVGRFTPGSLTNQIQKNFKEPRLLVVSDPQLDHQAVREASYVNTPVIAVANTDSPLKFVDIAIPANNKQKHSVGLIWWLLAREVLLLRGKISRQTGFMVDDKLIMPDLYFFRDPQEQEKEGTEGEAEADITVKEGGWGATGGMDTMGGDFP

SEQ ID NO: 123669 - protein, 294 aa, Heterodera glycines
  Homolog annotation: Hit_ID=AAK26378.1; Match level="QueryCoverage =100%, HitCoverage=88%, E-value=1e-175, Identity=100%"; Hit description=putative zinc finger protein [Heterodera glycines]
  Essential gene: C elegans homolog=Y53G8AR.9; Phenotype=Rup
  Coding regions on vcDNA: vcDNA=SeqID_50092; Strand=+; Position=14-895
MTNERDFSHDDHINNAVGTNGDSKDAAKRKDICRDFLNNICSRGNRCKFYHPEDSVEKNQNSADEPYQFCIDFQNQGCYRENCRYVHAFREDVDRYKRSGDVTLGLARALAALLKGDTINGIPLCKEFQNGHCARGPQCRYWHINRDEERRKRFGGGRNCGGSPSSLAFGAYPAVPPAGAQLSRRRGDEFVSEDFAPPSKRSFAHNQPFATIPGQMAPTSAPTAPSHPSPQLVIELERRNAELTTEVESLKRELNREKERYDDLMSLFRAAQGQPTVQRSVISTPSLVPANLQP

SEQ ID NO: 123670 - protein, 172 aa, Heterodera glycines; identical to SEQ ID NO: 122529
  Homolog annotation: Hit_ID=NP_499681.1; Match level="QueryCoverage =80%, HitCoverage=79%, E-value=2e-55, Identity=69%"; Hit description =cytochrome c oxidase Va (20.1 kD) (3N995) [Caenorhabditis elegans] emb|CAA21532.1| Hypothetical protein Y
  Gene Ontology: Mol. function=electron transporter activity; Cellular component=respiratory chain complex IV (sensu Eukarya); Biological process=aerobic respiration
  Essential gene: C elegans homolog=Y37D8A.14; Phenotype=Emb,Lva
  Coding regions on vcDNA: vcDNA=SeqID_50093; Strand=+; Position=19-537

SEQ ID NO: 123671 - protein, 184 aa, Heterodera glycines
  Homolog annotation: Hit_ID=CAE70145.1; Match level="QueryCoverage =84%, HitCoverage=50%, E-value=1e-54, Identity=64%"; Hit description =Hypothetical protein CBG16607 [Caenorhabditis briggsae]
  Gene Ontology: Mol. function=mRNA binding; Cellular component=snRNP U1; Biological process=mRNA splicing
  Essential gene: C elegans homolog=K04G7.10; Phenotype=Emb
  Coding regions on vcDNA: vcDNA=SeqID_50094; Strand=+; Position=40-594
MTQFLPDNLLALFAPRPPIQFKPPPDDLFIHRKHMQMGGMAECVHGFEDPKDTPPKPKIETREEKRARKRKEKEELMAYKIEQGIATWTPADNPKATVDPYKTLFIGRINYETSESKLRREFEKYGKITKIIMVHDKNSKPRGYAFIEYAHKSEMSASAGLRQICACIGTHFLLCSPKNYSKSP

SEQ ID NO: 123672 - protein, 218 aa, Heterodera glycines; identical to SEQ ID NO: 122618
  Homolog annotation: Hit_ID=NP_510256.1; Match level="QueryCoverage =99%, HitCoverage=63%, E-value=3e-54, Identity=47%"; Hit description =Cyclin-Dependent Kinase (39.4 kD) (cdk-4) [Caenorhabditis elegans] emb|CAB16925.1| Hypothetical protein F
  Gene Ontology: Mol. function=protein kinase activity; Cellular component=transcription factor complex; Biological process=G1 phase of mitotic cell cycle
  Essential gene: C elegans homolog=F18H3.5a; Phenotype=Lvl,Pvl,Unc
  Coding regions on vcDNA: vcDNA=SeqID_50095; Strand=+; Position=6-659

SEQ ID NO: 123673 - protein, 232 aa, Heterodera glycines
  Homolog annotation: Hit_ID=NP_741039.1; Match level="QueryCoverage =93%, HitCoverage=50%, E-value=1e-56, Identity=59%"; Hit description =serine/aRginine rich pre-mRNA SPlicing factor (52.7 kD) (rsp-7) [Caenorhabditis elegans] emb|CAA85414.2|
  Gene Ontology: Mol. function=pre-mRNA splicing factor activity; Cellular component=nucleus; Biological process=mRNA splicing
  Essential gene: C elegans homolog=D2089.1a; Phenotype=Unclassified
  Coding regions on vcDNA: vcDNA=SeqID_50096; Strand=+; Position=35-730
WIPRAAGIRHEAKVEEIRRTVYVGNLPKGCDGEEVLNFFNACIGEVMYLRMAAGNDYLPCDYAYVEFSQQSSVPLALQNSDSLEFQGRPLRIQHSKVAIIKPQRKTADQALEEVEEAIKSGSDGRTTTDTGRGYSPFRPGVSAPRVVPTSPRPSVKRSTRSRSTSSSHSRRSRSRSRRRRSRSRSTRSPSRSRRRRSRSRDRKRSRSRRRSRSRDKDRKKASKRSRSRDRST

SEQ ID NO: 123674 - protein, 186 aa, Heterodera glycines; identical to SEQ ID NO: 122261
  Homolog annotation: Hit_ID=CAE63933.1; Match level="QueryCoverage =100%, HitCoverage=100%, E-value=5e-79, Identity=75%"; Hit description=Hypothetical protein CBG08510 [Caenorhabditis briggsae]
  Gene Ontology: Mol. function=structural constituent of ribosome; Cellular component=cytosolic ribosome (sensu Eukarya); Biological process=protein biosynthesis
  Essential gene: C elegans homolog=Y48G8AL.8a; Phenotype=Emb,Lva
  Coding regions on vcDNA: vcDNA=SeqID_50097; Strand=+; Position=33-593

SEQ ID NO: 123675 - protein, 116 aa, Heterodera glycines
  Homolog annotation: Hit_ID=NP_492007.1; Match level="QueryCoverage =69%, HitCoverage=58%, E-value=5e-20, Identity=53%"; Hit description =nadh dehydrogenase Fe-S protein 6 (15.7 kD) (1H669) [Caenorhabditis elegans] emb|CAA95810.1| Hypothetical
  Essential gene: C elegans homolog=F22D6.4; Phenotype=Gro
  Coding regions on vcDNA: vcDNA=SeqID_50098; Strand=+; Position=66-413
MFSSSKSAAVLRMRGATGAMARRWKGGDEQKNVPVPSPKEMAQRPAEFDELTHTGQAWDIADWRRSRFEYMPKQVNPSIAAHLIAELAPVPSEERVVRCDGGHRELGHPRVYINLD

SEQ ID NO: 123676 - protein, 147 aa, Heterodera glycines
  misc_feature (50)..(50): Xaa can be any naturally occurring amino acid
  misc_feature (81)..(81): Xaa can be any naturally occurring amino acid
  misc_feature (100)..(100): Xaa can be any naturally occurring amino acid
  Homolog annotation: Hit_ID=CAB88203.1; Match level="QueryCoverage =99%, HitCoverage=48%, E-value=2e-54, Identity=69%"; Hit description =putative cuticular collagen [Globodera pallida]
  Essential gene: C elegans homolog=C29E4.1; Phenotype=Dpy
  Coding regions on vcDNA: vcDNA=SeqID_50099; Strand=+; Position=2-448
HIVLWIASVCSLVNIIATVGTLPSLYSEMRQMNNKVRDGVEAFRVNTDSXWTDLMDVQVVVTPPSKPRDNPFNSIFRSPRXLRGLCHCAGLQQPSCPPGXPRPTGPPGQTGHPAGARHPGQAGLPGQPTPDCSAEMLHCPRLPVSPA

SEQ ID NO: 123677 - protein, 322 aa, Heterodera glycines
  Homolog annotation: Hit_ID=CAB88203.1; Match level="QueryCoverage =92%, HitCoverage=99%, E-value=1e-150, Identity=80%"; Hit description= putative cuticular collagen [Globodera pallida]
  Gene Ontology: Mol. function=structural constituent of cuticle; Cellular component=extracellular; Biological process=cuticle biosynthesis (sensu Nematoda)
  Essential gene: C elegans homolog=C15A11.6; Phenotype=Emb
  Coding regions on vcDNA: vcDNA=SeqID_50100; Strand=+; Position=1-969
QETHIVLGIASLCSLLAIIATVVTLPSLYSEMSQLNNKVRDGVQAFRVNTDSAWTDLMDVQVVVAPPSKARDNPFSSIFRAKRQLPGHCNCGPPQRPNCPPGPPGPAGPPGQPGQPGGAGLQGQPGAPGQPAPPCPPQNIPCPRCPAGPPGSPGGQGPPGQQGAPGQPGAPAPGGGQGPPGPSGPQGQPGQPGRSGTPGQPGQPGNNAVIFNTIPGPRGAPGAPGQPGSPGSQGQPGQPGGQGPPGPSGAPGLPGLSGNSGQPGQPGAPGQPGKDSGYCPCPPRSSAMALKKKMAAVKIFLAKRAASNCDAKDNPIIGCWRN

SEQ ID NO: 123678 - protein, 169 aa, Heterodera glycines
  misc_feature (15)..(15): Xaa can be any naturally occurring amino acid
  Homolog annotation: Hit_ID=NP_493695.1; Match level="QueryCoverage =98%, HitCoverage=92%, E-value=9e-42, Identity=50%"; Hit description =mitochondrial ribosomal protein L41 like (20.9 kD) (2A579) [Caenorhabditis elegans] gb|AAB37899.1| Hypoth
  Essential gene: C elegans homolog=B0432.3; Phenotype=Lva
  Coding regions on vcDNA: vcDNA=SeqID_50101; Strand=+; Position=17-527
MVRHVTASCFRAPWXFEKKGSTGWRKNGPVVIESHKWPGQQKEFPELSPKFLGANFKQLWRYTGVAPTGFNDPKTDDFVHVPEMVPELVVPDLANFELKPYVSYKTDAKIEERLRNFDKKLTKFGGNEKAAIANSKETELWPPPPIDAKILFDFFYAEKIRQAFEKGKK

SEQ ID NO: 123679 - protein, 211 aa, Heterodera glycines
  misc_feature (89)..(89): Xaa can be any naturally occurring amino acid
  Homolog annotation: Hit_ID=NP_493228.1; Match level="QueryCoverage =81%, HitCoverage=91%, E-value=1e-25, Identity=35%"; Hit description =von Hippel-Landau Binding Protein, prefoldin (vbp-1) [Caenorhabditis elegans] emb|CAB04707.1| Hypothetica
  Gene Ontology: Mol. function=tubulin binding; Cellular component =prefoldin complex; Biological process=cell organization and biogenesis
  Essential gene: C elegans homolog=T06G6.9; Phenotype=Emb
  Coding regions on vcDNA: vcDNA=SeqID_50102; Strand=+; Position=5-641
MEIKEKSKNTSTSAVLPLTAEERMKRRQIMRTEVLENVEPFLKMKKKSLEDAQEDERENFRRFKMFETSALQQKAKIEENIRDYRKSLXLSKCSQDKIEKGVDSVEITYKLDENLYSRALVEEMDKVCIRLGANVMVEYELDEARQLLREHLENVERSSKETEEDIAFLQDQITTTEINLANLYHYAVQNRKQMSMNSELSVGQIGLDAVE

SEQ ID NO: 123680 - protein, 162 aa, Heterodera glycines; identical to SEQ ID NO: 122448
  Homolog annotation: Hit_ID=NP_504633.1; Match level="QueryCoverage =79%, HitCoverage=97%, E-value=3e-12, Identity=34%"; Hit description =putative mitochondrial protein (14.0 kD) (5G906) [Caenorhabditis elegans] gb|AAB66018.1| Hypothetical pro
  Essential gene: C elegans homolog=T05H4.12; Phenotype=Ste
  Coding regions on vcDNA: vcDNA=SeqID_50103; Strand=+; Position=42-530

SEQ ID NO: 123681 - protein, 218 aa, Heterodera glycines
  misc_feature (86)..(86): Xaa can be any naturally occurring amino acid
  Homolog annotation: Hit_ID=NP_506571.1; Match level="QueryCoverage =98%, HitCoverage=86%, E-value=1e-67, Identity=59%"; Hit description =proteasome Alpha Subunit (27.0 kD) (pas-1) [Caenorhabditis elegans] emb|CAB02738.1| Hypothetical protein
  Gene Ontology: Mol. function=endopeptidase activity; Cellular component=proteasome core complex (sensu Eukarya); Biological process=proteolysis and peptidolysis
  Essential gene: C elegans homolog=C15H11.7; Phenotype=Emb
  Coding regions on vcDNA: vcDNA=SeqID_50104; Strand=+; Position=18-671
MTRGSSAGYDRHITIFSPEGRIYQVEYAFKAANTATLSAVGIALDETAVIAVQRRVPDKLVDPSSVKSIYKLSSTVSCGVIGIVLXADAMFQVRRAQSEAARWKYENGYEMPISELARKMAEINQYYTQVAELRSLGTLMLMISYDDEKGASVFSIDPAGHYISVRGYGIGVKQQQINGFLEKKLKSKDRKFGDTEVIQLALEALQTGLGIDLNADQV

SEQ ID NO: 123682 - protein, 214 aa, Heterodera glycines; identical to SEQ ID NO: 122735
  Homolog annotation: Hit_ID=NP_491370.1; Match level="QueryCoverage =95%, HitCoverage=54%, E-value=6e-56, Identity=53%"; Hit description =eukaryotic Initiation Factor (41.0 kD) (eif-3.H) [Caenorhabditis elegans] gb|AAC48137.2| Eukaryotic initi
  Gene Ontology: Mol. function=translation factor activity, nucleic acid binding; Cellular component=eukaryotic translation initiation factor 3 complex; Biological process=positive regulation of growth rate
  Essential gene: C elegans homolog=C41D11.2; Phenotype=Emb,Gro
  Coding regions on vcDNA: vcDNA=SeqID_50105; Strand=+; Position=38-679

SEQ ID NO: 123683 - protein, 222 aa, Heterodera glycines; identical to SEQ ID NO: 122489
  Homolog annotation: Hit_ID=AAH20679.1; Match level="QueryCoverage =98%, HitCoverage=77%, E-value=2e-44, Identity=46%"; Hit description =Ribosomal protein L6 [Homo sapiens]
  Gene Ontology: Mol. function=structural constituent of ribosome; Cellular component=cytosolic large ribosomal subunit (sensu Eukarya); Biological process=protein biosynthesis
  Essential gene: C elegans homolog=R151.3; Phenotype=Emb,Lva
  Coding regions on vcDNA: vcDNA=SeqID_50106; Strand=+; Position=7-672

SEQ ID NO: 123684 - protein, 79 aa, Heterodera glycines; identical to SEQ ID NO: 122647
  Homolog annotation: Hit_ID=XP_317573.1; Match level="QueryCoverage =100%, HitCoverage=75%, E-value=1e-33, Identity=88%"; Hit description= ENSANGP00000010151 [Anopheles gambiae]
  Gene Ontology: Biological process=cell cycle
  Essential gene: C elegans homolog=F45H11.2; Phenotype=Lon,Pvl
  Coding regions on vcDNA: vcDNA=SeqID_50107; Strand=+; Position=27-266

SEQ ID NO: 123685 - protein, 148 aa, Heterodera glycines; identical to SEQ ID NO: 122056
  Homolog annotation: Hit_ID=NP_001001819.1; Match level="QueryCoverage= 97%, HitCoverage=99%, E-value=7e-57, Identity=73%"; Hit description =ribosomal protein S15 [Danio rerio] gb|AAH81516.1| Ribosomal protein S15 [Danio rerio] gb|AAS66964.1|
  Gene Ontology: Mol. function=structural constituent of ribosome; Cellular component=eukaryotic 48S initiation complex; Biological process=positive regulation of growth rate
  Essential gene: C elegans homolog=F36A2.6; Phenotype=Lva
  Coding regions on vcDNA: vcDNA=SeqID_50108; Strand=+; Position=26-472

SEQ ID NO: 123686 - protein, 151 aa, Heterodera glycines
  Homolog annotation: Hit_ID=CAE57854.1; Match level="QueryCoverage =99%, HitCoverage=100%, E-value=3e-50, Identity=60%"; Hit description= Hypothetical protein CBG00891 [Caenorhabditis briggsae]
  Gene Ontology: Mol. function=thioredoxin reductase (NADPH) activity; Cellular component=nucleus
  Essential gene: C elegans homolog=R05H5.3; Phenotype=Emb
  Coding regions on vcDNA: vcDNA=SeqID_50109; Strand=+; Position=36-491
MAQLLAGEKVVLSDGSKVEAEVFLKDKVVAVYFSAGWCPPCRAFTPKLKKFYEELKKAGKNFEVLFVSRDRAAKDLVEYYRDHHGAWAYLEFGNPKIQELLEKYEVKTIPTCKVIKPDGTIVVNDARTEVHEKGVENALGLWEEWLGFYEA

SEQ ID NO: 123687 - protein, 123 aa, Heterodera glycines
  Homolog annotation: Hit_ID=NP_587693.1; Match level="QueryCoverage =97%, HitCoverage=98%, E-value=5e-28, Identity=51%"; Hit description =putative ribosomal protein L35 [Schizosaccharomyces pombe] emb|CAA21057.1| SPCC613.05c [Schizosaccharomyc
  Gene Ontology: Mol. function=structural constituent of ribosome; Cellular component=cytosolic large ribosomal subunit (sensu Eukarya); Biological process=protein biosynthesis
  Essential gene: C elegans homolog=ZK652.4; Phenotype=Emb,Ste
  Coding regions on vcDNA: vcDNA=SeqID_50110; Strand=+; Position=89-460
MTKVKTFELRTKSKAELSKQLDDLRRELLSLRIKQQSGQSNQKPLEIRNVRRSIARVLTVINQSTKAEVLKEYAGKKYIPIDLRAKKTRAIRRALTPAERKIKTTRALKKAKHFPQRQFAVLA

SEQ ID NO: 123688 - protein, 226 aa, Heterodera glycines
  misc_feature (105)..(105): Xaa can be any naturally occurring amino acid
  Homolog annotation: Hit_ID=NP_001000.2; Match level="QueryCoverage =85%, HitCoverage=94%, E-value=3e-92, Identity=87%"; Hit description =ribosomal protein S5 [Homo sapiens] gb|AAH15405.1| Ribosomal protein S5 [Homo sapiens] gb|AAH18151.1| Rib
  Gene Ontology: Mol. function=structural constituent of ribosome; Cellular component=cytosolic small ribosomal subunit (sensu Eukarya); Biological process=protein biosynthesis
  Essential gene: C elegans homolog=T05E11.1; Phenotype=Ste
  Coding regions on vcDNA: vcDNA=SeqID_50111; Strand=+; Position=55-733
MATEVDENTAVADPWSTVEDVSGGESMHQLVTLDVPEIKLFGKWSLNDVDVSDISLVDYVAVKEKAAKYLPHSVGRYQQKRFRKATCPVVERLVSSMMMHGRNNXGKKLMAVRIVKHAFEIIHLLTGENPVQVLVNAVINSGPREDSTRIGRAGTVRRQAVDVSPLRRVNQAIWLLCTGSREAAFRNIKTIAECLADELMNAAKGSSNSYAIKKKDELERVAKSNR

SEQ ID NO: 123689 - protein, 86 aa, Heterodera glycines
  Homolog annotation: Hit_ID=CAE60566.1; Match level="QueryCoverage =97%, HitCoverage=42%, E-value=5e-36, Identity=82%"; Hit description =Hypothetical protein CBG04195 [Caenorhabditis briggsae]
  Gene Ontology: Cellular component=DNA-directed RNA polymerase II, holoenzyme; Biological process=histogenesis and organogenesis
  Essential gene: C elegans homolog=Y54E10BR.6; Phenotype=Emb,Lva
  Coding regions on vcDNA: vcDNA=SeqID_50112; Strand=+; Position=3-263
LRQVNKVGIFCEIGPLSCFISRHCIPPDMEFEPNNIPPCYKTADESIVIKQDDEIRLKLIGIRVDANDIFAIGTLMDDYLGLCSTE

SEQ ID NO: 123690 - protein, 174 aa, Heterodera glycines; identical to SEQ ID NO: 122067
  Homolog annotation: Hit_ID=NP_491093.1; Match level="QueryCoverage =100%, HitCoverage=88%, E-value=4e-84, Identity=82%"; Hit description= polymerase II (1D600) [Caenorhabditis elegans] gb|AAF59550.1| Hypothetical protein Y54E10BR.6 [Caenorhab
  Gene Ontology: Mol. function=DNA-directed RNA polymerase activity; Cellular component=DNA-directed RNA polymerase II, holoenzyme; Biological process=histogenesis and organogenesis
  Essential gene: C elegans homolog=Y54E10BR.6; Phenotype=Emb,Lva
  Coding regions on vcDNA: vcDNA=SeqID_50113; Strand=+; Position=6-530

SEQ ID NO: 123691 - protein, 181 aa, Heterodera glycines
  Homolog annotation: Hit_ID=NP_493024.1; Match level="QueryCoverage =98%, HitCoverage=100%, E-value=9e-62, Identity=62%"; Hit description= ubiquitin conjugating enzyme (ubc-12) [Caenorhabditis elegans] emb|CAB03238.1| Hypothetical protein R09B
  Gene Ontology: Mol. function=ubiquitin-protein ligase activity; Cellular component=proteasome complex (sensu Eukarya); Biological process=pronuclear fusion
  Essential gene: C elegans homolog=R09B3.4; Phenotype =Adl,Emb,Pvl,Stp,Unc
  Coding regions on vcDNA: vcDNA=SeqID_50114; Strand=+; Position=59-604
MFNLQDRCKGVDQDRDYHATRISIRDKLLSQETKELEQNLRDLPTCKLIFPSTSALHEMELTVKPNVGLYKGGAFKFSITVPPEYNNVPPIVKCLTRFWHPNINEDGSICLSLLRQNSLDGYGWMPTRRIRDVILGLDQLFTDLIDFDDPLNAQAAQQWQTNKDGFAQKVKEYMTKYCPRN

SEQ ID NO: 123692 - protein, 226 aa, Heterodera glycines
  Homolog annotation: Hit_ID=CAE71175.1; Match level="QueryCoverage =45%, HitCoverage=80%, E-value=3e-29, Identity=51%"; Hit description =Hypothetical protein CBG18032 [Caenorhabditis briggsae]
  Gene Ontology: Mol. function=ubiquitin-protein ligase activity; Cellular component=anaphase-promoting complex; Biological process =meiotic chromosome segregation
  Essential gene: C elegans homolog=F35G12.9; Phenotype=Mei,Ste
  Coding regions on vcDNA: vcDNA=SeqID_50115; Strand=+; Position=28-708
MMSSNEQEESGGSNDDQFSSPISPVSPIQPMSTDWSNAIDAQEIGAGGVGGGISSGSLHESLHELSPIWADSDLIGDTLSAVPDSPSDEDPYASTIYRPVSMVTPVAALPNPNPPSCSFGGPMESIEAKGPLELPTKTRLKVRIKRLDIVGSWRWVDGKEDACGICRTPFETCCMDCKFPGDECPLVLGQCKHPFHMHCIVKWTNTQSGQKPACPLCRQEWKFATS

SEQ ID NO: 123693 - protein, 171 aa, Heterodera glycines
  Homolog annotation: Hit_ID=NP_496279.1; Match level="QueryCoverage =95%, HitCoverage=95%, E-value=9e-42, Identity=48%"; Hit description =gene producing two messages overlaping 3' 5', encoding DNA-directed RNA polymerase subunit K/omega and a
  Gene Ontology: Biological process=positive regulation of body size
  Essential gene: C elegans homolog=C14A4.1; Phenotype=Unclassified
  Coding regions on vcDNA: vcDNA=SeqID_50116; Strand=+; Position=2-514
MAVFVKDQNFVPEKRVDEAGHILNDPSKSLADRFRALFLLRSVKSDRAVHWICKCFSDPSALLKHELAYCLGQMQNPAAIQKLIFVLQDTEQEPMVRHEAAEALGAIGDPSNEHGLSKLFEQYSGDAVREVAETCLLALRRTQWVKEKGKDDTESRSIYDSIDPAPAADGG

SEQ ID NO: 123694 - protein, 150 aa, Heterodera glycines; identical to SEQ ID NO: 122038
  Homolog annotation: Hit_ID=AAA03341.1; Match level="QueryCoverage =100%, HitCoverage=100%, E-value=4e-52, Identity=67%"; Hit description=ribosomal protein L23a
  Gene Ontology: Mol. function=structural constituent of ribosome; Cellular component=cytosolic large ribosomal subunit (sensu Eukarya); Biological process=ribosomal large subunit assembly and maintenance
  Essential gene: C elegans homolog=F55D10.2; Phenotype=Gro
  Coding regions on vcDNA: vcDNA=SeqID_50117; Strand=+; Position=52-504

SEQ ID NO: 123695 - protein, 163 aa, Heterodera glycines; identical to SEQ ID NO: 122104
  Homolog annotation: Hit_ID=NP_497291.1; Match level="QueryCoverage =52%, HitCoverage=89%, E-value=4e-15, Identity=48%"; Hit description =putative mitochondrial protein (11.0 kD) (3B528) [Caenorhabditis elegans] gb|AAC71133.1| Bmp receptor ass
  Essential gene: C elegans homolog=F23H11.5; Phenotype=Emb,Lva
  Coding regions on vcDNA: vcDNA=SeqID_50118; Strand=+; Position=8-499

SEQ ID NO: 123696 - protein, 151 aa, Heterodera glycines
  Homolog annotation: Hit_ID=CAF97896.1; Match level="QueryCoverage =98%, HitCoverage=28%, E-value=2e-51, Identity=65%"; Hit description =unnamed protein product [Tetraodon nigroviridis]
  Gene Ontology: Biological process=histogenesis and organogenesis
  Essential gene: C elegans homolog=Y110A7A.8; Phenotype=Emb
  Coding regions on vcDNA: vcDNA=SeqID_50119; Strand=+; Position=1-453
LILGKQKRTLAGFSSSVILPNTGFIYHHPIVQTLPPDLRRKAARLVAAKCTLASRVDSIHSSLDGRIGERLSVEIKGKLEKMQEPPPVKNAKPLPKPLDKASKKRGGKRVRKQKELLKATELRRKANRMNFGELQEDVMQDHLGFTLGQAN

SEQ ID NO: 123697 - protein, 152 aa, Heterodera glycines
  misc_feature (116)..(116): Xaa can be any naturally occurring amino acid
  Homolog annotation: Hit_ID=AAT92172.1; Match level="QueryCoverage =100%, HitCoverage=100%, E-value=9e-70, Identity=86%"; Hit description=ribosomal protein S14 [Ixodes pacificus]
  Gene Ontology: Mol. function=structural constituent of ribosome; Cellular component=eukaryotic 48S initiation complex; Biological process=protein biosynthesis
  Essential gene: C elegans homolog=F37C12.9; Phenotype=Emb,Ste
  Coding regions on vcDNA: vcDNA=SeqID_50120; Strand=+; Position=29-485
MASRKGKVKEEQPAVSLGPQVQEGENVFGVAHIFASFNDTFVHVTDLSGRETIVKITGGMRVKADRDEASPYAAMLAAQDVAERCKQVGINALHVKLRATGGTKTKTPGPGAQAAXLRALARSGMKIGRIEDVTPIPSDSTRQKGGRRGRRL

SEQ ID NO: 123698 - protein, 237 aa, Heterodera glycines
  Homolog annotation: Hit_ID=NP_741371.2; Match level="QueryCoverage =98%, HitCoverage=87%, E-value=8e-82, Identity=61%"; Hit description =ribosomal protein L7Ae/L30e/S12e/Gadd45 (30.2 kD) (4F154) [Caenorhabditis elegans] gb|AAK84600.1| Ribosom
  Gene Ontology: Mol. function=structural constituent of ribosome; Cellular component=cytosolic large ribosomal subunit (sensu Eukarya); Biological process=protein biosynthesis
  Essential gene: C elegans homolog=Y24D9A.4a; Phenotype=Ste
  Coding regions on vcDNA: vcDNA=SeqID_50121; Strand=+; Position=9-719
STLFERRPRNFSLGQDIQPKRDLTRFVRWPKYILLQRQRAVLEKRLKIPPPINQFKFALDKPNTNQLFKLLNKYRPETRQAKKERLRQRAQDRADGKQEKLTKRPPVVHFGIKDVVKAVENKKASLVVIAHDVDPIEIVICLPAICRKFGVPYAIVKGKAFLGQVVYRKTTSAVCLCDVNPEDRNALKNLADVAVTNFNERGDELRKNWGGAIMSQRSQARQAKIEKARQRDVGQKV

SEQ ID NO: 123699 - protein, 264 aa, Heterodera glycines
  misc_feature (107)..(107): Xaa can be any naturally occurring amino acid
  misc_feature (178)..(178): Xaa can be any naturally occurring amino acid
  misc_feature (185)..(185): Xaa can be any naturally occurring amino acid
  misc_feature (196)..(196): Xaa can be any naturally occurring amino acid
  Homolog annotation: Hit_ID=NP_498349.1; Match level="QueryCoverage =91%, HitCoverage=97%, E-value=5e-99, Identity=74%"; Hit description =ribosomal Protein, Small subunit (27.3 kD) (rps-3) [Caenorhabditis elegans] gb|AAF99870.1| Ribosomal prot
  Gene Ontology: Mol. function=structural constituent of ribosome; Cellular component=cytosolic small ribosomal subunit (sensu Eukarya); Biological process=protein biosynthesis
  Essential gene: C elegans homolog=C23G10.3; Phenotype=Emb
  Coding regions on vcDNA: vcDNA=SeqID_50122; Strand=+; Position=66-860
MAQQQAITKKRKAVQDGIFKAELNNFLMKELAEDGYSGVEVRRAPSRTEVIIMATRTQSVLGERGKRIRELTALVQKRFGYSAGQIELYAEKVSSRGLCAVAQCESXRYKLVGGLAVRRACYGVLRFIMESNARGCEIVVSGKLRGQRAKAMKFVDGVMIHSGNPVTEYIQEAVRHVXQMRQGVXGIKVKIMLPHXPKGQMGPRNPLPDHIQVKEPPIDVAPTTPYSEHREPMTTGMPPQTQMPPAHQQQQLPMVGQVPPPAQF

SEQ ID NO: 123700 - protein, 167 aa, Heterodera glycines
  Homolog annotation: Hit_ID=NP_727306.1; Match level="QueryCoverage =82%, HitCoverage=61%, E-value=3e-32, Identity=43%"; Hit description =CG32708-PA [Drosophila melanogaster] gb|AAF46440.1| CG32708-PA [Drosophila melanogaster]
  Gene Ontology: Mol. function=general RNA polymerase II transcription factor activity; Cellular component=nucleus; Biological process =gametogenesis
  Essential gene: C elegans homolog=F57B10.8; Phenotype=Lva
  Coding regions on vcDNA: vcDNA=SeqID_50123; Strand=+; Position=1-501
IQTVPPFFTVKRLRETMSRFDGLGRVYLQSEKRGAQRKKRYTEGWVEFKNKKVAKEVVRLMNGRVVGGRRRSAAYDSVWTMKYLHGFKWEHLMEQLNYEQRIEQQRLRTEIVQEKRKADFFAQQVEKGESLKKLEEKILKKCGLWEQYQRQHKQLKNCGRGGAIGGG

SEQ ID NO: 123701 - protein, 155 aa, Heterodera glycines
  misc_feature (139)..(139): Xaa can be any naturally occurring amino acid
  Homolog annotation: Hit_ID=CAE58392.1; Match level="QueryCoverage =87%, HitCoverage=52%, E-value=1e-32, Identity=48%"; Hit description =Hypothetical protein CBG01521 [Caenorhabditis briggsae]
  Gene Ontology: Cellular component=mitochondrion
  Essential gene: C elegans homolog=T23B12.3; Phenotype=Lva
  Coding regions on vcDNA: vcDNA=SeqID_50124; Strand=+; Position=17-482
MIKPVNTLKSLMRTMTDCRWMASVPMAFEQKVSMAQPQQSMAYLPDIETLRKGKVSPTILKPYIDPALCSSDPNSFESEVTVGRMLDARVHLGHKVGTLNDNMKWALYGERLGICVFDLEITRHYLLKALEFVRSVAFXGGRFLFVSTNKSSMLM

SEQ ID NO: 123702 - protein, 216 aa, Heterodera glycines
  misc_feature (70)..(70): Xaa can be any naturally occurring amino acid
  misc_feature (174)..(174): Xaa can be any naturally occurring amino acid
  misc_feature (188)..(188): Xaa can be any naturally occurring amino acid
  Homolog annotation: Hit_ID=NP_495707.1; Match level="QueryCoverage =100%, HitCoverage=100%, E-value=2e-97, Identity=79%"; Hit description=ribosomal Protein, Large subunit (24.7 kD) (rpl-10) [Caenorhabditis elegans] emb|CAA88308.1| Hypothetic
  Gene Ontology: Mol. function=structural constituent of ribosome; Cellular component=cytosolic large ribosomal subunit (sensu Eukarya); Biological process=protein biosynthesis
  Essential gene: C elegans homolog=F10B5.1; Phenotype=Lva,Ste
  Coding regions on vcDNA: vcDNA=SeqID_50125; Strand=+; Position=28-675
MGRRPARCYRYIKNKPYPKSRFCRGVPDPKIRIFDLGRKRATVDEFPCCVHMISNEREHLSSEALEAARXICANKYMVKNCGKDGFHMRVRIHPFHVIRINKMLSCAGADRLQTGMRGAFGKPQGLVARVGIGDMLMSVRVRDQHQAHALEAFRRAKFKFPGRQYIVISRKWGXFTPFDREVYEKHRXEGRVIPDGVNCRFLKQHGPLTEWLKNPI

SEQ ID NO: 123703 - protein, 122 aa, Heterodera glycines; identical to SEQ ID NO: 122673
  Homolog annotation: Hit_ID=CAD91428.1; Match level="QueryCoverage =94%, HitCoverage=97%, E-value=2e-43, Identity=75%"; Hit description =ribosomal protein S20 [Crassostrea gigas]
  Gene Ontology: Mol. function=structural constituent of ribosome; Cellular component=cytosolic small ribosomal subunit (sensu Eukarya); Biological process=protein biosynthesis
  Essential gene: C elegans homolog=Y105E8A.16; Phenotype=Lva,Sma
  Coding regions on vcDNA: vcDNA=SeqID_50126; Strand=+; Position=87-455

SEQ ID NO: 123704 - protein, 247 aa, Heterodera glycines
  Homolog annotation: Hit_ID=AAO14563.2; Match level="QueryCoverage =100%, HitCoverage=34%, E-value=1e-135, Identity=99%"; Hit description=Hsp90 [Heterodera glycines]
  Gene Ontology: Mol. function=protein binding; Cellular component =centrosome; Biological process=reproduction
  Essential gene: C elegans homolog=C47E8.5; Phenotype=Emb,Ste
  Coding regions on vcDNA: vcDNA=SeqID_50127; Strand=+; Position=30-770
MSEQSGETFAFQAEIAQLMSLIINTFYSNKEIFLRELISNSSDALDKIRYQALTDPSQMESGKELFIKIVPNKADKTLTIIDTGIGMTKADLVNNLGTIAKSGTKAFMEALQAGADISMIGQFGVGFYSAFLVADRVTVTSKHNDDDCYQWESSAGGSFIIRNCADPEVTRGTKIVLHLKEDQTDYLEERRVREVVKKHSQFIGYPIKLLVEKERDKEISDDEAEEEKKEDEAKEEEKKPEDDVSDD

SEQ ID NO: 123705 - protein, 165 aa, Heterodera glycines; identical to SEQ ID NO: 122519
  Homolog annotation: Hit_ID=CAE58558.1; Match level="QueryCoverage =100%, HitCoverage=99%, E-value=9e-75, Identity=77%"; Hit description= Hypothetical protein CBG01720 [Caenorhabditis briggsae]
  Gene Ontology: Mol. function=ubiquitin-like conjugating enzyme activity; Cellular component=chromosome; Biological process=growth
  Essential gene: C elegans homolog=F29B9.6; Phenotype =Emb,Gro,Pvl,Stp,Unc
  Coding regions on vcDNA: vcDNA=SeqID_50128; Strand=+; Position=124-618

SEQ ID NO: 123706 - protein, 229 aa, Heterodera glycines
  misc_feature (60)..(60): Xaa can be any naturally occurring amino acid
  Homolog annotation: Hit_ID=CAE65794.1; Match level="QueryCoverage =98%, HitCoverage=51%, E-value=1e-92, Identity=74%"; Hit description =Hypothetical protein CBG10899 [Caenorhabditis briggsae]
  Gene Ontology: Mol. function=sterol transporter activity; Cellular component=mitochondrion; Biological process=protein targeting
  Essential gene: C elegans homolog=M03A8.1; Phenotype=Gro
  Coding regions on vcDNA: vcDNA=SeqID_50129; Strand=+; Position=67-753
MSLLSFEGRVALVTGAGGGIGRTYALEFARRGAKVIVNDLGGDRHGKSASTSAADKVVAXILAAGGKAVPNYDSVENGDKIVRTAIDNFGRIDIVINNAGILRDVSFGKMSEFDWDSVMKVHVKGAFSVTKAAWEHMRAQKYGRLVFTSSNSGIYGSFGQANYAAAKMALIGLSNTLALEGAKYNIASNVLVPTAGSRMTQTVMPEELLTAMKPEFVTPLTGCLAHESC

SEQ ID NO: 123707 - protein, 139 aa, Heterodera glycines
  Homolog annotation: Hit_ID=AAH49478.1; Match level="QueryCoverage =76%, HitCoverage=58%, E-value=3e-37, Identity=77%"; Hit description =Zgc:66168 protein [Danio rerio]
  Gene Ontology: Biological process=cell cycle
  Essential gene: C elegans homolog=ZK1010.1; Phenotype=Emb
  Coding regions on vcDNA: vcDNA=SeqID_50130; Strand=+; Position=19-438
LKMQIFVKTLTGKTVTLEVEASDTIENVKAKIQDKEGIPPDQQRLIFAGKQLEDGRTLADYNIQKESTLHLVLRLRGGKVHGSLARAGKVRAQTPKVEKQEKKKKKRGRAFRRIQYKRRYVNVAAAGPGRRRGPNSNAA

SEQ ID NO: 123708 - protein, 208 aa, Heterodera glycines; identical to SEQ ID NO: 122642
  Homolog annotation: Hit_ID=P46436; Match level="QueryCoverage=97%, HitCoverage=97%, E-value=4e-39, Identity=43%"; Hit description =Glutathione S-transferase 1 (GST class-sigma) gb|AAB30767.1| glutathione S-transferase, AsGST1 [Ascaris suum,
  Gene Ontology: Mol. function=glutathione transferase activity; Biological process=glutathione conjugation reaction
  Essential gene: C elegans homolog=R05F9.5a; Phenotype=Unclassified
  Coding regions on vcDNA: vcDNA=SeqID_50131; Strand=+; Position=29-655

SEQ ID NO: 123709 - protein, 207 aa, Heterodera glycines; identical to SEQ ID NO: 122407
  Homolog annotation: Hit_ID=P46436; Match level="QueryCoverage=99%, HitCoverage=98%, E-value=6e-39, Identity=42%"; Hit description =Glutathione S-transferase 1 (GST class-sigma) gb|AAB30767.1| glutathione S-transferase, AsGST1 [Ascaris suum,
  Gene Ontology: Mol. function=glutathione transferase activity; Biological process=glutathione conjugation reaction
  Essential gene: C elegans homolog=R05F9.5a; Phenotype=Unclassified
  Coding regions on vcDNA: vcDNA=SeqID_50132; Strand=+; Position=36-659

SEQ ID NO: 123710 - protein, 178 aa, Heterodera glycines
  Homolog annotation: Hit_ID=CAE59836.1; Match level="QueryCoverage =70%, HitCoverage=72%, E-value=2e-30, Identity=50%"; Hit description =Hypothetical protein CBG03308 [Caenorhabditis briggsae]
  Essential gene: C elegans homolog=T09A5.6; Phenotype=Emb,Gro,Slu,Stp
  Coding regions on vcDNA: vcDNA=SeqID_50133; Strand=+; Position=352-888
MEEIVQSAANGGISSTAPDQSSESRFNQLERNLELFQENARHMGVIASDFTSKSQEPLNQKIHTLISGLQVLDQLKSQFTDVRVPIELLDYLDRGQNPQLYTKELLERTRQRNKELNGKTEMYRKFQACLLQELHREMPSDVEEYVCIRKPSGMNGAAAGNAMANSAMAAEETQHAME

SEQ ID NO: 123711 - protein, 335 aa, Heterodera glycines
  Homolog annotation: Hit_ID=CAE71252.1; Match level="QueryCoverage =92%, HitCoverage=60%, E-value=2e-57, Identity=44%"; Hit description =Hypothetical protein CBG18132 [Caenorhabditis briggsae]
  Gene Ontology: Mol. function=proteasome endopeptidase activity; Cellular component=proteasome regulatory particle (sensu Eukarya); Biological process=proteolysis and peptidolysis
  Essential gene: C elegans homolog=C30C11.2; Phenotype=Emb
  Coding regions on vcDNA: vcDNA=SeqID_50134; Strand=+; Position=22-1029
MINNHVNGANDVDMERTENESFGELNQRLIALKAEKNNKESATLAVKVLAFFVNCDNLSAAQDFVEALKNLPESASNSDWARWFYYLGRIEALKGTDAETYKAAEKHFEVALRKAPQNGAVGFKQEVNKWVVLVKLLIGEIPERSLFRTAELRHVLAPYLLLTQTVRLGDVAGFDQTKREHGPIFVKDRTAALVERIHQSVIRTAIRKISTTYSRIYVSDVATKLNFTEQEAHRELVKAIKEGIVRAQLVAGDPLAGGRHYVKFGTTDDQYRGIEPRREFDARVNELLELYHQAVKALRYPDMRNPEVETIDEQRRREQLALEMAAAEEEDDDDF

SEQ ID NO: 123712 - protein, 89 aa, Heterodera glycines; identical to SEQ ID NO: 122103
  Homolog annotation: Hit_ID=NP_501726.1; Match level="QueryCoverage =76%, HitCoverage=85%, E-value=3e-27, Identity=79%"; Hit description =putative protein of eukaryotic origin (4K471) [Caenorhabditis elegans] emb|CAA92471.1| Hypothetical prote
  Essential gene: C elegans homolog=K01H12.1; Phenotype=Emb
  Coding regions on vcDNA: vcDNA=SeqID_50135; Strand=+; Position=1-270

SEQ ID NO: 123713 - protein, 153 aa, Heterodera glycines
  Homolog annotation: Hit_ID=CAD27506.1; Match level="QueryCoverage =100%, HitCoverage=84%, E-value=3e-47, Identity=62%"; Hit description= rpl18-2 [Schizosaccharomyces pombe] sp|Q8TFH1|R18B_SCHPO 60S ribosomal protein L18-B
  Gene Ontology: Cellular component=cytosolic ribosome (sensu Eukarya); Biological process=protein biosynthesis
  Essential gene: C elegans homolog=Y45F10D.12; Phenotype=Ste
  Coding regions on vcDNA: vcDNA=SeqID_50136; Strand=+; Position=17-475
MGIDIKNHHVKKTQRREAASRNPYLLLLVKLYKFLARRTDAGFNKVVLQRLVKSKIYKPPVSLSKLSVSMKGREDKIAVVVGPITDDNRFHEVPKLTVAALRFTESARARIVKAGGECLTLDQLALRAPTGANTVLLRGSRQRVALKHFGKAP

SEQ ID NO: 123714 - protein, 130 aa, Heterodera glycines; identical to SEQ ID NO: 122597
  Homolog annotation: Hit_ID=CAE60902.1; Match level="QueryCoverage =96%, HitCoverage=92%, E-value=6e-21, Identity=43%"; Hit description =Hypothetical protein CBG04618 [Caenorhabditis briggsae]
  Gene Ontology: Cellular component=DNA-directed RNA polymerase I complex; Biological process=transcription
  Essential gene: C elegans homolog=C15H11.8; Phenotype=Gro,Stp
  Coding regions on vcDNA: vcDNA=SeqID_50137; Strand=+; Position=34-426

SEQ ID NO: 123715 - protein, 161 aa, Heterodera glycines
  misc_feature (28)..(28): Xaa can be any naturally occurring amino acid
  Homolog annotation: Hit_ID=NP_497962.1; Match level="QueryCoverage =86%, HitCoverage=53%, E-value=2e-26, Identity=41%"; Hit description =DNaJ domain (prokaryotic heat shock protein) (29.3 kD) (dnj-18Co) [Caenorhabditis elegans] emb|CAA84728.1
  Gene Ontology: Biological process=embryogenesis and morphogenesis
  Essential gene: C elegans homolog=T04A8.9; Phenotype=Emb
  Coding regions on vcDNA: vcDNA=SeqID_50138; Strand=+; Position=2-483
RHNDVAAHKNHYQTLGVSRDASAKDIKXAFFELTKKHHPDMNPTDKTKAAEAFQNITDAYEVLGSEEKRQIYDTLTAPKPQAHFGRTPNFRRTRSNHINMGPAGGHKDWTDLDIDFRDFEHFQRENRRRQTFKDWARANTKSEFYWSSHQSSKSYKSPLAL

SEQ ID NO: 123716 - protein, 162 aa, Heterodera glycines; identical to SEQ ID NO: 122477
  Homolog annotation: Hit_ID=CAE56013.1; Match level="QueryCoverage =75%, HitCoverage=94%, E-value=4e-27, Identity=45%"; Hit description =Hypothetical protein CBG23568 [Caenorhabditis briggsae]
  Essential gene: C elegans homolog=T02H6.11; Phenotype=Age,Gro,Lva,Ste
  Coding regions on vcDNA: vcDNA=SeqID_50139; Strand=+; Position=21-509

SEQ ID NO: 123717 - protein, 152 aa, Heterodera glycines; identical to SEQ ID NO: 122503
  Homolog annotation: Hit_ID=AAT92078.1; Match level="QueryCoverage =99%, HitCoverage=100%, E-value=2e-29, Identity=48%"; Hit description= S. cerevisiae fis1-related protein 2, isoform b [Caenorhabditis elegans]
  Gene Ontology: Cellular component=membrane
  Essential gene: C elegans homolog=F41G3.4; Phenotype=Emb
  Coding regions on vcDNA: vcDNA=SeqID_50140; Strand=+; Position=36-494

SEQ ID NO: 123718 - protein, 153 aa, Heterodera glycines
  misc_feature (101)..(101): Xaa can be any naturally occurring amino acid
  misc_feature (127)..(127): Xaa can be any naturally occurring amino acid
  Homolog annotation: Hit_ID=CAA34603.1; Match level="QueryCoverage =100%, HitCoverage=100%, E-value=6e-69, Identity=86%"; Hit description=unnamed protein product [Brugia pahangi] sp|P62300|RS13 _WUCBA 40S ribosomal protein S13 (40S ribosomal p
  Gene Ontology: Mol. function=structural constituent of ribosome; Cellular component=cytosolic small ribosomal subunit (sensu Eukarya); Biological process=protein biosynthesis
  Essential gene: C elegans homolog=C16A3.9; Phenotype=Emb
  Coding regions on vcDNA: vcDNA=SeqID_50141; Strand=+; Position=42-499
MGRMHNPGKGISRSALPYRRSVPTWQKLTNQEVEEQIVKLARKGLRPSQIGVILRDSHGVAQVRRITGNKIVRILRSKGMAPEIPEDLYHLIKKAVSIRKXHLERFRKDIDSKYRLILVESRIHRLXARYFKTKRMLPPTWKYESATASALVS

SEQ ID NO: 123719 - protein, 431 aa, Heterodera glycines; identical to SEQ ID NO: 122183
  Homolog annotation: Hit_ID=CAE67815.1; Match level="QueryCoverage =81%, HitCoverage=68%, E-value=5e-53, Identity=35%"; Hit description =Hypothetical protein CBG13395 [Caenorhabditis briggsae]
  Gene Ontology: Mol. function=glutathione synthase activity; Cellular component=intracellular; Biological process=neurogenesis
  Essential gene: C elegans homolog=M176.2; Phenotype=Emb,Lva
  Coding regions on vcDNA: vcDNA=SeqID_50142; Strand=+; Position=36-1328

SEQ ID NO: 123720 - protein, 142 aa, Heterodera glycines; identical to SEQ ID NO: 120682
  Homolog annotation: Hit_ID=NP_506180.1; Match level="QueryCoverage =88%, HitCoverage=94%, E-value=2e-20, Identity=48%"; Hit description =unidentified Trans-Spliced transcript, Ribosomal Protein, Large subunit (13.7 kD) (rpl-28) [Caenorhabditi
  Gene Ontology: Mol. function=structural constituent of ribosome; Cellular component=cytosolic ribosome (sensu Eukarya); Biological process=protein biosynthesis
  Essential gene: C elegans homolog=R11D1.8; Phenotype=Lva
  Coding regions on vcDNA: vcDNA=SeqID_50143; Strand=+; Position=28-456

SEQ ID NO: 123721 - protein, 128 aa, Heterodera glycines; identical to SEQ ID NO: 122033
  Homolog annotation: Hit_ID=CAE69561.1; Match level="QueryCoverage =100%, HitCoverage=100%, E-value=1e-66, Identity=96%"; Hit description=Hypothetical protein CBG15773 [Caenorhabditis briggsae]
  Essential gene: C elegans homolog=ZK1010.1; Phenotype=Emb
  Coding regions on vcDNA: vcDNA=SeqID_50144; Strand=+; Position=39-425

SEQ ID NO: 123722 - protein, 154 aa, Heterodera glycines; identical to SEQ ID NO: 122078
  Homolog annotation: Hit_ID=NP_775391.1; Match level="QueryCoverage =92%, HitCoverage=77%, E-value=6e-09, Identity=26%"; Hit description =hypothetical protein DT1P1A10 (human) - like [Danio rerio] gb|AAM28202.1| DT1P1A10-like protein [Danio re
  Essential gene: C elegans homolog=Y51H4A.15; Phenotype=Unclassified
  Coding regions on vcDNA: vcDNA=SeqID_50145; Strand=+; Position=15-479

SEQ ID NO: 123723 - protein, 111 aa, Heterodera glycines; identical to SEQ ID NO: 122614
  Homolog annotation: Hit_ID=NP_504688.1; Match level="QueryCoverage =95%, HitCoverage=92%, E-value=8e-45, Identity=86%"; Hit description =SyNaptoBrevin related, synaptic vesicle-associated membrane protein (12.0 kD) (snb-1) [Caenorhabditis ele
  Gene Ontology: Mol. function=v-SNARE activity; Cellular component =synaptic vesicle; Biological process=nonselective vesicle transport
  Essential gene: C elegans homolog=T10H9.4; Phenotype=Rup,Unc
  Coding regions on vcDNA: vcDNA=SeqID_50146; Strand=+; Position=54-389

SEQ ID NO: 123724 - protein, 51 aa, Heterodera glycines; identical to SEQ ID NO: 122520
  Homolog annotation: Hit_ID=AAV34853.1; Match level="QueryCoverage =100%, HitCoverage=100%, E-value=3e-19, Identity=84%"; Hit description=ribosomal protein L39 [Bombyx mori] gb|AAK92174.1| ribosomal protein L39 [Spodoptera frugiperda] dbj|BAD
  Essential gene: C elegans homolog=C26F1.9; Phenotype=Emb,Lva
  Coding regions on vcDNA: vcDNA=SeqID_50147; Strand=+; Position=23-178

SEQ ID NO: 123725 - protein, 122 aa, Heterodera glycines; identical to SEQ ID NO: 122654
  Homolog annotation: Hit_ID=CAE59329.1; Match level="QueryCoverage =99%, HitCoverage=100%, E-value=2e-44, Identity=75%"; Hit description= Hypothetical protein CBG02671 [Caenorhabditis briggsae]
  Gene Ontology: Mol. function=pre-mRNA splicing factor activity; Cellular component=nucleus; Biological process=mRNA splicing
  Essential gene: C elegans homolog=T28D9.10; Phenotype=Emb,Lva
  Coding regions on vcDNA: vcDNA=SeqID_50148; Strand=+; Position=66-434

SEQ ID NO: 123726 - protein, 193 aa, Heterodera glycines
  Homolog annotation: Hit_ID=NP_491233.1; Match level="QueryCoverage =90%, HitCoverage=81%, E-value=5e-91, Identity=95%"; Hit description =RAB family member (23.6 kD) (rab-2) [Caenorhabditis elegans] gb|AAB52431.1| Uncoordinated protein 108 [Ca
  Gene Ontology: Mol. function=ATP binding; Cellular component=Golgi apparatus; Biological process=two-component signal transduction system (phosphorelay)
  Essential gene: C elegans homolog=F53F10.4; Phenotype=Unc
  Coding regions on vcDNA: vcDNA=SeqID_50149; Strand=+; Position=11-592
RFNIFTVTRNFNLVCFQMSYSYLFKYIIIGDTGVGKSCLLLQFTDKRFQPVHDLTIGVEFGARMITIDGKQIKLQIWDTAGQESFRSITRSYYRGAAGALLVYDITRRDTFNHLTSWLEDARQHSNSNMVIMLIGNKSDLEARREVKKEEGEQFARENGLVFMETSAKTAANVEEAFIDTAKEIYRKIPGGRV

SEQ ID NO: 123727 - protein, 206 aa, Heterodera glycines
  misc_feature (195)..(195): Xaa can be any naturally occurring amino acid
  Homolog annotation: Hit_ID=NP_505181.1; Match level="QueryCoverage =92%, HitCoverage=64%, E-value=1e-64, Identity=61%"; Hit description =mitochondrial ribosomal protein L4 (34.3 kD) (5I949) [Caenorhabditis elegans] gb|AAB69933.1| Hypothetical
  Gene Ontology: Cellular component=mitochondrion
  Essential gene: C elegans homolog=T23B12.2; Phenotype=Emb,Lva
  Coding regions on vcDNA: vcDNA=SeqID_50150; Strand=+; Position=21-639
MMSAKFFTHLINSASVRPISTSCCRKELRELWKLDKRNPFQEIPEAWVTSLDDIEQKNCGLIQLHPDIFRVKPRLDLLHRNITWQSNYRNLTLLKMLSRAEMPGGGRKPWPQKKMGRHHAGSIRSPHFIRGGFAHGVRGPCTQFYMLPNTVRIHGLRTALTLKHAQDDLVIVDSYDTLNSAEPQFLNDLADARNXGYSVLFVDLTV

SEQ ID NO: 123728 - protein, 556 aa, Heterodera glycines; identical to SEQ ID NO: 122607
  Homolog annotation: Hit_ID=NP_499300.1; Match level="QueryCoverage =98%, HitCoverage=82%, E-value=1e-125, Identity=45%"; Hit description= RNA splicing factor (71.2 kD) (3L514) [Caenorhabditis elegans] emb|CAA88957.1| Hypothetical protein M03C
  Gene Ontology: Mol. function=pre-mRNA splicing factor activity; Cellular component=nucleus; Biological process=embryogenesis and morphogenesis
  Essential gene: C elegans homolog=M03C11.7; Phenotype=Emb
  Coding regions on vcDNA: vcDNA=SeqID_50151; Strand=+; Position=12-1682

SEQ ID NO: 123729 - protein, 174 aa, Heterodera glycines
  Homolog annotation: Hit_ID=CAE66018.1; Match level="QueryCoverage =96%, HitCoverage=44%, E-value=5e-50, Identity=51%"; Hit description =Hypothetical protein CBG11211 [Caenorhabditis briggsae]
  Gene Ontology: Mol. function=RNA-3'-phosphate cyclase activity; Cellular component=nucleolus; Biological process=35S primary transcript processing
  Essential gene: C elegans homolog=ZK1127.5; Phenotype=Emb,Lva
  Coding regions on vcDNA: vcDNA=SeqID_50152; Strand=+; Position=20-541
MGVHNELQLEGCNFLRQHIVFSLLTGRTITITKIRSYDDNPGLKEFERIFLSMIKRLTNGTELKLSKNGTELSFRPGLIHGGELEFDCGVQRCISYFLEPLILMAPFCKKPLNVNLTGVTNSVDELSIDAIRATWLPVFSRFVLADQCTEIKIKARGFKPSGGGSVTFSSPIKK

SEQ ID NO: 123730 - protein, 367 aa, Heterodera glycines
  misc_feature (191)..(191): Xaa can be any naturally occurring amino acid
  Homolog annotation: Hit_ID=AAR09171.1; Match level="QueryCoverage =100%, HitCoverage=100%, E-value=0.0, Identity=99%"; Hit description =aldolase [Heterodera glycines]
  Gene Ontology: Mol. function=fructose-bisphosphate aldolase activity; Biological process=fructose metabolism
  Essential gene: C elegans homolog=F01F1.12a; Phenotype=Gro,Unc
  Coding regions on vcDNA: vcDNA=SeqID_50153; Strand=+; Position=53-1154
MAEVGNSYRPPLSEEKQNELRAIAQKILQPGKGILAADESTGSIGKRFDTIGLENTENNRRRYRQLLFTTPSFGQNLSGVILFDETFRQSTDNGVRFVDVIKKAGAVAGIKVDTGVVPLAGTLDEGTTQGLDKLSDRCAEYKKGGCDFAKWRCVLNIGAHKPSHLALMENANVLARYASICQQNGLVPIVXEPEVLCDGEHSLERCQKVTELTLAYTYKALADHHIYLEGTLLKPNMVTPGQSHSPKATPDQIGLATVTALRRSVPIAVPGIVFLSGGQSEIEATHNLNAINSVPGPKPWTLSFSYGRALQSSVIKKWNGKDENLGDAQKVLLHRAKANGDAQQGKYTGEEAAASAAESLFVAKHAY

SEQ ID NO: 123731 - protein, 184 aa, Heterodera glycines
  Homolog annotation: Hit_ID=NP_508588.1; Match level="QueryCoverage =80%, HitCoverage=23%, E-value=8e-45, Identity=57%"; Hit description =chitinase (66.9 kD) (cht-1) [Caenorhabditis elegans] gb|AAA83586.1| Chitinase protein 1 [Caenorhabditis e
  Gene Ontology: Mol. function=chitinase activity; Cellular component =extracellular space; Biological process=response to bacteria
  Essential gene: C elegans homolog=C04F6.3; Phenotype=Emb
  Coding regions on vcDNA: vcDNA=SeqID_50154; Strand=+; Position=48-599
MLYVFLFYAGAANYWAKKGMPKSKIIIGIPTYGRGWTLSNPQQFRDIEAPAQVAKATKFVKLAGIGSYFEFCEMLANGAQRYVDRETLVPFLVADNDQWFSYDDVESIRNKLSWIRQNSFGGAFVWTLDFDDFNGQCPGSQLGRYPLIRTIAQELGGIQLSQTPVSALSNSPSPSTGAALPAVT

SEQ ID NO: 123732 - protein, 200 aa, Heterodera glycines; identical to SEQ ID NO: 122051
  Homolog annotation: Hit_ID=NP_496447.1; Match level="QueryCoverage =95%, HitCoverage=60%, E-value=3e-79, Identity=70%"; Hit description =mitochondrial solute carrier (34.1 kD) (2L760) [Caenorhabditis elegans] emb|CAA91399.1| Hypothetical prot
  Gene Ontology: Mol. function=carrier activity; Cellular component =mitochondrion; Biological process=embryogenesis and morphogenesis
  Essential gene: C elegans homolog=W02B12.9; Phenotype=Emb
  Coding regions on vcDNA: vcDNA=SeqID_50155; Strand=+; Position=21-620

SEQ ID NO: 123733 - protein, 221 aa, Heterodera glycines; identical to SEQ ID NO: 122517
  Homolog annotation: Hit_ID=CAE56730.1; Match level="QueryCoverage =92%, HitCoverage=96%, E-value=3e-98, Identity=82%"; Hit description =Hypothetical protein CBG24517 [Caenorhabditis briggsae]
  Gene Ontology: Cellular component=COPII-coated vesicle; Biological process=ER to Golgi transport
  Essential gene: C elegans homolog=T08D2.1; Phenotype=Unc
  Coding regions on vcDNA: vcDNA=SeqID_50156; Strand=+; Position=19-684

SEQ ID NO: 123734 - protein, 130 aa, Heterodera glycines; identical to SEQ ID NO: 122516
  Homolog annotation: Hit_ID=AAM63595.1; Match level="QueryCoverage =96%, HitCoverage=86%, E-value=1e-48, Identity=76%"; Hit description =60S ribosomal protein L26 [Arabidopsis thaliana] dbj|BAB08459.1| 60S ribosomal protein L26 [Arabidopsis th
  Gene Ontology: Mol. function=structural constituent of ribosome; Cellular component=cytosolic ribosome (sensu Eukarya); Biological process=protein biosynthesis
  Essential gene: C elegans homolog=F28C6.7a; Phenotype=Emb,Lva,Ste
  Coding regions on vcDNA: vcDNA=SeqID_50157; Strand=+; Position=160-552

SEQ ID NO: 123735 - protein, 276 aa, Heterodera glycines
  Homolog annotation: Hit_ID=CAE57680.1; Match level="QueryCoverage =100%, HitCoverage=50%, E-value=1e-110, Identity=74%"; Hit description=Hypothetical protein CBG00674 [Caenorhabditis briggsae]
  Gene Ontology: Mol. function=chaperone activity; Cellular component =cytoskeleton; Biological process=cell organization and biogenesis
  Essential gene: C elegans homolog=K01C8.10; Phenotype=Emb,Lva,Ste
  Coding regions on vcDNA: vcDNA=SeqID_50158; Strand=+; Position=18-845
MSPSLSVANSNVSRPLGQPKVAGFKDKDKPESVRTSNIVAAKAVADAVRTSLGPRGMDKMIQSGNGEVTITNDGATILNQMSVVHPTAKMLVELSKAQDIEAGDGTTTVVVLAGSLLDAAEKLLAKGIHPTTISDSFQRAATFSEKVLEEMATPIDINDDDELVKLAMTSLNSKVVSQYSHLLAPMAVQAVKKLMSSPEDSSVNLKLIKVVKKLGETVEESQLIEGALIDQKSMGHGGPARVENANIGLIQFQISPPKPYMENQVVISDYAQMDRA

SEQ ID NO: 123736 - protein, 212 aa, Heterodera glycines
  Homolog annotation: Hit_ID=NP_490676.1; Match level="QueryCoverage =100%, HitCoverage=86%, E-value=9e-76, Identity=62%"; Hit description= ribosomal Protein, Large subunit (28.1 kD) (rpl-7) [Caenorhabditis elegans] gb|AAB54165.1| Ribosomal pro
  Gene Ontology: Mol. function=structural constituent of ribosome; Cellular component=cytosolic large ribosomal subunit (sensu Eukarya); Biological process=protein biosynthesis
  Essential gene: C elegans homolog=F53G12.10; Phenotype=Emb,Lva
  Coding regions on vcDNA: vcDNA=SeqID_50159; Strand=+; Position=24-659
MTEAKKLPEVPETLLKRRKIRAAQRAAKAKNSLNTIKKVKAKKTEIFKRAEHYLVEYRQKQRQLVALKREAKKVGYYYVPDEPKLAFVVRIKGINKIHPRPRKVLQLLRLRQINNGVFVKLNKATIQMLRIADPYIAWGYPSQKIIRQLVYKRGYAKESGQRIPITDNAIVERNMGKSDVICVEDMIHQIWTVGPHFKQVTNFLWPFKLSNP

SEQ ID NO: 123737 - protein, 244 aa, Heterodera glycines
  misc_feature (229)..(229): Xaa can be any naturally occurring amino acid
  Homolog annotation: Hit_ID=NP_490676.1; Match level="QueryCoverage =100%, HitCoverage=100%, E-value=1e-91, Identity=64%"; Hit description=ribosomal Protein, Large subunit (28.1 kD) (rpl-7) [Caenorhabditis elegans] gb|AAB54165.1| Ribosomal pr
  Gene Ontology: Mol. function=structural constituent of ribosome; Cellular component=cytosolic ribosome (sensu Eukarya); Biological process=protein biosynthesis
  Essential gene: C elegans homolog=F53G12.10; Phenotype=Emb,Lva
  Coding regions on vcDNA: vcDNA=SeqID_50160; Strand=+; Position=26-761
MTEAKKLPEVPETLLKRRKIRAAQRAARAKNSLNTIKKAKAKKTEIFKRAEHYLVEYRQKQRQLVALKREAKKVGNYYVPDEPKLAFVVRIKGINKIHPRPRKVLQLLRLRQINNGVFVKLNKATIQMLRIADPYIAWGYPSQKIIRQLVYKRGYAKESGQRIPITDNAIVERNMGKSDVICVEDMIHQIWTVGPHFKQVTNFLWPFKLSNPVGGFKKKSNHFVEGGDXGNREDQINKLLEKMI

SEQ ID NO: 123738 - protein, 86 aa, Heterodera glycines; identical to SEQ ID NO: 122513
  Homolog annotation: Hit_ID=EAK82416.1; Match level="QueryCoverage =98%, HitCoverage=90%, E-value=3e-29, Identity=75%"; Hit description =hypothetical protein UM01635.1 [Ustilago maydis 521] ref|XP _399250.1| hypothetical protein UM01635.1 [Usti
  Essential gene: C elegans homolog=F56E10.4; Phenotype=Lva
  Coding regions on vcDNA: vcDNA=SeqID_50161; Strand=+; Position=6-266

SEQ ID NO: 123739 - protein, 201 aa, Heterodera glycines
  misc_feature (171)..(171): Xaa can be any naturally occurring amino acid
  misc_feature (188)..(188): Xaa can be any naturally occurring amino acid
  Homolog annotation: Hit_ID=CAB48391.1; Match level="QueryCoverage =99%, HitCoverage=99%, E-value=1e-96, Identity=87%"; Hit description =peroxiredoxin [Globodera rostochiensis]
  Gene Ontology: Mol. function=thioredoxin peroxidase activity; Cellular component=cytoplasm; Biological process=response to oxidative stress
  Essential gene: C elegans homolog=F09E5.15; Phenotype=Sck,Sma
  Coding regions on vcDNA: vcDNA=SeqID_50162; Strand=+; Position=37-638
MSSSSKAFIGKPAPNFMADAVVNGDFKTISLEQFKGQYVVLFFYPLDFTFVCPTEIIAFSDKAGEFKKIGVQLIACSTDSKFCHLEWINKPRKQGGLGEMNIPVLADTSHKISRDYGVLMEEAGIAYRGLFIIDDKGVLRQITINDLPVGRSVDETLRLVQAFQYTDKHGXEVCPANWQPGTDTIKPXDPKGSQAYFDKKG

SEQ ID NO: 123740 - protein, 181 aa, Heterodera glycines; identical to SEQ ID NO: 122579
  Homolog annotation: Hit_ID=NP_730760.1; Match level="QueryCoverage =98%, HitCoverage=98%, E-value=8e-98, Identity=96%"; Hit description =CG8385-PE, isoform E [Drosophila melanogaster] ref|NP_730759.1| CG8385-PD, isoform D [Drosophila melanoga
  Gene Ontology: Mol. function=enzyme activator activity; Cellular component=cytoplasmic vesicle; Biological process=G-protein coupled receptor protein signaling pathway
  Essential gene: C elegans homolog=B0336.2; Phenotype=Emb
  Coding regions on vcDNA: vcDNA=SeqID_50163; Strand=+; Position=48-593

SEQ ID NO: 123741 - protein, 100 aa, Heterodera glycines; identical to SEQ ID NO: 122606
  Homolog annotation: Hit_ID=CAE65191.1; Match level="QueryCoverage =74%, HitCoverage=55%, E-value=7e-19, Identity=54%"; Hit description =Hypothetical protein CBG10064 [Caenorhabditis briggsae]
  Essential gene: C elegans homolog=ZK1098.7; Phenotype=Lva
  Coding regions on vcDNA: vcDNA=SeqID_50164; Strand=+; Position=54-356

SEQ ID NO: 123742 - protein, 206 aa, Heterodera glycines
  misc_feature (78)..(78): Xaa can be any naturally occurring amino acid
  Homolog annotation: Hit_ID=NP_490749.1; Match level="QueryCoverage =97%, HitCoverage=98%, E-value=1e-60, Identity=63%"; Hit description =nascent polypeptide-associated complex NAC and Ubiquitin-associated domain containing protein (21.8 kD) (
  Gene Ontology: Mol. function=TATA-binding protein binding; Cellular component=nascent polypeptide-associated complex; Biological process= nuclear positioning
  Essential gene: C elegans homolog=Y65B4BR.5a; Phenotype=Gro,Stp
  Coding regions on vcDNA: vcDNA=SeqID_50165; Strand=+; Position=33-652
MVTAEDTVKTKEEDPKKTTTDDGSSSEEEVPELEEGDVTEEQKKVAEAAGLSEQVAEKGSKQSRSEKKARKLFSKLGXLSKCTGVSRVCIRKSKSILFVINKPDVYKSPGSDTYVVFGEAKIEDLAQHAQITDVENLKPPSIIRDVRNRITPAEEESDGEEADATGIEEKDIELVMSQANVSRNKAIKALKKADNDLVNAIMALTM

SEQ ID NO: 123743 - protein, 133 aa, Heterodera glycines; identical to SEQ ID NO: 121281
  Homolog annotation: Hit_ID=NP_492601.1; Match level="QueryCoverage =90%, HitCoverage=91%, E-value=4e-40, Identity=57%"; Hit description =cytochrome C Oxidase, subunit Vb, LiPid Depleted LPD-4 (lpd-4) [Caenorhabditis elegans] emb|CAB03002.1| H
  Gene Ontology: Biological process=negative regulation of FGF receptor signaling pathway
  Essential gene: C elegans homolog=F26E4.9; Phenotype=Lpd
  Coding regions on vcDNA: vcDNA=SeqID_50166; Strand=+; Position=40-441

SEQ ID NO: 123744 - protein, 133 aa, Heterodera glycines
  Homolog annotation: Hit_ID=I59348; Match level="QueryCoverage=94%, HitCoverage=34%, E-value=2e-30, Identity=56%"; Hit description=CCAAT binding transcription factor CBF subunit C - rat
  Gene Ontology: Mol. function=transcriptional activator activity; Cellular component=CCAAT-binding factor complex; Biological process =cell organization and biogenesis
  Essential gene: C elegans homolog=F23F1.1; Phenotype=Lva
  Coding regions on vcDNA: vcDNA=SeqID_50167; Strand=+; Position=28-426
MASSSSDHSAYSKQVLEEFWPGQNVKIGHMTMNSFREVNRHSELPIARIKKIMKIEEGVKTQMISAEAPVLLAKAAELFIEELTLRAWLNTNDNRRKTIQKSDIAAGAAKSEMFDFLIDILPRDELQKEQSVD

SEQ ID NO: 123745 - protein, 154 aa, Heterodera glycines; identical to SEQ ID NO: 122171
  Homolog annotation: Hit_ID=EAA05425.2; Match level="QueryCoverage =97%, HitCoverage=98%, E-value=6e-80, Identity=99%"; Hit description =ENSANGP00000012700 [Anopheles gambiae str. PEST]
  Gene Ontology: Mol. function=calcium ion binding
  Essential gene: C elegans homolog=T21H3.3; Phenotype=Emb,Ste
  Coding regions on vcDNA: vcDNA=SeqID_50168; Strand=+; Position=354-818

SEQ ID NO: 123746 - protein, 261 aa, Heterodera glycines
  Homolog annotation: Hit_ID=NP_492315.3; Match level="QueryCoverage =97%, HitCoverage=12%, E-value=1e-93, Identity=67%"; Hit description =abnormal GONad development GON-2, putative TRP homologous cation channel ltrpc1 family member (gon-2) [Ca
  Gene Ontology: Mol. function=calcium channel activity; Cellular component=integral to plasma membrane; Biological process =gametogenesis
  Essential gene: C elegans homolog=T01H8.5; Phenotype=Pvl,Stp
  Coding regions on vcDNA: vcDNA=SeqID_50169; Strand=+; Position=5-787
FANLSVLTKRHEMALCMWQHGEEALAKALVACRIYKSLANEAAEDYLEVEVCEELKTYAEEFRQLSLELLDHCYKEDDAQTLQLLTYELSYWGHQTCLSLAVIVNNKQFLAHPCCQILLADLWHGGLRIRSNSNIKVLMGILFPPSIFLLEFKSREELLLQPQTAAEHQKDINESSSSSSDSSSSSSSSDSESDGDESDAGERGGATAEERRRTSHSHGSMQSLNFTSIFKSKRKRRRPSHSRSSTTAKEDIEMGKQRNRV

SEQ ID NO: 123747 - protein, 143 aa, Heterodera glycines
  Homolog annotation: Hit_ID=CAE71300.1; Match level="QueryCoverage =97%, HitCoverage=93%, E-value=6e-48, Identity=62%"; Hit description =Hypothetical protein CBG18189 [Caenorhabditis briggsae]
  Gene Ontology: Mol. function=DNA-directed RNA polymerase activity; Cellular component=DNA-directed RNA polymerase II, holoenzyme; Biological process=transcription from Pol I promoter
  Essential gene: C elegans homolog=F26F4.11; Phenotype=Emb
  Coding regions on vcDNA: vcDNA=SeqID_50170; Strand=+; Position=1-432
QDLFTVKNIDPDGKKFDRVSRLFCDSESFKMGLILDVNTQLYAMGINDKFRLMLCSSIRDDGLTEEGEYDKSIENIPRVRMFEYVMYGKIYRIENDEGTAETSRLTAYASFGGLLMRIQGEANNLTGFEQDKNIYLLLKKVPN

SEQ ID NO: 123748 - protein, 141 aa, Heterodera glycines
  Homolog annotation: Hit_ID=CAE71253.1; Match level="QueryCoverage =97%, HitCoverage=17%, E-value=3e-32, Identity=50%"; Hit description =Hypothetical protein CBG18133 [Caenorhabditis briggsae]
  Gene Ontology: Mol. function=ATP binding; Cellular component=nucleus; Biological process=protein folding
  Essential gene: C elegans homolog=C30C11.4; Phenotype=Bmd,Gro
  Coding regions on vcDNA: vcDNA=SeqID_50171; Strand=+; Position=1-423
TRIDFGNLTCYMAVARNKGIEIVENDYSLHATPSCVSFGQFARMMGLGAKQQLNINYGNSVVNFKHILGRTFNDKVVQTFRQHIPCGLMGKFTDDQIEIKVTHLGTTRVLSPEQVVACLLTHLRVQLSCSLGTDVTECVIN

SEQ ID NO: 123749 - protein, 139 aa, Heterodera glycines
  Homolog annotation: Hit_ID=CAE71253.1; Match level="QueryCoverage =93%, HitCoverage=16%, E-value=6e-32, Identity=51%"; Hit description =Hypothetical protein CBG18133 [Caenorhabditis briggsae]
  Gene Ontology: Mol. function=ATP binding; Cellular component =cytoplasm; Biological process=protein folding
  Essential gene: C elegans homolog=C30C11.4; Phenotype=Bmd,Gro
  Coding regions on vcDNA: vcDNA=SeqID_50172; Strand=+; Position=107-523
MAGIDFGNLTCYMAVARNKGIEIVENDYSLHATPSCVSFGQFARMMGFGAKQQLNVNYGNSVVNFKHILGRTFNDKVVQTFRQHIPCGLMGKFTDDQIEIKVTHLGTTRVLSPEQVVACLLTHLRVQLSRSLGTDATEC

SEQ ID NO: 123750 - protein, 173 aa, Heterodera glycines; identical to SEQ ID NO: 122368
  Homolog annotation: Hit_ID=CAE71615.1; Match level="QueryCoverage =97%, HitCoverage=98%, E-value=2e-82, Identity=83%"; Hit description =Hypothetical protein CBG18577 [Caenorhabditis briggsae]
  Gene Ontology: Mol. function=peptidyl-prolyl cis-trans isomerase activity; Cellular component=membrane fraction; Biological process =protein folding
  Essential gene: C elegans homolog=Y75B12B.2; Phenotype=Emb
  Coding regions on vcDNA: vcDNA=SeqID_50173; Strand=+; Position=57-578

SEQ ID NO: 123751 - protein, 161 aa, Heterodera glycines; identical to SEQ ID NO: 122144
  Homolog annotation: Hit_ID=CAE70207.1; Match level="QueryCoverage =100%, HitCoverage=100%, E-value=1e-56, Identity=65%"; Hit description=Hypothetical protein CBG16683 [Caenorhabditis briggsae]
  Gene Ontology: Mol. function=structural constituent of ribosome; Cellular component=cytosolic large ribosomal subunit (sensu Eukarya); Biological process=protein biosynthesis
  Essential gene: C elegans homolog=C14B9.7; Phenotype=Emb
  Coding regions on vcDNA: vcDNA=SeqID_50174; Strand=+; Position=121-606

SEQ ID NO: 123752 - protein, 140 aa, Heterodera glycines; identical to SEQ ID NO: 122751
  Homolog annotation: Hit_ID=NP_495286.1; Match level="QueryCoverage =95%, HitCoverage=80%, E-value=5e-28, Identity=48%"; Hit description =ATP synthase H+ transporting mitochondrial F1 complex (16.9 kD) (2G673) [Caenorhabditis elegans] gb|AAC46
  Gene Ontology: Mol. function=hydrogen-transporting ATP synthase activity, rotational mechanism; Cellular component=proton -transporting ATP synthase, central stalk (sensu Eukarya); Biological process=ATP synthesis coupled proton transport
  Essential gene: C elegans homolog=F58F12.1; Phenotype=Emb,Lva
  Coding regions on vcDNA: vcDNA=SeqID_50175; Strand=+; Position=24-446

SEQ ID NO: 123753 - protein, 190 aa, Heterodera glycines; identical to SEQ ID NO: 122342
  Homolog annotation: Hit_ID=XP_392565.1; Match level="QueryCoverage =99%, HitCoverage=99%, E-value=6e-75, Identity=72%"; Hit description =similar to ribosomal protein L18 [Apis mellifera]
  Gene Ontology: Cellular component=cytosolic ribosome (sensu Eukarya); Biological process=protein biosynthesis
  Essential gene: C elegans homolog=Y45F10D.12; Phenotype=Ste
  Coding regions on vcDNA: vcDNA=SeqID_50176; Strand=+; Position=35-607

SEQ ID NO: 123754 - protein, 465 aa, Heterodera glycines; identical to SEQ ID NO: 122792
  Homolog annotation: Hit_ID=A45618; Match level="QueryCoverage=100%, HitCoverage=100%, E-value=0.0, Identity=89%"; Hit description =translation elongation factor eEF-1 alpha chain - nematode (Onchocerca volvulus) sp|P27592|EF1A_ONCVO ELONGATI
  Gene Ontology: Mol. function=translation factor activity, nucleic acid binding; Biological process=protein biosynthesis
  Essential gene: C elegans homolog=R03G5.1a; Phenotype=Emb,Lva,Unc
  Coding regions on vcDNA: vcDNA=SeqID_50177; Strand=+; Position=12-1409

SEQ ID NO: 123755 - protein, 299 aa, Heterodera glycines
  Homolog annotation: Hit_ID=NP_498013.1; Match level="QueryCoverage =59%, HitCoverage=92%, E-value=3e-29, Identity=35%"; Hit description =bzfb xenla basic fgf-repressed zic binding protein homolog like (3F951) [Caenorhabditis elegans] gb|AAA62
  Essential gene: C elegans homolog=C35D10.5; Phenotype=Gro
  Coding regions on vcDNA: vcDNA=SeqID_50178; Strand=+; Position=37-936
MLFCPMASQRTHCALFQQRHLATKYVRFPLVPPDNKNSVQTLQQLIASQKDPNAFVFGTNMAGRVGQWLTKRSFEKTVDTELRILLLKSANQMYLCCANKYPFIPLLNEFGLPDHYSSWYRLTLLHIWMALCRVQQSLEAMAYIYFMHQVLEVFNTDWYTRLDKAAKEMGMSVNKRKEGMALHAIYISTLHDYDEGFFGDDRVLAAAVWRSFFLQLPDVCPAQINRVGRYMRATMASLARMDDTRLLTDGIERWDVAEELARLVSAEQFGTIPAAPPSSSMDGDGRNSAQPAPKVAASN

SEQ ID NO: 123756 - protein, 165 aa, Heterodera glycines
  Homolog annotation: Hit_ID=NP_998660.1; Match level="QueryCoverage =99%, HitCoverage=21%, E-value=3e-37, Identity=47%"; Hit description =zgc:55483 [Danio rerio] gb|AAH48370.1| Zgc:55483 [Danio rerio]
  Gene Ontology: Mol. function=protein binding; Cellular component=SCF ubiquitin ligase complex; Biological process=apoptosis
  Essential gene: C elegans homolog=D2045.6; Phenotype=Emb
  Coding regions on vcDNA: vcDNA=SeqID_50179; Strand=+; Position=41-535
GNKAGFPAVAAALELVDPPGCRNSARGSKSPQLLVLYCDQLLRKSARNMEDEKMDENLEQVMTVFKYIDDKDMFQAFFHKFLCKRLVYDTSASEEQERCMIAKLKHMCGFEYTSKLERLLTDVALSRDHSEQFKQQPRTSNVDFSVIVVMSNVWPLQQPVKFEIP

SEQ ID NO: 123757 - protein, 291 aa, Heterodera glycines
  Homolog annotation: Hit_ID=CAA79619.2; Match level="QueryCoverage =95%, HitCoverage=69%, E-value=3e-42, Identity=35%"; Hit description =Hypothetical protein F02A9.4b [Caenorhabditis elegans] sp|P34384|YLPD_CAEEL Hypothetical protein F02A9.4b
  Essential gene: C elegans homolog=F02A9.4b; Phenotype=Lva
  Coding regions on vcDNA: vcDNA=SeqID_50180; Strand=+; Position=14-886
MLSKCLRSSIFGCFNCALQNVSSAGVLMNSVRHAGTAEHWRRAYLKDLYNRRQMVGPEPLRGRASEDNWNYPSEISALSHRLHIPDMDNALIVQALTDKSYFTRNDLDDEAMGDDGPLTTEVARDKSNDQLVEKGMPLFRHIVLTYLRAHWPLAPEEFIIAVATRIAPTSALAELATQLGLHHVVRTAEFPPTQQTLQSTLLALVGAMDVAKARDFVRRFVLPRLYEVPLEDVLPFRHPFAVLGDYLRTWQGATDIQPRTIGSGAVMKATPFYQGADYVDKQQIVGPSGGE

SEQ ID NO: 123758 - protein, 180 aa, Heterodera glycines
  misc_feature (174)..(174): Xaa can be any naturally occurring amino acid
  Homolog annotation: Hit_ID=CAB48391.1; Match level="QueryCoverage =99%, HitCoverage=89%, E-value=8e-79, Identity=77%"; Hit description =peroxiredoxin [Globodera rostochiensis]
  Gene Ontology: Mol. function=thioredoxin peroxidase activity; Cellular component=cytoplasm; Biological process=response to oxidative stress
  Essential gene: C elegans homolog=F09E5.15; Phenotype=Sck,Sma
  Coding regions on vcDNA: vcDNA=SeqID_50181; Strand=+; Position=32-571
MSAGRANIGKPAPNFSAEAVVDFDFKTVSLDDYKGKYVVLFFYPEDFSFVCPTEIIAFSDRSNEFANINTQLLACSTDSKFCHFEWVSKPRKQGGLGEMQIPILADRTQRISRDYGVLKEDTGNAYRGLFIIDTKGILRQITINDTPVGRSIDETLRLVQAFQFTDEHGEVCPXNWKPGE

SEQ ID NO: 123759 - protein, 140 aa, Heterodera glycines
  Homolog annotation: Hit_ID=CAE73245.1; Match level="QueryCoverage =98%, HitCoverage=37%, E-value=2e-27, Identity=45%"; Hit description =Hypothetical protein CBG20661 [Caenorhabditis briggsae]
  Gene Ontology: Mol. function=diphosphomevalonate decarboxylase activity; Cellular component=cytosol; Biological process =embryogenesis and morphogenesis
  Essential gene: C elegans homolog=Y48B6A.13a; Phenotype=Emb,Sck
  Coding regions on vcDNA: vcDNA=SeqID_50182; Strand=+; Position=1-420
MNRGGGFHITIQAPVNIALIKYWGKRNEELVLPLNDSIAITIDELSATTHITIGPDVSTDSVTLNGVGIDIAGSSRFRNVFQQIREYSNRKRKLKGEHASKGWHTKIESSTNFPTSAGLASSAAGFAAIAFGLGKIFRLP

SEQ ID NO: 123760 - protein, 345 aa, Heterodera glycines
  misc_feature (270)..(270): Xaa can be any naturally occurring amino acid
  Homolog annotation: Hit_ID=NP_500332.1; Match level="QueryCoverage =84%, HitCoverage=62%, E-value=4e-21, Identity=27%"; Hit description =ATPase H+ transporting lysosomal (49.6 kD) (4E137) [Caenorhabditis elegans] gb|AAC69004.1| Hypothetical p
  Essential gene: C elegans homolog=Y55H10A.1; Phenotype=Ste
  Coding regions on vcDNA: vcDNA=SeqID_50183; Strand=+; Position=14-1049
MILKLKVPILLYCFVQCLSAVKVDNAEQSDQPTGDSSSGQFPISYPPIKYENDLAYVEKPSGNERCLFYAEGLSVVVFATKKSQSAWADYRSDTKESPKYTASIECQGNMNVGSSFDVYLKIDGKAEGVVRADIGKKDAKSVFTVEGAEFILNFNVTQVGFWQLVGATVERIEVKGSSDFLNKNLNVDKKWTLEPSVVPSTNINGFKDYSFACGQTNPIVWALKDSNDYAVGITLNNVQFQPFNATYTAGGKEADRLKFGWKVNDCQGAXSIGTWMGLVVATLLICVRFFVFLICNSVTYNAQHSIIPNQKQIIISLENSISSFSFITFPSKFFILCSFININLF

SEQ ID NO: 123761 - protein, 179 aa, Heterodera glycines
  Homolog annotation: Hit_ID=CAE70201.1; Match level="QueryCoverage =93%, HitCoverage=98%, E-value=5e-38, Identity=44%"; Hit description =Hypothetical protein CBG16676 [Caenorhabditis briggsae]
  Essential gene: C elegans homolog=D2007.4; Phenotype=Lva
  Coding regions on vcDNA: vcDNA=SeqID_50184; Strand=+; Position=2-541
VRFLQRFVNNNPRNLERVRLQGKPSGWEFEKNRAQHNFIYRVDFCPTKNAIAARVVHYEDGIVIEASTREKTVQSQLYSQTDVSAAYNIGRLLAHRCKMAGIEHCMSSLTENELEGSKKREAFLRALNESGLLLEEPEAIPHTHLNDPNLVWETFPIQHNRADKLDELDLSLEPGKGVC

SEQ ID NO: 123762 - protein, 158 aa, Heterodera glycines
  Homolog annotation: Hit_ID=AAL78213.1; Match level="QueryCoverage =81%, HitCoverage=51%, E-value=3e-44, Identity=68%"; Hit description =probable protein kinase Hgg-20 [Heterodera glycines]
  Gene Ontology: Mol. function=protein kinase activity; Cellular component=nucleus; Biological process=signal transduction
  Essential gene: C elegans homolog=B0218.5; Phenotype=Unclassified
  Coding regions on vcDNA: vcDNA=SeqID_50185; Strand=+; Position=1-474
LGRDEQPDADSGQTMEFNYVVMSLVGRPMDKLLHESGDRFSPGTAIGTSIQLLKALKALHSVGYLHRDIKPANSAIGTPETNEQRLLYLLDFGMARKYVREDGTHRRQRDTARFRGTPIYAPISAHIKRDYSRRDDIESWFYMLIKFYKGSVPWNSLR

SEQ ID NO: 123763 - protein, 204 aa, Heterodera glycines
  Homolog annotation: Hit_ID=NP_499964.1; Match level="QueryCoverage =100%, HitCoverage=100%, E-value=1e-93, Identity=78%"; Hit description=ribosomal Protein, Large subunit (24.1 kD) (rpl-15) [Caenorhabditis elegans] gb|AAC24397.1| Ribosomal p
  Gene Ontology: Mol. function=structural constituent of ribosome; Cellular component=cytosolic large ribosomal subunit (sensu Eukarya); Biological process=protein biosynthesis
  Essential gene: C elegans homolog=K11H12.2; Phenotype=Gro,Stp
  Coding regions on vcDNA: vcDNA=SeqID_50186; Strand=+; Position=56-670
MGAYKYMQELWRKKQSEVMRYLLRIRCWQYRQMEAIHRCTRPTRPEKARRLGYKAKQGFLIYRVRIRRGGRKRQVTKGQTYGKPKTHGVNQLKNTRSLQAVAEARAGRRLGELRVLNSYWVGQDSTYKFFEVILVDPSHKTIRRNPDTQWITKPVQKHREQRGLTSAGRKSRGLGKGIKHTKTIGGSRRKCWKRQNTVEFHRKR

SEQ ID NO: 123764 - protein, 205 aa, Heterodera glycines
  misc_feature (168)..(168): Xaa can be any naturally occurring amino acid
  Homolog annotation: Hit_ID=NP_499964.1; Match level="QueryCoverage =100%, HitCoverage=100%, E-value=4e-92, Identity=77%"; Hit description=ribosomal Protein, Large subunit (24.1 kD) (rpl-15) [Caenorhabditis elegans] gb|AAC24397.1| Ribosomal p
  Gene Ontology: Mol. function=structural constituent of ribosome; Cellular component=cytosolic large ribosomal subunit (sensu Eukarya); Biological process=protein biosynthesis
  Essential gene: C elegans homolog=K11H12.2; Phenotype=Gro,Stp
  Coding regions on vcDNA: vcDNA=SeqID_50187; Strand=+; Position=48-660
MGAYKYMQELWRKKQSEVMRYLLRIRCWQYRQMEAIHRCTRPTRPEKARRLGYKAKQGFLIYRVRIRRGGRKRQVTKGQTYGKPKTHGVNQLKNTRSLQAVAEARAGRRLGELRVLNSYWVGQDSTYKFFEVILVDPSHKTIRRNPDTQWITKPVQKHREQRGLTSAXGRKSRGLGKGMKHTKTIGGSRKKCWKRQNTVEFHRRR

SEQ ID NO: 123765 - protein, 127 aa, Heterodera glycines
  Homolog annotation: Hit_ID=NP_492301.1; Match level="QueryCoverage =90%, HitCoverage=42%, E-value=2e-13, Identity=33%"; Hit description =putative protein family member, with a coiled coil domain, of bilaterial origin (27.8 kD) (1J62) [Caenorh
  Essential gene: C elegans homolog=K02B12.8; Phenotype=Him
  Coding regions on vcDNA: vcDNA=SeqID_50188; Strand=+; Position=99-479
MSTWIHCNHCFIVPTNDCNKTRFWFTSCGHLMCAECLKAKRSNNNNGQHFECLLCHQQNVQLVELNRHLRPELLALFRPAKDLIDEFNAKLKQVLTFQQSHQKRLVDHLTDKAQRATKWAQSVQKDM

SEQ ID NO: 123766 - protein, 213 aa, Heterodera glycines
  misc_feature (188)..(188): Xaa can be any naturally occurring amino acid
  Homolog annotation: Hit_ID=NP_502097.1; Match level="QueryCoverage =89%, HitCoverage=72%, E-value=4e-29, Identity=37%"; Hit description =peroxisomal membrane anchor protein like (28.2 kD) (4L949) [Caenorhabditis elegans] emb|CAB03225.1| Hypot
  Gene Ontology: Cellular component=integral to membrane
  Essential gene: C elegans homolog=R07H5.1; Phenotype=Lva
  Coding regions on vcDNA: vcDNA=SeqID_50189; Strand=+; Position=145-783
MASSSAASDDSSAVSSPPPPLLSSPIRSEMVAAAKQFLANPRVRNTPISEQTEFLRGKGLTETEIQKAMKLTTDGGGEQVPSTSLSSLPPASAPSPSARAVVDLARSALLFGTAGYMVYRFVRSWLLPQLLNVPDPAEERMQRLEQQVERLSDSTRCIAESVTQTLVAVTEQNEQLSRTMMMVQGGTXGTVCTADIDRVHTEIGIVKSLLLNQ

SEQ ID NO: 123767 - protein, 197 aa, Heterodera glycines
  Homolog annotation: Hit_ID=AAL78223.1; Match level="QueryCoverage =94%, HitCoverage=75%, E-value=2e-47, Identity=55%"; Hit description =hypothetical protein Hgg-29 [Heterodera glycines]
  Essential gene: C elegans homolog=ZC373.5; Phenotype=Unc
  Coding regions on vcDNA: vcDNA=SeqID_50190; Strand=+; Position=19-609
MEFKGEEWSDNPISECRMAELVRHFFALGWMCDNGSGMAVRVKDERTGEHLILNSSNSLEKEIFSENDLFVMKMNGEILKSPSKSDRSPTAPFYLLRDNPDLACVIHTHSKWANLITQLIRGDEFKISNQEMIQGCENRLTKGRLDNIDVLVVPIVQTEINEHLLYPILLRTLKQNAGASGILVRGHGFFCFGSNSW

SEQ ID NO: 123768 - protein, 236 aa, Heterodera glycines
  Homolog annotation: Hit_ID=XP_315060.1; Match level="QueryCoverage =93%, HitCoverage=43%, E-value=4e-33, Identity=35%"; Hit description =ENSANGP00000011452 [Anopheles gambiae]
  Gene Ontology: Mol. function=cyclin-dependent protein kinase, intrinsic regulator activity; Cellular component=nucleus; Biological process=mitotic anaphase B
  Essential gene: C elegans homolog=ZC168.4; Phenotype=Emb,Lva,Stp
  Coding regions on vcDNA: vcDNA=SeqID_50191; Strand=+; Position=55-762
MNRIRKALTVLSGNESNIPEKIAKAEPQHHDIEKPVSSLKFGGGATLFPAEYADDVDLYLRQLERRTPLDFDFLSVHKTVDGRMRQILVDWLVHVQVRFKLTIETLSLSVHILDRVLLALPGINKTNLQLLGVTSIFIAAKFEEVVMPNVDDFVYVAANMFKREDIMRMEPRVLSGLKFNLSVPYAVQFLRSYRFYASPSKSVWEFAKFVSEVAMVCYALAHFPPSVVAAVSLHLA

SEQ ID NO: 123769 - protein, 287 aa, Heterodera glycines
  Homolog annotation: Hit_ID=CAA65506.1; Match level="QueryCoverage =98%, HitCoverage=98%, E-value=5e-91, Identity=57%"; Hit description =cuticular collagen [Teladorsagia circumcincta]
  Gene Ontology: Mol. function=structural constituent of cuticle; Cellular component=extracellular; Biological process=cuticle biosynthesis (sensu Nematoda)
  Essential gene: C elegans homolog=T07H6.3a; Phenotype=Bmd,Gro,Unc
  Coding regions on vcDNA: vcDNA=SeqID_50192; Strand=+; Position=96-956
MADFDKHAAQREAESLRTLAFFGVCLSTVATVIAVLSVPFAYQHFQQLGTQMQNEVDFCKMRSGNMWREVTRTQAYSKVSHDSRHKRQAGGCCGCGVSPPGPPGPPGPSGQPGGDGQPGGSGQPGAPGQAAPRPYPPSGGCVPQCEAAQPGLPGPPGPPGPEGQNGQPGQSAPPASPGRPGPQGPPGPDGQPGNPGESGQPGQPGKLTQGPPVVGPPGPAGPPGQPGQPGENGQPGQPGNPGPQGYPGDGGSPGQPGNPGGSGEPGQPGAQGSSGQCYHCPPPRTAP

SEQ ID NO: 123770 - protein, 151 aa, Heterodera glycines
  misc_feature (21)..(21): Xaa can be any naturally occurring amino acid
  Homolog annotation: Hit_ID=CAE64528.1; Match level="QueryCoverage =100%, HitCoverage=34%, E-value=9e-60, Identity=72%"; Hit description= Hypothetical protein CBG09267 [Caenorhabditis briggsae]
  Gene Ontology: Mol. function=proteasome endopeptidase activity; Cellular component=proteasome regulatory particle (sensu Eukarya); Biological process=proteolysis and peptidolysis
  Essential gene: C elegans homolog=F29G9.5; Phenotype=Emb
  Coding regions on vcDNA: vcDNA=SeqID_50193; Strand=+; Position=12-465
MGQNQPQGGGRKPGDDKGQDXKKKRKYHGPPVPTRIGKRKKGSRGPDTANKMPTVTPITRCKLKLLKYDRIKDYLLMEEEFIKNMERLKPQDERQEEERVKVDDLRGTPMSVGSLEEVIDDQHAIVSTNVGSEHYVNILSFVDKEQLEPGC

SEQ ID NO: 123771 - protein, 347 aa, Heterodera glycines
  Homolog annotation: Hit_ID=NP_505415.2; Match level="QueryCoverage =100%, HitCoverage=76%, E-value=3e-65, Identity=41%"; Hit description= ubiquinone biosynthesis monooxgenase coq6 (49.1 kD) (5J819) [Caenorhabditis elegans] gb|AAB54238.2| Coen
  Gene Ontology: Mol. function=ubiquinone biosynthesis monooxygenase activity; Cellular component=mitochondrion; Biological process =electron transport
  Essential gene: C elegans homolog=K07B1.2; Phenotype=Age,Unclassified
  Coding regions on vcDNA: vcDNA=SeqID_50194; Strand=+; Position=1-1044
VEDGCAKSKIHFKQLDKRSPIAHIVENELIVAALQQCIRDRCANVEVRQGAVVDQNLSVPDNLGQNVTIQFEDGTIEASLMIAADGSKSTARKRAGIDFEETAYEQRAVVGTLALQHNSESDESFAWQRFVPSGPVALLPLGRELCSLVWTVSTADAARLLQLSPEHFVEELNGTLQFDNSSANSLVNNSLDCLGKALNFLPSKESPAKCTIPRVLSLPYDDRAVFPLSLGYAYDYIRPRVALIGDAAHRVHPLAGQGVNLGWSDVRFLTAALQRAFYEGGDLGSLTYLRDFDSASQRRNGPIIFAIDCLNRLYSTDHPFCTLFRSVGLNILDRILPAKDLIVHLAS

SEQ ID NO: 123772 - protein, 264 aa, Heterodera glycines; identical to SEQ ID NO: 122596
  Homolog annotation: Hit_ID=CAE62009.1; Match level="QueryCoverage =98%, HitCoverage=98%, E-value=3e-73, Identity=52%"; Hit description =Hypothetical protein CBG06017 [Caenorhabditis briggsae]
  Gene Ontology: Mol. function=7-alpha-hydroxysteroid dehydrogenase activity; Cellular component=plasma membrane; Biological process =lipid metabolism
  Essential gene: C elegans homolog=F01G4.2; Phenotype=Pvl,Stp,Unc
  Coding regions on vcDNA: vcDNA=SeqID_50195; Strand=+; Position=21-815

SEQ ID NO: 123773 - protein, 253 aa, Heterodera glycines
  Homolog annotation: Hit_ID=NP_495800.1; Match level="QueryCoverage =83%, HitCoverage=87%, E-value=5e-66, Identity=55%"; Hit description =mitochondrial ribosomal protein S18b like (2I817) [Caenorhabditis elegans] emb|CAA91421.1| Hypothetical p
  Gene Ontology: Mol. function=structural constituent of ribosome; Cellular component=mitochondrial small ribosomal subunit; Biological process=protein biosynthesis
  Essential gene: C elegans homolog=T13H5.5; Phenotype=Lva
  Coding regions on vcDNA: vcDNA=SeqID_50196; Strand=+; Position=17-778
MLALKSLLGRSPLVNPLVLSLRNRSIKKVKKKLAAGETLGGPEDYAYNYVEKKRGFIKPIHTLEEQIEYMNSEVFAETYKGRPICFMWKRNMKGQWKLQPPPRLFCIDRNGRFNVGNACTVCRDEYLFFDYRNPKLLEHFLYPGTDQPLPIIQTGLCQEQYVNLQAQLLKAKEHGTFIFNVPFRHFNYGQWYPKDANALISSDLEEDQPSRDLTNVEYIYPNPQIAFETHNRDKHNAWDEWWMRQERFIKRLK

SEQ ID NO: 123774 - protein, 258 aa, Heterodera glycines
  Homolog annotation: Hit_ID=BAB55646.1; Match level="QueryCoverage =99%, HitCoverage=77%, E-value=3e-39, Identity=36%"; Hit description =ataxin-3 [Homo sapiens]
  Gene Ontology: Cellular component=cytoplasm; Biological process =synaptic transmission
  Essential gene: C elegans homolog=F28F8.6; Phenotype=Emb
  Coding regions on vcDNA: vcDNA=SeqID_50197; Strand=+; Position=79-852
MDLVYHEKQVGRMCAQHALNMLLQGDYFTPDSLASIAQELDQRERAMLRDESEFQSQNYDDSGYFSIQVITEALRRQANLSLEPIISPNAMKVLQNPSLAHAYICHLEDHWFTIRKIGTTWFILNSLFKAPRIVSETFLELYVHQLNTEGWSLYVVEGELPACAAETVPREFWNETRRTKKFENDMERAIALSLNEARPFLVTKTADEELFGAATPVISQAEELDIQRALEDSLREANRATSVSTAESFLVGEAIRNS

SEQ ID NO: 123775 - protein, 104 aa, Heterodera glycines; identical to SEQ ID NO: 122461
  Homolog annotation: Hit_ID=NP_490842.1; Match level="QueryCoverage =83%, HitCoverage=95%, E-value=1e-35, Identity=82%"; Hit description =SUMO, small ubiquitin-like modifier, SUMO, small ubiquitin-like modifier SMO-1 (10.2 kD) (smo-1) [Caenorh
  Gene Ontology: Mol. function=protein tagging activity; Cellular component=chromosome; Biological process=cell organization and biogenesis
  Essential gene: C elegans homolog=K12C11.2; Phenotype =Dpy,Emb,Gro,Pvl,Stp
  Coding regions on vcDNA: vcDNA=SeqID_50198; Strand=+; Position=52-366

SEQ ID NO: 123776 - protein, 143 aa, Heterodera glycines; identical to SEQ ID NO: 122495
  Homolog annotation: Hit_ID=CAE69591.1; Match level="QueryCoverage =58%, HitCoverage=6%, E-value=3e-16, Identity=50%"; Hit description =Hypothetical protein CBG15813 [Caenorhabditis briggsae]
  Gene Ontology: Cellular component=cytoskeleton; Biological process =microtubule-based process
  Essential gene: C elegans homolog=ZK1151.1b; Phenotype=Bmd,Lva,Lvl,Unc
  Coding regions on vcDNA: vcDNA=SeqID_50199; Strand=+; Position=1-432

SEQ ID NO: 123777 - protein, 152 aa, Heterodera glycines
  misc_feature (152)..(152): Xaa can be any naturally occurring amino acid
  Homolog annotation: Hit_ID=CAF90372.1; Match level="QueryCoverage =99%, HitCoverage=48%, E-value=1e-23, Identity=43%"; Hit description =unnamed protein product [Tetraodon nigroviridis]
  Gene Ontology: Biological process=nonselective vesicle transport
  Essential gene: C elegans homolog=F45G2.4; Phenotype=Gro,Lvl,Unc
  Coding regions on vcDNA: vcDNA=SeqID_50200; Strand=+; Position=27-482
MDTLFDVRNNFYLGAFQQCINEAQKVKCKSEEEKELKDAFMYRAYIGLNKCSVPLGEIDATDGNGSAALLAIRRFATFMSGAPEKRSEIVDQVAKEFETKKYADNEICLLISTLIFMHGEKTEEALRVLNRTASDSLECAALRVQCLLKLNX

SEQ ID NO: 123778 - protein, 161 aa, Heterodera glycines
  Homolog annotation: Hit_ID=NP_492528.1; Match level="QueryCoverage =95%, HitCoverage=27%, E-value=1e-21, Identity=36%"; Hit description =benzodiazepine receptor (1K94) [Caenorhabditis elegans] emb|CAB02840.1| Hypothetical protein C41G7.3 [Cae
  Gene Ontology: Biological process=chromosome segregation
  Essential gene: C elegans homolog=C41G7.3; Phenotype=Him
  Coding regions on vcDNA: vcDNA=SeqID_50201; Strand=+; Position=58-540
MLLALTSVDTRNALLCAAVPSIGAFVGSTMAIKDQELVQFLKKQNFPSFARCCKYNYLLANTAVTIPFGYASYLVYKIGGGVSCTDSKIALGLYGATLLSGCFLVPTLKKHDIKALTANAVVLAGLSVATSVAFYNIDKISAYWTMPFTLWAILYAGLTVK

SEQ ID NO: 123779 - protein, 187 aa, Heterodera glycines
  Homolog annotation: Hit_ID=CAE56706.1; Match level="QueryCoverage =85%, HitCoverage=56%, E-value=2e-25, Identity=38%"; Hit description =Hypothetical protein CBG24492 [Caenorhabditis briggsae]
  Gene Ontology: Biological process=chromosome segregation
  Essential gene: C elegans homolog=C41G7.3; Phenotype=Him
  Coding regions on vcDNA: vcDNA=SeqID_50202; Strand=+; Position=36-599
NKKFKKCNHIITFIISANTNSLCLTMPLHWTSVDTRNALLCAAVPSIGAFVGSTMAIKDQELVQFLKNQNFPSFARCCKYNYLLANTAVTIPFGYASYLVYKIGGGFDYTDTTVALGLYGATVLSGCFLVPVLKKQDTKALTANAVVLAGLSVATSVAFYNIDKISAYWTMPFTLWAIFCAGLTVKA

SEQ ID NO: 123780 - protein, 133 aa, Heterodera glycines; identical to SEQ ID NO: 122484
  Homolog annotation: Hit_ID=NP_493258.1; Match level="QueryCoverage =100%, HitCoverage=100%, E-value=3e-41, Identity=60%"; Hit description=profilin (14.3 kD) (pfn-1) [Caenorhabditis elegans] emb|CAA22318.1| Hypothetical protein Y18D10A.20 [Ca
  Gene Ontology: Cellular component=actin filament; Biological process =cytokinesis
  Essential gene: C elegans homolog=Y18D10A.20; Phenotype=Emb,Stp,Unc
  Coding regions on vcDNA: vcDNA=SeqID_50203; Strand=+; Position=51-452

SEQ ID NO: 123781 - protein, 91 aa, Heterodera glycines
  Homolog annotation: Hit_ID=NP_496957.1; Match level="QueryCoverage =100%, HitCoverage=100%, E-value=5e-39, Identity=82%"; Hit description=ribosomal Protein, Large subunit (10.1 kD) (rpl-43) [Caenorhabditis elegans] emb|CAB54440.1| Hypothetic
  Essential gene: C elegans homolog=Y48B6A.2; Phenotype=Lva
  Coding regions on vcDNA: vcDNA=SeqID_50204; Strand=+; Position=55-330
MAKRTKKVGIVGKYGTRYGASLRKTVKKMEVSQHAKYTCAFCGKEAMKRVCVGIWNCSKCHKKVAGGAYVYATTTAATVRSTIRRLRETKE

SEQ ID NO: 123782 - protein, 329 aa, Heterodera glycines
  misc_feature (181)..(181): Xaa can be any naturally occurring amino acid
  Homolog annotation: Hit_ID=NP_498457.1; Match level="QueryCoverage =97%, HitCoverage=94%, E-value=1e-119, Identity=66%"; Hit description= malate dehydrogenase (35.1 kD) (mdh-1) [Caenorhabditis elegans] gb|AAB53985.1| Malate dehydrogenase prot
  Gene Ontology: Mol. function=L-malate dehydrogenase activity; Cellular component=mitochondrion; Biological process=malate metabolism
  Essential gene: C elegans homolog=F20H11.3; Phenotype=Emb,Gro
  Coding regions on vcDNA: vcDNA=SeqID_50205; Strand=+; Position=34-1024
MQQCSRLMSVRMKSSSIKVTLIGASGGIGQPLGLLLKKNPSIAHLALYDLVGTPGVAADLSHINTPAKVTGHLGPDQLVAALEGADVVIIPAGVPRKPGMTRDDLFTTNAGIVRDMAEAAAKTCPKAFMGIITNPVNSTLPIACEVYKNNDCFDPRRIFGVTLLDIVRAQAFVSELKGMDXSQTKVSVVGGHSGVTIVPLLSRCTPKVSLSDSETKALTERIQEAGTEVVKAKAGAGSATLSMALAAEYFVSALINALKGQKSVQCAYVKSDVVEGLDYFAGPLELGPNGVEKILPLGDLTAYEKELISKAVPELKKEIAKGVNFIKQG

SEQ ID NO: 123783 - protein, 231 aa, Heterodera glycines
  misc_feature (108)..(108): Xaa can be any naturally occurring amino acid
  Homolog annotation: Hit_ID=CAB88203.1; Match level="QueryCoverage =99%, HitCoverage=99%, E-value=1e-107, Identity=65%"; Hit description= putative cuticular collagen [Globodera pallida]
  Gene Ontology: Mol. function=structural constituent of cuticle; Cellular component=extracellular; Biological process=cuticle biosynthesis (sensu Nematoda)
  Essential gene: C elegans homolog=C15A11.6; Phenotype=Emb
  Coding regions on vcDNA: vcDNA=SeqID_50206; Strand=+; Position=6-702
MQETHIVLGIASVCSLLAIIATVVTLPSLYSEMSQMNSKVRDGVEAFRVNTDSAWTDLMDVQVVVTPPSKPRDNPFNSIFRAKRQLPGHCQCAGLQQPSCPPGPPGPXGPPGQPGQPGGAGQPGQPGQPGQPGQPGANGVVSRPIPGPKGPPGAPGQNGNPGSQGQPGQPGGQGPPGPPGAPGQPGQPGNSGQPGQPGAPGQPGKDSGYCPCPPRSSVLAVKKKMAAAKKA

SEQ ID NO: 123784 - protein, 112 aa, Heterodera glycines; identical to SEQ ID NO: 122490
  Homolog annotation: Hit_ID=AAT92169.1; Match level="QueryCoverage =100%, HitCoverage=100%, E-value=1e-31, Identity=61%"; Hit description=ribosomal protein, large P2 [Ixodes pacificus]
  Gene Ontology: Mol. function=structural constituent of ribosome; Cellular component=cytosolic large ribosomal subunit (sensu Eukarya); Biological process=protein biosynthesis
  Essential gene: C elegans homolog=C37A2.7; Phenotype=Emb,Gro
  Coding regions on vcDNA: vcDNA=SeqID_50207; Strand=+; Position=42-380

SEQ ID NO: 123785 - protein, 191 aa, Heterodera glycines
  misc_feature (181)..(181): Xaa can be any naturally occurring amino acid
  Homolog annotation: Hit_ID=CAB60993.2; Match level="QueryCoverage =97%, HitCoverage=48%, E-value=2e-89, Identity=85%"; Hit description =Hypothetical protein C08B11.5 [Caenorhabditis elegans] sp|Q09442|YP85_CAEEL Hypothetical RNA-binding prote
  Gene Ontology: Mol. function=poly(A) binding; Cellular component =cytoplasm; Biological process=mRNA splicing
  Essential gene: C elegans homolog=C08B11.5; Phenotype=Emb
  Coding regions on vcDNA: vcDNA=SeqID_50208; Strand=+; Position=45-618
MSVLITERNQDATIYVGGLDEKVTEAILWELFVNAGPVTNVNMPKDRITGTHQGFGFVEFMSEEDADYAIKIMNMIKLFGKPIKVNKASANEKNMDVGANLFVGNLDPEVDEKLLFDTFSAFGVILQPPKIMRDVETGSSKGYAFINFASFEASDAALEAMNGQFLCNRPITCSYAFKKDXRGERHGTTAE

SEQ ID NO: 123786 - protein, 175 aa, Heterodera glycines; identical to SEQ ID NO: 122068
  Homolog annotation: Hit_ID=NP_499554.1; Match level="QueryCoverage =84%, HitCoverage=89%, E-value=1e-35, Identity=48%"; Hit description =signal sequence receptor delta (17.4 kD) (3N11) [Caenorhabditis elegans] emb|CAB60502.1| Hypothetical pro
  Gene Ontology: Mol. function=calcium ion binding; Cellular component =translocon; Biological process=intracellular protein transport
  Essential gene: C elegans homolog=Y56A3A.21; Phenotype=Unc
  Coding regions on vcDNA: vcDNA=SeqID_50209; Strand=+; Position=9-536

SEQ ID NO: 123787 - protein, 156 aa, Heterodera glycines
  Homolog annotation: Hit_ID=NP_587923.1; Match level="QueryCoverage =100%, HitCoverage=94%, E-value=2e-62, Identity=75%"; Hit description= 60s ribosomal protein L12.1/L12A [Schizosaccharomyces pombe] ref|NP _587897.1| 60s ribosomal protein l12
  Gene Ontology: Mol. function=structural constituent of ribosome; Cellular component=cytosolic large ribosomal subunit (sensu Eukarya)
  Essential gene: C elegans homolog=JC8.3a; Phenotype=Ste
  Coding regions on vcDNA: vcDNA=SeqID_50210; Strand=+; Position=41-508
MPPKFDPNETKIITLRVTGGEVAGGSALAPKIGPLGLSPKKVGDDIAKATQAYKGLRVTVQLTVQNRQAAISVVPTASSLVIGALKEPPRDRKKEKNIKHSGNLTLDAIIDVARQMRPKSMARTLTGSVKEILGTAFSVGCTVDGMSPKEVQEKID

SEQ ID NO: 123788 - protein, 249 aa, Heterodera glycines
  misc_feature (97)..(97): Xaa can be any naturally occurring amino acid
  misc_feature (159)..(159): Xaa can be any naturally occurring amino acid
  misc_feature (210)..(210): Xaa can be any naturally occurring amino acid
  misc_feature (219)..(219): Xaa can be any naturally occurring amino acid
  misc_feature (223)..(223): Xaa can be any naturally occurring amino acid
  Homolog annotation: Hit_ID=AAH85313.1; Match level="QueryCoverage =85%, HitCoverage=30%, E-value=7e-95, Identity=76%"; Hit description =Intergral membrane protein 1 [Mus musculus]
  Gene Ontology: Mol. function=dolichyl-diphospho-oligosaccharide -protein glycosyltransferase activity; Cellular component=integral to plasma membrane; Biological process=N-linked glycosylation
  Essential gene: C elegans homolog=T12A2.2; Phenotype=Emb
  Coding regions on vcDNA: vcDNA=SeqID_50211; Strand=+; Position=30-777
WIPRAAVYKHEAAEKGGKAGGGGKSFGRGAARYHRGDENYPYKQEISLAVTLAMAICLISFVYHSTWVTSEAYSSPSIVLSARSGDGGRIIFDDFRXAYYWLRKNTPDDAKVMSWWDYGYQISAMANRTTIVDNNTWNNTHISRVGQAMASNESHAYEXMHELDVDYVLVIFGGVTGYSSDDINKFLWMVRIGGSTPEGRHIHENDYYTXMGEFRIDKXGSSXMLNCLMYKLCYHRFGTVYTEHGRATG

SEQ ID NO: 123789 - protein, 188 aa, Heterodera glycines
  Homolog annotation: Hit_ID=NP_493348.1; Match level="QueryCoverage =84%, HitCoverage=98%, E-value=4e-50, Identity=64%"; Hit description =small nuclear ribonucleoprotein, small nuclear ribonucleoprotein SNR- 2 (16.7 kD) (snr-2) [Caenorhabditis
  Gene Ontology: Mol. function=pre-mRNA splicing factor activity; Cellular component=small nucleolar ribonucleoprotein complex; Biological process=morphogenesis of an epithelium
  Essential gene: C elegans homolog=W08E3.1; Phenotype=Emb,Lva
  Coding regions on vcDNA: vcDNA=SeqID_50212; Strand=+; Position=62-628
MTISKNNKMMAHLNYKMKVIVQDSRVFIGYFKAFDKHMNIILADCEEMRRIKPKQGAKKSNVEEEKRILGLVLLRGDKIISISVEGPPQKEDSGVQLPKAGGLGGPGQGRGAGRGMPMGVVPPMGAVPPGLQGAVRGIGGPGMGGPMQPGYMQGMPAGNAATSILMLDFVFFVRPLFVFLLLHNDLFV

SEQ ID NO: 123790 - protein, 154 aa, Heterodera glycines
  Homolog annotation: Hit_ID=NP_496338.1; Match level="QueryCoverage =100%, HitCoverage=85%, E-value=3e-50, Identity=62%"; Hit description= i-120 protein (20.8 kD) (2L163) [Caenorhabditis elegans] emb|CAA85416.1| Hypothetical protein F59E10.3 [
  Gene Ontology: Cellular component=COPI-coated vesicle; Biological process=intracellular protein transport
  Essential gene: C elegans homolog=F59E10.3; Phenotype=Emb,Ste
  Coding regions on vcDNA: vcDNA=SeqID_50213; Strand=+; Position=22-483
MVDFDTSSLYSVKAILILDQDGKRIMAKYYDKQLFPLEKEQNVFEKNVFQKTHKANADIILLDGLVCLYRYNVDLFFYVVGSANENELILQSVLNCLYEAFSTILRKNVEKKALFEHIDTSFLIMDEICDDGIILETDPQAVVARCAVKADELA

SEQ ID NO: 123791 - protein, 173 aa, Heterodera glycines
  Homolog annotation: Hit_ID=AAP36083.1; Match level="QueryCoverage =98%, HitCoverage=36%, E-value=4e-42, Identity=53%"; Hit description =splicing factor, arginine/serine-rich 4 [Homo sapiens] ref|NP _005617.2| splicing factor, arginine/serine-r
  Gene Ontology: Mol. function=pre-mRNA splicing factor activity; Cellular component=nuclear speck; Biological process=mRNA splice site selection
  Essential gene: C elegans homolog=Y111B2A.18; Phenotype=Emb
  Coding regions on vcDNA: vcDNA=SeqID_50214; Strand=+; Position=3-524
GFGGYRGGGAGGMGMNRTQSSRYGPPIQTRYRMLVTNLSTRCSWQDLKDLMRNAGEVTYADAHKKVRNEAVVCFATHEDLRRAVERYQGKDINGRRIKLVDDSEGYAGRKSRSRSPRSRSRSPRSRTRSPPSRSRSPRSRSASPAENGRSRSRSRSRSPTPSRSRSRSPNDEK

SEQ ID NO: 123792 - protein, 163 aa, Heterodera glycines
  Homolog annotation: Hit_ID=CAE68163.1; Match level="QueryCoverage =99%, HitCoverage=41%, E-value=1e-61, Identity=64%"; Hit description =Hypothetical protein CBG13820 [Caenorhabditis briggsae]
  Gene Ontology: Mol. function=glutamate-ammonia ligase activity; Cellular component=cytoplasm; Biological process=glutamate metabolism
  Essential gene: C elegans homolog=C28D4.3; Phenotype=Emb
  Coding regions on vcDNA: vcDNA=SeqID_50215; Strand=+; Position=12-500
MNLRDQFSTNKYVAHRFMQLPTHNKVQVEYVWIDGSGENVRSKTRTVDFVPSKVDDLPVWNFDGSSTGQASGADSDVFIKPVAMYNDPFRMGNHKIVMCEAFDNKMQPHVTNNRARCKQTMDAAAKEHAWFGMEQEYTLLDVDQHPFGWPKAPFGFPGPQGPY

SEQ ID NO: 123793 - protein, 148 aa, Heterodera glycines
  Homolog annotation: Hit_ID=NP_501789.1; Match level="QueryCoverage =74%, HitCoverage=37%, E-value=2e-11, Identity=33%"; Hit description =RNaseIII (4K696) [Caenorhabditis elegans] emb|CAA93284.1| Hypothetical protein F25H8.1 [Caenorhabditis el
  Gene Ontology: Biological process=tRNA modification
  Essential gene: C elegans homolog=F25H8.1; Phenotype=Unclassified
  Coding regions on vcDNA: vcDNA=SeqID_50216; Strand=+; Position=39-482
MSSSNTILLDCSDDSAVVVGFEQCATSEGGGAVEPQQKLTKNQQKKRARMERFNAGKAEWRRKQRERHKERKRARKADGQTATVVHNDRPNKLNTMNESKCRVRVAVDMAYDDLMDERSVCKTVSQLRHCYASNRRAADPLQFYVVNL

SEQ ID NO: 123794 - protein, 179 aa, Heterodera glycines
  Homolog annotation: Hit_ID=CAE68452.1; Match level="QueryCoverage =99%, HitCoverage=60%, E-value=8e-47, Identity=50%"; Hit description =Hypothetical protein CBG14242 [Caenorhabditis briggsae]
  Gene Ontology: Mol. function=protein binding
  Essential gene: C elegans homolog=D2013.6; Phenotype=Gro,Stp
  Coding regions on vcDNA: vcDNA=SeqID_50217; Strand=+; Position=75-611
MSLNTANTPDGRGVIIYSGEMILLFVREVNLSFDKFTNAAFKGTKKGNLYLTTHRIIFNNTETSSRGNFKSLSMPFGCIRNVKLEQPIFGANYLAGELVAQPDGNWEGEVNWKLTFNRGGCIEFGQALLKTSEMANNFCPRPANAPPPYAPPPGAYYSPPPAYYWSGGQFNGYQAPVHA

SEQ ID NO: 123795 - protein, 190 aa, Heterodera glycines
  Homolog annotation: Hit_ID=CAE63617.1; Match level="QueryCoverage =74%, HitCoverage=42%, E-value=4e-23, Identity=45%"; Hit description =Hypothetical protein CBG08110 [Caenorhabditis briggsae] emb|CAE56356.1| Hypothetical protein CBG24030 [Cae
  Gene Ontology: Mol. function=acyl-CoA thioesterase activity; Biological process=acyl-CoA metabolism
  Essential gene: C elegans homolog=C17C3.1a; Phenotype=Unclassified
  Coding regions on vcDNA: vcDNA=SeqID_50218; Strand=+; Position=153-722
MSSESNMENFPVKLDMDYIKRLARIERTGPNTFNANFLVAGYRKAVNRDVFGGQMFAQAIAAAEATVDGDEFAPNAAHSMFIRKAFIDHPIEYIVTRTRDGRSFCTRTVEARQNGETVFCAQISLCVKERSSIEHQTEMPAEVPEPEELVPFFETVRRVVTEHDEGRTERNGRTIANLRAVLEDEQQPSV

SEQ ID NO: 123796 - protein, 247 aa, Heterodera glycines
  misc_feature (175)..(175): Xaa can be any naturally occurring amino acid
  Homolog annotation: Hit_ID=CAE71898.1; Match level="QueryCoverage =91%, HitCoverage=91%, E-value=8e-88, Identity=68%"; Hit description =Hypothetical protein CBG18956 [Caenorhabditis briggsae]
  Gene Ontology: Mol. function=arsenate reductase (thioredoxin) activity; Cellular component=mitochondrion; Biological process =electron transport
  Essential gene: C elegans homolog=F46E10.9; Phenotype=Dpy
  Coding regions on vcDNA: vcDNA=SeqID_50219; Strand=+; Position=37-775
MARSPLFLLSIFICTEFVLCAVKSKNLLNLNEENWRNILSGEWMMEFHAPWCPACKDLQKSWNSFADWSRDLNINVAEIDVTTNPGLSGRFLVTALPTIYHVKDGVFRLYAGPRDKNDFISFIEDKRWTSIDPLPSYKHPDSSQMGVVAVFFKLSMAVRDLHGHFVENVGVPAWXASYAFFATVTLALGCVLGFIIVCIIDYVFPTGALKKKEAERRKEQPSAKKNAKESAEKANGQKEVLSDEKKS

SEQ ID NO: 123797 - protein, 270 aa, Heterodera glycines
  Homolog annotation: Hit_ID=AAK39275.2; Match level="QueryCoverage =88%, HitCoverage=49%, E-value=2e-74, Identity=54%"; Hit description =Glutamyl(e)/glutaminyl(q) trna synthetase protein 3 [Caenorhabditis elegans]
  Gene Ontology: Mol. function=glutamate-tRNA ligase activity; Cellular component=mitochondrion; Biological process=tRNA modification
  Essential gene: C elegans homolog=T07A9.2; Phenotype=Gro
  Coding regions on vcDNA: vcDNA=SeqID_50220; Strand=+; Position=22-831
MVCFPPSLMPSFQCFCASSSRLFCSSAFVRPVRVRFAPSPTGELHLGSVRTALFNFLWARKYNGKFVLRIEDTDRERLVEGSEQRIEQTLSHFGLTPDESPLRGGQFGSYYQSERLPLYRELADQLVDIGHSYKCFCSQERLDFLRRKANSERIPFRYDGICRQLSTEETRARERNEEQFVVRFKFDGRRAGFTDIVFGDYEHYSEEGDFVILKRDGFPTYHFANVVDDRRMKISHVIRGAEWICSTTKHLQIYSAFGWSPPHFAHLPLI

SEQ ID NO: 123798 - protein, 186 aa, Heterodera glycines
  Homolog annotation: Hit_ID=NP_496755.1; Match level="QueryCoverage =88%, HitCoverage=67%, E-value=1e-13, Identity=29%"; Hit description =putative secreted or extracellular protein precursor (24.4 kD) (2N223) [Caenorhabditis elegans] emb|CAB04
  Essential gene: C elegans homolog=F58G1.4; Phenotype=Gro
  Coding regions on vcDNA: vcDNA=SeqID_50221; Strand=+; Position=3-560
VLRVSDLTKANERVPFRLLNLSLASLDVNMRPFCDSEGHSAVRLPGFLLILSGQIVLSRPLPPLNASSLRLSLTLEQNSVWVGRICDKGRSQSAFLSDDFCSFSLCSLLPDACNSLEALASKYAESDFPLLLPLSDLFPTDQPIALVPMANFPLLEGYWKAPAQIQADDGNAMEEEEDEQNEQHIL

SEQ ID NO: 123799 - protein, 157 aa, Heterodera glycines
  Homolog annotation: Hit_ID=NP_496178.1; Match level="QueryCoverage =99%, HitCoverage=20%, E-value=9e-18, Identity=32%"; Hit description =XTP5 (87.0 kD) (2K391) [Caenorhabditis elegans] emb|CAA88437.1| Hypothetical protein ZK945.3 [Caenorhabdi
  Essential gene: C elegans homolog=ZK945.3; Phenotype=Egl
  Coding regions on vcDNA: vcDNA=SeqID_50222; Strand=+; Position=4-474
MLKQGDSNCHSKKASGSRYSELFECIRDNLLTFIKANMRQMLFDKISAVLVLDTLEVPSPSDPFLREIGDSDLDDCFRAIAEIATDEFVPHSPDGPSHIVQGGCARFVFRKLLQADLGRCDGHRLSDFLADLPADNLSSWTSMDCGCYTLVEVFKSG

SEQ ID NO: 123800 - protein, 160 aa, Heterodera glycines
  Homolog annotation: Hit_ID=NP_496178.1; Match level="QueryCoverage =88%, HitCoverage=18%, E-value=4e-09, Identity=29%"; Hit description =XTP5 (87.0 kD) (2K391) [Caenorhabditis elegans] emb|CAA88437.1| Hypothetical protein ZK945.3 [Caenorhabdi
  Essential gene: C elegans homolog=ZK945.3; Phenotype=Egl
  Coding regions on vcDNA: vcDNA=SeqID_50223; Strand=+; Position=1-480
DTLEVPSPSDPFLREIGDSDLDDCFRAIAEIATDEFVPHSPDGPSHIVQGGCARFVFRKLLQADPGRCDGHRLSDFLADLPADNLSSWTSMDCGCYTLVEVFKSGSDKARKVLRRALSVAMLQNSHLSGAKSLLDLLLGKGKEQPTREHSVANGGGAGRK

SEQ ID NO: 123801 - protein, 422 aa, Heterodera glycines
  Homolog annotation: Hit_ID=NP_777285.1; Match level="QueryCoverage =97%, HitCoverage=88%, E-value=1e-155, Identity=64%"; Hit description= RuvB-like protein 2 [Danio rerio] gb|AAH58871.1| RuvB-like protein 2 [Danio rerio] gb|AAL18005.1| RuvB-l
  Gene Ontology: Mol. function=ATP dependent DNA helicase activity; Cellular component=cytosol; Biological process=DNA recombination
  Essential gene: C elegans homolog=T22D1.10; Phenotype=Emb,Lva
  Coding regions on vcDNA: vcDNA=SeqID_50224; Strand=+; Position=15-1283
MSEIGNFEIRNVSKVERIGAHSHITGLGLKANFEPIFISDGMVGQCAARKAAGLIVRMIKDGQIAGRALLIVGEPGTGKTAVAMGISKSIGGDTPFISISASEVFSMDLSKPEALTQSFRKAIGVRIKEETEVLCGEVVQLEIDRPQSGAGPRVGKLTLKTTDMEAIYDIGNKMTESVIKERITAGDVIQIDKATGKISKIGRSLARSKDFDALGPQDKLVACPSGEIQSRVETVNTISLHDIDVINSRSSGYLAVFSGDTGEIKSEVREQIDKKVMGWREENKAQIIPGVLFVDEVHMFDLECFSFINRYIESDLSPILVMATNRGIVNIRGTSVESPHGVPLFLLDRSLIIRTSSYKENEIGEILKIRASDELVEMEDASIAVLVQIALETSMRYCMQLISTADILRQRRKGEKTKCLRH

SEQ ID NO: 123802 - protein, 195 aa, Heterodera glycines
  Homolog annotation: Hit_ID=CAE69547.1; Match level="QueryCoverage =65%, HitCoverage=73%, E-value=1e-26, Identity=50%"; Hit description =Hypothetical protein CBG15759 [Caenorhabditis briggsae]
  Gene Ontology: Cellular component=mitochondrial ribosome
  Essential gene: C elegans homolog=Y37D8A.18; Phenotype=Lva
  Coding regions on vcDNA: vcDNA=SeqID_50225; Strand=+; Position=10-597
TVSRFFHCRALSPVNLVVHPFVARKCAFLSTPSLSFPFRRQYSSLASATTTGASNDKLNVDKLFEKINFEVRGHDFTVLKSYSLFVMNVCRVLDIDFTSRHRAMINTDHSKSNRPKYQRWFQWLLSAKFAKKKYKLHYETRTYLMEFDVHHLTGSTASAFLEYIERNIPEGVAMKVTYTEMCFLPETIVKTVMDN

SEQ ID NO: 123803 - protein, 225 aa, Heterodera glycines
  Homolog annotation: Hit_ID=CAE73541.1; Match level="QueryCoverage =93%, HitCoverage=47%, E-value=1e-54, Identity=49%"; Hit description =Hypothetical protein CBG21009 [Caenorhabditis briggsae]
  Gene Ontology: Biological process=protein modification
  Essential gene: C elegans homolog=Y17G7B.18a; Phenotype=Gro,Stp,Unc
  Coding regions on vcDNA: vcDNA=SeqID_50226; Strand=+; Position=138-812
MEQHENAGRKRHTKDRFRYGNYNRYYGVRNQGFDHDPRVDLFPVQWFHGRRVLDIGCNVGHLTLEIAKKLGPAHIVGIDIDDHLVGVARKNIRHYCGSAQKLIGKFPASLLPPAEEAEASSTNAVNDDGKSATKMESENGKEEGPSSTTAKPAVLPYGQFPKNVWFLRENYVLDCDEFLEMVREEYDVILALSITKWVHLNWGDDGLKRFLRRTFLNLRPGGRLL

SEQ ID NO: 123804 - protein, 338 aa, Heterodera glycines
  misc_feature (147)..(147): Xaa can be any naturally occurring amino acid
  misc_feature (181)..(181): Xaa can be any naturally occurring amino acid
  Homolog annotation: Hit_ID=AAT70232.1; Match level="QueryCoverage =100%, HitCoverage=89%, E-value=0.0, Identity=96%"; Hit description =unc-87 [Heterodera glycines]
  Gene Ontology: Mol. function=troponin C binding; Cellular component =cytoskeleton; Biological process=muscle contraction
  Essential gene: C elegans homolog=F08B6.4a; Phenotype=Unc
  Coding regions on vcDNA: vcDNA=SeqID_50227; Strand=+; Position=131 -1140
MPESENDFDEEAPNATMETKVAGGGAAPKRVGRWTLSQLRQTDGIIPSQAGWNKGDSQKLMTNFGTPRNTTTKVKVENLAEIPEDILLKSHGEVRLQSGTNRFASQKGFVSFGTGRDVCREGVNVNILAGRLGAACREEKIRASDGXIVRLQAGTNKFDSQKGMTLFGTGRRETTRMKDSXKHPEYSHERDIDNTEIPLQMGTNKFASQKGMTGFGTNRRETTKMLDTSHPEYSHEQSIDQTSIPYQMGSNKYASQKGMTGFGQPRWEVLDPSISYQNRKSQGMVRLQSGTNRFASQAGMTGFGTPRNNTYEAEAGELPYEDMKKSEAIIPSQAGWDR

SEQ ID NO: 123805 - protein, 277 aa, Heterodera glycines
  misc_feature (17)..(17): Xaa can be any naturally occurring amino acid
  misc_feature (264)..(264): Xaa can be any naturally occurring amino acid
  Homolog annotation: Hit_ID=NP_506559.1; Match level="QueryCoverage =99%, HitCoverage=47%, E-value=1e-142, Identity=88%"; Hit description= ATP synthase alpha and beta subunits ; ATP synthase ab C terminal (66.5 kD) (5O835Co) [Caenorhabditis el
  Gene Ontology: Mol. function=hydrogen-transporting ATPase activity, rotational mechanism; Cellular component=vacuolar membrane (sensu Fungi); Biological process=transport
  Essential gene: C elegans homolog=Y49A3A.2; Phenotype=Emb,Ste
  Coding regions on vcDNA: vcDNA=SeqID_50228; Strand=+; Position=3-829
LPSFGCGKTVISQSFSXKYSNSDAIIYVGCGERGNEMSEVLRDFPELTMEVDGVTTSIMERTALVANTSNMPVAAREASIYTGITLAEYFRDMGLNVAMMADSTSRWAEALREISGRLGEMPADSGYPAYLAARLASFYERAGKVKCFGSPEREGSVTIVGAVSPPGGDFADPVTSATLGIVQVFWGLDKKLAQRKHFPSINWLISYSKYMRALDDYYEKNFAEFVPLRTKCKEILQEEEDLSEIVQLVGKASLAEADKITLEXYDRFCPFYKTVGM

SEQ ID NO: 123806 - protein, 614 aa, Heterodera glycines
  misc_feature (178)..(178): Xaa can be any naturally occurring amino acid
  misc_feature (589)..(589): Xaa can be any naturally occurring amino acid
  Homolog annotation: Hit_ID=NP_506559.1; Match level="QueryCoverage =98%, HitCoverage=99%, E-value=0.0, Identity=85%"; Hit description =ATP synthase alpha and beta subunits ; ATP synthase ab C terminal (66.5 kD) (5O835Co) [Caenorhabditis elega
  Gene Ontology: Mol. function=hydrogen-transporting ATPase activity, rotational mechanism; Cellular component=vacuolar membrane (sensu Fungi); Biological process=transport
  Essential gene: C elegans homolog=Y49A3A.2; Phenotype=Emb,Ste
  Coding regions on vcDNA: vcDNA=SeqID_50229; Strand=+; Position=37-1883
MPPTTREHIKESQYGFVYGVSGPVVTAEKMSGAAMYELVRVGHSELVGEIIRLEGDYATIQVYEETSSVTICDPVLRTGQPLSVELGPGIMGSIFDGIQRPLHDISEMTKSIYIPKGVNVKALNRAKRWEFMPRKDLRVGDHVTGGDIIGMVHESALVKHKIMVEPKACGTVKFIAPXGQYTVEDTILEVEFAGHTQKLTMMHIWPVRNPRPSAEKLAANFPLLCGQRVLDALFPCVQGGTTAIPGAFGCGKTVISQSLSKYSNSDAIIYVGCGERGNEMSEVLRDFPELTMEVDGVTTSIMERTALVANTSNMPVAAREASIYTGITLAEYFRDMGLNVAMMADSTSRWAEALREISGRLGEMPADSGYPAYLAARLASFYERAGKVKCFGSPEREGSVTIVGAVSPPGGDFADPVTSATLGIVQVFWGLDKKLAQRKHFPSINWLISYSKYMRALDDYYEKNFAEFVPLRTKCKEILQEEEDLSEIVQLVGKASLAEADKITLEVAKLIKDDFLQQNGYSSYDRFCPFYKTVGMLKNMIGFYDFARHSVETTAQSDNKITWNQIRDHLGDIIHELSSMKFEDPSEKXEDQIKKDYEELYERMQNKFRALEDE

SEQ ID NO: 123807 - protein, 521 aa, Heterodera glycines
  Homolog annotation: Hit_ID=CAE63795.1; Match level="QueryCoverage =87%, HitCoverage=95%, E-value=1e-147, Identity=57%"; Hit description= Hypothetical protein CBG08337 [Caenorhabditis briggsae]
  Gene Ontology: Mol. function=carboxypeptidase activity; Cellular component=plasma membrane; Biological process=neuropeptide signaling pathway
  Essential gene: C elegans homolog=F59A3.1; Phenotype=Rup,Unc
  Coding regions on vcDNA: vcDNA=SeqID_50230; Strand=+; Position=12-1577
MKFMASMVASFPVSFFLFFSTALIHGTMGGLFWSKKPADSADDSLWSRYHDQNAMEELLEKVHSKCPNVTRLYSVGRSVQGRDLAVIEFSLHPGRHQILKPEMKYIGNMHGNEAIGRELLLRLAQFLCDGWRQGQRSVVEMLNSTNIHIMPSMNPDGFELTLKTKPEQRGWVTGRTNAHGVDLNRNFPDLDAIFYKANAQRLPFFDHLLEVFHDSDNGQQFEPEVTAVANWVLSWPFVISANLHEGDLVANYPFDESLNPNELRAYSKSPDDVTFRYIAETYARAHAHMAKNDHAPCDGTAGDNFARQGGITNGAKWYSVAGGMQDFNYLSTNAFEITLELSCEKMPAPERLPQFWVDNKLALLEFIRLAHIGIKGMVSDARNGEPIANAVVWVRNVTDGDGQTAIKHPVTTWITGDYFRPLVSGCYQIAVEADGYEIGIKTLNISQKDVKERRPHIVNFQLRPIEVEVPEARIGREMGEEERGEEENGPLTPEQAAEFLQLIRMQQPVGVRTANAPSFSQ

SEQ ID NO: 123808 - protein, 238 aa, Heterodera glycines
  Homolog annotation: Hit_ID=CAE58533.1; Match level="QueryCoverage =93%, HitCoverage=59%, E-value=3e-51, Identity=47%"; Hit description =Hypothetical protein CBG01690 [Caenorhabditis briggsae]
  Gene Ontology: Mol. function=transcription regulator activity; Biological process=cell cycle
  Essential gene: C elegans homolog=R08C7.2a; Phenotype=Gro
  Coding regions on vcDNA: vcDNA=SeqID_50231; Strand=+; Position=14-727
MARNRPNANIITSDLGEAQIKKHKPKDTRLLQQRLVAWQPILTAKTVIPLVFSISILFIPIGIVLLRISQSVQEYVVQYVNDANECKDYHANGQCAVNFTLNEDFKGDVYFYYALENFFQNHRRYMKSRNDQQLSGIDFLNTKDCTPFEKAPDGRPIAPCGAIANSLFNDSFQLNYLGRNGNGYANISWSHEGLVWPVDLESKFRNPTCDGQPCKTIAELCHKFSLTVRPPNWEKDLC

SEQ ID NO: 123809 - protein, 143 aa, Heterodera glycines
  Homolog annotation: Hit_ID=NP_500963.1; Match level="QueryCoverage =83%, HitCoverage=38%, E-value=1e-37, Identity=64%"; Hit description =ribonucleoprotein (33.5 kD) (4H89) [Caenorhabditis elegans] gb|AAM44397.1| Homologous to drosophila sqd (
  Gene Ontology: Mol. function=RNA binding; Cellular component=nucleus; Biological process=RNA catabolism
  Essential gene: C elegans homolog=Y73B6BL.6; Phenotype=Stp
  Coding regions on vcDNA: vcDNA=SeqID_50232; Strand=+; Position=50-478
MSNDNDKRDASSIPTNALVNKEESPDGNEEKKIFCGGISYETSNEDLAVYFGQYGKVKEVQVKYDRVTGRSRGFAFVEFDTVAACQASLVQREQVIKGKQCEIKPAKSREVGYMNKKVFVGGLPGDFPEEELRKHFNQYGKVE

SEQ ID NO: 123810 - protein, 321 aa, Heterodera glycines; identical to SEQ ID NO: 122343
  misc_feature (66)..(66): Xaa can be any naturally occurring amino acid
  Homolog annotation: Hit_ID=CAE64813.1; Match level="QueryCoverage =100%, HitCoverage=49%, E-value=1e-112, Identity=61%"; Hit description=Hypothetical protein CBG09607 [Caenorhabditis briggsae]
  Gene Ontology: Mol. function=RNA binding; Cellular component =cytoplasm; Biological process=reproduction
  Essential gene: C elegans homolog=Y32F6A.3; Phenotype=Emb,Lva
  Coding regions on vcDNA: vcDNA=SeqID_50233; Strand=+; Position=2-964

SEQ ID NO: 123811 - protein, 252 aa, Heterodera glycines; identical to SEQ ID NO: 122110
  misc_feature (237)..(237): Xaa can be any naturally occurring amino acid
  Homolog annotation: Hit_ID=CAE68535.1; Match level="QueryCoverage =98%, HitCoverage=49%, E-value=1e-111, Identity=81%"; Hit description= Hypothetical protein CBG14362 [Caenorhabditis briggsae]
  Gene Ontology: Mol. function=hydrogen-transporting ATPase activity, rotational mechanism; Cellular component=plasma membrane; Biological process=proton transport
  Essential gene: C elegans homolog=F20B6.2; Phenotype=Emb,Lva
  Coding regions on vcDNA: vcDNA=SeqID_50234; Strand=+; Position=48-805

SEQ ID NO: 123812 - protein, 259 aa, Heterodera glycines
  Homolog annotation: Hit_ID=CAE56255.1; Match level="QueryCoverage =99%, HitCoverage=38%, E-value=7e-96, Identity=65%"; Hit description =Hypothetical protein CBG23896 [Caenorhabditis briggsae]
  Gene Ontology: Mol. function=CTP synthase activity; Cellular component=cytosol; Biological process=pyrimidine base metabolism
  Essential gene: C elegans homolog=W06H3.3; Phenotype=Emb,Lva,Unc
  Coding regions on vcDNA: vcDNA=SeqID_50235; Strand=+; Position=53-829
MAEEPVKLILVTGGVMSGVGKGIVSSSIGVLLKGCGYRVTVIKIDPYINVDAGTFSPFEHGEVFVLDDGGEVDLDLGNYERFLDIRLTRDNNITTGKIFHQVIQRERNGDYLGKTVKTVPHITDAIIEWVERVSKISVDGSGKTPQICIVELGGTIGDIEGMPYTMAFSMAFRRKTYRNRFLTVHVTKLLHESGEIKTKPAQNGLRSLRETGLYPDLLLCRSQKPLTQALRSKIASFAQLDINEIIDVYDCHDIHSVPL

SEQ ID NO: 123813 - protein, 443 aa, Heterodera glycines
  misc_feature (246)..(246): Xaa can be any naturally occurring amino acid
  Homolog annotation: Hit_ID=AAO14563.2; Match level="QueryCoverage =100%, HitCoverage=61%, E-value=0.0, Identity=99%"; Hit description =Hsp90 [Heterodera glycines]
  Gene Ontology: Biological process=reproduction
  Essential gene: C elegans homolog=C47E8.5; Phenotype=Emb,Ste
  Coding regions on vcDNA: vcDNA=SeqID_50236; Strand=+; Position=3-1332
KPIWTRNPDDISNEEYAEFYKSLSNDWEDHLAVKHFSVEGQLEFRALLFVPQRAPFDLFENKKSKNAIKLYVRRVFIMENCEELMPEYLNFIKGVVDSEDLPLNISRETLQQSKILKVIRKNLVKKCMDLFEEISEDKDNFKKFYEQFAKNIKLGIHEDSVNRKKLSDFLRYYTSASGEEPCSFKDYVSRMKENQTCIYYITGESKDVVQNSSFVERVKKRGFEVIYMVDPIDEYCVQQLKEYDGXKKLVSVTKEGLELPESEEEKKKFEEDKVKFEKLCKVIKDILDKKVQKVSVSNRLVSSPCCIVTGEYGWSANMERIMKAQALRDSSTMGYMASKKNLEINPDHSIIKSLRDRVEKEQDDKTAKDLVVLLYETSLLTSGFSLEDPQQHASRIYRMVKLGLDIPDEEEPAEQQPSTSGEPTIAEKIAGAEEEASRMEEVD

SEQ ID NO: 123814 - protein, 316 aa, Heterodera glycines
  misc_feature (173)..(173): Xaa can be any naturally occurring amino acid
  misc_feature (188)..(188): Xaa can be any naturally occurring amino acid
  misc_feature (197)..(197): Xaa can be any naturally occurring amino acid
  Homolog annotation: Hit_ID=NP_501727.1; Match level="QueryCoverage =96%, HitCoverage=96%, E-value=1e-140, Identity=83%"; Hit description= adenine nucleotide family member (4K472) [Caenorhabditis elegans] emb|CAA92472.1| Hypothetical protein K
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_50237; Strand=+; Position=38-982
MSENKSEGGAEKKKSGGFNTKKFLLDLASGGTAAAVSKTAVAPIERVKLLLQVQDASIHITADKRYKGIIDVLVRVPKEQGFLSLWRGNLANVIRYFPTQALNFAFKDTYKRVFTQGVDKEKQFLKFFAMNLASGGAAGATSLCFVYPLDFARTRLAADVGKADAREFKGLAXDCIMKILKSDGPIGXLYRGFFVSXVQGIIIYRAAYFGCFDTAKMLFSPEGKQMNFFVNWAIAQVVTVSSGVLSYPWDTVRRRMMMQSGRKDIMYKNTLDCAIKIIKNEGLLKGMFKGALSNVFRGTGGALVLAFYDEIQKYIH

SEQ ID NO: 123815 - protein, 170 aa, Heterodera glycines
  Homolog annotation: Hit_ID=AAH10792.1; Match level="QueryCoverage =47%, HitCoverage=33%, E-value=9e-18, Identity=50%"; Hit description =2600011C06Rik protein [Mus musculus]
  Essential gene: C elegans homolog=W04D2.6a; Phenotype=Gro
  Coding regions on vcDNA: vcDNA=SeqID_50238; Strand=-; Position=63-624
GPPTTTTVFIGNISDKCPDRIIQEVLKKCGSVCNWKRLQDSGGKFKAFGFCDFMYPDGAKKALSVLKDFPIGDKRLNVKVSLVLKVSEIVAIFRRTNKRRNCWMNSPRISSSPPTRRATTPSELRSESFWRTRRPTWWTCRRTKVFGEGRRIVTKQFRRIQRKKPGRRKH

SEQ ID NO: 123816 - protein, 278 aa, Heterodera glycines
  misc_feature (139)..(139): Xaa can be any naturally occurring amino acid
  Homolog annotation: Hit_ID=NP_498280.1; Match level="QueryCoverage =60%, HitCoverage=95%, E-value=5e-55, Identity=42%"; Hit description =paxillin (3G980) [Caenorhabditis elegans] gb|AAA62294.1| Hypothetical protein C28H8.6a [Caenorhabditis el
  Gene Ontology: Mol. function=protein binding; Cellular component =focal adhesion; Biological process=integrin-mediated signaling pathway
  Essential gene: C elegans homolog=C28H8.6a; Phenotype=Lva
  Coding regions on vcDNA: vcDNA=SeqID_50239; Strand=+; Position=121-955
MPSGGDDEQQFEEAVKPALESLLADLQKTTEVLRQGKHGKGRRQQKEDESAALLDLKKLRNSPRQRNQSPAAVANLRNGRSEELQPRRDPMLEGDKLGIHTIPKGDCASCNQAVIGPVVIALGKMWHPEHFCCAHCGAXIENRNFFERQGKAYCESDYHDLFSPRCSYCNGPIKERCVTALGGKNFHVEHFVCAECGKSFGDGGFHEKSNSAYCRDCFYRTYAPQGQSWQQPITPQILTALNTHWHPECFCCREGGQTLPWGPPVPPFWAPLLWKKGP

SEQ ID NO: 123817 - protein, 184 aa, Heterodera glycines
  misc_feature (124)..(124): Xaa can be any naturally occurring amino acid
  misc_feature (132)..(132): Xaa can be any naturally occurring amino acid
  misc_feature (152)..(152): Xaa can be any naturally occurring amino acid
  misc_feature (169)..(169): Xaa can be any naturally occurring amino acid
  Homolog annotation: Hit_ID=XP_313971.1; Match level="QueryCoverage =98%, HitCoverage=47%, E-value=1e-79, Identity=78%"; Hit description =ENSANGP00000009996 [Anopheles gambiae]
  Gene Ontology: Biological process=reproduction
  Essential gene: C elegans homolog=T04C12.6; Phenotype=Ste
  Coding regions on vcDNA: vcDNA=SeqID_50240; Strand=+; Position=49-600
KHQSQPEKMCDEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLQEARLNPKAXRRKMTQFXFKSFTRPALYVAIPARLVLXTLGPTTGFWLNPGNGVXHPGPFHKGYPFPQGI

SEQ ID NO: 123818 - protein, 65 aa, Heterodera glycines
  Homolog annotation: Hit_ID=NP_499891.1; Match level="QueryCoverage =90%, HitCoverage=15%, E-value=3e-11, Identity=54%"; Hit description =parvin alpha, Paralysed Arrest at Two-fold PAT-6 (43.0 kD) (pat-6) [Caenorhabditis elegans] gb|AAC48090.1
  Essential gene: C elegans homolog=T21D12.4; Phenotype=Emb,Lvl
  Coding regions on vcDNA: vcDNA=SeqID_50241; Strand=-; Position=14-260
DIVAILHLLITLALHYRAPIRFPNNVNVQVLIYTRHGKQISKSIVTEQLTTKQTELAPKVRFWKD

SEQ ID NO: 123819 - protein, 362 aa, Heterodera glycines
  Homolog annotation: Hit_ID=NP_510260.1; Match level="QueryCoverage =99%, HitCoverage=54%, E-value=1e-141, Identity=52%"; Hit description= PolyA Binding protein (76.0 kD) (pab-2) [Caenorhabditis elegans] emb|CAA90444.1| Hypothetical protein F1
  Gene Ontology: Mol. function=poly(A) binding; Cellular component =cytoplasm; Biological process=blood coagulation
  Essential gene: C elegans homolog=Y106G6H.2a; Phenotype=Gro,Stp
  Coding regions on vcDNA: vcDNA=SeqID_50242; Strand=+; Position=49-1134
MAPSYPLASLYVGDLHPDVTEAMLFERFSNAGPVLSIRVCRDAITRRSLGYAYVNFQQPADAERALDTMNFDMILNKPIRIMWSQRDPSIRRSGAGNIFIKNLGKEIDTKAIYDTFSMFGSILSCKIATDIEGGSKGYGFIHFETEEAANSAIAKVNGMLLDGKKVFVGKFVPRTAREKQIGDPSSRFTNVYVKNFGEAMDSEKLSEVFSQYGEIISAKVMEDDSGKSKGFGFVAYKDHESAARAVEKMNEVSVPGSEKVEQKFTVCRAQKKSERQAELKRRYEQYKAERIQRYQGVNLYVKNLHDTINDETLRSNFESYGNITSAKVMCDEHGRSKGFGFVCFEKADEATKAVVEMNNKII

SEQ ID NO: 123820 - protein, 681 aa, Heterodera glycines
  Homolog annotation: Hit_ID=NP_492727.1; Match level="QueryCoverage =98%, HitCoverage=98%, E-value=0.0, Identity=53%"; Hit description =polyadenylate-binding protein, PolyA Binding protein (71.6 kD) (pab -1) [Caenorhabditis elegans] emb|CAA2157
  Gene Ontology: Mol. function=poly(A) binding; Cellular component =cytoplasm; Biological process=regulation of protein activity, epigenetic
  Essential gene: C elegans homolog=Y106G6H.2a; Phenotype=Gro,Stp
  Coding regions on vcDNA: vcDNA=SeqID_50243; Strand=+; Position=15-2057
MAQAVAAVAPAPNANAASAQATQPQVMAPSYPLASLYVGDLHPDVTEAMLFERISNAGPVLSIRVCRDAITRRSLGYAYVNFPQPADAERALDTLNFDMILNKPIRIMWSQRDPSIRRSGAGNIFIKNLGKEIDTKAIYDTFSMFGSILSCKISTDIDGGSKGYGFIHFETEEAANSAIAKVNGMLLDGKKVFVGKFLPRSARDKQIGDPSSRFTNVYVKNFGDAMNSEKLSEVFSQFGEIISAKVMEDDSGKSKGFGFVAYKDHESAARAVEKMNEVSVPGSEKVEQKFTVCRAQKKSERQAELKRRYEQYKAERIQRYQGVNLYVKNLHDTINDETLRSNFESYGNITSAKVMCDEHGRSKGFGFVCFEKADEATKAVVEMNNKIIENKPLYVALAQRKEDRKAQLASQYMQRLAAMRMQNPAGLMGTMYAPASGGFFLPQAIQNQRAAPFMQTPNLSGAQMRGAVPRWNNMGGFNHPMQGYMMGPAVGGQFGGANQIARGGPRSGGMGGGGGMRQYGGQPRQQQNRMPGMGGGHQQQGMRYQGQPKGMQQQQHQQAQQPQIAYSSYPQQQSRGMAPQMGGGGGGGVKAGHAITATHQEPLNTQMLTEADMTGQKQMLGERLYAMVARCFRDGDVEKVGKITGMLLEMENAEILLLLGDEEMLRLRVDEAATVLYQATG

SEQ ID NO: 123821 - protein, 398 aa, Heterodera glycines
  misc_feature (323)..(323): Xaa can be any naturally occurring amino acid
  Homolog annotation: Hit_ID=NP_871953.1; Match level="QueryCoverage =92%, HitCoverage=89%, E-value=1e-170, Identity=74%"; Hit description= i mitochondrial  ascsu pyruvate dehydrogenase e1 component type (45.8 kD) (2I357Co) [Caenorhabditis eleg
  Gene Ontology: Mol. function=pyruvate dehydrogenase activity; Cellular component=mitochondrion; Biological process=acetyl-CoA metabolism
  Essential gene: C elegans homolog=T05H10.6a; Phenotype=Emb
  Coding regions on vcDNA: vcDNA=SeqID_50244; Strand=+; Position=19-1216
MIFLTSFSKHPLSAAFRFFSSVNEVTLQTRPYKLFKLDSGPSTEVRLTRDEALDYYRKMQLVRRMETSANNLYKEKRIRGFCHLYSGQEACAIGMVAATDPKDAVITAYRCHGWTYLMGATVQDILAELTGRIAGNVYGKGGSMHMYAKNFFGGNGIVGAQVPIGAGIAFAMKYRRQKNVCLTLYGDGAANQGQLFEATNMAKLWGLPCIFVCENNGFGMGTPVDRASASTDYYTRGDYVPGIWVDGMDVLTVREATRWAKEYCDAGNGPLMMELAPYRYYGHSMSDPGTSYRTRDEIQEVRKSRDPITSFKDRIVTAGLVTXEELKDIDKKVRQEVDEAVKVALSDEVLPPEALFSDLYANTPPLAVRGTTADATVTQPFVSTAEVLRKMGREPKNY

SEQ ID NO: 123822 - protein, 124 aa, Heterodera glycines
  Homolog annotation: Hit_ID=CAE59526.1; Match level="QueryCoverage =87%, HitCoverage=33%, E-value=7e-17, Identity=40%"; Hit description =Hypothetical protein CBG02921 [Caenorhabditis briggsae]
  Essential gene: C elegans homolog=B0491.5; Phenotype=Emb,Lva
  Coding regions on vcDNA: vcDNA=SeqID_50245; Strand=+; Position=47-418
MLLRWLQKCLLIHRHGFLRGKEYKGRTEWWASLGYKDLDLKRGLTTGFYPFFEERDIRYVDSKVPDGTSMVGPQGKDSRYHQSKMVKWGIPGKFEDFQKQIRENCSQYKQIAEKWDLSDEHPGI

SEQ ID NO: 123823 - protein, 417 aa, Heterodera glycines
  Homolog annotation: Hit_ID=CAE60034.1; Match level="QueryCoverage =99%, HitCoverage=62%, E-value=1e-156, Identity=64%"; Hit description= Hypothetical protein CBG03543 [Caenorhabditis briggsae]
  Gene Ontology: Mol. function=oxidoreductase activity; Cellular component=integral to membrane; Biological process=embryogenesis and morphogenesis
  Essential gene: C elegans homolog=K10D2.6; Phenotype=Emb
  Coding regions on vcDNA: vcDNA=SeqID_50246; Strand=+; Position=1-1254
HIFTGEFGRIGAYEKQRPPFEPKNPFLATLTLNRELHSVASDRSCRHIELAVDKALIRYETGDHIAIFPTNDTEKVDKLGNLLVVELDTVFKLVNTDEESTKKHPFPCPCTFRTALTHYVDICSPVKSHVLKALVEVSADEETKAKLTLLSTASEEGLREYAQFIVKERRSIVDVLQHFPACKPPLDLLLELLPRLQARYYSISSSPRVDASLVAVTAVVLRYNTSDGRLVKGVCTNFLADRAPGVSTAPVFVRKSTLRLPHRVQQPVIMVGPGTGFAPFRGFLHDRLWHKQQGKEVGEMHLFFGCRHPDHDHIYKEEMEEFVRVGLLTQLHVAYSRLGSEKVYVQHKLWEARQQIWELIQAGASVYICGDARNMARDVQNMFYKIFAEVGGLSDQESQKMMKDMERQRRYQADVWS

SEQ ID NO: 123824 - protein, 161 aa, Heterodera glycines
  Homolog annotation: Hit_ID=CAE68810.1; Match level="QueryCoverage =100%, HitCoverage=32%, E-value=2e-55, Identity=48%"; Hit description= Hypothetical protein CBG14762 [Caenorhabditis briggsae]
  Gene Ontology: Mol. function=RNA binding; Cellular component =cytoplasm; Biological process=regulation of protein activity, epigenetic
  Essential gene: C elegans homolog=W06B11.2; Phenotype=Gro
  Coding regions on vcDNA: vcDNA=SeqID_50247; Strand=+; Position=1-483
VRCIKDQNGNHVVQKIIERVQPHQLQFIIDTMVNGFTDSVTSLSVHPYGCRVIQRVLEHCTEGQKRPVLEQLHENVLTLVTDQYGNYVIQHVIEHGLFDDRERIVRALHGDILKYAQHKFASNVIEKCLICGTTDQKNALIDEVCADNGSSNPPLLEMMKD

SEQ ID NO: 123825 - protein, 249 aa, Heterodera glycines; identical to SEQ ID NO: 122413
  Homolog annotation: Hit_ID=CAE65730.1; Match level="QueryCoverage =99%, HitCoverage=96%, E-value=1e-81, Identity=62%"; Hit description =Hypothetical protein CBG10813 [Caenorhabditis briggsae]
  Gene Ontology: Mol. function=endopeptidase activity; Cellular component=proteasome core complex (sensu Eukarya); Biological process=ubiquitin-dependent protein catabolism
  Essential gene: C elegans homolog=Y110A7A.14; Phenotype=Emb
  Coding regions on vcDNA: vcDNA=SeqID_50248; Strand=+; Position=11-760

SEQ ID NO: 123826 - protein, 202 aa, Heterodera glycines
  Homolog annotation: Hit_ID=CAE57635.1; Match level="QueryCoverage =88%, HitCoverage=32%, E-value=8e-36, Identity=45%"; Hit description =Hypothetical protein CBG00620 [Caenorhabditis briggsae]
  Gene Ontology: Mol. function=microtubule binding; Cellular component =spindle pole; Biological process=meiotic spindle assembly
  Essential gene: C elegans homolog=F22B5.7; Phenotype=Emb
  Coding regions on vcDNA: vcDNA=SeqID_50249; Strand=+; Position=15-620
MRRFDNRSSGGRFAKISANKRGCALNRVDISKLNINFESPKWQERKEALDALQQLLLQSPRLADLPNYRELIGRLTKIMANDANIFVAASATKCVMLFAKGLRAEFTPHVSLVVPVIFDKFKVEKRLLRDALVECIDVIAAYTSFDHLSKALLEAMTSKQNPSQKSQTDLFIYRLFRSLPAEDVPKGLLKDLVAILSKHGFD

SEQ ID NO: 123827 - protein, 141 aa, Heterodera glycines
  Homolog annotation: Hit_ID=CAB88203.1; Match level="QueryCoverage =98%, HitCoverage=94%, E-value=2e-49, Identity=64%"; Hit description =putative cuticular collagen [Globodera pallida]
  Gene Ontology: Mol. function=structural constituent of cuticle; Cellular component=extracellular; Biological process=cuticle biosynthesis (sensu Nematoda)
  Essential gene: C elegans homolog=F54C9.4; Phenotype=Dpy
  Coding regions on vcDNA: vcDNA=SeqID_50250; Strand=+; Position=79-501
MHEAKIIGGIASLCSLAAILATLVVIPQLYTQINEMNNRVMDGVQAFRVNTDSAWTELMEVQISVTPPTRPRENPFNSIFLRQKRQGLPPQCVCQLQQPSCPPGPPGPPGPPGTPGEPGGAGQPGSPGQPGQQAPPCPPPV

SEQ ID NO: 123828 - protein, 139 aa, Heterodera glycines
  Homolog annotation: Hit_ID=CAE61651.1; Match level="QueryCoverage =87%, HitCoverage=33%, E-value=4e-33, Identity=55%"; Hit description =Hypothetical protein CBG05585 [Caenorhabditis briggsae]
  Gene Ontology: Mol. function=protein binding; Cellular component =intracellular; Biological process=positive regulation of body size
  Essential gene: C elegans homolog=Y59A8B.2; Phenotype=Gro,Sma
  Coding regions on vcDNA: vcDNA=SeqID_50251; Strand=+; Position=64-480
MSAQRIASNSEWKKTPLGQTGLFNMGNTCFMNATLQPLFHTPGFSQLFQEKSAQRFVNGNNSFGTNGMISGSFSALIDLIWSGKFNALRPTTFLEFFARRVNTEMADRRQHDAQEFQLYLLDALHEDTNRVNKRQSFEQ

SEQ ID NO: 123829 - protein, 297 aa, Heterodera glycines
  Homolog annotation: Hit_ID=CAE59273.1; Match level="QueryCoverage =96%, HitCoverage=97%, E-value=1e-123, Identity=76%"; Hit description= Hypothetical protein CBG02605 [Caenorhabditis briggsae]
  Gene Ontology: Mol. function=estrogen receptor binding; Cellular component=mitochondrion; Biological process=negative regulation of transcription
  Essential gene: C elegans homolog=T24H7.1; Phenotype=Emb,Gro
  Coding regions on vcDNA: vcDNA=SeqID_50252; Strand=+; Position=41-931
MAAIDPKDFFNKFAKPSKGAGVGAGLMTAAAVAGYALYKSMYTIEAGHRAIMFNRIGGLGDEVYREGLHFRIPWFQYPIVYDIRARPNQIRSPTGSKDLQMVNIGLRVLSRPDPGQLQTICRMLGTNWEERVLPSICNEVLKGVVAKFNASQLITQRQQVSLLVRKGLIERALDFNIILDDVAITELAFSPQYSAAVDAKQVAAQEAQRASFMVEKAIQQRQEKIVQAEGEAQAAKLLGESMKNDPGFLKLRKIRAAQKIARFIANSSNRVYLPSDGLFLNLADEDYLSLATNKGRR

SEQ ID NO: 123830 - protein, 218 aa, Heterodera glycines
  Homolog annotation: Hit_ID=CAE59203.1; Match level="QueryCoverage =93%, HitCoverage=26%, E-value=2e-55, Identity=53%"; Hit description =Hypothetical protein CBG02514 [Caenorhabditis briggsae]
  Gene Ontology: Mol. function=protein binding; Cellular component =mitochondrial membrane; Biological process=mitochondrial fusion
  Essential gene: C elegans homolog=ZK1248.14; Phenotype=Emb,Gro
  Coding regions on vcDNA: vcDNA=SeqID_50253; Strand=+; Position=3-656
ATINHISASNGNDQKRRHLASGNEPLQRFGEAKKWMTDIYGQLDGHVGELLEFYLGLVKNGQKFVPPAQIDEIGHFRDSVRAIREVIGRDKMKVVFFGRTSNGKSSVINAMLSCRVLPQGMGHTTCCFLQVEGGSEQDKYFMMEDGAKHFPIAELDSVGHALGSEGMGSLGRDSLIHIFYPKSASKLLQNDVLIVDSPGVDLSPEFDSWIDKHCLDAD

SEQ ID NO: 123831 - protein, 215 aa, Heterodera glycines
  misc_feature (178)..(178): Xaa can be any naturally occurring amino acid
  misc_feature (194)..(194): Xaa can be any naturally occurring amino acid
  Homolog annotation: Hit_ID=NP_498047.1; Match level="QueryCoverage =100%, HitCoverage=17%, E-value=1e-100, Identity=82%"; Hit description=RNA polymerase II subunit (3G33) [Caenorhabditis elegans] gb|AAA21158.1| Hypothetical protein C26E6.4 [
  Gene Ontology: Mol. function=DNA binding; Cellular component=DNA -directed RNA polymerase II, core complex; Biological process =transcription from Pol II promoter
  Essential gene: C elegans homolog=C26E6.4; Phenotype=Emb
  Coding regions on vcDNA: vcDNA=SeqID_50254; Strand=+; Position=1-645
IRVSGDDVIIGKTIALPEVEDELEASTARYSKKDASTTLRSSETGIVDQVMVSVNAEGNKFVKIRVRSIRTPQIGDKFASRHGQKGTMGMMYRQEDMPFTCEGITPDIIINPHAVPSRMTIGHLIECLQGKLSANKGEIGDATPFNDTVNVQKISALLEGYGYQLRGNEIMYNGFTGXKLSTQVFLGPTYYQRXLRHMVEDKIHSRARGPVQGMN

SEQ ID NO: 123832 - protein, 210 aa, Heterodera glycines
  Homolog annotation: Hit_ID=NP_495863.1; Match level="QueryCoverage =100%, HitCoverage=45%, E-value=1e-89, Identity=73%"; Hit description= phenylalanine hydroxylase, Biogenic Amine Synthesis related (52.1 kD) (bas-2) [Caenorhabditis elegans] e
  Gene Ontology: Mol. function=phenylalanine 4-monooxygenase activity; Biological process=phenylalanine catabolism
  Essential gene: C elegans homolog=ZK1290.2a; Phenotype=Emb
  Coding regions on vcDNA: vcDNA=SeqID_50255; Strand=+; Position=3-632
CTGFTLRPVAGLLSSRDFLAGLAFRVFHSTQYIRHSSKPHYTPEPDICHELLGHCPLFADPDFAQFSQEFGLASLGASDEMVEKLATLYWFTVEFGICIQNGAKKAYGAGLLSSFGELEYALSGQPELAAFNPPETCQTKYPITSYQPKYFVAESFADAKNKLATWSTSIPRQFQVNYNPYTQRIEMLDNESAANKLVRDVKSQVSKLEE

SEQ ID NO: 123833 - protein, 160 aa, Heterodera glycines
  Homolog annotation: Hit_ID=NP_498064.2; Match level="QueryCoverage =91%, HitCoverage=11%, E-value=1e-32, Identity=52%"; Hit description =la related protein (3G102) [Caenorhabditis elegans] gb|AAK93859.2| Hypothetical protein R144.7 [Caenorhab
  Essential gene: C elegans homolog=R144.7; Phenotype=Emb
  Coding regions on vcDNA: vcDNA=SeqID_50256; Strand=+; Position=1-480
LNPWEKQQPNNNNRQNKGKENGTRQPQAMPVGWVLGVRSKTTSINEDAGPSHPSTSDALSTTVKPPASSSSIASVLPPHPSFSLIQENGFEQRVYTDWRSQCKKQREALGYDIPEMHTLYRFWSLFLRDNFNRSMYNEFRKFALEDADHGLRYGIESLFR

SEQ ID NO: 123834 - protein, 70 aa, Heterodera glycines; identical to SEQ ID NO: 122040
  Homolog annotation: Hit_ID=BAD26684.1; Match level="QueryCoverage =100%, HitCoverage=100%, E-value=3e-27, Identity=85%"; Hit description=Ribosomal protein L38 [Plutella xylostella]
  Essential gene: C elegans homolog=C06B8.8; Phenotype=Gro,Stp
  Coding regions on vcDNA: vcDNA=SeqID_50257; Strand=+; Position=64-276

SEQ ID NO: 123835 - protein, 211 aa, Heterodera glycines
  Homolog annotation: Hit_ID=NP_492779.1; Match level="QueryCoverage =100%, HitCoverage=37%, E-value=2e-77, Identity=71%"; Hit description= RNA helicase (61.3 kD) (1L203) [Caenorhabditis elegans] gb|AAC17654.2| Hypothetical protein B0511.6 [Cae
  Gene Ontology: Mol. function=ATP dependent RNA helicase activity; Cellular component=nucleolus; Biological process=35S primary transcript processing
  Essential gene: C elegans homolog=B0511.6; Phenotype=Lva
  Coding regions on vcDNA: vcDNA=SeqID_50258; Strand=+; Position=3-635
FERMTEIQAKSIPPLLEGKDVLGSAKTGSGKTLAFLIPSIELLLRNGWKQQQGTGVLIVSPTRELSMQTYGVLYELMEKHPNISHGLVMGGANRQNEEKRLAGGVAILVATPGRLLDHLQNTSNFVVRNLKCLIVDEADRIFDIGFEQEMHQIVKLLPKKRQSMLFSATCSPKVDELVKTALKTDPLKIGVMEQQRDPNDMATVEGLEQGY

SEQ ID NO: 123836 - protein, 236 aa, Heterodera glycines; identical to SEQ ID NO: 122746
  Homolog annotation: Hit_ID=NP_499076.1; Match level="QueryCoverage =81%, HitCoverage=53%, E-value=4e-51, Identity=49%"; Hit description =tyrosine phosphatase (41.1 kD) (3K532) [Caenorhabditis elegans] emb|CAA80156.1| Hypothetical protein F54C
  Gene Ontology: Mol. function=protein tyrosine phosphatase activity; Cellular component=nucleus; Biological process=RNA processing
  Essential gene: C elegans homolog=F54C8.4; Phenotype=Emb
  Coding regions on vcDNA: vcDNA=SeqID_50259; Strand=+; Position=75-782

SEQ ID NO: 123837 - protein, 156 aa, Heterodera glycines
  Homolog annotation: Hit_ID=NP_503446.1; Match level="QueryCoverage =69%, HitCoverage=21%, E-value=2e-20, Identity=46%"; Hit description =cell Division Cycle related (55.7 kD) (cdc-25.2) [Caenorhabditis elegans] gb|AAB94237.2| Cell division cy
  Gene Ontology: Mol. function=protein tyrosine phosphatase activity; Cellular component=intracellular; Biological process=meiotic spindle assembly
  Essential gene: C elegans homolog=F16B4.8; Phenotype=Bmd,Emb,Lvl
  Coding regions on vcDNA: vcDNA=SeqID_50260; Strand=+; Position=4-471
MESYVQVEDQDSRDSGISLAQSTTSQQSCFAKIYFPTLFDFGFKVRELYSLDTVERPQVPHKAFRSINADTMANLLGSLTEEQFQRRFILIDCRYPYEYDAGHIWYSLNLWETTSIEKLFYPEEEERFGEIIVRTPIFYCEYSQKRGPKMALALRE

SEQ ID NO: 123838 - protein, 163 aa, Heterodera glycines
  Homolog annotation: Hit_ID=NP_501793.1; Match level="QueryCoverage =100%, HitCoverage=30%, E-value=5e-25, Identity=39%"; Hit description= SH2 motif and protein kinase family member (kin-5) [Caenorhabditis elegans] emb|CAA93289.1| Hypothetical
  Gene Ontology: Mol. function=protein tyrosine kinase activity; Cellular component=plasma membrane; Biological process=cell proliferation
  Essential gene: C elegans homolog=T04B2.2; Phenotype=Unclassified
  Coding regions on vcDNA: vcDNA=SeqID_50261; Strand=+; Position=3-491
TEEISGTERVYALSVNVGGFLNHVIFRRHKGMFSVDLNSDKGFRTIERFVDNYLRTGVSVTTQQYVALIRAVPRAHWELSHTSIILGNELGRGTFGVVKSGVYVDQQGTRAAVAIIEVSQTSTKEQIKEFMNEARVMRQLRHPNVIQFYGVAVGQEPLMIVME

SEQ ID NO: 123839 - protein, 231 aa, Heterodera glycines
  Homolog annotation: Hit_ID=NP_957491.1; Match level="QueryCoverage =92%, HitCoverage=92%, E-value=5e-33, Identity=39%"; Hit description =similar to splicing factor, arginine/serine-rich 10 (transformer 2 homolog, Drosophila) [Danio rerio] gb|
  Gene Ontology: Mol. function=RNA binding; Cellular component=nuclear speck; Biological process=growth
  Essential gene: C elegans homolog=C18D11.4; Phenotype=Lva
  Coding regions on vcDNA: vcDNA=SeqID_50262; Strand=+; Position=29-724
YSLILYIFLHKMGREHRSDRKRDYEKEHSPLADESSSGSRKRTKREKNRSVSPARSRSHTYSPSPRREISPKRRARSRSRSRDLPSSRGGGGGGGGYYGSRRFHDGRDNPNPNPCLGVFGMSLHTTERDLKHLFGRYGEVDSVQIVYDRLSGRSRGFGFVYFTHTKDAARAKENLVDAVIDGMKVRVDYSVTRGGGPHSRHVRKSFSRSPVRNNRSRTRSRSRSESRSVSR

SEQ ID NO: 123840 - protein, 163 aa, Heterodera glycines
  misc_feature (105)..(105): Xaa can be any naturally occurring amino acid
  misc_feature (139)..(139): Xaa can be any naturally occurring amino acid
  Homolog annotation: Hit_ID=AAC79129.1; Match level="QueryCoverage =89%, HitCoverage=44%, E-value=5e-62, Identity=82%"; Hit description =glyceraldehyde-3-phosphate-dehydrogenase [Globodera rostochiensis] sp|O16027|G3P1_GLORO Glyceraldehyde-3-p
  Gene Ontology: Mol. function=glyceraldehyde 3-phosphate dehydrogenase (phosphorylating) activity; Cellular component=cytoplasm; Biological process=glycolysis
  Essential gene: C elegans homolog=K10B3.7; Phenotype=Unclassified
  Coding regions on vcDNA: vcDNA=SeqID_50263; Strand=+; Position=1-493
FRPSLFSCLKKLQRWSKPKVGINGFGRIGRLALRAAIEKDTVQVVAVNDPFIELDYMVYMFNYDSTHGRFKGKISTNAGNLVVEKEGKSAHTIKVFNLKDPVEIXWGEAGAGYVIESTGVFTTIEKASAPLKSGAKKVXSSAPSADAPDVLEWASTKDKSDPG

SEQ ID NO: 123841 - protein, 267 aa, Heterodera glycines
  Homolog annotation: Hit_ID=CAE57570.1; Match level="QueryCoverage =97%, HitCoverage=60%, E-value=1e-106, Identity=68%"; Hit description= Hypothetical protein CBG00548 [Caenorhabditis briggsae]
  Gene Ontology: Mol. function=RNA binding; Cellular component =nucleosome; Biological process=mRNA cleavage
  Essential gene: C elegans homolog=F28C6.3; Phenotype=Emb,Lva
  Coding regions on vcDNA: vcDNA=SeqID_50264; Strand=+; Position=178 -1024
QKVGGFESAGLDLEFDADVVPTSPEPSLYETVYLTTHKAPCRAAAFSPDGALVATASNDCSIKILDVDKIISRIDVTLSESGPDAHHPVIRTLYDHLDEVTCVAFHPRESVLLSGSNDFTLKMFDYSKTAVKRAMKTITEVEPITAVSFHPSGEFFLCATRHPTLRLYSAETQQCFVSTIPKDQHSDSITDVCYSENARMFVTGSRDGNVKVWDGVSNRCIETFTRAHDGAPICSAQFTRNGKYVLTVGMDSVPKLWELSTNRCLIA

SEQ ID NO: 123842 - protein, 248 aa, Heterodera glycines
  misc_feature (111)..(111): Xaa can be any naturally occurring amino acid
  Homolog annotation: Hit_ID=AAT70232.1; Match level="QueryCoverage =92%, HitCoverage=88%, E-value=1e-128, Identity=69%"; Hit description= unc-87 [Heterodera glycines]
  Gene Ontology: Mol. function=troponin C binding; Cellular component =cytoskeleton; Biological process=muscle contraction
  Essential gene: C elegans homolog=F08B6.4a; Phenotype=Unc
  Coding regions on vcDNA: vcDNA=SeqID_50265; Strand=+; Position=11-757
MKDSKHPEYSHERDIDNTEIPLQMGTNKFASQKGMTLFGTGRRETTRMKDSKHPEYSHERDIDNREIPLQMGTNKFASQKGMTGFGTNRRETTKMLDTSHPEYSHEQSIDXTSIPYQMGSNKYASQKGMTGFGQPRWEVLDPSISYQNRKSQGMVRLQSGTNRFASQAGMTGFGTPRNNTYEAEAGELPYEDMKKSEAIIPSQAGWNKGDSQKLMTNFGTPRDVKGKHLKRIWELEYPEEAEVSLDRL

SEQ ID NO: 123843 - protein, 193 aa, Heterodera glycines
  misc_feature (140)..(140): Xaa can be any naturally occurring amino acid
  misc_feature (177)..(177): Xaa can be any naturally occurring amino acid
  Homolog annotation: Hit_ID=XP_311177.1; Match level="QueryCoverage =99%, HitCoverage=45%, E-value=7e-85, Identity=84%"; Hit description =ENSANGP00000019055 [Anopheles gambiae]
  Gene Ontology: Biological process=reproduction
  Essential gene: C elegans homolog=T04C12.6; Phenotype=Ste
  Coding regions on vcDNA: vcDNA=SeqID_50266; Strand=+; Position=32-607
KHQSQPEKMCDEEVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPXAMYVAIQGLLSLVPFGAEPPGFGLNSGDGGTPTRAPXTRGIALPQAFFRLDLA

SEQ ID NO: 123844 - protein, 155 aa, Heterodera glycines
  Homolog annotation: Hit_ID=CAE67217.1; Match level="QueryCoverage =100%, HitCoverage=28%, E-value=1e-45, Identity=57%"; Hit description= Hypothetical protein CBG12654 [Caenorhabditis briggsae]
  Gene Ontology: Biological process=locomotory behavior
  Essential gene: C elegans homolog=F57B10.3a; Phenotype=Age
  Coding regions on vcDNA: vcDNA=SeqID_50267; Strand=+; Position=3-467
DTSPTSGAGFLQQLLDFLSAENYGELATIVGRYYAMDRDNRWERIKVAYEALVAGEGEKCEPANAVQLVNERYANQQTDEFLTPIVFSDEARVKDNDTLVFFNYRADRMREINKCMGDLQNLQDLGTNVALPNGLHIKTMTQYNAEFPFPILFPP

SEQ ID NO: 123845 - protein, 146 aa, Heterodera glycines
  Homolog annotation: Hit_ID=NP_502065.1; Match level="QueryCoverage =100%, HitCoverage=99%, E-value=1e-83, Identity=99%"; Hit description= UBiquitin Conjugating enzyme E2, Ubiquitin conjugating enzyme, LEThal LET-70 (16.7 kD) (let-70) [Caenorh
  Gene Ontology: Mol. function=ubiquitin conjugating enzyme activity; Cellular component=proteasome complex (sensu Eukarya); Biological process=chromosome organization and biogenesis (sensu Eukarya)
  Essential gene: C elegans homolog=M7.1; Phenotype=Emb
  Coding regions on vcDNA: vcDNA=SeqID_50268; Strand=+; Position=14-451
MALKRIQKELQDLGRDPPAQCSAGPVGDDLFHWQATIMGPPESPYQGGVFFLTIHFPTDYPFKPPKVAFTTRIYHPNINSNGSICLDILRSQWSPALTISKVLLSICSLLCDPNPDDPLVPEIARIYKTDRERYNTLAREWTQKYA

SEQ ID NO: 123846 - protein, 399 aa, Heterodera glycines; identical to SEQ ID NO: 122651
  Homolog annotation: Hit_ID=NP_501878.1; Match level="QueryCoverage =99%, HitCoverage=63%, E-value=1e-153, Identity=69%"; Hit description= transketolase (66.0 kD) (4L9) [Caenorhabditis elegans] emb|CAB02889.1| Hypothetical protein F01G10.1 [Ca
  Gene Ontology: Mol. function=transketolase activity; Cellular component=cytoplasm; Biological process=positive regulation of growth rate
  Essential gene: C elegans homolog=F01G10.1; Phenotype=Emb,Gro,Lva
  Coding regions on vcDNA: vcDNA=SeqID_50269; Strand=+; Position=51-1247

SEQ ID NO: 123847 - protein, 346 aa, Heterodera glycines
  Homolog annotation: Hit_ID=CAE59466.1; Match level="QueryCoverage =100%, HitCoverage=47%, E-value=1e-123, Identity=66%"; Hit description=Hypothetical protein CBG02850 [Caenorhabditis briggsae]
  Gene Ontology: Mol. function=glucosamine-fructose-6-phosphate aminotransferase (isomerizing) activity; Biological process=fructose 6-phosphate metabolism
  Essential gene: C elegans homolog=F07A11.2a; Phenotype=Ste
  Coding regions on vcDNA: vcDNA=SeqID_50270; Strand=+; Position=4-1041
MCGIFAYLNFFSPKKRSEIIDILLQGLRRMEYRGYDSAGIAIDCSNDVNLPHADVAVYRKTGKVDNLDDSIKNSEGVDMDFTYNVHCGIGHTRWATHGKPKDENAHPQRSNFDNDFAVVHNGIITNYKEIKDYLLTKGYKFESETDTEVIAKLTQHIHQRHPHYGLRQLVEIVVQQLEGAFALAFKSRRFPGQLVATRRGSPLLVGIKSQSKLTTDHFPVFYSRPRRGPVSLVFDESCTTAMETPNKLNASDMFASFSAPFNDTINSTARKIECSDSTRSVRPCDLANFEVEYFVASDASAVIEHTRQVIFLEDDDVAFVEDGALSIHRIKRSDDTAALTEQTREV

SEQ ID NO: 123848 - protein, 211 aa, Heterodera glycines
  Homolog annotation: Hit_ID=CAE63626.1; Match level="QueryCoverage =88%, HitCoverage=93%, E-value=2e-41, Identity=48%"; Hit description =Hypothetical protein CBG08120 [Caenorhabditis briggsae]
  Gene Ontology: Mol. function=signal sequence binding; Cellular component=integral to membrane; Biological process=cotranslational membrane targeting
  Essential gene: C elegans homolog=T04G9.5; Phenotype=Emb
  Coding regions on vcDNA: vcDNA=SeqID_50271; Strand=+; Position=12-647
MFQKVFLVLLFLLAFTVSNLRSDEGIGEMDANQKPLNSARILASKFTLSQYAVESMDLVMEYNLFNVGDRTAFRVVLDDRNSFPTHSFDIVRGMLHIRWEKISPGENVSHSVVVRPRSYGIFNYTSAMVTYYVTEDAKQATVGYSTAPGEGNIYRLKDYERRFSSKIGIWLVFLLLALPTTLLPFFLWYKFQQKYATKSGTSGQQNSKKAQ

SEQ ID NO: 123849 - protein, 216 aa, Heterodera glycines
  Homolog annotation: Hit_ID=CAE64415.1; Match level="QueryCoverage =53%, HitCoverage=11%, E-value=2e-17, Identity=42%"; Hit description =Hypothetical protein CBG09108 [Caenorhabditis briggsae]
  Gene Ontology: Mol. function=RNA binding; Cellular component =extracellular space
  Essential gene: C elegans homolog=C56G2.1a; Phenotype=Emb
  Coding regions on vcDNA: vcDNA=SeqID_50272; Strand=+; Position=136-783
MDDKSPAAIFAREFEHRQARDVDELRRIFHRHIEEESRSDEQQRHEKTAAPMLTTAPAMAAALPSARIVRTPHIGTNARENGTASLSAITPIAAAFRWCTPLANTPTVSRLTLPFRTPCFVHISVHVNPGHFFVQLPSHPTFSSLALLNQYMLTVYTHNQPGVGAPGLAKPYDVGVLCAGPACDGWCRAITVAYDQDQDGMVGRFVDYGGFARLAR

SEQ ID NO: 123850 - protein, 285 aa, Heterodera glycines
  misc_feature (213)..(213): Xaa can be any naturally occurring amino acid
  misc_feature (249)..(249): Xaa can be any naturally occurring amino acid
  Homolog annotation: Hit_ID=BAC66617.1; Match level="QueryCoverage =98%, HitCoverage=77%, E-value=1e-108, Identity=62%"; Hit description= inorganic pyrophosphatase [Ascaris suum]
  Gene Ontology: Mol. function=inorganic diphosphatase activity; Cellular component=mitochondrion; Biological process=energy pathways
  Essential gene: C elegans homolog=C47E12.4a; Phenotype=Emb,Lva
  Coding regions on vcDNA: vcDNA=SeqID_50273; Strand=+; Position=54-908
MSAYQTIEKGSLHTLNYRVFFKNSDGKLISPWHDIPLYASESNKLFNMVVEIPRWTNAKMEIATKEVMSPIRQDEKKGLPRFVNNIFPHRGYIWNYGALPQTWEDPGHKDENTGENGDNDPIDVIEIGSKVQKRGAVIRVKVLGVLALLDEGETDWKLVAIDENDELAPKLNGIEDIEKHLPGLLSATHEWFRIYKIPTGKPANQFPFNGQFXDRNFAHQVIERTHQFWKKLVTSASPHPLNTDCHKEXAVFKANLSDWESFISKQPKFGHAQQVPEHVDKWHFI

SEQ ID NO: 123851 - protein, 405 aa, Heterodera glycines
  Homolog annotation: Hit_ID=CAE62116.1; Match level="QueryCoverage =76%, HitCoverage=16%, E-value=9e-52, Identity=44%"; Hit description =Hypothetical protein CBG06155 [Caenorhabditis briggsae]
  Gene Ontology: Mol. function=microtubule binding; Cellular component =microtubule cytoskeleton; Biological process=gametogenesis
  Essential gene: C elegans homolog=C10C6.1; Phenotype=Stp
  Coding regions on vcDNA: vcDNA=SeqID_50274; Strand=+; Position=2-1216
GIVPFMGDTPEALFANIINEDVEYPEGDEALDSDAESLIHLLLEKNPLDRLGTVGGAPQVSAHPFFAPLDFDTILRQKAEFVPQLENDEDTSYFDSRSDRYNHDANESAEDDDAAAVPMFWSFSTASPRHSIVGLELPAGGMAMLQAAHAAAIERSGQPLQQQDRIVDDDRVESRRRLLSSATTASSGIGSGPNSAFGPLSSTLLTRGGNCSDSQDSSHESAVGRRATAAASEFACDVMPSAVILRRRFSNQRHHTNDSSTSSSAGTTIGTTAGGGVGSSTDDSSSLDIATTMHLEQPRRSQGQLPRLAISPCGTTFDSSTGGAIVTHQRESACGTGGEFLSPVNERHITAGGGSGGMKRMEKRPSAVVHELITDVVRVSSSYGQSLARQSRSSSCRVSNMSPGA

SEQ ID NO: 123852 - protein, 211 aa, Heterodera glycines; identical to SEQ ID NO: 122390
  Homolog annotation: Hit_ID=NP_491593.1; Match level="QueryCoverage =93%, HitCoverage=95%, E-value=9e-55, Identity=53%"; Hit description =ATP synthase mitochondrial (22.4 kD) (1F996) [Caenorhabditis elegans] gb|AAB37654.1| Hypothetical protein
  Gene Ontology: Mol. function=hydrogen-transporting ATP synthase activity, rotational mechanism; Cellular component=mitochondrion; Biological process=growth
  Essential gene: C elegans homolog=F27C1.7a; Phenotype=Emb,Lva
  Coding regions on vcDNA: vcDNA=SeqID_50275; Strand=+; Position=8-640

SEQ ID NO: 123853 - protein, 99 aa, Heterodera glycines; identical to SEQ ID NO: 123171
  Homolog annotation: Hit_ID=AAT70232.1; Match level="QueryCoverage =76%, HitCoverage=94%, E-value=8e-34, Identity=75%"; Hit description =unc-87 [Heterodera glycines]
  Essential gene: C elegans homolog=F08B6.4a; Phenotype=Unc
  Coding regions on vcDNA: vcDNA=SeqID_50276; Strand=+; Position=194-493

SEQ ID NO: 123854 - protein, 257 aa, Heterodera glycines
  Homolog annotation: Hit_ID=NP_499094.1; Match level="QueryCoverage =99%, HitCoverage=99%, E-value=1e-101, Identity=75%"; Hit description= vacuolar H-ATPase (28.8 kD) (3K599) [Caenorhabditis elegans] emb|CAA81600.1| Hypothetical protein F55H2.
  Gene Ontology: Mol. function=hydrogen-transporting ATPase activity, rotational mechanism; Cellular component=vacuolar membrane (sensu Fungi); Biological process=vacuolar acidification
  Essential gene: C elegans homolog=F55H2.2; Phenotype=Emb
  Coding regions on vcDNA: vcDNA=SeqID_50277; Strand=+; Position=5-778
MSGGGKDRIAVFPSRMAQTVMKTRLKGAQKGHSLPKKKADALNMRFREILKKITENKKRMADVLKEAAFSLAEAKFTAGDFSHMVVQNVSSQAQYTVRMKRENVVGVFLPVFEAHRKEGSDGDAYNLTGLGKGGANIGKLKRNYNKAVELLVELATLQTCFITLDEAIQVTNRRVNAIEHVIIPKIENTLTYIVTELDEMEREEFFRMKKIQAKKKRQRDEEKARETENVLTERQPDDGRAPKSLLEDEEEVPVLFA

SEQ ID NO: 123855 - protein, 194 aa, Heterodera glycines
  Homolog annotation: Hit_ID=CAE74731.1; Match level="QueryCoverage =100%, HitCoverage=51%, E-value=8e-75, Identity=68%"; Hit description= Hypothetical protein CBG22549 [Caenorhabditis briggsae]
  Gene Ontology: Mol. function=actin binding; Cellular component =cytoskeleton; Biological process=cell adhesion
  Essential gene: C elegans homolog=T21D12.4; Phenotype=Emb,Lvl
  Coding regions on vcDNA: vcDNA=SeqID_50278; Strand=+; Position=3-587
TAEMIHAKDIVAILHLLITLALHYRAPIRFPNNVNVQVLIYTRHGKQISKSIVTEQLTTKQTELAPKGERDAFDTLFDYGPDKLQHVKNSLVAFCNKHLNKINLEVTDLETQFQDGVFLILLMGLLEGYFVPLYKFHLQVNNNDEKLKNVQFAYFLMEEAGMAKPKCRPADIVNGDLKSTLRVLHALFTKYKHV

SEQ ID NO: 123856 - protein, 160 aa, Heterodera glycines
  Homolog annotation: Hit_ID=CAE59341.1; Match level="QueryCoverage =91%, HitCoverage=8%, E-value=2e-20, Identity=37%"; Hit description =Hypothetical protein CBG02686 [Caenorhabditis briggsae]
  Essential gene: C elegans homolog=C56E6.1; Phenotype=Lva
  Coding regions on vcDNA: vcDNA=SeqID_50279; Strand=+; Position=3-482
MTEPSASIVRPTFFDSVERWADRDFGEDLRNFLEEISYSDLASYAQLIHHKDIIIQCLLRHLADRSLSLPAFCDFCSAIATDLRDDFHTHFWQIFDAISNLVLASKGKEQCSDNELECTFRAMEQIVRINFRFVSARLKQLFSRLLPLFAFPSDGRLRFI

SEQ ID NO: 123857 - protein, 99 aa, Heterodera glycines
  Homolog annotation: Hit_ID=CAE69514.1; Match level="QueryCoverage =85%, HitCoverage=35%, E-value=1e-12, Identity=45%"; Hit description =Hypothetical protein CBG15723 [Caenorhabditis briggsae]
  Gene Ontology: Cellular component=proteasome regulatory particle (sensu Eukarya)
  Essential gene: C elegans homolog=F40G9.1; Phenotype=Gro
  Coding regions on vcDNA: vcDNA=SeqID_50280; Strand=+; Position=3-302
RGTTPLHKAASQGHQRIVNLLLGCRKNLQIDLPNREGDTALHLACEDQQMDVALLLARSGASIEKKNRQNKTPIDLVDGKEQKLKLIKASESVKPTAGT

SEQ ID NO: 123858 - protein, 113 aa, Heterodera glycines
  Homolog annotation: Hit_ID=NP_499552.1; Match level="QueryCoverage =96%, HitCoverage=84%, E-value=5e-26, Identity=51%"; Hit description =putative nuclear protein of eukaryotic origin (14.6 kD) (3N8) [Caenorhabditis elegans] emb|CAB60500.1| Hy
  Gene Ontology: Mol. function=transcription co-repressor activity; Cellular component=nucleus; Biological process=embryogenesis and morphogenesis
  Essential gene: C elegans homolog=Y56A3A.18; Phenotype=Emb
  Coding regions on vcDNA: vcDNA=SeqID_50281; Strand=+; Position=8-349
MPKKHTQSNKTRNMSGRDLDEIHADLIRPDKMQRIQERPFDDDLPGGGWHYCVACDRHFVDEQTKAGHEKTKGHKRRLRALREKPYTQREAELAGGLGVEEQIKLESLADLTF

SEQ ID NO: 123859 - protein, 151 aa, Heterodera glycines
  Homolog annotation: Hit_ID=CAE67303.1; Match level="QueryCoverage =98%, HitCoverage=34%, E-value=1e-71, Identity=85%"; Hit description =Hypothetical protein CBG12756 [Caenorhabditis briggsae]
  Gene Ontology: Mol. function=adenosylhomocysteinase activity; Cellular component=cytoplasm; Biological process=one-carbon compound metabolism
  Essential gene: C elegans homolog=K02F2.2; Phenotype=Lva,Unc
  Coding regions on vcDNA: vcDNA=SeqID_50282; Strand=+; Position=101-553
MSSKPAYKVADISLADFGRREITIAENEMPGLMAMRAKFGAQKPLKGARIAGCLHMTVQTAVLIETLLELGAEVQWSSCNIFSTQDHAAAAIAKRGVPVYAWKGETDEEYEWCIEQTLIFPDGKPLNMILDDGGDLTNLVHHQHAELLPGI

SEQ ID NO: 123860 - protein, 159 aa, Heterodera glycines; identical to SEQ ID NO: 122379
  Homolog annotation: Hit_ID=NP_508542.1; Match level="QueryCoverage =71%, HitCoverage=88%, E-value=3e-28, Identity=56%"; Hit description =putative nuclear protein, with a coiled coil-4 domain (15.0 kD) (XD770) [Caenorhabditis elegans] gb|AAK39
  Essential gene: C elegans homolog=C15C7.5; Phenotype=Unclassified
  Coding regions on vcDNA: vcDNA=SeqID_50283; Strand=+; Position=163-642

SEQ ID NO: 123861 - protein, 262 aa, Heterodera glycines; identical to SEQ ID NO: 122684
  Homolog annotation: Hit_ID=AAD43464.1; Match level="QueryCoverage =100%, HitCoverage=45%, E-value=1e-148, Identity=98%"; Hit description=pre-mRNA splicing factor [Heterodera glycines]
  Gene Ontology: Cellular component=spliceosome complex; Biological process=locomotory behavior
  Essential gene: C elegans homolog=F49D11.1; Phenotype=Bmd,Emb,Lva
  Coding regions on vcDNA: vcDNA=SeqID_50284; Strand=+; Position=11-796

SEQ ID NO: 123862 - protein, 105 aa, Heterodera glycines
  Homolog annotation: Hit_ID=NP_510360.1; Match level="QueryCoverage =91%, HitCoverage=32%, E-value=6e-13, Identity=39%"; Hit description =putative endoplasmic reticulum protein, with a coiled coil domain, of bilaterial origin (34.2 kD) (XO782)
  Essential gene: C elegans homolog=R03E1.2; Phenotype=Emb,Lva,Lvl,Unc
  Coding regions on vcDNA: vcDNA=SeqID_50285; Strand=+; Position=53-370
MLLRFSLTVQLLLLFFAFEVFGAEPPEGAQNEEGQRDSKRLEMARKGLNVHMFSSPNFAPMFGIIAGLSVVLIIAIVFIVVGLLSMEPAKDSIIYRMTTTRLKKD

SEQ ID NO: 123863 - protein, 206 aa, Heterodera glycines; identical to SEQ ID NO: 122457
  Homolog annotation: Hit_ID=CAE60169.1; Match level="QueryCoverage =91%, HitCoverage=60%, E-value=3e-83, Identity=79%"; Hit description =Hypothetical protein CBG03723 [Caenorhabditis briggsae]
  Gene Ontology: Mol. function=adenine transporter activity; Cellular component=integral to plasma membrane; Biological process =embryogenesis and morphogenesis
  Essential gene: C elegans homolog=T27E9.1a; Phenotype=Emb
  Coding regions on vcDNA: vcDNA=SeqID_50286; Strand=+; Position=50-667

SEQ ID NO: 123864 - protein, 233 aa, Heterodera glycines
  misc_feature (89)..(89): Xaa can be any naturally occurring amino acid
  Homolog annotation: Hit_ID=CAE56899.1; Match level="QueryCoverage =100%, HitCoverage=60%, E-value=2e-76, Identity=57%"; Hit description= Hypothetical protein CBG24740 [Caenorhabditis briggsae]
  Gene Ontology: Mol. function=acetyl-CoA C-acetyltransferase activity; Cellular component=cytosol; Biological process=ergosterol biosynthesis
  Essential gene: C elegans homolog=T02G5.7; Phenotype=Bmd,Unc
  Coding regions on vcDNA: vcDNA=SeqID_50287; Strand=+; Position=2-704
MGVCAEKTVAEFGFTREQQDAYALASYARATRAWAGGAFGAEIVPVKVKQRKGTELMVAEDEEYRRLMPDKVTSLQPAFVKDGTGTITXANASSLNDGAASLVIASGQVEGAKPLAKVIAYAEAGRAPVDFSVAPVDAVKTLLQSVNISIDQIARWEVNEAFSVTALAFIRQLDLDPARVNALGGAVALGHPIGCSGARIVVTLVHQLESGEFGIAAICNGGGEATAILVQRI

SEQ ID NO: 123865 - protein, 209 aa, Heterodera glycines
  Homolog annotation: Hit_ID=NP_499156.1; Match level="QueryCoverage =82%, HitCoverage=59%, E-value=2e-61, Identity=70%"; Hit description =Enoyl-CoA hydratase/carnithine racemase, mitochondrial (31.2 kD) (3K842) [Caenorhabditis elegans] emb|CAA
  Gene Ontology: Mol. function=enoyl-CoA hydratase activity; Cellular component=mitochondrion; Biological process=energy pathways
  Essential gene: C elegans homolog=T05G5.6; Phenotype=Lva
  Coding regions on vcDNA: vcDNA=SeqID_50288; Strand=+; Position=36-662
MFTKLMPFLSLRQPLAVASYSLIQQARKFSTAVMTNYEMIKVERVGADDVVALITLNRPKALNALCSQLMDELAHSLTYLDKDDGVHAIVLTGSERAFAAGADIKEMVPKKFAEVFGGGFLENWSQVATVRKPTIAAVNGHALGGGCELAMMCDIIYAGEKAMFGQPEIKIGTIPGAGGTQRLARIVGKSLAMKMCLTGEPINASKALE

SEQ ID NO: 123866 - protein, 157 aa, Heterodera glycines
  Homolog annotation: Hit_ID=AAC48266.2; Match level="QueryCoverage =59%, HitCoverage=10%, E-value=2e-24, Identity=59%"; Hit description =Valyl trna synthetase protein 1 [Caenorhabditis elegans]
  Gene Ontology: Mol. function=valine-tRNA ligase activity; Cellular component=mitochondrion; Biological process=embryogenesis and morphogenesis
  Essential gene: C elegans homolog=ZC513.4; Phenotype=Emb,Lva
  Coding regions on vcDNA: vcDNA=SeqID_50289; Strand=+; Position=7-477
MKLLRLRSYLHFSCNLHVRNLTNLSKFGTYNEKAIQLIQQHYDEATSSSHQFVDSPSQEVFRMVLPPPNVTGNLHIGHAITVALEDAICRYQRLLGKKVRWTPGFDHAGMATEQVVQRQLAQRFGKQTDEMSQSEFVAHCEEWKEARIRDISGQLRS

SEQ ID NO: 123867 - protein, 169 aa, Heterodera glycines
  Homolog annotation: Hit_ID=NP_502290.1; Match level="QueryCoverage =100%, HitCoverage=76%, E-value=1e-84, Identity=87%"; Hit description= 3a splicing factor 6 (25.5 kD) (4M849) [Caenorhabditis elegans] emb|CAA92593.2| Hypothetical protein F11
  Gene Ontology: Mol. function=pre-mRNA splicing factor activity; Cellular component=small nuclear ribonucleoprotein complex; Biological process=mRNA splicing
  Essential gene: C elegans homolog=F11A10.2; Phenotype=Emb
  Coding regions on vcDNA: vcDNA=SeqID_50290; Strand=+; Position=2-508
MDFQNRAGGKTGGGGVASATDANVDRRERLRQLALETIDLQKDPYFMRNHLGGYECKLCLTLHNNEGSYLAHTQGKKHQANLARRAAKEASDVPYMPLPQQAKIEPKKFVKIGRPGYKVTKERDHASGQQALLFQIDYPEIADGVVPRHRFMSSYEQKIQPPDKRWQYL

SEQ ID NO: 123868 - protein, 220 aa, Heterodera glycines; identical to SEQ ID NO: 122603
  Homolog annotation: Hit_ID=XP_420553.1; Match level="QueryCoverage =94%, HitCoverage=50%, E-value=2e-31, Identity=38%"; Hit description =PREDICTED: similar to COP9 signalosome subunit 4; COP9 (constitutive photomorphogenic, Arabidopsis, homol
  Gene Ontology: Cellular component=signalosome complex; Biological process=photoreceptor differentiation (sensu Drosophila)
  Essential gene: C elegans homolog=Y55F3AM.15; Phenotype=Emb,Lva,Unc
  Coding regions on vcDNA: vcDNA=SeqID_50291; Strand=+; Position=40-699

SEQ ID NO: 123869 - protein, 64 aa, Heterodera glycines; identical to SEQ ID NO: 122450
  Homolog annotation: Hit_ID=NP_501634.1; Match level="QueryCoverage =100%, HitCoverage=100%, E-value=2e-19, Identity=75%"; Hit description=putative protein, with a coiled coil domain (6.9 kD) (4K83) [Caenorhabditis elegans] emb|CAA92514.1| Hy
  Essential gene: C elegans homolog=F49C12.11; Phenotype=Lva,Lvl,Unc
  Coding regions on vcDNA: vcDNA=SeqID_50292; Strand=+; Position=62-256

SEQ ID NO: 123870 - protein, 114 aa, Heterodera glycines
  misc_feature (108)..(108): Xaa can be any naturally occurring amino acid
  Homolog annotation: Hit_ID=AAC79129.1; Match level="QueryCoverage =95%, HitCoverage=33%, E-value=1e-52, Identity=91%"; Hit description =glyceraldehyde-3-phosphate-dehydrogenase [Globodera rostochiensis] sp|O16027|G3P1_GLORO Glyceraldehyde-3-p
  Gene Ontology: Mol. function=glyceraldehyde 3-phosphate dehydrogenase (phosphorylating) activity; Cellular component=cytoplasm; Biological process=glycolysis
  Essential gene: C elegans homolog=K10B3.7; Phenotype=Unclassified
  Coding regions on vcDNA: vcDNA=SeqID_50293; Strand=+; Position=109-643
EHSSHFQVYMFNYDSTHGRFKGKISTNAGNLVVEKEGKSAHTIKVFNLKDPAEIKWGEAGAEYVIESTGVFTTIEKASAHLKGGAKKVVISAPSADAPMYVMGVNEDXYDPAKD

SEQ ID NO: 123871 - protein, 434 aa, Heterodera glycines
  Homolog annotation: Hit_ID=CAE75362.1; Match level="QueryCoverage =98%, HitCoverage=98%, E-value=0.0, Identity=75%"; Hit description =Hypothetical protein CBG23346 [Caenorhabditis briggsae]
  Gene Ontology: Mol. function=ATPase activity; Cellular component =proteasome regulatory particle (sensu Eukarya); Biological process =proteolysis and peptidolysis
  Essential gene: C elegans homolog=C52E4.4; Phenotype=Emb
  Coding regions on vcDNA: vcDNA=SeqID_50294; Strand=+; Position=32-1336
MSSDIVEKKETNPNETDDKTKEIKSLDEDEIAALSNYNMGPYADQLKQAEKDIDEIQKRINTLCGVKESDTGLAPPILWDIAADKMAMSHEQPLQVARCTKIIKEEGKETRYMINVKQFAKFVVDLHENVAPTDIEEGMRVGVDRNKYQIHLPLPAKIDASVTMMQVEDKPDVTYADIGGCEEQIKKLREVVEFPLLQPERFTSLGIEPPKGVLFFGPPGTGKTLCARAVANRTDACFIRVIGSELVKKYVGEGARMVRELFSLAKTKKACILFFDEVDAIGGARFDDGKGGDNEVQRTMLELVNQLDGFDSRGAIKVLMATNRPDTLDPALIRPGRIDRRIEFSLPDVKARKNILQIHTKRMSIERNIRYELIARLCPNTTGADLRSVCTEAGMFALRARRKVITEQDFLKAVQKVVKGYAKFSSTPSYLTHN

SEQ ID NO: 123872 - protein, 125 aa, Heterodera glycines; identical to SEQ ID NO: 122706
  Homolog annotation: Hit_ID=CAE68925.1; Match level="QueryCoverage =100%, HitCoverage=99%, E-value=5e-42, Identity=68%"; Hit description= Hypothetical protein CBG14904 [Caenorhabditis briggsae]
  Gene Ontology: Mol. function=hydrogen-exporting ATPase activity, phosphorylative mechanism; Cellular component=integral to synaptic vesicle membrane; Biological process=hydrogen transport
  Essential gene: C elegans homolog=F46F11.5; Phenotype=Emb
  Coding regions on vcDNA: vcDNA=SeqID_50295; Strand=+; Position=98-475

SEQ ID NO: 123873 - protein, 170 aa, Heterodera glycines; identical to SEQ ID NO: 122406
  Homolog annotation: Hit_ID=NP_501688.1; Match level="QueryCoverage =77%, HitCoverage=87%, E-value=1e-38, Identity=58%"; Hit description =nadh dehydrogenase 1 alpha subcomplex 5 (17.3 kD) (4K286) [Caenorhabditis elegans] emb|CAA92789.1| Hypoth
  Gene Ontology: Mol. function=NADH dehydrogenase (ubiquinone) activity
  Essential gene: C elegans homolog=C33A12.1; Phenotype=Lva
  Coding regions on vcDNA: vcDNA=SeqID_50296; Strand=+; Position=20-532

SEQ ID NO: 123874 - protein, 177 aa, Heterodera glycines
  Homolog annotation: Hit_ID=NP_493021.1; Match level="QueryCoverage =96%, HitCoverage=59%, E-value=2e-47, Identity=55%"; Hit description =exonuclease (32.9 kD) (exo-3) [Caenorhabditis elegans] emb|CAB03235.1| Hypothetical protein R09B3.1 [Caen
  Essential gene: C elegans homolog=R09B3.1; Phenotype=Emb,Lva
  Coding regions on vcDNA: vcDNA=SeqID_50297; Strand=+; Position=75-605
MFEGPIKIWSWNVAGLRACVKKGGHKHIRESGADIVSLQETKCSEFPAEINALDEYPYKKLLMTNEKKGYAGVALLSKEKPIKVEEGMGDVDFDDHARYIQAEFAAFFLIAVYVPNAGQKLVNLQKRGRFDELLLNKLSALNERKAVIIAGDMNVAHQEIDLRNPETNRNKTAGFTD

SEQ ID NO: 123875 - protein, 187 aa, Heterodera glycines
  Homolog annotation: Hit_ID=CAE75189.1; Match level="QueryCoverage =100%, HitCoverage=65%, E-value=9e-79, Identity=73%"; Hit description= Hypothetical protein CBG23133 [Caenorhabditis briggsae]
  Essential gene: C elegans homolog=K10D6.2a; Phenotype=Emb
  Coding regions on vcDNA: vcDNA=SeqID_50298; Strand=+; Position=79-639
MPSTAIQKLLLAVSIFLIVAGIVLTVAGVFSPAWQVVDIREFRAEHQHGLWWDCIRAEKHVVAVGDFYEEAPLHCMYKFDESAALVIERALNHVDEDGAAGEAEHHRFWGWHKVVLSLILLSQLAAFVAVCTGVCAPYFAPSTFCFAISLFIAMLLSVLADGIFFFSANRVDIRFVTGMVGTYEQVI
